United States Patent 11,078,247 (RNA ENCODING A THERAPEUTIC PROTEIN) - sequence listing, part 39

SEQ ID NO: 65670 - RNA, 1617 nt, Artificial Sequence
  derived and/or modified sequence opt5 from AJUBA__Homo_sapiens__NP_116265
auggagagacugggcgaaaaggccagccggcuccuggagaaauucgggcgcagaaagggagaauccucucggagcggcuccgacgggacccccggaccuggcaaagggcgccuuucuggacugggcggcccgagaaagagcgggccccggggagcuacaggcgggccuggagaugagccccucgaaccugcccgcgagcagggcucccuggacgcggagagaaaccaacgggggucuuuugaagcuccccgcuacgaggggagcuucccugccggcccgcccccuacgagagcccuuccccugccucagucccucccgccggauuuucggcuggaaccuaccgcucccgcccugagcccucgcagcuccuucgcuucuucuuccgccagcgacgcgucuaaacccuccagccccagaggcucccuccugcuugauggggccggagcuggcggggccggaggcucucggccuugcagcaaucgcacauccgggaucagcaugggauaugaccagagacacggcucuccgcugcccgcuggcccuugucucuuugggcccccucuggccggagcgcccgccggcuacucccccgggggagugccuagcgcuuaucccgagcuucaugccgcucuggaucggcucuacgcccagagaccugccggcuucgggugccaagagucucgccacagcuaucccccugcucugggcucccccggagcgcuggccggcgcuggggucggagccgccggcccgcucgaacggagaggggcucagccuggacgccauucuguuaccggcuacggggacugugccgugggcgcgcgguaucaggaugagcugacagcccuucugagacucaccgugggaacaggcgggcgcgaagcuggagcccggggcgagcccagcgggauugaacccuccggacuggaggagccuccgggccccuuugucccugaagcugccagagcucgcaugcgggagcccgaagccagagaggacuacuucgggaccugcaucaaguguaacaagggcauuuacggacagagcaaugcgugccaagcccuugauucucuguaucacacgcaguguuuugugugcuguuccugcggccgcacccuccgguguaaggcuuucuacagcguuaacgggucuguguauugcgaagaggacuaccuguuuuccggauuccaggaggccgcugaaaaaugcugugucugcggccaucugauccucgagaaaauucugcaggccaugggaaagagcuaucacccuggauguuuuagaugcaucguguguaauaaaugccuugauggcauccccuucacaguugacuucuccaaccaaguguacugugucaccgacuaucacaagaauuacgcgccuaagugcgccgcuugugggcagcccauucugccgucugaaggcugcgaggauaucgugcgggugauuagcauggaccgcgauuaccauuuugaauguuaucacugcgaggacugcagaaugcagcucuccgaugaggaaggauguugcuguuucccucuggacggccaucuucugugccacgggugucacaugcaacggcucaacgccagacagcccccugcuaauuacaucuga

SEQ ID NO: 65671 - RNA, 585 nt, Artificial Sequence
  derived and/or modified sequence opt5 from AK1__Homo_sapiens__NP_000467
auggaggaaaagcugaaaaagaccaaaaucauuuucguggucggcgggcccggaagcggcaaggggacacagugcgagaaaaucguucaaaaguacggauauacgcaccucuccaccggcgaccugcuuagaucugaagugagcuccgggucugcccggggaaagaaacugagcgagauuauggaaaagggccagcucgugccucuggagacaguccuugauaugcugcgcgacgcuaugguggccaaaguuaacaccuccaagggcuuucucaucgauggguacccgagagaggugcagcagggagaagaguucgaacggcgcauuggccaacccacacugcugcucuaugucgacgcggggccugagaccaugacacagagacugcuuaaacggggagagaccucuggccgcguggaugacaaugaagagacgaucaagaagagacuggaaaccuacuauaaagcuacagagcccguuaucgccuuuuacgaaaagcgggggauugugcgcaaagucaacgccgagggaagcguggauuccguguucagccaggucuguacccaucucgacgcucugaaguga

SEQ ID NO: 65672 - RNA, 564 nt, Artificial Sequence
  derived and/or modified sequence opt5 from AK3__Homo_sapiens__NP_001186781
augggcgccagcgcuagacugcuccgggccgugaucaugggggcgcccggauccggcaaggggaccgucucuagccgcauuacaacgcacuucgagcugaaacaucuuuccucuggagaccugcucagagauaacaugcugcggggcaccggguuuccucgcacacuuccgcaggcugaagcccuggacagagccuaccaaaucgauaccguuauuaaucucaacgugcccuucgaggugaucaagcagcggcugacagcucgcuggauucacccugccagcggaagagucuauaauaucgaauuuaaucccccuaaaaccgugggcaucgacgaucugacaggcgagccccucauucagcgggaagacgauaagccugagaccguuaucaaacgccugaaggcuuacgaggaccagacgaagccggugcuugaauauuaccagaaaaaggggguccuggagaccuucuccggaacagaaaccaacaaaauuuggcccuauguguacgccuuucuccaaacaaagguuccucagagaucucagaaagcgagcgugacccccuga

SEQ ID NO: 65673 - RNA, 510 nt, Artificial Sequence
  derived and/or modified sequence opt5 from AK6__Homo_sapiens__NP_001015891
augugccacagaaagcccggcaccccuggggugggaaaaacaacgcugggcaaggagcucgccagcaaauccgggcugaaguacaucaacgucggagaccuugcucgggaggagcagcuguaugauggcuacgacgaagaguaugauuguccgauucucgacgaagaucgcguuguggacgagcuggauaaucaaaugagagaagggggagugaucgucgacuaccauggcugcgauuucuuucccgaacggugguuccacauuguguuuguucuucgcaccgacacaaacgugcuguaugagagacucgaaacccggggcuacaaugagaaaaagcugacagauaacauccagugugagauuuuccagguccuguaugaagaggccaccgcgucuuacaaggaagagaucgugcaucagcucccuagcaauaaacccgaggaacuggagaacaauguugaccaaauccuuaaguggauugaacaguggaucaaagaucacaacuccuga

SEQ ID NO: 65674 - RNA, 2172 nt, Artificial Sequence
  derived and/or modified sequence opt5 from AK7__Homo_sapiens__NP_689540
auggccgaggaagaggaaaccgcugcccugacagagaaggugaucagaacgcagcgggucuucauuaaccuccuggacagcuacuccucuggcaauaucgggaaauuucuuagcaacugcguugugggagcgucccuggaagagauuaccgaggaagaggaagaggaggaugaaaauaagucugcuaugcucgaggccagcuccacaaaagugaaggaaggcaccuuccaaaucgucgggacacugucuaaacccgacagcccucgcccggauuuugccguggagaccuauuccgcuauuagcagagaagaccuucugaugcggcuccuggagugugauguuaucaucuacaacauuacagagucuucccagcagauggaagaggccaucugggcugugagcgcccugucugaagaggucucccacuucgaaaagcgcaagcucuuuauucugcuuagcaccgugaugacgugggcgagaucuaaagcccuggaccccgaggauuccgagguuccuuucaccgaagaggacuaucggcgcagaaagagccaucccaauuuucucgaucacaucaacgcugagaaaauggugcugaaguucggaaagaaggcccggaaguuugcugccuacgucguggcggccggccuucaguauggggcugagggaggcaugcugcauacauucuuuaaaauggccuggcucggcgaaauuccugcucugcccguguucggggacggaaccaaugucaucccuacaauucacguucuggaucucgccggcgugauccaaaacgugaucgaccaugucccgaagccccacuaccugguggccguugaugaguccgugcacacccuugaggacauugucaaaugcaucucuaagaauacggggccuggaaaaauucagaagaucccccgcgaaaacgcuuaucugacaaaagaccucacccaggauugucuggaccaucuucuggugaaucucagaauggaggcgcuguuuguuaaggaaaacuucaauauucggugggccgcucagacaggcuucguggagaacaucaauaccauccugaaggaguacaaacaaagccgcgggcucaugccuauuaagaucugcauucugggacccccggccgucggcaaauccagcaucgccaaggaacuugcuaacuacuauaaacugcaccauauucagcucaaggaugugaucucugaggccaucgcgaagcuggaagcuauugucgccccuaacgacgugggcgagggggaagaggagguugaagaggaagaggaagaggagaauguggaagaugcccaggagcuucuggacggaaucaaagaauccauggagcagaacgcuggccaacucgaugaccaguacauuaucagauuuaugaaggaaaaacugaaaagcaugcccugucggaaucagggguauauucuggauggauucccuaaaaccuacgaccaagccaaggaucucuuuaaccaggaggacgaggaagaggaagacgauguccgcggcagaauguuccccuuugacaagcugaucauucccgaguucgugugcgcucuugaugccucugacgaguuucugaaagaacggguuaucaaucucccugagagcaucguggcggggacacacuauucccaggauagauuccugcgcgcccugucuaacuaccgggacauuaauaucgaugacgaaacggucuuuaacuauuucgaugagcuugaaauucacccgauccauauugacgugggaaagcucgaggaugcucagaauagacuggccaucaaacaacugaucaaggagauuggcgaaccccgcaacuacggccucaccgacgaggaaaaagcugaggaagaacggaaggccgcggaggaaagacuggcccgcgaggcugccgaagaggcugaacgggagcaccaggaggccguggaaauggccgagaagaucgcuagaugggaagaguggaauaaacgccuugaggaaguuaagcgggaggaaagagagcugcucgaagcgcagagcauuccucugcgcaacuaccugaugacauaugucaugcccacccuuauccaggggcucaaugaguguugcaacgugcggccugaggaucccguggacuuucuggccgaauaccuguucaaaaauaacccggaggcucaauga

SEQ ID NO: 65675 - RNA, 1440 nt, Artificial Sequence
  derived and/or modified sequence opt5 from AK8__Homo_sapiens__NP_689785
auggacgccaccaucgcuccccaccggauuccuccggagaugccccaguacggcgaagagaaccauaucuucgaacugaugcaaaauaugcucgagcagcugcuuauucaccagccugaagaucccaucccuuuuaugauucagcaucugcaccgggacaacgauaaugugccccgcaucgucauccucgggccuccggccagcggaaagacaacgauugcgauguggcugugcaaacaucuuaacuccucucugcucacccuggagaaucugauccucaacgaguucagcuauacagcuaccgaagccagacggcuguaccuucaacgcaagacaguucccuccgcccugcucgugcagcugauucaggagagacuugcugaagaggacuguaucaaacagggcuggauucuggaugggaucccugagacccgggaacaagcccuccgcauucagacacugggaaucacccccagacacgugaucguccugucugcuccugacacggugcucauugagcggaaucugggcaagcgcaucgauccccagaccggggaaauuuaucacacaaccuuugacuggccgccugagagcgaaauccagaacagacuuaugguucccgaggauauuuccgagcuggaaacagcccaaaaacuccuggaguaccaucggaauaucgugcgcgucaucccuucuuaucccaagauucuuaaggugaucagcgcggaccagcccugcguugauguguucuaccaggcccugaccuauguccaauccaaccacagaacgaaugcuccuuuuacaccgcgggugcuccugcugggacccgugggcagcggcaaaucucuccaggccgcucugcuugcccagaaguaccgccuggucaacguuuguugcgggcagcuccugaaagaagcgguggccgacagaaccacauucggagagcuuauucaacccuuuuucgaaaaggagauggcugugccugauucccugcucaugaaaguccugagccagcggcuggaccagcaggacuguauccaaaagggcugggugcuccaugggguuccuagagaucuggaccaggcccaccuucugaaucgccucggauacaaccccaaucggguguuuuuccugaacgucccguuugauucuauuauggagagacugacccuucgccggaucgacccugugaccggcgaaagauaucaccucauguacaagcccccucccacaauggagauccaggcucgccugcugcagaacccuaaagaugccgaggaacaaguuaagcucaaaauggaccuguucuauagaaauuccgccgaucuugaacagcuguacgggagcgcuauuacgcucaacggagaccaggaucccuauaccguguuugaguacaucgagucuggcauuaucaauccgcugccuaagaaaauucccuga

SEQ ID NO: 65676 - RNA, 1266 nt, Artificial Sequence
  derived and/or modified sequence opt5 from AK9__Homo_sapiens__NP_659462
augaccagccaggagaagacagaagaguaccccuucgccgacaucuuugaugaagacgagacggaaagaaacuuccugcucuccaaaccugugugcuuugucguuuucggcaagccgggggugggaaaaaccacacuggcucgguauauuacccaagccuggaaguguauccgcguggaggcgcuucccauucuggaggaacagaucgcugccgagacagaaucuggcgucaugcuccagagcaugcugauuuccgggcagucuaucccugaugagcuugugaucaaacugaugcucgagaagcugaauagccccgaaguuugccacuuuggauacauuaucaccgagauuccuucccugucucaagacgccaugacaacccuccagcagaucgaacugauuaagaaccuuaaucugaaacccgaugugaucauuaacaucaaguguccugacuaugaucucugccagagaaucagcggccaacggcagcauaauaacacgggguacauuuauucccgcgaccagugggauccggaggucaucgaaaaucaccggaaaaagaaaaaggaggcucagaaggacggaaaaggcgaggaagaggaagaggaagaggagcaagaagaggaagaggccuucauugcugaaaugcagaugguggccgagauccugcaucaccuuguucagagacccgaggauuaccuggaaaacguggagaauauugucaagcucuauaaagaaaccauccugcaaacacuggaggaggugauggcggaacauaacccucaguaccucaucgagcugaauggcaacaagcccgccgaggagcuuuuuaugauugugauggaccgccugaaauaccucaaucugaagagagcugccauccuuaccaaacugcagggggcugaagaggagauuaacgauacaauggaaaaugacgaacucuuccggacccuggccagcuauaagcugaucgcgccucgcuacagauggcagcggucuaaguggggacgcacgugucccgucaaccucaaagacggcaacauuuauuccgggcugccggauuacagcguuucuuuucuuggaaagaucuauugccuguccagcgaagaggcccucaaaccuuuccugcuuaaucccagaccuuaccugcucccucccaugcccggcccgcccuguaagguguuuauccuggggccucaauauucuggaaaaacaacccugugcaacaugcucgcugaaaauuacaagggcaaggugacaaacuga

SEQ ID NO: 65677 - RNA, 1989 nt, Artificial Sequence
  derived and/or modified sequence opt5 from AKAP10__Homo_sapiens__NP_009133
augagaggcgccgggcccagcccucggcaguccccgcgcacccugagacccgacccuggacccgcuaugucuuucuuucggcgcaaggugaaaggcaaggagcaagagaaaacaagcgaugucaaguccaucaaagccucuauuagcguucacuccccucagaagucuacgaagaaccaugcgcuccuggaggcugccgggcccagccacguggccaucaaugcuauuuccgccaacauggacagcuucucuuccagcagaaccgcuacacuuaaaaagcagccuucucauauggaagccgcgcacuuuggagaucugggccgguccugccucgacuaccagacccaagagacaaaaagcucucuguccaagacccuugaacaggugcugcaugauacaaucguccucccguauuucauucaguuuauggagcugcgcagaauggagcaccuggugaaauucuggcucgaagccgagagcuuucacuccaccacguggucucggauccgcgcucauagccugaauaccguuaagcaguccagccuugccgaacccgugucuccuuccaagaaacacgagacaaccgcuagcuuccugacagacucucucgauaagagacuggaggacagcggguccgcccaacuuuuuaugacccauucugaaggaaucgaucugaacaaucggacgaacagcacacagaaucaccuccugcugucccaggagugugacagcgcgcacucucuccgccuggaaauggccagagcuggcacccaucaggucuccauggagacacaagaaucuagcuccacccuuaccguggccagccggaacucccccgcuucuccucugaaagagcucagcggcaagcugaugaaauccauugagcaggaugccguuaauacauucacgaaguacaucucucccgacgccgcuaaaccgauuccuaucaccgaagcgaugcgcaacgauauuaucgccagaauuugcggggaggacggacagguggaccccaauuguuuuguccuugcucaaagcaucguguucuccgccauggaacaggagcacuuuagcgaguuccugcggucucaucacuucugcaaguaucagaucgaggugcucacauccggcaccgucuaccuggccgauauucuguuuugugagagcgcucucuucuauuuuucugaauacauggagaaggaagacgccguuaacauccugcaguucuggcuugcggcugauaauuuucaaucccagcuggccgccaaaaaggggcaguaugacggacaggaggcucaaaacgaugccaugauucucuacgacaaauacuucagccugcaggcuacacauccucuuggcuuugaugacguggugagacuggaaaucgagucuaauauuugccgcgaagggggaccccuccccaacuguuucaccacgccucugcggcaggccuggacaaccauggaaaaggucuuucugccgggcuuccucagcuccaaccuguauuacaaauaucuuaaugaucugauccacagcgugagaggcgacgaguuucucgggggaaacguuucucugaccgcgcccggcuccguggggccucccgaugaaagccacccuggauccucugacagcuccgccucucagagcuccgucaagaaggcuucuaucaaaauucugaagaauuucgacgaggccaucauuguggaugcugccagccuugaccccgagucccucuaccaacgcacauaugcgggcaaaaugaccuuugggcggguuagcgaucugggacaguucaucagagaaucugagccggaaccugacgugcgcaaguccaaaggcagcauguucucucaggccaugaagaaguggguccagggcaacacagaugaggcucaagaagaacuggccuggaaaauugcuaagaugaucguguccgacaucaugcagcaggcccaauacgaucagccccucgagaaaagcacgaagcuguga

SEQ ID NO: 65678 - RNA, 5349 nt, Artificial Sequence
  derived and/or modified sequence opt5 from AKAP12__Homo_sapiens__NP_005091
augggcgccggguccuccaccgagcagagaucucccgaacaaccuccggagggaagcuccacacccgcugaaccugagcccucuggcgggggaccuagcgccgaagccgcucccgacacgaccgccgauccugccaucgcugccuccgacccggcuacaaagcugcuccagaaaaacggccagcugucuaccaucaaugggguggccgagcaggaugagcuuagccugcaagaaggagaccucaacggccagaagggcgcgcugaaugggcagggagcccuuaacucccaggaggaagaggaggucaucguuacagaagugggccaacgggauagcgaggacgugucuaaacgcgauuccgacaaggaaauggcuaccaaaagcgccgucgugcacgauauuacagacgaugggcaggaggaaacccccgagaucauugagcagaucccuucuuccgaaagcaaucuggaggaacucacgcagcccaccgagucucaagcuaacgacaucggauucaagaagguuuuuaaauucgugggcuuuaaguucacagucaaaaaggauaaaaccgaaaagccugacacagugcagcugcugaccguuaagaaagacgagggggagggagccgcgggcgccggcgaucauaaggaccccucccucggggcuggagaagccgcuagcaaagaguccgaaccgaagcagucuacggagaaaccugaagagacacugaagagagagcaaagccacgccgaaauuagcccgccugccgagagcggccaggcuguggaagagugcaaagaggaaggggaggaaaagcaggagaaggaacccucuaaauccgcggagagccccaccucuccugucacaagcgagaccggauccaccuuuaagaaauucuuuacacagggcugggccggguggcggaagaaaacgucuuuccgcaagccgaaggaagaugagguggaagcuagcgagaaaaagaaagaacaagagcccgagaagguggacaccgaagaggauggaaaagccgaagucgccuccgagaaacuuacagcuagcgaacaggcccauccucaggagcccgcggagucugcucacgaaccuagacuguccgccgaguacgaaaagguugagcuccccagcgaggaacaggugucuggcucccaaggcccgagcgaggaaaaaccugcgccccuggcuaccgagguguuugacgaaaagaucgagguccaucaggaggaagugguugccgaggugcacgucuccacaguggaggaacggaccgaagaacagaaaacggagguugaagagacagcugggucugugccugccgaagaacuugucgaaauggaugcggagccccaggaggccgaaccugcuaaggagcuggugaaacucaaggaaaccugugucagcggagaggaccccacccaaggcgccgaucuguccccggacgagaaggugcugucuaaaccucccgaagggguugugagcgaggucgaaaugcucuccagccaggagcgcaugaaggugcagggaucuccccugaagaaacuuuucacauccaccggccugaagaaacucagcgggaagaaacagaaaggcaaaagaggaggcggggaugaagagucuggagagcacacacaaguuccugcugacuccccggacagccaggaagaacagaagggcgaaucuagcgccuccagccccgaggaaccugaggagauuacgugccuggaaaaagggcuugcggaggugcaacaggauggagaagccgaggaaggcgcuaccucugacggggagaagaaacgggagggcgucacacccugggccuccuuuaagaagauggugaccccuaaaaagcgcgugagacggcccagcgaauccgauaaagaggacgaacuggauaagguuaaaucugcuacacucagcuccaccgagucuacggccagcgagaugcaggaagagaugaagggauccgucgaggaaccuaagcccgaggaaccgaaacgcaagguggacaccucugugagcugggaggcccugaucugugucggcuccagcaaaaagagagcucggcgcgggucuuccagcgaugaagagggaggcccuaaagcgaugggaggggaccaucagaaggccgaugaagcuggcaaggacaaagagacagggaccgauggcauucuggccggaucucaagaacacgaccccggccagggguccagcucuccugagcaggccggaucccccacagagggcgaaggggugagcaccugggaguccuucaagagacucguuacgccgcggaaaaagagcaaaucuaagcuggaagagaaaagcgaagauuccaucgcuggaucuggcguggagcauagcacaccugacaccgagcccgggaaggaagaguccugggucucuauuaagaaauuuaucccuggcagacgcaagaaacggcccgacggaaagcaggaacaagcccccguggaggaugcgggcccuacaggggcuaaugaggacgauagcgacguuccggccguggucccccuuuccgaauaugaugccguggagagagagaagauggaggcucagcaggcccagaagucugcggaacaaccugagcagaaggcugccaccgagguuagcaaagaacuguccgagagccaggugcacaugauggccgcugccgucgcugacggaacccgcgccgcgacaaucauugaggaacggucucccuccuggaucagcgccucugugacggaaccucucgagcaaguggaggcugaagccgcucugcuuaccgaggaaguccuggagagagaaguuauugccgaggaggaacccccuacagugaccgagccgcuccccgaaaaccgcgaggcccggggcgauacaguggucuccgaggcugaacugaccccugaggcggugacggccgcugaaacagccgggccccugggagccgaggaaggcaccgaggcuagcgccgcggaggaaaccacagagaugguuuccgcugugucucagcucaccgacagcccugauacaacggaagaggccacccccguccaggaaguggagggcgggguuccggacaucgaggaacaggagagacgcacacaagaagugcugcaggccgucgcugagaaggugaaagaagagucccagcuuccuggaaccggcgggcccgaggauguucugcagcccgugcaacgggccgaagcggagagaccugaggaacaggcugaggccagcggacucaagaaagaaacagacgucgugcugaagguggaugcccaggaggcuaagaccgaacccuucacgcagggcaaagucguugggcaaaccacaccugagucuuucgaaaaggcuccccaggugaccgaguccauugagagcucugaacuggugacaaccugccaggccgagacacuugccggagucaaaagccaggaaauggugauggagcaagcgauucccccugacuccguugaaacccccacggacucugagacagauggcagcaccccuguggccgacuuugaugcucccggcaccacacagaaggacgagaucgucgaaauucacgaggaaaaugagguggccuccgggacccagucuggaggcacggaagcugaggccguuccggcccaaaaagagcgcccucccgcuccuagcuccuucguguuucaggaagagacaaaggaacagagcaagauggaggauacccucgagcauacagacaaagaagucucuguggagaccgucuccauccugagcaagacagaagggacccaggaggcggaucaauacgccgacgagaaaacgaaggaugugcccuucuuugaaggacuggagggcuccauugacaccgggaucacaguuucucgggaaaaagugaccgaggucgcucucaagggagaaggcacagaggaagccgaguguaagaaagaugacgcccuggagcuucagagccacgcuaaguccccucccucuccgguggaaagagagaugguugugcaggucgaacgggagaaaaccgaagccgagccuacgcaugugaacgaggaaaagcuggagcacgaaacagcggugaccguuagcgaggaggucuccaaacagcuccugcaaacagugaaugugcccauuaucgacggcgcuaaggaagucagcucucuggaggggucucccccuccgugccuuggacaggaagaggccguguguaccaaaauccagguucagagcagcgaagccuccuucacccucacagcugccgcggaggaggaaaaggugcugggcgagacggccaacauucuggaaaccggggagacacucgaacccgcuggagcccaucugguccuugaggaaaagagcucugagaagaaugaggauuuugcugcccacccuggcgaagacgcugugcccaccgggccugauugccaagccaagagcacacccguuaucguguccgcgaccacgaaaaagggacugucuagcgaccucgagggcgagaaaaccaccucccugaaguggaaguccgaugaggucgacgaacagguggccugucaggaaguuaaaguguccgucgcuauugaggaucuggaaccugagaacggcauccuugagcucgaaaccaagucuagcaaacuggugcaaaauauuauccagacagccguggaccaguucguccgcaccgaggaaacagcuacggagaugcugaccuccgaacuccagacacaagcccacguuauuaaggccgauucucaggacgcugggcaggagaccgagaaagaaggagaggaaccgcaggcgagcgcccaagaugagacacccaucaccuccgcuaaggaagagucugagagcacggccgugggccaggcccauuccgacaucagcaaggauaugucugaggcuuccgagaaaaccaugacaguggaagucgaggggagcaccgugaacgaccagcagcuggaagagguugugcuuccuucugaggaagagggaggcggggccggaacaaaguccguccccgaagacgauggccacgcgcugcucgccgagagaauugagaaaagccugguggaaccuaaggaggacgaaaaaggcgaugacguugaugaccccgagaaccaaaauucugcucuggccgauaccgacgcuuccgggggacuuacaaaggaaagcccggauacgaacggcccuaagcagaaagagaaggaggacgcccaggaaguggagcuccaggaagggaaaguccauuccgagagcgauaaggcgaucacaccccaagcccaggaggagcugcagaaacaagagcgggaaucugcuaagagcgagcugacagaauccuga

SEQ ID NO: 65679 - RNA, 4305 nt, Artificial Sequence
  derived and/or modified sequence opt5 from AKAP13__Homo_sapiens__NP_001257475
auguacgagagacacaagcggcgcuauagccugugcgacaucuccaaaguggauagaaccgucgacguugugcuccugaagauuaaccgggaaaauugguguacaaucgagcccugcccugaugccgcuucucuucuggccagcaaacaguccccggaaugugagaacuuccucgacgugggccuggggcgcgaaugcacgucuaagcaaggaguccuuaaaagagagagcggcuccgauucugaccuguuucauagccccuccgaugacauggauagcauuaucuucccuaagcccgaggaagaacaccucgcgugugacauuaccgggucuuccagcucuacagaugacaccgcuucccuggaucggcauagcucucacggauccgacgugagccugucccagauccucaagccuaaucgcucuagagaccggcagagccuggauggcuuuuacucccaugggaugggagccgaaggccgcgagagcgagucugaacccgccgacccuggcgauguugaggaagaggaaauggacuccaucacagaggugccggcuaacugcagcguccuuagaucuagcaugcggucccugucucccuuccgcagacacagcugggggccugggaaaaaugccgcuuccgaugccgagaugaaccaccggagcuuuucucucgaaggccugaccgggggagcgggcguggggaauaagcccuccagcucucuugagguuuccagcgccaacgcugaggagcugcgccauccuuucuccggagaagagagaguggacucucucgucagccuguccgaggaagaucuggagucugaccagcgggaacacagaauguuugaucaacagauuugucaucgcagcaaacagcagggcuucaauuauugcacauccgccaucagcucuccccucaccaaguccauuagccugaugacgaucucucacccgggccuugacaacucccggccuuuucacagcaccuuccauaauacaucugcuaaccugaccgagagcauuacagaagagaauuacaacuuucucccccacuccccuagcaaaaaggauucugaguggaaguccgggaccaaagugagcagaacguucuccuauaucaagaauaaaaugucuagcuccaagaaaucuaaggaaaaagagaaggaaaaggacaaaauuaaggagaaagagaaggacagcaaagauaaggaaaaggacaaaaagacagugaacggacauaccuuuuccucuauccccgucguuggccccaucagcuguucccaaugcaugaaaccuuucacaaacaaggaugccuacaccugugcgaauugcagcgccuucgugcacaaagggugccgcgagucucuggcuuccugugccaaggugaagaugaaaccgaagggaagccuucaggcucaugacaccucuucccugcccacagucauuaugcggaacaaaccuagccagcccaaggaaagaccucgcucugccgugcuccugguugaugagacggccaccacacccaucuuugcuaaucggagaucccagcaaagcgugucccugagcaaaucugucagcauucagaacaucaccggcguggggaaugacgaaaacauguccaauacauggaaguuccucucucacagcaccgauucccugaacaagauuucuaaaguuaaugagagcacggagucccuuacagacgaaggagugggcaccgauaugaacgagggccagcugcucggggacuuugaaaucgagucuaagcaacuggaagcggagagcuggucccgcaucauugauagcaaauuccuuaagcagcagaaaaaggacgucgugaaacggcaggaggucaucuaugaacugaugcaaaccgaguuucaccaugugagaacacucaagauuaugucuggaguuuacucccagggcaugauggccgaucugcuguucgaacagcagaugguggagaagcucuuuccgugccuggacgaacuuaucagcauucacucucaauucuuucagcgcauccuggagcggaaaaaggagucccucgucgacaaaagcgaaaagaauuuccugaucaaaagaauuggggaugugcugguuaaccaguuuuccggagagaaugcugaacggcuuaagaagaccuacggcaaauucugugggcagcauaaccaaucugugaauuauuuuaaggaccucuacgccaaagauaagcgcuuccaggccuucgucaaaaagaagaugagcuccagcguggugagacggcugggcaucccugagugcauucugcucguuacacagagaaucacgaaauaucccguccuguuucagcgcauucuucaauguaccaaggacaacgagguggaacaggaggaucuggcucagucucucucccuggugaaagacgucaucggagccguggauagcaagguugcgucuuacgaaaagaaggugcggcugaacgagauuuauacaaagaccgacagcaaauccaucaugagaaugaagucuggccaaauguucgcuaaagaagaucuuaagcgcaaaaagcucgucagagacgggagcguguuucugaaaaaugccgccggacggcugaaggagguucaggcugugcuccugacagauauccuugucuuccugcaggagaaggaccagaaauacauuuuugccucccucgaucaaaagucuaccgugaucagccugaaaaagcugauuguucgcgaaguggcucacgaggaaaaaggccuuuuccucaucuccauggggaugacggacccugagauggucgaagugcacgccagcucuaaggaggagagaaacuccuggauucagaucauccaggacaccauuaauacacugaaccgggaugaagacgagggaauccccagcgaaaaugaggaagagaagaaaaugcuggauacccgcgcgagagagcucaaggaacagcugcaucaaaaagaccagaagauucuucugcuccuggaggaaaaagagaugaucuuucgggauauggccgagugcuccacaccucugcccgaagacuguucuccgacccacagcccucgcgugcuuuucagauccaacacggaggaagcucucaagggcgggccccugaugaagucugccauuaaugaggucgaaauccugcagggccucguuagcggaaaccugggcgggacacuuggacccaccguguccagcccuaucgagcaggauguggucggcccggugucucugccccggcgcgcugagacauuugggggauucgacucccaucaaaugaaugccagcaaaggcggggaaaaggaggaaggcgaugacggacaggaucucagacggaccgagucugacuccggccugaaaaagggaggaaacgcgaaucugguuuuuaugcuuaaaagaaacagcgaacaggugguccaaucugugguucaccuguaugagcuccugagcgcccuccagggcgugguccugcagcaggacuccuacauugaggaucaaaaacuugugcugucugaacgcgcucucacccggagccuguccagaccuagcucccugaucgagcaggaaaagcagcgcucucuugagaaacagcggcaagaccuggccaaucuccagaagcagcaggcucaauaccuggaagagaaaagacgccgggagagagaaugggaggcccgcgaacgggagcucagagagcgggaagcccugcuugcucagcgcgaggaagagguucagcaggggcaacaggaucuggaaaaggagagagaggaacuccagcagaaaaagggaacauaucaauacgaccuggagcggcugcgcgcggcccagaagcagcuugaaagagagcaagaacagcugcggagagaggcugagcgccucagccagcggcagacggaaagagaucugugccaagugucccauccccacaccaaacucaugcgcauuccuucuuucuuucccagcccugaggaacccccguccccuucugcccccagcaucgccaaguccggcagccuggacucugagcuuuccgucagcccuaaacggaacucuauuuccagaacacacaaggauaaagggcccuuccauauccugagcucuaccucccagacaaauaagggcccggaaggacagagccaggcuccugccuccaccagcgcgucuacgcgccuguucggccucacaaaacccaaggagaagaaagagaagaaaaagaaaaacaagaccagccggucccaaccuggggacggacccgcuucugaagugagcgccgagggcgaagagaucuuuuguuga

SEQ ID NO: 65680 - RNA, 2088 nt, Artificial Sequence
  derived and/or modified sequence opt5 from AKAP17A__Homo_sapiens__NP_005079
auggccgcugccaccaucgugcacgacacaagcgaggcggucgaacugugccccgcuuacggccucuaucugaagccuauuacgaaaaugaccaucuccguugcccuuccgcagcugaagcaacccgggaaaucuauuagcaacugggaggugauggaaagacucaagggaauggugcagaaucaucaguucuccacacugcggaucucuaaaagcaccauggauuuuauucgcuucgagggcgaagucgagaacaagucccuugugaagucuuuucuggccugucucgacgggaaaacaaucaagcugagcggauucuccgauauccugaaaguuagagcugccgaguuuaagauugacuucccuacccggcacgauugggacagcuuuuuccgcgaugcuaaagacaugaaugaaacacuccccggcgagagaccugauaccauccaucuggaagggcuucccugcaagugguuugcccugaaggagucuggauccgagaaaccuagcgaagacgugcucgucaagguguucgagaaauuuggcgaaauucggaacguugauaucccgaugcuggaccccuaccgcgaggaaaugacgggcagaaauuuccacaccuuuucuuucgggggacaucuuaacuucgaggcguaugugcaguaccgggaguauaugggcuuuauucaagccauguccgcucugcgcgggaugaagcucauguacaaaggagaagauggcaaggccgucgcuuguaauaucaaagugagcuucgacucuacaaagcaccuguccgacgccagcauuaagaaaagacagcuggagcggcagaagcuccaggaacuggagcaacagcgcgaggaacagaaaagacgggagaaggaagcggaggaacgccagagagccgaggaacggaaacaaaaggagcuugaggaacuggagagagaacgcaagcgggaggagaaacucagaaagcgcgaacagaaacagcgggauagagagcugcgccggaaccaaaagaaacuugaaaagcugcaggcugaggaacagaagcagcuccaagagaaaaucaagcuggaggaaagaaaacugcuccuggcccagcgcaaucuucaguccauccggcugauugcugagcuccugucuagagccaaggccgugaaacuucgcgaacaggagcaaaaggaagagaagcugcggcuccagcagcaggaggaaagacggcgccugcaagaggcugaacugagacgggucgaggaagagaaagagagagcgcucgggcugcagcgcaaggaacgggagcuuagagaacgccugcucagcauccugcuguccaaaaagccugacgauagccacacccaugacgagcuuggaguugcccacgcugaucuccugcagcccgugcuggacauucuccagacagugucuuccggcugcgucagcgccaccacgcugcauccucuuggcgggcaacccccggccggagcuccuaaagagucucccgcccacccugaagcggauggcgcucccaagagcgugaacggguccguugccgaggaagcccccuguaaagaggugcagucuagcugcagagucgugccugaagacggauccccggagaagcggugucccggcgggguucugagcugcaucccugauaauaaccagcaacccaagggcauuccugcuugugagcagaaugugucucgcaaagacacaagauccgaacaggauaagugcaaccgggagcccagcaaaggacgcggcagagccaccggggacggacucgcugaccggcacaagcgcgaaagaucucgggcccgcagagcguccagccgggaggauggcagaccgcgcaaagaacggagaccucauaagaagcacgccuauaaagacgauucuccccgccggagauccacaagcccugaccauacccgcucccggagaucucacagcaaggaucgccaucggagagagcggucccgcgagagacgggggagcgcuucucgcaaacacuccagacaccggagacgcagcgaacggucuagaucccgcagccccucucggcauagaagcaccuggaaucgcuga

SEQ ID NO: 65681 - RNA, 2712 nt, Artificial Sequence
  derived and/or modified sequence opt5 from AKAP1__Homo_sapiens__NP_003479
auggccauccaguucagaagccuguuuccccucgcucugccuggcaugcuugcccugcucgggugguggugguucuuuucccggaagaaaggacacgugucuagccaugacgagcaacaggucgaagcgggcgcuguucagcugcgcgccgauccggccauuaaggagccccuuccuguggaagacgugugccccaaagucguguccaccccucccucuguuacagagccuccggaaaaggagcugagcacgguguccaaacuccccgcugagccucccgcccugcugcagacccacccucccuguagacggucugaaagcuccgggauccucccgaacacaaccgauaugcgccugagaccuggaacacggcgcgacgauagcaccaaacuugagcuggcucucacaggcggggaagccaagucuauuccccuggagugcccucuuuccagccccaagggaguccuguucucuuccaagagcgcggagguguguaaacaagacucucccuuuuccagaguuccucggaaggugcagccgggcuaccccgucgugccugccgaaaaacgcagcuccggcgagagagcucgggaaaccgggggagccgagggcacgggggaugcugugcucggagaaaagguccuggaggaggcccugcucucucgcgaacauguucuggagcuugaaaauagcaagggccccucccuggcgagccucgagggggaagaggacaaaggaaagucuuccagcucucagguggugggcccuguccaggaggaagaguauguggccgaaaaacugcccagcagauucaucgaguccgcucacaccgaacuugccaaggaugacgcugccccggccccucccguugcugaugcgaaagcccaagaccggggcguggagggggagcugggaaacgaagagucucucgaucgcaaugaagagggccuggacagaaacgaggaagggcuggaccggaaugaggaaagccucgauagaaacgaggaaggacuggaccgcaaugaggagauuaagcgggcugccuuucagaucaucucccaggucauuagcgaagccacagaacaggugcuugcuaccacaguuggcaaaguggccgggagagucugccaagcgucucagcugcagggacaaaaggaagaguccugugugccuguccaucagaagaccgugcucggccccgauacggcugaaccugccacagccgaggcugccguugcucccccggacgccggccugccucuucccgggcugcccgcggagggaagcccuccgcccaaaaccuacgugucuugccucaagucccugcugagcuccccuacaaaagauucuaagcccaacaucagcgcccaccacauuucccucgcuucuugucuggcccuuaccaccccuagcgaggagcugcccgaccgcgcuggcauccucgucgaagaugccacaugcgugacguguauguccgacagcucucaguccguuccucugguggcgagccccgggcauugcucugauuccuucagcaccucuggacuggaggacagcuguacagaaaccuccagcucuccgcgggauaaagccauuacaccuccccuuccugaguccaccguccccuuuagcaauggcgugcucaagggggagcuguccgaccugggcgcugaagacggauggacgauggaugccgaggcugaccacucuggcgggagcgauagaaacuccauggacucuguggauagcugcugcucccucaagaaaacagaaucuuuccagaaugcccaagccggaagcaacccgaagaaaguugaccugaucauuugggagaucgaggucccuaagcaucuugugggccgccugaucgggaaacagggacgguauguguccuuucucaagcagaccagcggcgcuaagauuuacaucucuacccugcccuauacacaguccguccaaauuugucacaucgaagggagccagcaccauguggauaaagcgcugaaucuuauuggcaagaaauucaaggagcucaaccugaccaauaucuacgccccuccccugcccucucucgcucugccuucccuuccgaugacaagcuggcugaugcuccccgacggaaucacgguugaagugauugucgugaaccagguuaacgccggccaccuguuugugcagcaacauacccacccuacauuccaugcccugagaucucuugaucagcagauguaucucugcuacucccagcccgggaucccuacccugcccacaccugucgagauuaccgugaucugugcugccccgggagcggacggcgcuugguggcgcgcccaaguuguggccagcuacgaagagacgaaugaggucgaaauucgguauguggauuacgggggauauaaaagagugaaggucgacguucugcgccagauccgguccgauuucgugacccuccccuuucagggcgcugaggugcugcuugacagcgucaugccucugucugacgaugaccaauucagccccgaagccgaugcggcuauguccgagaugacagggaacaccgcccuccuggcccaggugacaucuuacagcccuaccggccugccccuuauccagcucugguccguugugggagacgaagucgugcugauuaauagaucucugguugagcggggccucgcucaguggguggauagcuauuacacgucccuguga

SEQ ID NO: 65682 - RNA, 2847 nt, Artificial Sequence
  derived and/or modified sequence opt5 from AKAP2__Homo_sapiens__NP_001004065
augagauggccccagccuggcgccgcugcccggcugccgcccgagagcccugggcccccugaaucccccggaccuccggagcgcgaagcggcugccgccagacgguggaccggcgcugagccccaagacugcgccccugggucuggacgccccgaaaagccuccccagcucagcgaggaugacaucuggcugaaauccgagggcgauaacuacucugcuacacuucuggaaccggccgcgagcucccucucuccugaccacaagaauauggagauugaagugagcgucgccgaguguaaauccguucccgggaucacgagcaccccucaucccauggaucaccccucugcuuucuauuccccuccgcauaacggacugcuuacagaccaccaugagagccuggauaaugacguggccagagaaauucgguaccucgaugaggugcuggaagcuaacugcugugacucugccgucgauggcaccuauaauggcacauccagccccgagccuggggcggugguucuggugggaggccucucucccccuguccacgaagccacccagcccgagccgacagagcgcaccgcuuccagacaggccccuccccacaucgaacugagcaacuccucuccugaccccauggcugaggccgaacggacgaaugggcauagcccuucccaaccccgcgaugcccuuggagacagccuucaggugccgguuucuccuuccagcaccacaucuagcagaugcuccucucgggacggcgaguuuacccucacaacccugaagaaagaagcuaaguucgagcuucgcgcguuucacgaggauaagaaacccagcaagcuguucgaagacgaugagcaugaaaaagagcaguacuguauuagaaaggugcggcccuccgaagagaugcucgagcuggaaaaagagcgcagagaacugauccggagccaggccgucaagaagaacccugggaucgcugccaaaugguggaauccgccccaagagaagacgauugaggaacagcucgacgaggaacaccuggagucucacaaaaaguauaaagaaagaaaggagcgccgggcccagcaggagcaacuucugcuccagaaacagcugcaacagcagcagcaacagccucccucccagcuuugcacagcuccugccagcucucaugaaagagcguccaugaucgauaaggcuaaggaggacauugugaccgaacagaucgauuuuagcgccgcccgcaaacaauuccagcugauggagaacucccggcaggcuguggccaagggacagucuacacccagacucuuuagcauuaaaccuuucuaccgcccccugggcuccgucaauucugacaagccgcugaccaacccucggcccccuagcguuggcgggcccccggaagauuccggagcuagcgccgcgaaaggccaaaagucuccuggggcccucgagacccccuccgcugccggaagccagggcaauacagcuucucaggggaaggagggaccuuauuccgaacccagcaaaagaggcccccugucuaagcugugggccgaggacggcgaauuuacgagcgcgcgcgccgugcugaccguggucaaagaugacgaccacgggauccucgaucaguucucccggagcgugaacguuucucugacacaagaggaacuugacuccggacuggaugagcucagcgugagaucccaggacaccacaguccuggagacccugucuaaugauuuuagcauggacaacauuuccgauucuggcgcuagcaacgaaacgacaaaugcccuccaggagaacucccuggcugacuucucucuuccucaaaccccgcagaccgauaaucccagcgaagggcgcggagagggcguguccaagagcuuuucugaccauggguucuacuccccuagcucuacacugggcgauagcccccucguugacgauccucuggaguaccaggccggacugcuugugcagaacgccauccaacaggcuaucgcggaacaggucgacaaagccguguccaagaccucucgggacggcgcugagcagcaagggcccgaagccacagucgaggaagccgaggcugccgcguucggauccgagaagccucagagcauguuugaaccgccccagguguccagcccuguucaggagaaaagagaugugcuccccaagauucugccugcugaagaccgggcccugcgcgagagagggcccccgcaaccucuccccgccguccagcccucuggcccuaucaauauggaagagacgcggcccgagggaagcuauuucuccaaauacucugaagcugccgagcugagaagcaccgcgucccuucuggcuacacaggaaucugaugugaugguuggcccuuuuaagcuccgcagccggaaacaaagaacccuguccaugauugaggaagagauccgcgccgcccaggagagagaagaggaacugaagcggcagcgccaggugcuucaaucuacacagagcccgagaaccaagaacgcucccucccucccuagccggacguguuauaaaaccgcccccgggaagauugagaaagucaagccucccccgucuccuacaaccgagggccccucccugcagccugaccuggcucccgaagaggccgcgggaacacagcgcccuaaaaaucucaugcaaacccugauggaagauuacgagacgcacaagagcaaaagacgggaacgcauggacgauucuuccgugcuugaggccacaagagugaaccggcgcaagagcgcucuggcccucagaugggaggcuggcaucuaugccaaucaggaagaggaagacaacgaguga

SEQ ID NO: 65683 - RNA, 2562 nt, Artificial Sequence
  derived and/or modified sequence opt5 from AKAP3__Homo_sapiens__NP_001265238
augagcgagaagguggacuggcugcagucccaaaacggcgucugcaaaguugauguguacucucccggggacaaucaggcccaggauuggaagauggacaccagcacagauccugugagaguccucuccuggcugcggcgcgaccuugaaaaaucuacggcugaguuccaggaugugagauuuaagccgggagagagcuucggcggggaaaccuccaacucuggagacccccacaaaggcuuuagcguugauuauuacaauacaaccacaaaggggaccccugaacggcugcauuucgagaugacacacaaggagauccccugucaaggaccucgcgcccagcucggcaacggcuccagcguggacgaagucucuuuuuaugcgaauagacugaccaaccuugugauugcuauggcccggaaagagaucaaugaaaagauugauggguccgagaacaaaugcguuuaccagagccuguauaugggaaaugagcccacgccuaccaagucucucuccaaaaucgccagcgaacuggugaacgagacagucucugcuuguucccgcaaugccgcuccggacaaggcccccggcagcggggauagaguguccggaucuagccaguccccucccaaccugaaguacaaaagcacccucaagauuaaagaaucuacaaaggagcggcaaggcccugacgacaaacccccguccaagaaaucuuucuuuuauaaggaaguguucgagagccgcaauggggauuacgcgagagagggaggccgguuuuucccucgcgaaagaaagcgguuucgcggccaggagagacccgacgauuucaccgccagcgucuccgaagggaucaugacguacgcuaacucuguugugagcgacaugaugguguccaucaugaaaacacugaagauucaggucaaagauaccacaaucgccaccauucuucugaagaaagugcuccugaagcaugcuaaggagguugugagcgaccuuaucgauucuuuucugcggaaucuccacuccgucaccggaacacugaugacggacacccaguucgugagcgccguuaaaagaacaguguucucucauggcucccaaaaggcgaccgauauuauggacgccaugcugcgcaaacucuauaacgucauguuugcuaagaaagugccugaacacguccggaaggcccaggauaaggcugagagcuacucccugaucucuaugaaagggaugggagaccccaagaacagaaaugugaacuucgccaugaaaagcgagacaaagcugcgcgaaaagauguauuccgagcccaagucugaagaggaaaccugcgccaagacgcugggcgagcacauuaucaaagaggggcucacacuguggcauaagagccagcaaaaagaauguaagucccuuggauuucagcacgcugcguucgaggccccuaauacccagcggaaaccggcuagcgacaucucuuuugaauaccccgaggauauuggcaaccugucccucccucccuauccucccgagaagccggaaaauuucauguacgacagcgauucuugggccaaagaccugaucguuuccgcccugcuccugauucaguaucaucuugcucaaggcgggagacgcgaugcccggagcuuuguggaggcggcuggaaccacaaacuucccugccaaugaacccccugucgcccccgacgagucuugccuuaagagcgcuccuaucgugggcgaucaggaacaggccgagaagaaagaccucagauccguguuuuucaacuuuauucgcaaucugcuuagcgagaccaucuucaagcgggaucagucucccgaaccgaaaguuccugagcaacccgucaaggaagacagaaaacugugugagcgcccccucgcuuccagcccuccgcggcuguacgaagaugacgagacacccggggcccuguccggacucacgaagauggcggugucucagaucgauggccacaugagcgggcagaugguggagcaccugaugaacuccguuaugaaacuuugcgucauuaucgccaaaucuugugacgcuagccuggccgaacucggcgacgauaaguccggagacgcuucuagacugaccagcgccuuuccugauucccuguacgagugccuucccgcgaaaggcacagggagcgccgaagcugugcuccagaaugccuaucaagcuauucauaacgagaugcggggaaccucuggccagccucccgaagggugugccgccccuacagugaucgucuccaaucacaaccugaccgacacggugcagaauaagcagcugcaagcuguucuccaguggguggcggccagcgagcugaacguccccauucuuuacuucgcuggagaugacgagggcauccaggaaaaacugcuccaacugucugccgccgcuguggauaaggggugcuccguuggcgaggugcugcagagcguccuucgcuaugaaaaggagagacagcucaacgaggccgugggaaauguuaccccgcugcagcugcucgacuggcugauggugaaccuuuga

SEQ ID NO: 65684 - RNA, 2565 nt, Artificial Sequence
  derived and/or modified sequence opt5 from AKAP4__Homo_sapiens__NP_003877
augauggccuacagcgacaccacaaugauguccgaugacaucgauuggcugagaucucaccggggcgugugcaaggucgaccucuauaaccccgaggggcagcaagaucaggaccgcaaaguuauuuguuucguggaugugagcacgcugaaugucgaagacaaggauuacaaagacgcugccuccucuagcuccgagggaaaccuuaaucugggcucucucgaagagaaggaaaucauugugaucaaagauaccgagaagaaggaccagagcaaaacagagggguccguuugccuguuuaagcaggcgccuagcgauccggugucuguccuuaacuggcugcucuccgaccugcaaaaauaugcucugggauuccagcaugcccucagccccucuaccuccacauguaagcacaaagugggcgacaccgaaggggaguaccauagagccagcucugaaaauugcuauuccguuuacgcugaucaggugaacauugacuaucugaugaaucggccucagaaccuucgccuggagaugacagccgcuaagaauaccaacaauaaccaaagccccuccgccccucccgcgaagccuccgucuacgcagagagccgucaucagccccgauggagaguguuccaucgacgaucucagcuuuuacgugaaucggcugucuucccuugugauucagauggcucacaaagaaaucaaggagaaacuggaaggcaagagcaaaugccuccaucacucuauuuguccuagccccggcaacaaggagcgcaucuccccuagaacccccgccucuaaaauugcuagcgaaauggccuacgaggcggucgagcugacagccgcugaaaugcgggggaccggagaggaaucccgcgagggcgggcagaagucuuuccuguauucugaacucuccaauaagagcaaaucuggagacaagcaaaugucccagagagagagcaaagaguuugccgauuccaucucuaagggccugaugguuuacgcuaaccagguggccagcgacaugauggugucccuuaugaaaacacugaagguccacucuagcgggaagccgauuccugccuccgugguucucaaacgggugcugcuucgccauaccaaggaaaucgucagcgaucugaucgacucuugcaugaaaaaccuccacaauauuacgggagugcugaugacagauuccgacuucguuagcgcugugaagagaaaccuguuuaaucaauggaaacagaacgcgaccgacaucauggaggccaugcucaagcggcuggucucugcucuuauuggcgaagagaaggaaacaaaaucccagagccugucuuaugccagccucaaggccggcucccaugaucccaaaugucgcaaucagagccuggaguucucuaccaugaaggcugagaugaaagaaagagacaaggggaagaugaaauccgauccuugcaagagccuuaccuccgccgagaaagugggagaacacauccugaaggagggccucacaauuuggaaccaaaaacaggggaauagcuguaaggucgcgacgaaggcuugcagcaacaaagacgagaagggagagaaaaucaaugccuccaccgauucucuggccaaggaccugaucgugagcgcucucaaacugauucaguaccaccuuacacagcaaaccaagggcaaagauacaugcgaggaagacugucccggguccaccaugggauauauggcccagucuacgcaguacgagaagugcggcggcgggcagagcgcuaaggcccuguccguuaaacaacucgaaagccaucgggcgcccggaccuucuacaugucagaaggagaaccagcaccuggauucccagaaaauggacaugagcaauaucgugcugaugcuuauucaaaagcuccugaacgagaauccguuuaaaugcgaagaucccugugagggcgaaaacaagugcucugagccuagagccuccaaggcugccagcaugucuaaucgcuccgacaaagcugaagaacagugucaggagcaucaagaacuggauugcaccagcgggaugaagcaggccaacggacaguucaucgacaaacucgucgaguccgugaugaagcugugucuuauuauggcgaaauauagcaacgacggcgccgcucuggccgaacucgaggaacaggcugccucugccaauaagcccaacuuucgggggaccagaugcauccacagcggcgcuaugccucaaaauuaccaggauucccugggacaugagguuaucgugaacaaucaguguucuacaaacagccugcagaagcaacuucaggcgguccuccaguggauugccgcuucccaguucaaugugcccaugcuguacuuuaugggcgacaaagaugggcaacuggagaagcucccucaggugucugccaaagccgcugaaaagggauauagcguuggcgggcugcuucaggaggucaugaaauucgccaaggaacgccaaccggacgaggcggugggaaaaguggcucggaagcagcugcucgauuggcugcuggccaaccuuuga

SEQ ID NO: 65685 - RNA, 1284 nt, Artificial Sequence
  derived and/or modified sequence opt5 from AKAP5__Homo_sapiens__NP_004848
auggagaccacaaucagcgaaauucacguggagaacaaggacgagaaaagauccgccgagggcucucccggggcugaacggcagaaggagaaagccagcaugcugugcuucaagcgcagaaagaaggcggcuaaggcccucaaaccuaaggccggauccgaggcugccgaugucgcucggaaauguccgcaagaagccggcgcgucugaccagcccgagccuacgcgcggggccugggcuagccugaagagacuuguuacccggcgcaaaagauccgaaucuagcaagcagcagaagccccuggagggagagaugcaaccugccaucaaugcugaagaugccgaccucuccaaaaagaaagcgaaaagccggcugaaaauucccugcaucaaguuuccucgcggcccgaaaagaucuaaccauuccaagauuaucgaggauagcgacuguucuaucaaggugcaggaagaggccgaaauucuugauauccagacacagacaccccugaaugaccaagcuaccaaagccaaguccacccaggaucucagcgaggggauuucucggaaagacggagaugaggugugcgaauccaacgucagcaauuccacaaccucuggcgagaaggugaucagcguugaacugggccuggacaacgggcacuccgcuauucagacgggaacccucauccuggaggaaauugagacaaucaaagagaagcaggaugugcaaccucagcaggccagcccccuugaaaccucugagacagaccaucaacagccuguccuguccgacgugcccccgcucccugccauccccgaucagcagauuguugaagaggcuagcaauucuacccuggaaagcgcgccuaacggcaaggacuacgaguccacggagaucguggccgaagagacaaaacccaaggauaccgaacuuucucaagagagcgacuucaaagagaaugggauuacagaagagaaguccaaaagcgaagagucuaagcgcauggaacccaucgcuauuaucaucaccgauaccgagauuuccgaguuugacgucacaaagagcaaaaacgugccuaagcaguuccugaucucugccgaaaaugaacaggugggagucuuugccaacgauaauggcuucgaagacagaacguccgagcaguaugaaacccuccugauugagacagcuagcucccugguuaaaaacgccauccaacucucuauugagcagcuggugaaugaaauggcgagcgaugacaacaagaucaacaaucuucugcaguga

SEQ ID NO: 65686 - RNA, 6960 nt, Artificial Sequence
  derived and/or modified sequence opt5 from AKAP6__Homo_sapiens__NP_004265
augcugaccauguccgugacacucagcccccugagaucucaggaccuugauccuauggccacggacgcuagcccgauggccaucaacaugacccccacagucgagcaaggcgaaggggaggaagcgaugaaggauauggacuccgaucagcaguacgagaaaccucccccucugcacaccggagcugacuggaagauuguucuccaucugcccgaaaucgagacauggcuucggaugaccucugagcgcgugagagaucugacauauuccgugcagcaagacuccgauucuaaacacgucgacgugcaccucguucagcugaaggauauuugugaagacaucagcgaucacguggagcagauucaugcccugcucgaaaccgaguucucccugaaacuucugagcuacucugucaaugugaucguugacauccacgccgugcagcuccuguggcaccaacuucgggucuccgugcuggugcuccgcgagcggauucugcagggccugcaggacgcuaaugggaauuauacgcggcagaccgauauccuccaagccuuuagcgaagagacaaaggaaggacgccuggacucucuuaccgaggucgaugacuccggccagcugacaauuaaguguagccagaacuaccucucucuggauugcgggaucaccgcuuucgaacuuuccgacuauagcccuuccgaggaucugcucucuggacugggcgacaugacgagcucccaaguuaaaacaaagccguuugauagcuggucuuacuccgagauggaaaaagaguuccccgaacugauuagaagcgugggccuccugaccguggccgcggacucuaucagcacaaauggguccgaggccgucaccgaagaggugucucagguuagccuuuccguggaugacaagggaggcugugaggaagacaacgcuagcgccgucgaggaacagccugggcugacccucggagugucuuccagcucuggcgaggcucugacaaaugccgcgcagcccuccagcgaaacgguucaacaggaguccucuagcuccucucaucacgaugccaaaaaccagcagccugugcccugcgagaaugcuaccccgaagcggacaauucgcgacuguuuuaacuauaaugaagauagcccuacccaacccacacuuccuaagagagggcuguuccucaaagaggaaaccuuuaagaacgaccugaaaggaaauggcggcaagcggcagauggucgaucugaaacccgagaugucccgcagcacgcccucucucguggacccuccggauagauccaagcugugccuuguccugcagagcucuuaccccaacuccccuagcgccgcuucucagagcuacgagugucuccauaaaguggggaauggaaaccuggaaaacacaguuaaguuccacaucaaggagaucuccagcucucugggccggcuuaaugacugcuauaaagaaaagucccgccucaaaaagccccacaaaaccagcgaggaagugccucccuguagaaccccgaagcgggggacaggauccggcaagcaagccaaaaacaccaagucuagcgccgucccuaauggggagcuguccuacacaucuaaagcuauugagggaccccagacgaacagcgcguccaccucuagccuggaaccuugcaaucagagauccuggaacgccaagcuccagcugcaaagcgagacaucuuccagccccgcuuuuacccagucuuccgaaagcucugugggcuccgauaauaucaugagcccuguuccccuucuguccaaacauaagagcaagaaaggccaggccucuagcccgucccacgugacacgcaacggggaggucguggaagccugguauggaucugacgaguaccucgcucugccuagccaucugaagcaaaccgaggugcuugcccucaaacuggaaaaucugacgaagcuccugccccagaaaccccggggcgagaccauucagaacaucgaugacugggaacuuuccgagaugaacucugauagcgaaauuuauccuacauaccacguuaagaagaaacauaccagacuggggcgcgucuccccgucuagcuccagcgacaucgcgucuucccucggagagagcaucgagucuggcccccuguccgacauucugagcgaugaagaguccucuaugccucuugcugggaugaagaaauaugccgacgaaaagagcgagcgggccuccagcucugagaaaaacgaaucccacagcgcuacaaagucugcccucauccagaaacugaugcaagauauucagcaccaggacaauuacgaggcuaucugggaaaagauugagggcuucgugaacaagcuggaugaauuuauccaguggcucaaugaggccauggagaccacggaaaacuggacacccccuaaagcggagauggacgaucugaaacuuuaccuggaaacccaucucagcuucaaacugaacguggacucccacugugcccugaaggaggcugucgaagaggagggacaucaacuucucgaacugaucgccucucacaaagcuggccugaaggauaugcucagaaugauugccagccaguggaaggagcugcagcgccagaucaaacggcaacacuccuggauucuuagagcgcuggacacaaucaaggccgaaauucucgcuaccgaugugucuguugaggacgaagaggggaccggaagccccaaagccgaggugcagcugugcuaucuggaagcucagcgcgaugccgucgagcaaaugucccuuaagcuguacagcgaacaguauacaucuuccagcaaacggaaggaggaguuugccgacauguccaaggugcauucuguuggcagcaaugggcuccuggacuucgauuccgaauaccaggagcucugggacuggcugaucgauauggaaucucuugugauggacagccacgaucugaugauguccgaggaacagcaacagcaucucuauaaaagauacagcgucgagaugucuauucgccaccugaagaaaacggagcugcuuuccaagguggaagcucugaaaaagggaggcguucuccugccuaacgaccuccuggagaagguggauagcaucaaugaaaaaugggagcuucuggggaagacccucggcgagaagauccaggacacaauggcgggacauucuggcuccagcccccgggaucugcugucuccggagagcgggucccuugucagacagcuggaggugcggauuaaggaacucaaaggauggcugcgcgacaccgaacuguucaucuuuaacucuugccugagacaagaaaaggagggcacaaugaauaccgaaaaacagcuucaguauuucaagagccugugucgggagauuaagcagagacgcagagggguggccuccauccugagacucugccaacaucugcuugaugaccgcgagacguguaaccugaaugcugaccaccagccuaugcagcucauuaucgucaaccuggaaagacggugggaggccaucguuaugcaggccgugcaauggcagacacgccuccagaaaaagaugggaaaagaaagcgagacccugaaugugauugaucccggccuuauggaccugaacgggauguccgaggaugcucuggaaugggacgagauggauaucucuaauaagcucauuagccugaacgaagaguccaaugaccuugaucaagaacugcagccugucauccccucucucaaacugggcgagaccagcaacgaggacccgggauacgaugaagaggccgacaaucauggcgggucccaguacgcgucuaacauuacagcuccuagcagcccccacaucuaucagguguacagccuccauaacguugaacuguaugaggauaaucacaugccuuuucuuaagaacaaucccaaggugaccggaaugacacaacccaacguccugacgaaaucucuguccaaggacagcucuuucuccagcaccaaaucucucccugaucugcuuggcggguccaaucuggugaagccgugcgccugucauggaggcgacaugagccagaacuccgggagcgaaucuggcaucguuagcgagggagacacagagaccacaaccaauuccgaaaugugccuccugaacgccguggauggcucucccagcaaucucgagacggaacaccuggacccucagaugggggaugcugucaacgugcuuaaacagaaguuuaccgacgagggagaauccauuaagcugcccaauucuagccaauccucuaucagcccuguuggcugugugaacgggaaagucggagaucucaauuccauuacaaagcacacccccgacugccucggcgaggagcugcagggcaaacaugauguguucacauuuuacgacuauagcuaccuucaggggucuaagcugaaacucccuaugaucaugaagcagucccaaagcgaaaaggcccacguggaggauccgcugcugagaggauucuauuuugacaaaaagucuuguaaauccaagcaucagaccacagaacuccagcccgaugucccuccccacgagcggauucuugcgagcgcuucccacgagauggaccgcaucucuuacaaaagcggcaacaucgaaaagaccuucacggggaugcaaaaugccaagcagcugucccugcucagccauucuuccagcauugagucucugagcccuggaggcgaucuuuuugggcugggaaucuucaaaaacggcuccgacucucuccagagaagcacaucccuggaaucuuggcugaccagcuacaaguccaacgaggaccucuuuagcugccacucuuccggcgauauuagcguuuccucugggagcgugggagaacuuuccaaacggacccuggaccugcucaaucgccuggagaacauccagucucccagcgagcaaaagauuaaaagauccgugagcgauaucacacuucagucuuccagccagaagaugucuuucaccggccagaugucccuggacauugccagcucuaucaaugaagauuccgcugccagccucacggagcugucuagcuccgacgaacugagccucuguuccgaggauaucguccuucauaaaaacaagauuccggaaucuaaugcuagcuuccggaagcgccugacaagauccguggccgacgagucugauguuaacgugagcaugaucgucaauguguccugcaccucugcgugcacagacgaugaggacgacagcgaucugcucuccagcucuacccugacacuuaccgaagaggaacuguguauuaaagacgaggaugacgauuccagcaucgccacggacgaugaaauuuaugaggacugcacccucaugucugggcuggauuacaucaagaacgagcugcaaacauggauccggccuaaacucucccuuaccagagacaagaaacgcuguaauguuagcgaugaaaugaagggaucuaaggacauuuccagcucugagaugacaaaccccuccgauacccugaauaucgaaacgcugcucaacggcagcgugaaacgggucagcgagaauaacgggaauggaaagaacuccucucacacacaugagcugggcaccaaaagagaaaauaagaaaacaauuuuuaaggugaacaaggaccccuaugucgcugacauggagaacggcaauaucgaagggauuccugagcgccagaaaggaaagcccaacgugaccagcaaaguuuccgaaaaucuuggcucucacgggaaggagaucagcgaguccgaacacugcaaauguaaggcccugauggauucucucgacgauagcaacaccgcuggaaaggaguucgugucccaggacguccggcaucugccuaaaaagugcccgaaucaccaucacuuugaaaaccagagcacagccucuacgcccaccgagaaauccuucagcgaacuggcccucgagacaagauuuaauaaccgccaagauucugacgcucuuaaguccagcgaugacgcgccuuccauggccggcaaaucugcuggguguugccuggcccuggagcagaauggaaccgaagagaacgccagcaucuccaauauuucuuguugcaacugugaacccgauguguuccaccagaaggacgcugaggauugcagcguucauaauuuugugaaagaaaucauugacauggccuccacagcgcucaagagcaagucucagccugagaacgaggucgcugcccccaccucccugacgcaaaucaaagaaaaggugcuugagcacagccaucggccgauucagcugagaaaaggcgacuucuacucuuaucucagccuguccucucacgauagcgacugcggcgaagugacaaauuacaucgaggagaaguccagcaccccucugccccucgauaccacagacucugggcuugaugacaaagaagauauugagugcuuuuucgaagccugcguugagggagacuccgauggcgaggaaccuuguuuuagcuccgcucccccuaacgagucugccguccccagcgaagcggcuaugccgcugcaggccaccgccugcuccucugaguucagcgacuccucucugagcgcugaugacgccgauacaguggcucucuccagcccuucuucccaagaacgcgccgagguggggaaggaagucaacggacugccccagacgagcucuggcugugcggagaaucuugaguuuacccccuccaagcuggacagcgaaaaagagucuagcgggaagccuggagaauccggcaugccggaggaacauaacgccgcuagcgccaaauccaaggugcaggaccucucucugaaagcuaaucagcccacagauaaggccgcccugcacccuagccccaagacccucacaugcgaggagaaccuucugaaucugcacgaaaaacggcauagaaacaugcaccgguga

SEQ ID NO: 65687 - RNA, 246 nt, Artificial Sequence
  derived and/or modified sequence opt5 from AKAP7__Homo_sapiens__NP_004833
augggccagcugugcuguuuccccuuuagcagagacgaggggaagaucuccgagaaaaacggaggcgaaccugaugacgccgaacucgugcggcugucuaagcgccuugucgagaaugcuguucugaaagccgugcaacaguaccucgaagagacccagaacaagaauaaaccgggggagggaagcuccgugaagacagaagcggcugaucagaacggcaaugacaacgagaauaacagaaaguga

SEQ ID NO: 65688 - RNA, 11724 nt, Artificial Sequence
  derived and/or modified sequence opt5 from AKAP9__Homo_sapiens__NP_005742
auggaggacgaagagagacagaagaagcuggaagcuggcaaggcuaagcucgcucaauuccggcagcgcaaggcgcagagcgaugggcagucccccucuaagaagcaaaagaaaaagagaaaaaccagcuccucuaagcacgacgugagcgcucaccacgaucugaacaucgaccagucccagugcaaugagauguacauuaacucuagccagcgggucgaauccacaguuaucccugagagcacgauuaugcgcacccuucauucuggagagaucacaucccacgaacaaggcuuuagcguggagcuggaaucugagauuuccaccacagccgaugacugcagcucugaggugaaugggugcuccuucgucaugagaaccggaaaaccgacaaaccuccugcgggaagaggaauuuggcguggaugacagcuauuccgagcagggggcccaggauucucccacccaucuugaaaugauggagagcgagcuggcuggaaagcagcacgaaaucgaggaacucaaucgcgagcuggaagagaugagaguuacguacggcaccgagggccugcaacagcuccaggaguucgaggccgcuaucaagcaacgggacgggauuaucacacagcugaccgccaaccuucagcaggcgcgcagagaaaaagaugagacaaugcgggaauuucuggagcucaccgagcaaucccagaagcugcagauucaguuccaacagcuucaggccagcgaaacgcugcgcaauucuacacacuccagcaccgcugccgaccuccugcaggcuaaacaacagauccugacacaucagcagcaacucgaggaacaggaucaucugcuugaggacuaucagaagaaaaaggaggacuuuaccaugcaaauuucuuuccugcaggagaagaucaagguguacgagauggaacaggauaagaaagucgagaacagcaauaaggaagagauucaggagaaagaaaccaucaucgaggaacucaacacaaagauuaucgaggaagagaaaaagacgcuggagcuuaaggacaaacugaccacagccgauaagcuccugggagaacugcaagagcagauugugcagaaaaaucaggaaaucaagaacaugaaacucgagcugaccaauuccaagcaaaaggaaagacagucuagcgaggagauuaaacagcuuaugggcacaguugaggaacugcagaagcggaaccauaaagacucccaauuugaaaccgauaucgugcagcgcauggagcaggagacgcaaagaaagcucgaacagcugcgggcggagcuugacgaaauguaugggcagcagaucguccaaaugaaacaggagcugauuagacagcacauggcccagauggaagagaugaagacacgccacaagggagagauggaaaaugcucuccggagcuacucuaacaucaccgugaacgaggaucaaauuaaacugaugaauguggccaucaacgaacugaauauuaagcuccaggacaccaacucccagaaagagaagcugaaagaagaacuuggccugauccucgaggaaaagugugcucugcagagacaacuggaggaucuugucgaagaacucagcuucucucgcgaacagauccagcgggccagacagacaauugccgagcaagaguccaaacugaaugaagcucauaagagccuguccaccguugaggaccucaaggcggaaaucgugucugccagcgagucccgcaaagagcuggaacuuaagcacgaggcugaagugacaaacuauaaaauuaagcuggagaugcucgaaaaagagaagaaugccguccuggaucggauggccgagucucaggaagcugagcuggaaagacuucgcacgcagcuccuguuuagccaugaggaagaacuguccaagcucaaagaggaccuggaaaucgagcaccggauuaacaucgaaaaacuuaaagacaaucuggggauucauuacaagcaacagaucgauggacuccagaacgagaugagccagaaaaucgaaaccaugcaauucgagaaggacaaucugauuacaaagcagaaccagcugauccuugagauuucuaaacucaaggaucugcagcaaucccuggugaauagcaaaucugaagagaugacccuccagaucaacgaacugcagaaggagauugagauccuuagacaggaagagaaagaaaagggcacacuggagcaagaaguucaggagcuccagcugaagaccgagcugcuugaaaaacaaaugaaggagaaagaaaaugaccuccaggagaaguuugcccagcuggaagcggagaacuccauccugaaagaugagaagaaaacgcucgaagacaugcugaagauucacaccccugugagccaggaggaacgccuuaucuuccuggauucuauuaagagcaaauccaaggacagcgucugggagaaagaaaucgagauucucaucgaggaaaacgaggaucugaagcaacagugcauccagcugaaugaagagauugagaaacagcggaacacauucucuuuugcugaaaagaauuucgaggugaacuaccaagaacuucaggaggaauaugccugucugcucaagguuaaagacgaucuggaggacuccaagaauaaacaggagcucgaauacaagagcaaacugaaggcccuuaacgaggaacugcaccuccagagaaucaaucccaccacagugaagaugaaauccucugucuuugaugaggacaagaccuucguggcugaaacgcuggagaugggcgaggucguggaaaaagacacaaccgagcugauggaaaaacuugagguuacaaaacgggaaaagcuggagcucagccaacgccuguccgaucucucugagcagcugaagcagaaacauggggaaauuagcuuucuuaacgaggaagugaagucccugaaacaggagaaggagcaagucucucucagaugccgggaacuggagaucauuaucaaucacaacagagccgaaaaugugcagagcugugacacccagguuuccagccugcuugauggaguggucaccaugacaucucgcggcgcugagggguccgugagcaaagugaacaagucuuucggagaagaguccaagaucaugguugaggacaaagucagcuuugaaaauaugacggugggcgaggaaucuaagcaagagcagcugauucucgaucaucugccuuccgugaccaaagaaagcucccuccgggccacacagcccagcgagaacgacaagcugcagaaagagcuuaauguccugaagucugaacaaaacgaucugagacuccagauggaggcgcagcgcaucugccugagccuuguguauuccacccacguugaccaggugagagaauacauggagaacgaaaaagauaaggcccuguguucucucaaggaggagcugauuuucgcucaagaagagaaaaucaaggaacuccagaaaauucaccagcuggagcuucagacaaugaagacccaagagacgggggacgaaggaaaaccucugcaucugcucaucggcaagcugcagaaggccgucagcgaggaaugcuccuauuuucuucagacacuguguucugugcucggcgaguacuauaccccggcucugaaaugcgaaguuaaugccgaggauaaggagaacagcggggacuacauuuccgaaaaugaggaucccgaacuccaagacuaccgguaugaggugcaggacuuccaggaaaacaugcacacccugcuuaauaaagucacagaggaguacaacaagcugcuggugcuccagacccgccugucuaaaaucuggggacaacagacagauggcaugaaacuugaauuuggggaggaaaaucugccuaaggaggaaacggaguuccucagcauccauucccagaugaccaaccuggaggacauugauguuaaucacaaaagcaagcucucuucccugcaggaccuugagaagacaaagcuggaggaacaagugcaggagcuggagagccucaucucuucccugcagcagcaacuuaaagaaaccgagcagaacuaugaagcggagauucauugccugcagaagagacuccaagccgucagcgaauccacagugcccccuucucugcccguggauagcgucguuaucaccgaguccgacgcucagcggacgauguacccgggaagcugugugaagaaaaauauugauggcaccaucgaguuuucuggggaguucggcgugaaggaggaaacaaacaucgucaaacugcucgagaagcaguaucaggaacaacuugaggaggaaguggccaaaguuauuguguccaugagcaucgcuuucgcccagcagaccgagcugucucgcauuagcggaggcaaggaaaauacagccuccucuaaacaggcucacgcggucugccaacaggagcagcacuacuuuaacgaaaugaagcugagccaggaccaaaucggguuccagaccuuugagacaguggauguuaaguucaaagaggaauuuaagccucucuccaaagagcugggagaacauggcaaggagauucuucugucuaauagcgacccccacgauaucccugaguccaaagacugugugcucaccaucagcgaagagauguucucuaaggacaagacguuuauugucagacaguccauccaugaugaaauuagcguguccucuauggacgccagccggcagcugaugcugaacgaggaacaacucgaggauaugcgccaggagcuuguuagacaguaucaagaacaccagcaggcuacagagcugcugcggcaggcccauaugcgccaaauggaaagacagcgggaggaccaggaacagcuccaagaggagaucaaaagacugaaccgccagcuugcccagcgguccucuauugauaaugaaaaccuggugagcgagagagaacgcguccuccuggaggaacuggaggcucucaagcagcuuucccuggccgggcgggagaaacugugcugugaacucagaaauagcucuacccaaacccagaacggaaaugagaaccagggcgaaguggaggagcaaacauucaaggaaaaagagcuggaccgcaagcccgaagaugugcccccugagauccuuuccaaugaacgguacgcgcugcagaaggcuaacaauagacuccugaaaauucugcucgaggucguuaagaccacggccgccguggaggaaacaaucgggcgccacgugcuuggcauccuggaccggagcucuaaaucccagagcucugcuagccugauuuggagauccgaggccgaagcgucugucaagagcugcgugcacgaggaacauacccggguuacagaugaguccaucccgagcuacuccggaucugacaugccccgcaacgauauuaauauguggagcaaagugaccgaggaaggcacagagcucucccagagacugguccggucuggguuugcuggaaccgaaaucgacccugagaacgaagaacuuaugcugaauauuagcucccgccuccaagccgccguggagaagcugcuggaagcuaucucugagacgagcucccagcucgaacacgccaagguuacccagacagagcuuaugagagagagcuuccggcagaaacaagaagcuaccgagucucugaagugucaggaagaacugagagaacgccuccaugaggagucccgggccagagaacagcuggcgguggagcuuagcaaagccgaaggcgucaucgauggguaugcugacgagaagacacuguuugaacgccagauucaagagaaaaccgacaucauugaucggcucgagcaggaacugcugugcgccucuaacagacuccaggagcuugaagcugagcagcaacagauccaggaagaacgcgagcugcugucccggcaaaaggaagccaugaaagccgaggcuggacccguggaacagcagcuccugcaggagacggagaaacuuaugaaggaaaaacuggagguccaaugucaggcggaaaaggugagagacgaucuccagaaacagguuaaggcccuggagauugacguggaggaacaagucagccgcuucaucgagcuggaacaggagaaaaauacagaacucauggaucuuagacagcagaaccaagcucuggagaagcagcuggaaaagaugcggaaauuucucgacgagcaggccaucgaucgcgagcacgaaagagacguguuccaacaggagauucagaagcuggaacagcaacuuaaaguugugccucgguuccagcccaucucugagcaccagacccgcgaagucgagcagcuggccaaucaucucaaggagaaaacagauaagugcuccgaacugcugcucagcaaggagcaacuucagagagacauucaggaacggaacgaggagaucgaaaaacuggaguuuagagugcgcgaacuggagcaggcucuccugguguccgccgauaccuuccaaaagguugaagaccggaaacacuuuggcgcggucgaggcuaagccggagcuuagccuggaagugcagcuccaggccgagagagaugccauugaccgcaaagaaaaggagaucaccaaccuggaggaacaacuggagcaguuccgggaggaacucgaaaauaagaacgaggaagugcagcagcuucauaugcaacuggagauucagaaaaaggagucuacaacgagacugcaggaacucgagcaggaaaauaaacuguuuaaggacgauauggagaaacuugggcuggcuaucaaggagagcgacgccauguccacccaagaucagcacguccucuucggcaaguuugcgcagaucauucaggaaaaagagguggaaaucgaccaacugaacgagcagguuacaaagcugcagcagcaacucaaaauuaccacagauaauaaggugaucgaagagaaaaacgagcugauucgggaccuugaaacccagaucgagugucugaugucugaucaggaaugcgucaagcgcaauagagaggaagagaucgagcaacucaacgaagugauugagaaacugcagcaggaacuugcuaauaucggacagaagacgagcaugaacgcccauucccugucugaggaagccgacagccucaagcaccaacuggauguugugauugcugagaaacuggcccucgagcagcaggucgaaacagcuaaugaggaaaugaccuucaugaagaacgugcugaaagagaccaauuuuaagaugaaccagcuuacacaagagcuguucucccucaaacgggaacgcgagucuguugaaaagauccagagcauuccugaaaauuccgugaacgucgccaucgaccaccugagcaaggauaaacccgaacuugagguggugcugaccgaggacgcgcucaagucucuggaaaaccagacauacuuuaaauccuucgaggaaaauggcaaggggagcaucauuaaccuggagacgagacuccugcagcuugaaucuaccgucuccgccaaagaccuggagcucacacaaugcuauaagcagaucaaggauaugcaggagcaaggacaguucgaaaccgagaugcugcagaaaaagauuguuaaucuucagaaaaucguggaagagaagguggcugccgcucuggucagccaaauucagcucgaagccgugcaggaguacgccaaauuuugucaggacaaccaaacaaucuccucugagccugaacggaccaauauucagaaccugaaucagcugcgcgaggaugaacucggcagcgacaucuccgcucugacgcuuagaaucagcgagcuggagucucagguuguggaaaugcauaccucccucauucuggagaaggaacaagucgagaucgcggaaaagaacgugcuugagaaagagaagaaacugcucgaacugcagaagcugcucgaggggaaugagaagaagcagcgggagaaagaaaagaagcgcagcccccaggauguugaggugcugaaaacaaccacagagcuuuuccacucuaacgaagagagcggauuuuucaaugaacuggaggcccucagagcugaauccgucgccaccaaggccgagcuggcuucuuauaaagagaaggccgaaaaacuucaagaggaacugcucgugaaggagacaaacaugacgagccugcagaaggaccugucccagguccgggaucaucucgcggaggcuaaagaaaagcugucuauucuugagaaagaagacgagaccgaagugcaagagagcaagaaagccugcauguuugagccucugcccaucaagcucuccaagagcauugccucucagacagauggcacccugaaaaucuccagcuccaaucagaccccgcagauccuuguuaagaacgcugggauucaaaucaaucugcagucugaauguagcuccgaggaagugacagagauuaucucucaguucacggagaaaauugagaagaugcaggagcuccacgccgcggaaauccuggacauggagagcagacacaucuccgaaaccgagacacugaaacgcgaacauuacguggccguccaacuccugaaggaggagugcggcacccuuaaggcuguuauucagugucugcggagcaaagaaggaucuuccaucccugagcucgcccacagcgaugcuuaucagacaagagaaauuuguucuuccgacagcggcucugauugggggcagggaaucuaccugacccauucccaaggcuuugacauugccagcgaggggcgcggagaggaaucugagagcgcuacggacuccuuccccaagaaaaucaagggccuucugcgggccgugcacaacgaaggcaugcaagugcucagccugacagagucccccuacucugauggggaagaccauagcauucagcaggucuccgagccuuggcuggaggaaagaaaagcguauaucaacaccaucucuagccuuaaggaucugauuaccaaaaugcagcuccagcgcgaggccgaaguguacgacuccucucagagccacgaguccuuuagcgauuggcggggagaacugcuccuggcccuucaacagguuuuccuggaggagagaucugugcugcucgccgcuuuucgcacagaacugaccgcccuuggcacaaccgacgccgucgggcugcucaauugucuggagcagcggauccaggaacaaggaguggaguaucaggcugcgauggagugccuccagaaggccgauagacgcucccugcugagcgaaauucaggcccuucacgcccaaaugaacggccggaagaucacgcugaaaagagagcaggaaucugagaagccgucccaggaacuccuggaguacaauauucagcaaaaacagagccagaugcuugagaugcaagucgaacugucuuccaugaaggaccgcgccacagagcuccaggaacagcugagcucugagaaaauggugguugcugaacucaaguccgagcuggcccagaccaagcuggagcuugaaacaacccugaaagcgcaacauaagcaccucaaagagcuggaagccuucagacuugaggugaaggauaaaacggacgaaguccaucugcucaacgauacccuggcuagcgagcagaagaagucccgggagcugcagugggcccucgaaaaagagaaggcuaaacuggggcgcuccgaagagagagacaaggaggaacuugaggaccugaaauuuucucucgaaagccagaagcaacggaaucugcagcuuaaccugcuccuggagcagcagaagcaacugcucaaugaaucccagcagaaaaucgagucucaaagaaugcuguaugaugcccagcuuagcgaggaacagggacggaaccuggagcuccaggugcugcuugaauccgagaagguucgcaucagagaaaugucuagcacacuggaccgggagcgcgagcuccacgcgcaacugcaguccagcgauggcaccggccagucuagacccccucugcccuccgaagaccuccugaaagagcuucagaagcaacuggaagagaaacacagccggauuguggaacuccugaaugagacagagaaguacaaacuugauucucugcagacccgccagcagauggaaaaagacagacaaguccaucggaagacacuccagaccgagcaggaagccaacacggaggggcagaagaagaugcacgagcugcaguccaaaguggaagaucugcagcgccagcucgaggaaaagagacaacagguguauaaacuggaccuugagggacagcggcugcagggcaucaugcaagaguuccagaagcaggagcucgagcgcgaagagaagagagaaagccggcgcauucuguaccagaaucuuaacgagccuacaaccuggucccugaccucugauagaacacggaauuggguucuccaacagaaaaucgaaggggagaccaaggagagcaacuacgcuaaacugauugaaaugaauggaggcgggacaggauguaaccaugagcuggaaaugaucagacagaagcuccagugcgucgccuccaaacugcaagugcuuccccagaaggcuucugagcgccugcaguucgaaacggccgacgaugaggacuuuaucugggugcaagagaacauugaugaaaucauucuccagcugcagaaacuuaccggccagcaaggcgaggaaccuagccuggucucccccagcacaucuugugggucccucaccgagcggcugcugagacagaaugcugagcucacaggacacaucagccagcugaccgaagagaaaaacgaccuucgcaauaugguuaugaagcuggaggaacaaauucggugguauagacaaacgggcgccgggcgcgacaacucuagccgguucucccucaauggaggcgcgaacaucgaagccaucauugcuucugagaaagagguguggaauagagaaaagcugacccugcagaaaagccucaagcgcgccgaggcugaaguguacaaacuuaaagccgagcugcggaacgauucccugcuccagacacugagcccggacucugaacaugucacccuuaagagaaucuaugggaaauaccugcgcgccgaguccuuucggaaggcgcucauuuaucagaaaaaguaccugcugcuucuccugggaggcuuccaagagugcgaagaugcuacacuggcccuccuggcuagaaugggcgggcagccugccuuuaccgaccuugaggugaucacgaaucggcccaagggauucacaagauuucgcagcgccguucggguguccauugcuaucucuagaaugaaauuccugguccgcagauggcaccgggugaccggcagcguuuccauuaacaucaaucgcgauggguuuggacucaaccagggcgccgaaaagacagacucuuucuaucacagcuccgggggacuggagcuguacggcgaaccuagacauaccaccuaccggucucgcagcgaucuugacuauaucagaagcccccucccguuucaaaaucgguacccuggcacacccgcggauuucaacccugggagccuggccugcucucagcugcagaauuaugaccccgaucgcgcucucacggacuacauuaccagacuggaggcccuucagcggcgccugggaacaauccaauccggcagcaccacacaguuucacgcugggaugagacgguga

SEQ ID NO: 65689 - RNA, 552 nt, Artificial Sequence
  derived and/or modified sequence opt5 from AKIP1__Homo_sapiens__NP_001193575
auggacaacugccuggccgcugccgcgcucaauggcguggauagacggagccugcagcgcuccgcuagacuugcccuggagguccucgaacgggccaagcgcagagcuguugacuggcacgcccuggagcggcccaaaggguguaugggagugcuugcucgcgaagccccucaucuggagaagcaaccggcggccggcccccagagagugcucccuggggaaaaauacuauucuagcguccccgaggagggaggcgcuacccacguguaccgguaucaucgcggggaauccaagcugcacaugugccuggauaucggaaacggccagagaaaagaccggaagaagacaucucucggcccugggggaagcuaccagauuuccgagcaugcccccgaggcuucucaaccugccgaaaauaucagcaaagaucuguauauugagguuuacccgggcacguauuccgugaccgucgggagcaacgaccuuacaaagaaaacccacgugguugcgguggauucuggacaguccgucgaccugguguuccccguguga

SEQ ID NO: 65690 - RNA, 612 nt, Artificial Sequence
  derived and/or modified sequence opt5 from AKIRIN2__Homo_sapiens__NP_060534
auggccugcggcgcuacccugaagagaacacucgacuucgauccccugcuuagcccugccuccccgaaacggcgcagaugugcgccccugucugcuccuacgagcgccgccgcuucuccccucuccgccgcugccgcgaccgccgcuagcuuuuccgccgcugccgcgucuccucagaaguaccugcggauggagcccagcccuuucggggacguguccagccgccuuacaaccgaacaaauccuguauaacauuaaacaggaguacaagagaaugcagaaacggcgccaccucgaaacaucuuuucagcaaaccgauccgugcuguacauccgacgcccagccccaugcuuuccugcugagcggaccugccucucccggcaccuccagcgcugccucuuccccucucaagaaggagcagccccuguuuacgcuuagacaggucgggaugaucugcgaacggcugcucaaagagcgcgaggaaaagguuagagaggaauaugaggagauucugaauaccaaacuugccgaacaauacgaugcuuucgugaaguuuacacacgaccagaucaugcggcgcuauggagagcagccggcgagcuacguguccuga

SEQ ID NO: 65691 - RNA, 4320 nt, Artificial Sequence
  derived and/or modified sequence opt5 from AKNA__Homo_sapiens__NP_110394
auggccagcuccgagaccgaaaucagaugggcugagcccggccuggggaagggaccucagcggcgcagaugggccugggcggaagacaaacgggauguggaccgcucuagcucccaaucuugggaggaagagagacucuucccgaacgcuacaagccccgagcugcuugaagauuuucggcuggcccagcagcaccucccuccccuggagugggacccucauccccagccugauggccaccaagacuccgaaucuggggagacgagcggagaggaagccgaggcugaagaugucgacuccccggccagcucucaugagccccuugcuuggcugccucagcagggccgccagcucgauaugaccgaagaggagcccgacgggacacugggaucccuggaaguugaggaagccggcgaguccucuuccagacucggcuacgaagcggggcugagccuugagggacacggcaauaccucuccuauggcccuggggcauggacaagcucggggcuggguggccuccggggagcaggcuagcggagauaagcucuccgaacacucugaggugaaccccagcgucgaacuguccccggcccgcagcuggucuuccggcacagugagccuugaccacccuucugauagccuggacuccaccugggagggcgaaacagacgggccccagccuaccgcgcucgccgagacgcugcccgagggacccucucaucaucugcucagcccugauggcagaaccgggggauccguugcucgggccacaccgauggaguuccaggacagcucugcucccccugcccaaagcccccagcacgccaccgaucgcuggagacgggagacaacccgcuuuuucugcccucagcccaaagaacacauuuggaagcaaacgaaaacaagcccgaagccucugcccucuagauuuaucggcuccauuagcccucuuaauccccagccucggcccaccagacaggggcgcccgcugccucggcagggagcuacacucgcgggcagauccucuagcaacgcccccaaguauggccgcgggcaacugaauuacccccuuccugacuucuccaaagugggaccgcgggucagauuucccaaggaugagucuuaucgcccucccaaaagccggucccacaacagaaagccucaggcucccgcccgcccucugaucuucaaaagccccgccgagauugugcaggaaguucuccugucuuccggcgaggcugcccuggcgaaggacaccccgccugcucaucccaucacccgggugccucaggaauuucaaacacccgagcaggccacggaacucguccaccagcugcaggaggauuaccauagacuucugaccaaguaugccgaggcugaaaauacaaucgaccaacuccgccugggggccaaagugaaccuuuucagcgauccgccucagcccaaucacucuauucauaccggaauggugccucagggcacaaagguccuguccuuuaccaucccccagccccggagcgcugagugguggccugggccggccgaagacccccaagcgucugccgcuagcggcuggccuuccgccagaggagaucucagccccucuucccugacgagcaugccuacacugggcuggcuccccgagaaccgggacauuuccgaagaccagucuagcgcugagcagacccaagcccuggcgucccaggccucucaguuccuugcuaaaguugagagcuuugaacgccugauccaggccgggagacucaugccucaagaucaggugaagggauuccagcggcugaaagcugcccacgccgcucuggaggaagaguaccuuaaggcguguagagaacagcacccggcccaaccccucgcuggcuccaaagggaccccuggacgcuucgacccccggagagagcuggaggccgaaauuuaucgccugggcucuugccucgaggaacugaaggagcauaucgaucagacacagcaggagccugaacccccggggagcgacuccgcccuugauagcaccccugcucugcccugucuccaccaacccacacaucugccugcccccucuggccaggcgccuaugccggcuauuaagacguccugccccgagccugccaccacaaccgccgcugccagcacaggacccuguccucugcacgugaaugucgaagugucuuccggcaacagcgagguugaagacagaccccaggauccgcuugcgcggcuccgccacaaagagcugcaaauggaacagguguaccaugggcugauggaaagauaccucucugucaagucccugccugaggcuaugcggauggaagaggaagaggagggagaagaggaagaggaagaggagggcgggggagacagccuugaaguggauggcguugccgccacccccgggaaagcugaggccacgcgcgugcugccuagacagugccccguccaggcugaaaagucccacggcgccccucucgaggaggcgaccgagaaaauggugagcaugaagcccccgggauuucaagccucucuggcucgggacggccauaugagcgggcugggaaaggccgaagcugccccucccggccccggggucccuccgcaucccccuggaacaaaauccgccgcuucucaccagagcuccaugaccucucuugaaggcagcgggaucuccgagcgccucccccagaagccucugcacagaggcggaggcccccaccuggaagagacauggauggcgucuccugagaccgauagcggguucgugggauccgaaacgagccggguuucuccgcucacacagacccccgagcaucgccugucccacaucagcacagccggcacccuugcucaaccuuuugccgccucugugcccagagacggggcuuccuauccuaaagcccggggaagccugauucccagacgcgcgaccgaaccguccacaccucggucucaggcucagagauaccucagcucccccagcggcccccugcgccagcgggccccuaauuucucucuggagagaacgcuugccgcugaaauggccguccccggcuccgaguuugaggggcauaagcgcaucagcgaacaaccucucccgaacaaaaccauuucucccccucccgcgccugcucccgccgccgcuccgcugccuuguggacccacagagaccaucccuagcuuccugcucacacgggccggcagagaucaggcuauuugcgaacugcaggaggaagugucccgccuucggcugagacucgaggacucucugcaccagccccugcaagggagcccuacccggcccgccuccgcguuugaccgcccggccagaacgcggggacgcccugcugauucucccgccacauggggcagccauuauggguccaagagcaccgagagacuucccggagaaccucggggcgaggaacagaucguuccgcccggcagacagcgcgcucggucuuccagcgugccuagagagguccugcgccucucccugucuagcgaguccgaacuccccucucugccucuuuucagcgagaaguccaaaaccacaaaggacagcccccaagccgcccgggaugggaaaagaggagugggcucugcuggguggccugaccgcgugaccuuucggggacaguacacaggccacgaauaucacguucugucccccaaggcggucccgaaagggaauggaacggugagcuguccucauugcagacccauccgcacccaggaugccggcggcgcugugacaggggacccucucggacccccgccugccgauacccugcaguguccccugugcggccaagucgggucucccccugaggccgacggacccggcuccgcuacaagcggggccgaaaaggcgaccacgagacggaaggcuucuagcaccccuuccccgaaacagcgcucuaagcaggccggaagcucccccagaccucccccuggccuuugguaccuggccacagcucccccugccccggcgcccccugccuucgcuuauauuagcuccgugcccaucaugccuuaucccccggccgcuguuuacuacgccccugcuggccccaccucugcccagcccgcggccaaauggccucccacagcuagcccuccgcccgcccggcgccacagacauuccauucaacucgaucugggggaccucgaggagcugaacaaggcucuuucucgggccgugcaggccgcugaaagcgucagauccaccacacgccagaugcggucuagccuguccgcggaucucagacaggcccacagccugcgcggaucuugccuguuuuga

SEQ ID NO: 65692 - RNA, 951 nt, Artificial Sequence
  derived and/or modified sequence opt5 from AKR1B10__Homo_sapiens__NP_064695
auggccaccuucguggagcugagcacaaaggcuaagaugcccaucgucggccucgggacguggaaguccccucugggaaaaguuaaggaagccgugaaaguggcgauugacgcuggcuacagacacaucgauugcgccuaugucuaccagaacgagcaugaagugggggaggccauucaagaaaagauccaggagaaggcuguuaaacgggaggaccuuuuuauugugucuaagcuguggccgaccuucuuugaacgcccccucgucagaaaagccuucgagaagacacugaaagaucuuaagcugagcuaucucgacguguaccugauccacuggccucagggauuuaaguccggcgaugaccuguuccccaaagaugacaaggggaaugcuaucggaggcaaagccaccuuucucgaugcgugggaagccauggaggagcugguugacgaaggccuugugaaggcucugggggucucuaacuucagccauuuucagauugagaaacuccugaauaagccuggacuuaaauauaagcccgugacaaaccaaguggaaugucacccuuaccugacccaggagaagcucauccaguauugccauuccaaaggcauuacagucaccgccuacucuccgcuggggagccccgaucggccuugggcuaagcccgaagacccuucccugcucgaggaucccaaaaucaaggagauugccgcgaaacacaagaagacggccgcucagguucugauccgcuuccacauucaaagaaaugugaucgugaucccgaaaagcgucaccccugcccggauuguggaaaacauccagguuuuugacuucaaacuuucugacgaggaaauggcuacaauucuguccuuuaaucgcaacuggagagccuguaaugugcuccagagcucucaucuggaggauuaccccuucaacgccgaauauuga

SEQ ID NO: 65693 - RNA, 951 nt, Artificial Sequence
  derived and/or modified sequence opt5 from AKR1B1__Homo_sapiens__NP_001619
auggccagcagacugcuccugaacaauggcgcuaagaugcccauccuugggcugggaaccuggaaauccccuccgggccaggugacagaggccgucaagguugcgauugacgugggguaccggcacaucgauugcgcucauguguaucaaaacgaaaaugaggucggaguggccauucaggaaaaacuccgcgagcagguugugaagagagaagaacuguucaucgucucuaaacuuugguguacguaccacgagaagggccuggugaagggggccugccagaaaacccucagcgaccugaagcuggauuaucucgaccuguaccuuauucauuggcccacaggauuuaaaccuggcaaggaguucuuuccccuggaugaguccggcaacguugugccuucugacaccaauauccucgauacaugggcugccauggaagaacuggucgacgaggggcuugugaaagcuaucggaauuagcaacuucaaucaucugcaaguggaaaugauccucaacaagcccggccugaaguauaaaccugccgucaaucagauugagugucacccguaccugacccaggaaaagcucauccaguauugccaauccaaagggauuguugugacagcguacucuccccugggaagcccugaucggcccugggccaagccugaggaccccucccuucuggaagauccgcgcaucaaagcuauugccgcuaagcacaacaaaaccacggcccaggugcucaucagauuuccuaugcagcggaaucuggucgugauccccaagagcguuaccccugagcgcauugcggagaacuucaagguguuugacuucgaacuuucuucccaggauaugacaacccugcucagcuacaauagaaacuggcgggucugugcccugcugucuugcacaucccacaaagacuaucccuuucaugaggaguucuga

SEQ ID NO: 65694 - RNA, 972 nt, Artificial Sequence
  derived and/or modified sequence opt5 from AKR1C1__Homo_sapiens__NP_001344
auggacagcaaguaccagugcgugaaacugaacgauggccacuucaugcccguccucggguuuggaaccuaugccccugcugagguuccgaaguccaaagcccuggaagcgacaaaacuugcuaucgaggccggcuucagacauauugacucugcccaccuguacaauaacgaagaacaaguggggcucgcuauccggagcaagauugccgauggauccgugaagcgcgaagacaucuuuuauacgucuaagcugugguguaauagccauagacccgagcuuguccggccugcucuggagcgcucccucaaaaaccugcagcuggauuacguggaccucuaucugauucacuuccccguuucugugaagccuggcgaagaggucauccccaaagaugaaaaugggaagauccuuuuugacaccguggaucugugcgccacaugggaggcgguugagaaauguaaggacgccggacucgcuaagagcauuggcguguccaacuucaauagacggcagcuggaaaugauccuuaacaaaccuggccugaaguacaaaccggucugcaaucagguggagugucaucccuauuuuaaccaacgcaagcuccuggauuucugcaaaagcaaggacauugugcuggucgccuacucugcucucgggucccacagagaggagccuuggguugaucccaauagcccugugcugcuugaagaccccgugcugugugcccucgcgaaaaagcacaagcggaccccggcccugaucgcccuucgcuaccagcugcagagaggagucgugguucucgcuaaaucuuauaacgagcagcggauucgccaaaaugugcaggucuuugaguuccagcugacauccgaagagaugaaggcuaucgacggccugaacagaaaugugcgguaccucacccuggauauuuuugccgggccucccaacuauccuuucagcgacgaauacuga

SEQ ID NO: 65695 - RNA, 420 nt, Artificial Sequence
  derived and/or modified sequence opt5 from AKR1C2__Homo_sapiens__NP_001128713
auggacagcaaguaccagugcgugaaacugaacgauggccacuucaugcccguccucggguuuggaaccuaugccccugcugagguuccgaaguccaaagcccuggaagcggugaaacuugcuaucgaggccggcuuccaucacauugacucugcccauguguacaauaacgaggaacaagucgggcuggcuaucagaagcaagauugccgauggauccgugaagcgggaagacaucuuuuauacaucuaagcucuggagcaauucccaccgccccgagcugguuagaccugcucuugagcggucucugaaaaaccuccagcuggauuacguggaccuguaucucauucauuuccccgucagcgugaaggaagauaucggcauccugacguggaaaaaguccccuaaacacaauagcuga

SEQ ID NO: 65696 - RNA, 972 nt, Artificial Sequence
  derived and/or modified sequence opt5 from AKR1C3__Homo_sapiens__NP_001240837
auggacagcaagcaccagugccugaaacucaacgauggccauuucaugcccgugcugggguuuggaaccuacgccccuccggagguccccagauccaaggcucuugaaguuacaaaacuggccaucgaggcgggcuuccggcacauugacucugcucaucucuauaauaacgaagaacaaguggggcuggccauccgcagcaagauugccgauggauccgugaaaagagaagacaucuuuuacacgucuaaacuuuggagcaccuuccaccggccugagcugguccgccccgcucucgaaaauucccugaagaaggcccagcuggauuauguggaccucuaccugauucauucuccuaugagccuuaagcccggcgaggagcuguccccuacagaugaaaacgggaaaguuaucuuugacaucguggaucucuguaccacaugggaggcuauggagaagugcaaagacgccggacuggccaagagcauuggcgucucuaauuucaacagacggcagcuugaaaugauccugaauaagccgggccucaaauauaagcccguguguaaccagguugagugccacccuuacuuuaaucgcuccaaacugcuggauuucuguaagagcaaagacauugugcucgucgcguauucugcucuggggucccaaagagauaagcgguggguggaccccaacagcccugugcuucuggaagaccccguccucugcgcccuggcuaaaaagcacaagcgcaccccggcccuuaucgcgcugagauaccagcuccagcggggaguuguggugcuggccaaaucuuacaaugagcagcgcauuagacaaaacguccagguguuugaguuccagcugacagcugaggauaugaaggccaucgacggccucgaucggaaucugcauuauuuuaacuccgacagcuucgcuucccacccuaauuaccccuauucugaugaguacuga

SEQ ID NO: 65697 - RNA, 972 nt, Artificial Sequence
  derived and/or modified sequence opt5 from AKR1C4__Homo_sapiens__NP_001809
auggaccccaaguaccagagaguggagcugaacgauggccacuucaugccuguccucggguuuggaaccuaugccccgcccgaaguuccucggaaucgcgcuguggaggugacaaaacuggccaucgaagcgggcuucagacauauugacagcgcuuaccuuuauaacaaugaggaacaagucgggcuggccauccgguccaagauugccgauggaucugugaaacgcgaggacaucuuuuacacgagcaagcucuggugcaccuucuuucagccccagaugguucagccugcucuggaguccucucuuaaaaagcugcaacucgauuauguggaccuguaccugcuccacuuccccauggcccugaagccuggcgaaacaccgcuucccaaagaugagaacgggaaggucauuuuugacaccguggaucugagcgcuacaugggaaguuauggagaaauguaaggacgccggacucgcgaaauccaucggcgugucuaauuucaacugcagacagcuggagaugauccuuaauaagccuggccugaaguauaaacccgucuguaaccagguggaaugccauccuuaccucaaucagagcaagcugcuggauuuuuguaaauccaaggacauugugcucgucgcccacagcgcucuggggacccaacggcauaaacuuuggguugaucccaacucuccggugcugcucgaggacccugugcugugcgcccuugcuaagaaacacaagcgcacacccgcccugaucgcgcucagauaccagcugcagcggggagucgugguucuggccaaguccuauaaugaacagcgcauuagagagaacauccaaguguucgaauuucagcucaccagcgaggacaugaaaguccuggauggccuuaaucggaacuaccgcuaugugguuauggacuuccugauggaucacccugacuaccccuuuucugaugaguauuga

SEQ ID NO: 65698 - RNA, 858 nt, Artificial Sequence
  derived and/or modified sequence opt5 from AKR1D1__Homo_sapiens__NP_001177835
auggaccugagcgccgcuucccacagaaucccccucucugauggcaacagcauuccuaucauugggcugggaaccuacuccgagccgaagucuacacccaaaggcgccugcgcgacgagcgugaaggucgcuaucgacaccggguaucggcauauugauggagccuacaucuaucagaaugaacacgagguuggcgaagccauccgcgagaaaauugcugaagggaaggugagacgggaggacaucuucuacuguggaaaacuuugggccacaaaccaugugccugagaugguccgccccacccuggaaagaacacuccgggugcugcaacuugauuauguugaccuguacauuaucgaggugccuauggcuuuuaagcccggcgaugaaauuuauccucgcgacgagaauggcaaguggcucuaccacaaauccaaccugugcgccaccugggaggucgaaugucauccguacuucacacagcccaagcugcucaaauuuugccagcagcacgauaucgugauuaccgcguauucuccucuggggacgagcagaaaucccaucuggguuaacguguccagcccuccccuucugaaggacgcccuccuuaauucucugggaaaacgguacaacaagaccgcugcccaaaucguccugcgcuucaauauucagagaggcgugguggucaucccgaaguccuuuaaccucgagcggauuaaagaaaauuuccagaucuuugauuucagccugacagaggaagagaugaaggacauugaggcucugaacaaaaauguucgcuuuguggaacuccugauguggagagaucacccugaguaucccuuccaugacgaauacuga

SEQ ID NO: 65699 - RNA, 963 nt, Artificial Sequence
  derived and/or modified sequence opt5 from AKR1E2__Homo_sapiens__NP_001035267
augggcgacauccccgccguggggcugagcuccuggaaggcuucuccuggaaaagucaccgaggccguuaaggaagcgauugaugcuggcuacagacacuucgacugcgccuauuuuuaccauaacgagcgggaagugggggccggaauccgcuguaaaauuaaggagggcgcugugagacgggaagaucucuucaucgccacaaaacuguggugcacgugucacaaaaagagccuugucgagaccgcuugccgcaagucccugaaggcccucaaacugaauuaucuugaccuguaccucauucauuggccgaugggguuuaagcccccucaccccgaguggaucaugucuuguagcgaacuguccuucugccugucucauccuagagugcaggaucucccccuggacgagagcaacaugguuaucccuuccgauacagacuuucuugauaccugggaagcgauggaggaccuggugauuacaggacucgucaaaaauaucggcgugagcaacuucaaucacgagcaacuggaacggcuucugaacaagccgggccuccgcuuuaagccccugaccaaucagauugagugucacccuuaucugacacagaaaaaccucaucucuuucugccaguccagagauguuagcgugaccgccuaccggccccuugggggaucuugugaaggcgucgaccugauugauaauccugugaucaagcgcauugcuaaagagcaugggaagucccccgcccaaauccugaucagauuucagauucagcggaacgugaucgucauuccgggaagcaucacgccuucucacauuaaagaaaauauccagguuuucgacuuugagcucacccaacaugacauggauaacauccugucccuuaaucgcaaccugagacucgcuauguuccccauuacaaagaaucacaaagacuauccuuuucacaucgaguacuga

SEQ ID NO: 65700 - RNA, 519 nt, Artificial Sequence
  derived and/or modified sequence opt5 from AKR7A3__Homo_sapiens__XP_011539349
augagcagacagcugucccgggcccgccccgcuaccgugcucggcgccauggagauggggagacggauggacgcgccuacaucugcugccgucacgcgcgccuuccuggaaagaggacacaccgagaucgauacagcuuuuguuuacagcgaaggccaauccgagaccauucuugggggacugggccuccggcuugggggaucugacugccgcgugaagaucgauacaaaagccauuccgcuguucggcaacagccugaagcccgacucccucagauuucagcuggaaaccucucugaaacggcuccaguguccucgcguggaucuguucuaucuucauaugcccgaccacagcacaccugucgaggagacccugagagcuugccaucagcuccaccaagaaggcaaguuuguggagcuggggcuuuccaauuacgccgcgugggaaguugccgagaucuguacgcugugcaaaagcaacggauggauucuccccaccguguaucagggcgcuuguuga

SEQ ID NO: 65701 - RNA, 1443 nt, Artificial Sequence
  derived and/or modified sequence opt5 from AKT1__Homo_sapiens__NP_001014431
augagcgacguggccaucgucaaggagggcuggcugcacaaaagaggggaauacauuaagaccuggcggccccgcuauuuccuccugaaaaacgauggaacauuuaucggcuacaaggagagaccucaggacguugaucaacgggaagcuccgcuuaauaacuucuccguggcccagugccagcugaugaaaacggagcgccccagaccuaauaccuuuauuauccggugucuccaguggacaaccgugauugaacgcacauuccaugucgagacccccgaggaaagagaggaauggacaaccgcgauccaaacgguggcugacgggcugaagaagcaggaggaggaagagauggauuuucggucuggaagcccuuccgacaacucuggcgccgaagagauggaaguuagccuugccaaacccaagcaccgcgugaccaugaaugaguucgaguaucugaaacuccuggggaagggaacauuuggcaaagucauccuggugaaggaaaaggcuaccggcagauacuaugccaugaaaauucucaagaaagagguuaucguggcuaaggaugaagucgcccauacacugaccgagaaccgggugcuucaaaauucccgccacccuuuccugacggcgcucaaauacucuuuucagacacaugacagacugugcuucgugauggaauaugccaacgggggagagcuguuuuuccaccuuagccgggagcgcgucuuuuccgaagauagagcucgguucuacggcgccgagauuguuagcgcucucgacuaccugcacucugaaaagaaugugguguauagagaucugaaacucgagaaccugaugcuugacaaggaugggcauaucaagauuaccgacuucggacuguguaaagaaggcaucaaggacggggccacaaugaaaaccuuuugcggaaccccggaguaccucgcgcccgagguccuggaagauaaugacuauggccgcgccguggauugguggggccuugggguugugauguacgagaugauguguggacggcugccuuucuauaaccaggaccacgaaaagcucuuugagcugauucugauggaggaaaucagauucccccgcacacucggcccugaggcuaaaucccugcuuagcgggcugcucaagaaggaucccaaacagcggcugggaggcgggucugaagacgccaaggagaucaugcagcauagauuuuucgcuggaauugucuggcagcacguguacgaaaagaaacuuuccccgccuuuuaaaccccaaguuacgagcgagaccgauacacgcuauuucgacgaggaauuuaccgcccagaugaucacaauuaccccucccgaucaggacgauucuauggagugcguggacuccgaacggagaccccacuucccucaauuuagcuacuccgccucuggcacggcuuga

SEQ ID NO: 65702 - RNA, 771 nt, Artificial Sequence
  derived and/or modified sequence opt5 from AKT1S1__Homo_sapiens__NP_001092103
auggccagcggcagacccgaggaacugugggaggcuguggucggggccgcggaacgguuccgcgcuagaaccggaacagagcucguucugcuuacggccgccccuccgcccccuccccggccuggccccugcgcuuacgccgcucacgggcgcggagcccuggcggaagccgcuagacggugucuccaugacaucgcccuggcucaccgcgccgcgaccgccgcuagaccuccggcucccccucccgccccucagcccccguccccuacacccucuccuccccggcccacccuugcccgcgaggauaacgaggaagacgaggaugaaccuacagagaccgagacaagcggcgaacaacuggggauuuccgacaauggaggccucuuugugauggaugaggacgccacccugcaggaucugccgcccuucugcgaaucugacccugagagcacggaugacggcucccucucugaagagacccccgcugggccucccacauguagcgugccgccugcguccgcccugcccacccagcaguaugcuaagagccuuccugucucugugcccguuuggggauuuaaagagaagagaacagaagcccgguccagcgaugaggaaaacggcccucccucuuccccggaccuggaucgcaucgccgcuagcaugagagcccucgugcugcgggaggcggaagacacccaagucuucggggaccuuccucgccccagacugaauacgucugauuuucagaaacucaagcggaaauacuga

SEQ ID NO: 65703 - RNA, 1260 nt, Artificial Sequence
  derived and/or modified sequence opt5 from AKT2__Homo_sapiens__NP_001229957
augaagaccgagagaccccggccuaacacauucgugauccgcugccugcaguggacgaccgucauugaaagaacauuucacguugacagcccggaugagcgggaagaguggaugcgcgccauccaaaugguggcuaauucccucaaacagagagcccccggcgaagacccuauggauuacaagugugggucucccagcgacuccucuaccacagaggagauggaaguggcggucagcaaagcucgggccaaggugaccaugaacgauuucgacuaucugaaacuucugggaaagggcacauuugggaagguuauucucgugcgcgagaaagccaccggaagauacuaugcuaugaagauccugcggaaagaagucauuaucgccaaggaugagguggcucauacgguuaccgagucccgcgugcuucagaauacaagacacccuuuccugaccgcccucaaauacgcguuucagacacaugaccggcugugcuucgucauggaauaugccaacggcggggagcuguuuuuccaccucucucgcgaaagaguguuuaccgaggaacgggcucgcuucuacggagccgagaucgugagcgcucuggaguaucuucauuccagagaugucguuuaccgggacauuaagcuggaaaaucucaugcuggauaaggacggccacaucaaaauuacggauuuuggccuuuguaaggaggggaucagcgacggagccacaaugaaaaccuucugcggcacacccgaauaccuggcgccugaggugcucgaagacaacgauuaugggagagccguggacugguggggacugggcgucgugauguacgagaugaugugugggcgccugccguuuuauaaucaagaucacgagagacucuucgaacugauucuuauggaggaaauccgguucccccgcacccugucuccugaggcuaagucccuccuggccggacuucugaaaaaggaccccaaacagcggcucggcggcgggccuagcgaugcuaaggaaguuauggagcauagauuuuuccugucuauuaacuggcaggacgugguccagaagaaacugcugcccccguuuaagccucaagugaccuccgagguugauacacgcuacuucgacgaugaauuuacggcccagagcaucaccaucacacccccugaccgguaugauucucucggacuucuggagcucgaccagagaacccacuucccccaguuuuccuacagcgccuccauucgcgaauga

SEQ ID NO: 65704 - RNA, 1398 nt, Artificial Sequence
  derived and/or modified sequence opt5 from AKT3__Homo_sapiens__NP_001193658
augagcgacgugaccaucgucaaggagggcuggguucagaaaagaggggaauacauuaagaacuggcggccccgcuauuuccugcucaaaacagauggauccuuuaucggcuacaaggagaaaccucaagacguggaucugccguauccccuuaauaacuucucuguggccaagugccagcugaugaagacggaaagaccuaaacccaauaccuuuauuauccggugucuccaguggacaaccgucauugagcgcacauuccacguggacaccccugaagagagagaggaauggacagaggcuauccaggccguugcggaucggcugcaacgccaggaagaggagagaaugaacugcagccccaccucccagaucgacaauauuggggaagaggaaauggaugcuucuacgacccaucacaagcggaaaacaaugaacgacuuugauuaccuuaagcugcucggaaaaggcaccuucgggaaggugauccugguccgcgagaaggccagcggaaaauauuacgccaugaagauucugaaaaaggaagugaucauugcuaaagacgagguugcccauacacucaccgaguccagagugcugaagaauacgcggcacccuuuucuuacaucucugaaauauagcuuccagaccaaggaucgccucuguuuugucauggaauacgugaacggcggcgagcuguucuuucaucuuuccagagaacggguguucagcgaggaccgcacaagauuuuacggggcugaaaucgucucugcccuggauuaucuccacuccggaaagauuguuuaccgggaccugaaacuggagaaucucaugcuggacaaggauggccacaucaaaaucaccgacuucgggcuuugcaaggagggaauuaccgaugcggccacaaugaaaacguucuguggcaccccggaauaucuggcucccgaggugcucgaagacaacgauuacgggagagccguggacugguggggacugggcgucgugauguaugagaugaugugcggccgccuuccuuuuuacaaucaagaucaugaaaagcuguucgagcucauccugauggaggacauuaaguuuccccggacacugagcucugaugcuaaaucccuccugagcgggcuucugaucaaggacccuaacaaaagacucggaggcgggcccgaugacgccaaggaaauuaugcgccacucuuucuuuuccggaguuaauuggcaggacguguaugauaaaaagcuggucccgccuuucaagccccaggugaccagcgagacagacacccgguacuuugaugaagaguucacggcgcagacaaucaccaucaccccucccgagaaaugucaacaguccgacugcggcaugcuugggaacuggaagaaauga

SEQ ID NO: 65705 - RNA, 879 nt, Artificial Sequence
  derived and/or modified sequence opt5 from AKTIP__Homo_sapiens__NP_071921
augaaccccuucuggagcauguccaccucuagcgugagaaagcgguccgagggcgaagagaaaacacugacgggggacgucaagaccucuccuccgcgcacagcccccaaaaagcagcucccuagcauccccaaaaaugcucugccuauuaccaagcccacauccccugccccggcggcucaaucuaccaacggaacacacgccagcuacggccccuuuuaucuugaauacucccugcucgccgaguucacccugguugugaagcagaaacuuccugggguguauguccagcccagcuacagaucugcucugaugugguuuggagugaucuucauucggcauggccucuaucaggaugggguuuuuaaguucacgguguacaucccugacaauuaucccgauggagacugcccgcgccuggucuuugauauuccuguguuccacccccugguugacccuaccuccggcgaacucgaugugaaaagagccuuugcuaaguggcggcgcaaccauaaucacaucuggcaaguccugauguacgccagacggguguucuacaaaaucgacacagcgagcccccuuaaccccgaggccgcugugcuguaugagaaggauauucagcucuuuaagucuaaagucguugacuccgugaagguguguaccgcccgccuguucgaucagccuaaaaucgaagacccguacgcuauuagcuuuucucccuggaauccuuccguccaugaugaggccagagaaaagaugcuuacacagaaaaagcccgaggagcaacacaacaaaagcgugcacguugcgggccuguccugggugaagccugggucuguccagcccuucagcaaggaagagaaaaccguggccacguga

SEQ ID NO: 65706 - RNA, 993 nt, Artificial Sequence
  derived and/or modified sequence opt5 from ALAD__Homo_sapiens__NP_000022
augcagccccaaagcgugcugcacuccggcuacuuccauccucuccugagagccuggcagaccgcuacaacgacccuuaacgccucuaaucugaucuauccgauuuuugucacagacguucccgaugacauccagccuauuaccagccuccccgggguggcgcgguacggagugaagcgccuggaggaaaugcuuagaccucuggucgaggaaggccuccggugcgugcugaucuucgggguucccucccgcgugccuaaagaugagagaggaucugcugccgacagcgaagaguccccggccauugaggcuauccaucugcuccggaagacauuucccaaccugcuugucgccugugaugugugccuguguccuuauaccucucacggccacugcgggcuccugagcgaaaauggagcuuuccgcgccgaggaauccagacagcggcuugcggagguugcccuggcuuacgccaaagcuggcugucaaguggucgcccccagcgacaugauggauggccgcguggaggcgaucaaggaagcccucauggcucaugggcugggaaacagagugucugucauguccuauagcgccaaauuugcuucuugcuucuacggcccuuuucgggacgccgccaaguccagccccgcuuucggggaucgcagauguuaucagcugccgccuggagcgcggggccucgcccugcgcgcuguugacagagaugugcgggagggggccgacaugcuuauggugaagcccggaaugccuuaccuggauauugucagagaagugaaagacaagcaccccgaccucccccuggccguuuaccacgugucuggcgaguuugcuaugcuuuggcauggcgcccaggcgggggcuuucgaucugaaagccgccguccucgaagcuaugacagccuuucgccgggcuggagccgacaucauuaucaccuauuacacgccucagcugcugcaauggcucaaggaggaguga

SEQ ID NO: 65707 - RNA, 1923 nt, Artificial Sequence
  derived and/or modified sequence opt5 from ALAS1__Homo_sapiens__NP_001291372
auggagagcguggucagacggugccccuuccugucccgcguuccucaggccuuucuccaaaaggcuggcaaaucucugcuuuucuacgcccagaacuguccgaagaugauggaagugggggcgaaacccgcuccuagagcccugagcaccgccgcugugcacuaucagcagaucaaggagacacccccugccuccgaaaaagacaagacggcuaaggccaaaguccaacagacccccgauggaucucagcagagcccugacggcacacaacucccguccgggcauccccugccugcgaccucucagggaacagccagcaagugccccuuucuugcugcccagaugaaucagcggggcuccagcguguucuguaaggcuucucuggagcuccaagaagauguucaggagaugaacgccgugcgcaaggaggucgcggaaaccuccgccgggccuagcgugguuucugugaaaacagacggaggcgaucccuccggccugcugaagaauuuucaggacauuaugcaaaagcagagaccggagcgggucagccaccuccugcaggauaaccuuccuaaaucuguguccaccuuccaguacgaccgcuuuuucgaaaagaaaaucgaugagaagaaaaaugaccauacguauagaguguuuaagaccgucaaccggcgcgcucacauuuuccccauggccgaugacuacagcgauucccugaucaccaaaaagcaaguuucuguguggugcagcaaugacuaucucgggauguccagacauccucggguguguggagcugucauggacacccugaagcagcacggcgccggggccggaggcacacgcaacauuagcgggaccucuaaauuucacguggaucuugagagagaacuggcugaccuccauggaaaggaugcggcccugcuguucuccagcugcuuuguugcuaaugacucuacacucuucacgcuggccaaaaugaugcccggcugugagaucuacagcgauuccggcaaccacgccucuaugauccaggggauucggaauagccgcgugcccaaguauaucuucagacauaacgacgucucccaccuucgggaacugcuccagagaagcgauccuucugugccgaaaauuguugcuuuugagaccgugcacuccauggacggagccgucugcccccuggaggaacuuugugauguggcgcaugaguucggcgcuaucacauuugucgacgaagugcacgccguugggcuguacggagcccgcggcgggggaauuggcgaucgggacggcgugaugccuaagauggacaucauuagcgggacccucggaaaggcuuucggcugcgucgggggauacaucgccucuaccuccagccugaucgauacagugagauccuaugcugccggcuuuauuuucacgaccucucugcccccuaugcuccuggcgggggcccuugagagcguucgcauccugaaauccgcugaaggccgggugcucagacgccaacaucagcggaaugucaagcugaugagacagaugcuuauggacgccggacugcccguggugcacuguccgucucauauuaucccuguucgcgucgcugaugccgcgaaaaacacagaggugugcgacgaacucaugagccggcacaauauuuacgugcaggccaucaacuaucccaccgucccuagaggcgaggagcugcugcgcaucgcucccacaccucaccauacaccccaaaugaugaacuacuuucucgaaaaucugcuugugacguggaagcagguugggcuggagcucaaaccgcacuccagcgccgaaugcaacuucugucggagaccucugcauuuugaggugaugucugaacgggagaaguccuauuucagcggacugucuaaacuugucuccgcucaggccuga

SEQ ID NO: 65708 - RNA, 1764 nt, Artificial Sequence
  derived and/or modified sequence opt5 from ALAS2__Homo_sapiens__NP_000023
auggugaccgccgcuaugcugcuccagugcugucccguccuggccagaggcccuacaagccuucuggggaagguugugaaaacgcaccaauuccucuuuggaaucggccggugcccgauucuggcgacccaggggcccaacuguucccagauccaucuuaaggcuacaaaagccggaggcgacucuccuagcugggccaaggggcacugccccuucaugcuguccgagcuccaggauggaaaaucuaagauugugcaaaaggcugccccugaaguccaggaggacgugaaggcuuuuaaaaccgaucugcccagcucccugguuucugugagccuccgcaaaccuuucuccggcccgcaggaacaggagcaaaucagcggcaaggucacacaucugauucagaauaacaugcccgggaauuacguguuuucuuaugaccaguucuuuagagauaaaaucauggaaaagaagcaggaccacaccuaccggguuuucaaaacagugaaccgcugggccgaugcguauccuuuugcccaacauuucuccgaggcuagcgucgccucuaaggacguguccgugugguguagcaaugauuaccuuggaaugucuagacacccccagguccugcaggcuacccaagagacgcuccagcggcacggcgccggggcgggaggcacccgcaacaucuccgggacaagcaaauuucauguugaacuggagcaggaacuugccgagcugcaccagaaggacuccgcucuccuguucucuagcugcuuuguggccaaugauuccacccuguucacacucgcuaaaauucugccuggaugugagaucuauagcgacgccggcaaccaugccucuaugauucaaggcaucagaaauuccggggcugcgaaguucguguuucggcacaacgaucccgaccaccuuaaaaagcugcucgaaaagagcaauccgaaaauuccuaagaucgucgccuucgagaccgugcauucuauggacggagcuauuugcccccuggaagaacuuugugauguuagccaccaguacggcgcccugacguuuguggacgaaguccaugccguggggcucuauggaucccgcggcgcugggaucggagagagagauggcaucaugcacaaaauugacaucauuucuggcacacuggggaaggccuucggaugcguuggcggguacaucgcgagcacccgggaucugguggacaugguccgcuccuacgcugccggauuuauuuucacaaccagccucccucccauggugcugucuggcgcccuugaguccgucagacugcucaaaggggaagagggccaggcucugcggcgcgcccaucagagaaacgugaagcacaugcggcaacuucugauggauagaggacuccccguuaucccuuguccgagccacaucauucccauccgcgugggcaaugcugcccugaacucuaagcugugcgaccuccugcuuuccaaacaugggauuuauguccaggcgaucaauuacccuaccgugccccggggagaggagcugcucagacuggccccuagcccccaccauuccccgcagaugauggaagauuuuguugagaagcugcuucucgcuuggacagccgugggccugccucugcaggacgucucuguggcugccugcaacuucugucgccggcccgugcacuuugagcucaugagcgaaugggagagauccuauuucgggaacaugggaccucaauacguuacgaccuaugcguga

SEQ ID NO: 65709 - RNA, 1830 nt, Artificial Sequence
  derived and/or modified sequence opt5 from ALB__Homo_sapiens__NP_000468
augaagugggugaccuucaucagccugcucuuucuguucuccucugccuacagcagaggcgucuuucggcgcgacgcucacaaauccgagguugcccauagauucaaggaucuuggggaagagaacuuuaaagcgcuggugcucauugcuuucgcccaguaucugcaacagugccccuuugaagaccacgugaaacuugucaaugaggugacagaguucgccaagacguguguugcugaugaaucugccgagaacugcgacaagagccugcauacccucuuuggagauaagcuguguacaguggcuacccugcgggaaacauacggcgagauggccgacugcugugcgaaacaggaaccugagcgcaaugagugcuuccuccagcacaaggaugacaacccgaaucugcccagacuuguccggccugaaguggauguuauguguaccgccuuucaugacaacgaggaaacauuccugaaaaaguaucucuacgagaucgcucgcagacaccccuauuuuuacgccccugaacugcuuuucuucgcuaaacgguauaaggccgcguuuaccgagugcugucaagccgcugauaaggccgcuugccugcuccccaaacuggacgagcugcgcgaugaagggaaggccuccucugccaaacagagacucaagugugcuagccugcagaaauucggagagcgggcguuuaaggccugggcuguggcccgccuuucccagagauucccuaaagccgaauuugcugaggucagcaagcuggugacggaccucaccaaggugcacacagaaugcugccauggcgaccugcuugagugugccgaugaccgggcggaucuggcuaaauacauuugcgagaaucaagacucuaucuccagcaagcucaaagaauguugcgagaagccgcugcuggaaaaaucucacuguauugccgaggucgaaaacgaugagaugcccgccgaccucccuucccuggcugccgauuucguugagagcaaggacgugugcaagaauuacgcugaagccaaagauguguuucuugggauguuccuguaugaguacgcgcgcagacaucccgacuauucugucgugcuccugcuucggcuggccaagaccuacgaaacaacccucgagaaauguugcgcugccgcugauccucacgaguguuaugccaagguuuuugacgaguucaaaccccugguggaagaaccgcagaaccugaucaagcagaauugcgagcucuuugaacagcugggagaguacaaguuccaaaacgcgcuucuggucagauauacgaaaaaggugccucagguuuccacacccacccucguggaggucagccgcaaucugggcaaagugggcuccaaguguugcaaacacccugaagccaagcggaugcccugcgcugaggacuaccugucugucgugcuuaaccagcucuguguucugcaugaaaagacacccgugagcgauagagucaccaaaugcuguaccgagucccuggugaaucgccggccuugcuuuagcgcccucgaaguugacgagacauacgugccgaaggaguucaacgcugaaacguucaccuuucacgccgauaucuguacacugucugagaaagaaagacaaauuaagaaacagaccgcccuugucgagcuggugaagcauaaacccaaggcuacaaaggaacagcucaaagcggugauggacgauuucgccgcuuuuguugagaagugcuguaaagccgacgauaaggagaccugcuucgccgaagaggggaaaaagcuggucgcugccucccaggcggcucugggacuuuga

SEQ ID NO: 65710 - RNA, 1713 nt, Artificial Sequence
  derived and/or modified sequence opt5 from ALCAM__Homo_sapiens__NP_001230209
auggaaagcaagggcgccuccucuugcagacuucucuucugucugcuuaucagcgcuaccguguuucggcccgggcugggaugguacacagucaacuccgccuauggcgacacgauuaucauuccuugccgccucgauguuccgcagaaucugauguucgggaaauggaaguacgaaaaacccgacggaucuccuguguuuaucgcguucagaagcuccaccaagaaaucugugcaauaugaugacguccccgaguacaaggaucggcuuaaccugagcgaaaauuauacacucuccauuagcaacgcucgcaucucugacgagaagagauuuguguguaugcugguuaccgaagauaauguguucgaggccccuacaaucgucaaaguguuuaagcagcccuccaaaccugagauuguuagcaaggcccuguuccucgaaaccgagcagcugaaaaagcugggcgacugcaucucugaagauuccuacccggacgggaacauuacaugguaucggaauggaaaggugcugcacccccucgagggcgcugucgugaucauuuuuaaaaaggagauggauccugugacccagcuguacacgaugaccagcacacuugaauacaaaaccacaaaggccgacauccaaaugcccuucaccuguucugucacguauuacggcccuuccgggcagaaaacaauucauagcgagcaggcuguuuuugauaucuauuaccccaccgaacaggugacaauccaagugcugccgccuaagaacgccauuaaagagggagacaauaucacccucaagugccugggcaacgggaaucccccucccgaagaguuccuguuuuaucuccccggacagccugagggcauucgcuccucuaacaccuacacacugacggacgucagacggaaugcgaccggggauuauaaguguagccuuaucgacaaaaaguccaugauugccagcacagcuaucaccgugcacuaccuggaucucucucugaacccguccggagaaguuacacgccagaucggcgacgcccuucccgugagcugcaccauuucugcuagcagaaaugccacggucguguggaugaaagauaacauccggcugcgcuccucuccuagcuucuccagccuccauuaccaggacgcgggcaacuauguuugugagacagcccugcaagaaguggaggggcugaagaaaagagaaucucucacccugauugucgagggaaagccccagaucaagaugaccaaaaagacagauccuuccggccuuagcaaaaccauuaucugccacguggagggguuccccaagccggcuauccaguggacaauuacgggaucuggcuccgucaucaaucaaaccgaagagagcccuuacauuaacgggcgguauuacuccaaaaucauuaucucucccgaagagaaugugacacugaccuguacagccgaaaaccagcucgagcgcaccguuaauagccugaacguguccgcuaaugagaacagagaaaaggucaaugaccaggccaaacuuauugugggaaucguugugggccugcuccuggccgcucuggucgcgggcgugguguauuggcucuacaugaagaagucuaaaacggccagcaagcauguuaacaaagaucuggggaauauggaggaaaacaagaaacuugaggagaauaaccacaagaccgaggcuuga

SEQ ID NO: 65711 - RNA, 2256 nt, Artificial Sequence
  derived and/or modified sequence opt5 from ALDH16A1__Homo_sapiens__NP_001138868
auggccgcuaccagagccggcccccgggcgcgcgagaucuucacaagccuggaauacgggccugugccggagucccacgcuugcgcccucgccuggcuggacacgcaggauagaugucuuggacauuaugucaacggcaaguggcugaaacccgaacaccgcaauucuguuccuugccaagaccccauuaccggggagaaccucgcuagcugucugcaggcccaggcugaagauguggccgcggccguggaggcugcccggauggcuuuuaagggaugguccgcccauccuggcgucgugagagcgcagcaccuuacacggcuggccgagguuauccaaaaacaucagcgccuccuguggacccuggaaucucucgugacagggagagcuguccgggaggugcgcgacggagauguucagcuggcccagcaacuucugcacuaccacgcuauucaggccagcacccaggaagaggcccucgcuggcugggagcccaugggcgugaucgggcugauucuuccuccgacauucuccuuucuggaaaugauguggagaaucugccccgcgcucgccgucggauguaccgugguggcucuggucccucccgccucuccugcgccccugcuccuggcucagcuugccggcgagcuggggccguucccuggaauccucaauguucugagcggccccgcgucccuugugccuauucuggcuagccaacccgggauccggaagguggccuuuugcggagcccccgaaggcggccuccgccugcugauucaggagucugucugggacgaagcuaugagacggcuccaggagcgcauggggagacugcgguccggaagaggccuugauggggccguggacaugggagcucgcggcgccgcggccugugaucugguucaacgguucgugagagaggcucagagccagggggcccaggucuuucaagcuggagacgugccuucugaacgcccguucuaucccccuacgcucguuuccaaccugcccccugccagccccugcgcccagguggaggucccguggccuguggucguggccucucccuuucggaccgcuaaagaagcccuucugguugcuaauggcacaccuagaggcggguccgccagcgugugguccgagcgccucggacaggcccuggaacugggcuacgggcuccaggucggaaccguguggaucaacgcucauggccugcgggaucccucuguuccuacagggggcuguaaggagagcggaugcuccuggcacggcgggcccgacggacuuuaugaguaccugagaccgagcggcaccccugcgcgccucucuugucuguccaagaaucugaacuaugauacguucgggcuugccgugcccagcacacuccccgcuggaccugaaauuggcccgucucccgccccucccuacgggcuguuugucggcggacgguuccaagccccuggcgcuagaagcucccgccccauccgggacucuagcgggaaucugcauggauacguggccgagggcggggcgaaagacauuagaggagcuguggaagccgcccaccaggcuuuuccuggcugggccgggcagucccccggcgcgcgggcugcccuccugugggcccuugcugccgcucuggagcgcagaaagagcacccucgccucucggcuggaaagacagggagcggagcugaaagccgcugaggccgaaguugagcuuuccgcucgccggcucagagccuggggcgcccgcguccaagcucaggggcacacacuccagguggcgggacugagaggcccggugcugcggcugcgcgaaccucuugggguccuggccgugguuugccccgaugaguggccucuccuggcuuucgugagccugcuugcccccgcccucgcuuauggaaacaccgucgugaugguuccgucugccgcgugcccucugcuggcucucgaggugugucaggacauggccaccgucuuccccgccggccuggcuaaugugguuacaggggauagagaccaucuuacgcggugccuggcccuccaccaagaugugcaggcgaugugguacuuuggcuccgcucagggaagccaauucgucgaaugggccuccgccggcaaccugaagccugugugggcuucucgcgggugucccagagccugggaccaggaggcugaaggagccggccccgagcuggggcuucggguggcgcgcaccaaagcccucuggcugccuaugggagauuga

SEQ ID NO: 65712 - RNA, 2382 nt, Artificial Sequence
  derived and/or modified sequence opt5 from ALDH18A1__Homo_sapiens__NP_001017423
augcugagccagguguacagaugcggcuuccaacccuuuaaccagcaccuccugccuugggucaaguguaccacaguuuuccggucccauugcauccagccgucugugauucgccacgugagaagcugguccaauauccccuuuauuacggucccucuuucucggacccaugggaaauccuucgcccaccgcuccgagcugaagcaugcuaaaagaaucgugguuaagcucggaucugccguggucacacggggcgacgaaugugggcuggcgcuuggacgccuggcuagcauuguggagcagguuuccgugcuccaaaaccagggcagagaaaugaugcuggucaccagcggggccguggccuuuggaaaacagcggcugcgccacgagauccuccugucucaguccgugagacaagcccuucacagcggccagaaucagcugaaggaaauggccauccccguccucgaggcucgggccugcgcggccgcuggccagucugggcugauggcccuuuaugaggcuauguucacacaauacuccauuugugccgcgcagauccugguuaccaaccucgauuuucaugacgaacagaagcgcagaaaucugaacggaacacugcacgagcuccugcggaugaauauugugccuaucgugaacaccaaugaugccgucgugcccccugcugaaccgaacagcgaccuucaaggcguuauuucugugaaagauaaugacucccuggccgcucgccucgccgucgagaugaagacggaucugcuuaucgugcugagcgacguugagggccucuucgauagcccucccggaucugacgaugccaaacugauugacaucuuuuaucccggcgaucagcagagcgugaccuucgggacaaaguccagagucggaaugggcggcauggaagcuaaagugaaggcggcccugugggcucuccaagggggaaccagcgucgugaucgccaacggcacacauccuaagguuucugggcacgugauuaccgacaucgucgagggaaagaaggugggcacguuuuucuccgaaguuaaacccgccgggccgacaguggagcagcagggagaaauggcucggagcggcggcagaaugcuggccacccuugagccugagcagcgcgcggaaauuauccaccaucuggcugaccuccugacagaucagcgggacgagauucuucuggccaauaagaaagaucucgaagaggccgaagggagacuggcugcuccccugcucaagcgccugucucuuagcaccuccaaacugaacucucucgcuaucggacugcggcaaaucgccgcgagcucccaggacagcgucggcagagugcugcgccggaccagaauugccaagaaucuugagcucgaacaggugacaguuccuaucgggguccugcuggugauuuuugagucucgccccgauugccucccccagguggcugcccuggcuaucgccuccggaaacggccuucugcucaaagggggcaaagaggcggcccacagcaaccggauucugcaucugcuuacgcaagaagcucucucuauccacggagucaaggaggccgugcagcugguuaauaccagagaagagguggaggaccugugucgccucgauaaaaugaucgaccugauuaucccucggggcuccagccagcuugucagagauauucagaaggcugccaaagggaucccggugaugggacauuccgaaggcauuugccacauguacguugacucugaggccagcguggauaaggucacacggcuggugcgcgacuccaagugugaauaucccgcugcgugcaacgcccucgagacccugcugauccacagagaccuucuccggacaccucuguucgaucaaauuaucgacaugcugagaguugaacaggugaaaauccaugcugggcccaaguucgccucuuaccucaccuuuagcccuuccgaggucaaaagccugcgcacggaguauggagaucuugaacuguguauugaggugguggacaauguccaggaugccaucgaccacauucauaaguacgggucuucccacacagauguuaucgugaccgaagacgagaacaccgcugaguucuuucuccaacacguggauagcgccugcgucuucuggaaugcgucuacacgguuuuccgacggguacagauucggccugggagcugaagugggcauuagcaccucucgcauccaugccagagggcccguuggacuggagggccuucucacaacgaaauggcugcugcgggggaaggaucacguggucagcgacuuuuccgaacauggaagccucaaguaucugcacgagaaccuuccgaucccucagcgcaauaccaacuga

SEQ ID NO: 65713 - RNA, 1506 nt, Artificial Sequence
  derived and/or modified sequence opt5 from ALDH1A1__Homo_sapiens__NP_000680
augagcuccucuggcacccccgaccugccugugcuccugacagaucuuaagauccaguacacgaaaauuuucaucaacaaugaguggcacgacagcgucuccgggaagaaauuuccgguuuucaaccccgccaccgaagaggaacugugccaaguggaggaaggagauaaggaggacguggauaaagcugucaaggccgcgagacaggcuuuucagauuggcucuccuuggcggacaauggacgccagcgagcgcgggagacuccuguauaaacuugccgaucugaucgaacgggaccgccuccugcuggcuaccauggaguccaugaauggaggcaagcucuacucuaacgccuaucugaaugaucuugcuggguguauuaagacacugagauacugcgccggaugggcggacaaaauccagggccggaccauccccauugauggcaacuucuuuacauauacccgccaugaaccuaucgggguguguggacaaauuauccccuggaauuucccucucguuaugcugauuuggaagaucggcccggcccuuagcugcgggaacacgguggucgugaaacccgcugagcagaccccucugacagcccuccacguugcuucccugauuaaggaggccggauuucccccuggcguggucaauaucgugcccggguacggaccgaccgcgggcgccgcuaucagcucucauauggacauugauaagguggccuucacaggcuccaccgaagucgggaaacugaucaaggaggcugccggaaaaagcaaccucaagagaguuacgcuggaacuuggcgggaaaucuccuuguauugugcuggccgacgcugaccucgauaaugcgguggaguuugcccaccauggagucuucuaucaccagggccagugcuguaucgcugccucccggauuuuuguggaagagagcaucuacgacgaguucguucgcagaucuguggaacgggccaagaaauacauccuggggaacccccuuacaccuggagucacccaaggcccccagauugauaaggagcaguaugacaagauccuggaucucauugaauccggcaaaaaggagggggcuaaacuggaaugcggaggcgggcccuggggaaauaagggcuacuuugugcagccuacaguuuucagcaacgugaccgacgagaugcgcaucgccaaagaggaaauuuucgggccgguccaacagaucaugaaguuuaagucccuggaugacgugaucaaaagagcgaauaacaccuucuauggccucucugcuggagucuuuacaaaggauauugacaaagccaucacgauuagcuccgcccugcaggcuggcaccguguggguuaacuguuacgggguggucagcgcccaaugccccuucggaggcuuuaagaugucugggaauggacgggagcuuggcgaauauggguuccacgaguacacagaagugaaaaccguuacagugaagaucucccagaagaacagcuga

SEQ ID NO: 65714 - RNA, 1494 nt, Artificial Sequence
  derived and/or modified sequence opt5 from ALDH1A2__Homo_sapiens__NP_001193826
augaagaaccagugcgagaccguguggcugaaaagccccaucaagcucaaacugauuuucaucaauaacgaauggcaaaauuccgagucuggcagagucuuuccuguuuacaacccggccacaggggaacaggugugugaggugcaggaagcugacaaggccgauauugacaaagcgguccaggcugcccggcuugccuucagccugggauccguguggcgcagaauggaugcuucugagcggggccgccuccuggacaaacuugccgaucugguugagagagaccgggcugugcucgccacgauggaaagccugaaugggggaaagcccuuucugcaagcguucuaugucgaucuccagggcgugaucaagaccuuucgcuacuaugccgggugggcugacaagauucacggaaugacaaucccuguugauggcgacuacuucaccuuuacaagacaugagcccaucggcgugugcgggcagauuaucccuuggaacuucccccugcuuauguuugccuggaaaauugcuccugcccuguguugcggaaauaccgucgugaucaagccggcggaacagacaccccucuccgcccuguauaugggcgcucuuauuaaagaggccggguucccucccggagugaucaacauucugccuggcuacgggcccaccgcuggagccgccaucgcuucucacaucggcauugauaagaucgcguuuacgggcagcaccgaggucgggaagcucauucaagaagccgcuggacgguccaaucugaaacgcguuacacuggagcucggcgggaaguccccgaacaucauuuucgccgacgccgaucuggacuaugcuguggaacaggcccaucagggaguguuuuucaaucagggccaauguugcaccgcggggucuagaaucuucgucgaggaauccaucuacgaggaguuugugcggcgcagcguugaaagagcuaaacggcgcguggucggaucuccuuucgaccccacaaccgagcagggcccucagauugauaagaaacaauacaacaagauccuugaacugauucaguccggcguggccgagggggccaaacucgaauguggaggcaaggggcugggaagaaagggcuuuuucaucgagcccacgguuuuuagcaaugugacagacgauaugcggauugcuaaagaggaaaucuucgggcccguccaggagauccuuagauuuaagaccauggacgaagugauugagcgcgccaacaauucugauuucggccuggucgcugccguguuuacaaacgacaucaacaaagcgcucaccguuuccagcgccaugcaggcuggaaccguguggauuaauugcuauaacgcccugaaugcucaauccccuuucggcggguuuaagaugucuggaaacggccgggaaaugggggaguucggacugagagaguacagcgaagucaaaacagugacgguuaagaucccgcagaagaauagcuga

SEQ ID NO: 65715 - RNA, 1539 nt, Artificial Sequence
  derived and/or modified sequence opt5 from ALDH1A3__Homo_sapiens__NP_000684
auggccaccgcuaacggcgccguggagaaugggcagcccgacagaaagccuccggcgcugccccggccuauccgcaaccucgaagucaaauucacaaagauuuuuaucaauaacgaguggcacgaaagcaaauccggaaagaaauucgcuacgugcaaucccucuaccagagagcaaauuugugaaguugaggagggcgauaagccugacguggauaaggccguggaagccgcucaggucgccuuucagcgggggagccccuggcgcagacuggacgcucuuucccggggacgccugcuccaucagcuggccgaucuuguggagagagaccgggcgacacuggccgcucucgaaaccauggauacaggcaaaccuuuccugcacgccuuuuucaucgaccuggaggggugcauucgcacccucagauacuuugcuggaugggccgauaagauccaaggcaaaacaaucccgaccgacgauaacguuguguguuucacgcggcaugagcccauuggcgucugcggggcgaucaccccuuggaauuuuccccugcuuaugcugguguggaagcucgccccugcucuguguugcggaaacacaaugguucuuaaacccgccgaacagaccccgcugacagcucucuaucugggcucucugauuaaggaggccggguucccucccggaguggucaauaucgugccuggcuuugggcccaccgugggagccgcuauuagcucccacccccagaucaacaagauugcguucacgggcucuacagaagucggcaaacucguuaaggaggccgcuagccgcuccaaucugaaaagagugacccuugaacucgggggaaagaacccuuguaucgugugcgccgacgccgaucuggaccuggcugucgagugugcccaucagggcguguuuuucaaucaagggcagugcuguacagcggcuagccggguuuucguggaggaacaggucuacucugaguuugugcgcagauccguugaauaugccaaaaagcggccggugggagaccccuucgaugucaaaaccgagcagggcccucaaaucgaccagaagcaguuugauaagauucuugaacugaucgagagcgggaaaaaggagggagccaaacucgaaugcggcggcucugcuauggaggacaaggggcuguucauuaaacccaccguguuuuccgaagucacagauaacaugagaaucgccaaggaggaaauuuucggaccugugcaacccauccugaaguuuaaaagcaucgaggagguuauuaagcgcgcuaauucuacggacuacggccucaccgccgcgguguucaccaaaaaccuggauaaggcccuuaaacuggcuuccgcccucgaaagcgggacagucuggaucaacugcuauaaugcucuguacgcccaggcgccguuuggaggcuucaagauguccgggaacggccgggagcuuggagaauaugcccuggcugaguacacagaggugaagaccguuacgauuaaacucggcgacaagaauccuuga

SEQ ID NO: 65716 - RNA, 1554 nt, Artificial Sequence
  derived and/or modified sequence opt5 from ALDH1B1__Homo_sapiens__NP_000683
augcugagauuccucgcuccccggcugcuuagccugcagggccgcaccgccagauacuccucugccgcggcucucccuagcccgauccugaaccccgacauuccuuauaaucaacuuuuuaucaacaaugaguggcaggaugccguguccaagaaaacauuccccacggucaacccuaccacaggggaaguuauuggacacguggccgagggcgaccgggcugauguggaccgcgccgucaaggcugccagagaagcguuucggcuggggucucccuggcgcagaauggaugccagcgagcggggacgccuccugaauagacuggcugaccucguggaacgggaucgcguuuaccuggccucccuugagacccuggacaacggcaaaccuuuccaggagucuuaugcucucgaucuggacgaagugaucaaggucuacagauauuuugccgggugggcggauaaauggcauggaaagacaauuccgauggacggccagcacuucugcuuuacccggcaugagcccgugggcguuugugggcaaaucaucccuuggaauuucccccuugugaugcagggauggaagcuggccccugcucucgccacaggcaacaccgucgugaugaaaguggcugaacagacgccccugagcgcccuguaccucgccucccugauuaaggaggcuggguuuccgccuggagucguuaauaucauuaccggcuaugggcccacagcgggagccgcuaucgcccagcacguggauguggacaaagucgccuucaccggcagcacagaggugggccaucuuauucaaaaggcugccggggacucuaaccugaaacgcguuacccucgaacugggaggcaaguccccuagcaucgugcuugcggaugcugacauggagcacgccgucgaacagugccacgaggcccuguuuuucaauauggggcaguguugcugugcuggaucuagaacguuuguggaagaguccauuuacaacgaguuccucgaacggacaguugagaaggccaaacagagaaaggugggcaaucccuucgaacuggauacccaacaggggccccaggucgacaaagagcaauuugaacgcgugcugggauacauccagcucggccagaaggagggcgcuaaacugcuuugcgggggagagcgguucggcgaaagaggguuuuucaucaagccuacagucuuuggaggcgugcaggaugacaugcgcauugccaaagaggaaaucuucgggccgguucaaccccuguuuaaguucaagaaaauugaggaaguggucgagcgggcgaacaauaccagauauggccucgccgcugccguguuuacccgcgaucuggacaaggcuauguacuucacacaggcccuucaggcgggaacgguuugggugaacaccuauaacaucgucacaugucauaccccuuuuggcggguucaaagagagcggaaauggccgggaacugggggaggauggacucaaggccuacacagaagugaaaaccgugacgauuaagguuccccagaagaacucuuga

SEQ ID NO: 65717 - RNA, 2739 nt, Artificial Sequence
  derived and/or modified sequence opt5 from ALDH1L1__Homo_sapiens__NP_001257293
auggccggccccagcaacccuccggcuaccaugaagaucgccgugauugggcagucccuguucggacaagaggucuacugccaccucagaaaagaaggccaugagguuguggggguguuuacaguccccgacaaggauggaaaagcggacccucugggccuugaagcugagaaggauggggugcccguuuucaaauauucucgguggcgcgccaagggacaggcccugccugacguggucgcuaaguaccaggcccucggcgcugaacugaaugugcuucccuuuuguagccaguucaucccuauggagauuaucuccgccccgagacacggcucuauuaucuaucaucccagccugcucccucggcaccgcggggcguccgccaucaacuggacgcugauucauggagauaaaaagggcggguuuucuaucuucugggcugacgauggacuggacaccggcgaucuccugcuucaaaaagagugcgaaguucugcccgacgauacagugagcacccucuacaauagauuucuguucccugaggggauuaagggaaugguccaggccgugcggcuuaucgcugaaggcaaagcgccccgccugccgcagccugaggagggcgccacauaugaagggauucagaagaaggagaccgccaaaaucaacugggaccaacccgcugaagccauucacaauuggaucagaggaaacgauaaggugccuggcgcuuggacagaggccugugaacagaaacucaccuuuuucaauuccacgcugaacaccagcgggcugguccccgagggagacgcccuccccaucccuggcgcucaccggccggggguugugacaaaggcgggacugauucuuuuuggcaaugacgauaaaaugcugcucgugaagaacauccagcuggaggacggcaaaaugauucuugccucuaauuucuuuaagggggcugccuccagcguccuggaacucaccgaggccgaacuggugacagcugaggccguucgcucuguguggcagagaauccugcccaagguccucgaaguggaggauuccaccgacuucuucaaaagcggagcggcuucuguugaugugguccggcugguggaggaagucaaggagcuuugcgacggccuggaacucgagaacgaagauguguacauggccuccacguuuggggacuucauucaacugcuuguucgcaaacugagaggagaugacgaggagggcgaauguagcaucgauuauguggagauggccgucaauaagcggacagugcgcaugccucaucagcucuuuaucgggggcgaguucguugacgcugagggagccaaaaccuccgagacaauuaaccccaccgacggcucugugaucugccaggucagccuggcucaagugaccgauguggacaaggccguugcggccgcuaaggaugccuuugaaaaugggagauggggaaaaauuuccgcucgggacagaggccgccugauguaccggcucgccgaucugauggagcagcaccaggaagaacuugcgacaaucgaagcccuggacgcuggggccgucuacacgcucgcucugaagacccaugugggaaugagcauucagacauucagauauuuugccggcuggugugauaaaauccaagggucuaccaucccuauuaaccaggcccgccccaaccggaaucugacacuuaccagaaaggagccggugggcgucugcggaaucauuaucccuuggaacuacccccucaugaugcuguccuggaaaacggcugcgugucuggccgcuggcaauacagugguuauuaagccugcccaggugacaccccucaccgcccugaaguucgcugagcuuacccugaaagccgggaucccuaagggagucgugaacguucuccccggcagcgggucucuggugggacagcgccugagcgaccacccggauguccggaaaauuggcuuuaccggguccacagaagugggcaagcacaucaugaaaucuugcgcgaucagcaauguuaagaaggugucccuugagcucggaggcaaaagcccucugauuaucuucgcugacugugaucugaacaaggccguccaaauggggaugucuuccguguuuuucaauaaaggagaaaacugcauugccgcuggcagacucuuuguggaggacagcauccaugaugaguucguccgccggguuguggaagaggugagaaagaugaaagucgggaauccccuggaccgcgacacggaucacggaccccagaaccaucacgcccaucuugugaagcugauggaauauugccagcacggcguuaaagagggggcgacccucguguguggcggaaaucaggucccucggccgggcuucuuuuucgaacccacaguguuuaccgacguugaggaucacauguucauugcuaaggaagagucuuuugggccugugaugaucaucuccagauucgccgacggagaucuggacgccguccugagccgggcuaacgccacagaguuuggccuugcuuccgggguguucacccgcgauauuaauaaggcccucuacguuucugacaaacugcaagcgggaacgguguuugucaacaccuauaauaagacagauguggccgcucccuucggcggcuuuaaacagagcggguucggaaaggaccugggcgaagccgcucucaacgaguaccugagagugaaaaccgucacauuugaauauuga

SEQ ID NO: 65718 - RNA, 1554 nt, Artificial Sequence
  derived and/or modified sequence opt5 from ALDH2__Homo_sapiens__NP_000681
augcugagagccgcugcccgguucggcccccgccucgggagacggcugcuuagcgcggcugccacccaggccgugccugcuccgaaccaacagcccgaggucuuuugcaaucagaucuucauuaacaaugaauggcacgacgccguuucccgcaagacauuuccuacggugaaccccucuaccggagaggugaucugucaggucgcugaaggcgauaaagaggacguggauaaggccguuaaagcggccagagcugccuuccaacuggggagcccuuggcggcgcauggacgcuucccauagaggacggcuccugaaucgccuugccgaucugauugaaagagaccggacauaccucgcggcccuggagacccuggauaacggcaagcccuaugugaucucuuaccucgucgaccuggauauggugcuuaaaugccugcgcuauuacgcugggugggccgacaaguaucacggaaagacaauuccuaucgauggcgacuuuuucagcuacaccagacaugagccgguuggcgugugugggcagaucauucccuggaauuuuccucuccugaugcaggcuuggaaacuuggacccgcccuggccacaggcaacgucguggugaugaaggucgcugaacagaccccucucacggcgcuguauguugccaaucugaucaaagaggcuggguuucccccgggaguggugaacauugucccuggcuucgggcccaccgccggagccgcuaucgccucccacgaagauguggacaagguugcguucacaggcucuaccgagauuggccgggugauccaagucgcugccgggagcuccaaucucaaacgcgugacacuggagcuuggaggcaagagcccuaacauuaucaugucugacgccgauauggacugggcuguugaacaggcccauuuugcucuguucuuuaaucaggggcagugcuguugcgccggauccagaaccuucgugcaagaggauaucuacgacgaguucgucgaacggagcguggcgagagccaagucucgcgucgugggcaaccccuuugauuccaaaacggaacaggggccccagguugacgagacacaauucaagaaaauucucggauacaucaauaccggcaagcaggagggcgcuaaacugcuuugugggggaggcauugccgcugaucggggguauuuuauccagccuacaguguucggagacguccaggauggcaugaccauugccaaggaagagaucuuugggccggugaugcaaauccugaaauucaagaccauugaagagguugugggcagagcgaacaacagcacauacggacucgccgcugccgucuuuacgaaggaccuggauaaagcuaauuaucugucucaggcccuccaggccggcaccgugugggugaacugcuacgacguuuucggggcucagucccccuuuggaggcuauaagaugagcggguccggacgcgaacugggcgaguacgggcuucaagcguauacagaggucaaaaccgugacagugaaggucccucagaaaaauucuuga

SEQ ID NO: 65719 - RNA, 1362 nt, Artificial Sequence
  derived and/or modified sequence opt5 from ALDH3A1__Homo_sapiens__NP_000682
augagcaagaucuccgaggccgugaaaagagcucgggccgcguucucuagcggccgcaccagaccccugcaguuucggauucaacagcucgaagcucugcagcgccuuauccaggagcaagaacaggagcuggucggggcccucgccgcugaccugcacaagaacgaauggaaugccuacuacgaggagguuguguacgugcuugaagagauugaauauaugauccagaaacugccugagugggcugccgaugagccggucgaaaagacaccccagacgcaacaggacgagcucuacauucauuccgaaccucugggagugguucuggugaucggcaccuggaacuaucccuucaaucucacaauccagccuauggucggggcgauugccgcuggaaacucugugguucugaaacccagcgagcuuuccgaaaauauggccucucugcucgcuaccaucauuccucaguaccuggauaaggaccuuuauccggugaucaacggcgggguccccgagacaaccgagcugcucaaggaaagauuugaucacauucuguacacaggaagcaccggcgugggcaaaaucauuaugacggccgcggccaagcaucugaccccugugacacucgagcuugggggaaaaucccccugcuacgucgacaagaauugugaucuggacguugcuugccggcgcaucgccuggggcaaauucaugaacagcgggcaaaccuguguggcuccugauuauauccugugcgaccccucuauucagaaucagaucguggaaaagcucaagaaaucccugaaggaguuuuacggagaagaugccaaaaagagcagagacuauggccggauuaucucugcccgccacuuccaaagagucauggggcuuauugagggacagaaaguggcuuacggcggcacaggggaugcggccacccgguauaucgcuccgacgauccugacagacguugacccucagucccccgugaugcaggaggaaauuuuuggaccuguccuccccaucguguguguucgcagccuggaggaagccauucaauucaucaaccagagagagaagccccuggcccucuacauguuuucuuccaaugauaaagugauuaagaagaugaucgcugaaaccagcuccggcggggucgccgcgaacgacgugaucguccauauuacacugcacucucuuccuuucggaggcguggggaauagcggaaugggcuccuaucacggcaaaaagagcuuugagaccuucucucaucggcgcuccugccugguuagaccgcucaugaacgaugaggggcugaaagugcgguaucccccuagccccgcuaagaugacccagcacuga

SEQ ID NO: 65720 - RNA, 1458 nt, Artificial Sequence
  derived and/or modified sequence opt5 from ALDH3A2__Homo_sapiens__NP_000373
auggagcuggaagugagacggguccgccaggccuuccucagcggcagaucccggccccugcgcuuuagacuucaacagcuggaggcucuccggcgcaugguucaggaaagagagaaggacauccugaccgccauugcggcugaucuuugcaaaucugaguucaacguguacagccaggaagugaucacaguccugggggagauugacuuuaugcucgaaaaucugccugagugggugacggccaagccgguuaaaaagaacgugcugaccaugcucgaugaagccuauauccaaccccagccucugggagucgugcuuauuaucggcgcuuggaauuaccccuucguucugacaauccagccucucauuggggccaucgcugccggaaacgcggugauuaucaaacccuccgagcugucugagaauaccgccaagauucuugcuaagcugcucccucaguaucuggaccaagaucuguacaucgucauuaacggcgggguggaagagacaaccgaacuccugaaacagcgguuugaccacaucuucuauacaggaaauaccgccgugggcaagaucgucauggaggcugccgcgaaacaucuuacgccgguuacccuggaacucggcggaaagagccccuguuacauugauaaagacugcgaucuggacaucgugugucgcagaauuacaugggggaaguauaugaacugcggccagaccuguaucgccccugauuacauucuuugcgaggcuucccugcagaaucaaaucguguggaagaucaaagagacagucaaggaauuuuacggggagaacauuaaagaaucucccgacuaugagcggaucauuaaucuccgccacuucaagagaauccugagccugcucgaaggacagaaaauugccuuuggcggggagaccgaugaggcuacgcgguacaucgccccuacagugcugaccgacguugaccccaagacaaaagugaugcaggaagagaucuucggaccgauucuuccuaucguccccgugaagaacguugaugaagccauuaauuuuaucaacgagcgcgaaaagccucuggcucucuauguguucucccauaaucacaaacugauuaagagaaugaucgacgagaccagcucuggcggcgucaccgggaacgaugugauuaugcauuuuacacuuaacuccuuccccuucggaggcgucgggagcucuggaaugggcgcguaccacgggaaacacuccuuugacacguucagccaucaacggcccugucugcucaagucucugaaaagagagggagccaauaagcugcgcuauccuccgaacucccagagcaagguggauuggggcaaauuuuuccuccugaagcgguuuaauaaagaaaaacuuggccugcuccugcugaccuuccuugggaucguugcugccgugcucgucaaggccgaguacuauuga

SEQ ID NO: 65721 - RNA, 1407 nt, Artificial Sequence
  derived and/or modified sequence opt5 from ALDH3B1__Homo_sapiens__NP_000685
auggacccccugggcgauacccucagacggcugcgcgaggccuuccacgcugggagaacacggccugccgaauuucgcgcggcucagcuucaaggacugggcagauuccuccaggagaacaagcagcugcuucaugacgcccuggcccaggaucuccacaaaagcgcuuuugaauccgaggugucugaagucgccaucagccaaggggagguuacgcuggcucugcggaaucuccgcgccuggaugaaggacgagagagugccgaaaaaccuggcgacccagcuugauuccgccuucauucggaaggaacccuuuggacuggugcucaucauugcuccuuggaauuacccccugaaccuuacacuggucccucucgugggcgcccuggcugccgggaauugcguugugcugaaacccucugagaucagcaagaacgucgaaaagauucucgcggaggugcugccucaguauguugaccaguccuguuucgccgugguccuuggaggcccgcaagagaccggccagcugcucgaacaucgcuuugauuacaucuucuuuacagggucucccagagugggaaaaaucgugaugaccgcugccgcuaagcaccugacaccugucacccuugagcugggcgggaaaaaucccugcuauguugacgauaacugugacccucagacgguggccaaucggguggccugguuccgcuacuuuaacgcuggacagaccugcgucgcgcccgauuaugugcucuguagcccggaaaugcaagagagacugcugccugcccuccaguccacaauuacccgguucuacggcgacgauccccagagcucuccuaaucuggggcgcaucauuaaccaaaagcaguuucagagacuucgggcucugcucggaugcggcagaguugccaucggcgggcaguccgacgaaagcgaccgcuauauugcccccacagugcuggucgaugugcaagagauggagcccguuaugcaggaagagaucuucggaccuauucuuccgaucgugaauguccagucucuggacgaagcuaucgaguucauuaaccggagagaaaaaccccucgcccuguacgcguuuuccaauagcucucagguggucaagcgcgugcugacccaaacguccagcggcggguucuguggaaacgauggcuuuaugcauaugacacucgcuucccugccuuucgggggaguuggcgccucuggcauggggcgguaccacggaaaguuuagcuucgacaccuuuucccaccauagagccugccuucugcgcagccccggcauggagaaacucaacgcucugcgguauccuccccagucuccgagacgccugcggaugcuucucguggccauggaggcucagggguguuccugcacacugcuguga

SEQ ID NO: 65722 - RNA, 1539 nt, Artificial Sequence
  derived and/or modified sequence opt5 from ALDH4A1__Homo_sapiens__NP_001306147
augcugcuccccgccccugcucugagacgggcccuucugagccgcccguggaccggcgcggggcucagauggaagcacacauccucucugaaaguggcuaacgagcccguccuugccuucacgcagggaagcccugaacgggacgcccugcaaaaggcucucaaagaucugaagggccgcauggaggccauccccugcguugugggggacgaagagguguggaccuccgauguccaguaccaggugucuccuuuuaaucauggacacaaaguugcuaaguucuguuaugccgacaagagccugcucaacaaagcgauugaagccgcucuggccgcuagaaaggagugggaucuuaaacccaucgccgaccgggcgcagauuuuucugaaggccgcugauaugcucuccggcccucgcagagccgagauccuggcuaaaacaaugguggggcaaggaaagaccgucauucaggccgaaaucgacgccgcugcggagcuuaucgauuucuuucgguucaaugccaaguacgcuguggaacuggagggccagcagccgauuucuguucccccuagcacaaacuccaccguguaucgcggccucgagggguuugucgccgccaucagccccuucaauuuuacagcuauuggaggcaaccuggccggggcgccugcucugaugggaaauguggugcucuggaaacccucugacaccgccaugcuggccuccuacgcugucuauagaauccuucgggaagccggccugccgccuaacauuauccaauucguucccgcugaugggccucucuuuggagacacggugaccagcucugagcaucugugcggcauuaauuucacaggcuccgugcccaccuuuaagcaccuuuggaaacaggucgcccagaaccuggaucgcuuccauacauuccccagacucgcgggggaauguggaggcaagaauuuucacuucgugcaccggagcgccgacguugagucuguggucuccgggacccugcgcagcgcuuuugaauacggaggccagaaaugcuccgccuguucuagacuguaugugccucauagccucuggccgcaaaucaaggggcggcugcuugaggagcacuccagaaucaaaguuggagaccccgcugaagauuucggcacguuuuucagcgccgugauugacgcgaaggagaucuuuggcccuguccugucuguguacgucuaccccgaugacaaguauaaagaaacacuccagcugguggauuccaccacaagcuacgggcuuaccggagccguuuucucucaggacaaggaugugguccaagaggcuaccaaagugcugcgcaacgccgcuggcaauuuuuauauuaacgacaagagcacaggguccaucguuggacagcagccuuucggcggggcccgggccucuggcacgaaugauaaacccggaggcccgcauuacauucucagauggaccagcccucaggugaucaaggaaacacacaagccccugggggacugguccuaugcuuacaugcaauga

SEQ ID NO: 65723 - RNA, 1647 nt, Artificial Sequence
  derived and/or modified sequence opt5 from ALDH5A1__Homo_sapiens__NP_733936
auggcuaccugcaucuggcugagaagcuguggcgcucggcgccucggguccacauuccccggaugcagacugcggccucgcgccggcgggcuugugccggcgucuggacccgcuccuggccccgcccagcugagauguuacgccgggcggcucgcuggacugagcgccgcccuucugcgcacggacuccuuugucggcggcagauggcucccugccgcggccaccuuccccguucaagauccugcuucuggggccgcucugggaaugguggccgacugcggcgugcgggaggcgcgcgccgcugucagagccgcuuaugaagccuuuugucgguggcgcgaggugagcgccaaggaaagauccucucugcuccggaaaugguacaaccugaugauucagaauaaggaugaccuugcucgcaucauuacagcggagagcgggaaaccgcugaaggaagcccacggagagauccucuauuccgcuuucuuucuggagugguucagcgaagaggccagacggguuuacggcgauauuauccauacccccgccaaagacagacgcgcucuugugcugaagcagccuaucggggucgccgcggugauuacacccuggaacuuuccuucugcuaugaucacccggaagguuggagccgcccucgcugccggcugcacaguggucgugaaacccgcugaagauaccccguucuccgcccuggcgcuggccgaggugaaucagggcuuucuccuggaccuugauccucugcuccuggcuagccaagccgggauucccucuggagucuauaacguuaucccuuguuccagaaagaaugcuaaagaggugggcgaagccauuugcacggacccccuugugagcaagaucucuuucaccggguccacaaccacaggaaaaauucugcuccaccaugcggccaacagcgucaagcgcguguccauggagcugggcgggcuggcucccuuuaucguuuucgauucugccaauguggaccaggcugucgccggagccauggcuagcaaguuucggaacaccggccagacgugugugugcuccaaucaguuccucguucaaagaggcauccacgaugcguucgugaaagccuuugcugaagccaugaagaaaaaccugcgcgucgggaauggauucgaggaaggcacaacccaggggccucuuauuaacgagaaggccguggagaaagucgaaaaacaggugaaugacgcuguuagcaagggagccacaguggucaccggcgggaagcggcaucagcugggcaagaacuuuuucgagccgacccuccuguguaaugugacacaagacaugcuuugcacgcacgaagagaccuuuggaccccuggcgccuguuaucaaauucgauacagaagaggaggcuauugccaucgccaacgcugccgacgugggccucgcgggguacuuuuauucucaggaucccgcucagauuuggagagucgccgaacaacuggaggugggaauggugggcguuaacgaagggcugaucuccagcgucgagugcccuuucggaggcgugaagcagucugggcucggccgcgaaggaagcaaauacggcaucgacgaguaccuggagcuuaaguauguguguuacgggggacuguga

SEQ ID NO: 65724 - RNA, 1608 nt, Artificial Sequence
  derived and/or modified sequence opt5 from ALDH6A1__Homo_sapiens__NP_005580
auggccgcucugcucgccgcggcugccgugagagcccggauccugcaggucagcuccaagguuaaaucuagccccaccugguacuccgcuucuagcuucuccucuagcgugccuacagugaaacuuuuuauuggcgggaaguucgucgaguccaagagcgacaaauggaucgauauucacaacccggccacgaaugaagugaucggacgcguuccccaagcuaccaaggccgagauggacgcggccauugcuucuugcaagagagccuuuccugcuugggccgauacauccgugcugagccggcagcagguccuccugcgcuaucagcaacuuaucaaagaaaaccugaaggagaucgcgaaacucauuacccuggaacagggcaagacacuggccgacgcugagggggauguguucagaggacuccagguuguggagcaugccuguucugucaccucccugaugaugggcgaaacaaugcccagcaucaccaaagacauggaucuuuacucuuaucggcugccucucggggugugcgcuggaauugcccccuuuaauuucccugccaugaucccgcuguggauguuucccauggcuaugguguguggcaacacguuccuuaugaagccuuccgagcgcguccccggcgcgaccaugcugcucgccaagcugcugcaggacagcggggcuccugauggaacacucaauauuauccacggccaacaugaagccguuaacuuuauuugcgaccaccccgauaucaaagccaucuccuucguggggucuaauaaggcuggagaguacauuuuugagagaggcagccggcaugggaaacgcgugcaggccaacaugggagcgaagaaucacggcgucgugaugccggacgcuaacaaagaaaauacccugaaccagcuuguuggcgccgccuucggggcugccggacagagauguauggcucuguccacagccgugcucgucggcgaggcgaagaaauggcugccugaacuuguggagcacgccaagaaucugcggguuaacgcuggggaucaacccggagccgaccucggcccucugaucacgccccaggcuaaggaacgcgugugcaaucugauugacagcgggaccaaagagggagccucuauccuccuggauggcagaaagauuaaagucaagggcuaugagaacgggaacuuugugggacccacaaucaucuccaaugucaaaccuaacaugaccuguuacaaggaagagauuuucggcccggugcuuguugugcuggaaacagagacccucgacgaagcgauccagauugucaauaacaaucccuaugggaacggaaccgccaucuucacaacgaauggcgcuaccgcccggaaguacgcucaucugguggauguugggcaagugggcgucaacgugccuauucccgugccucuucccauguuuagcuucacaggaucucgcagcuccuuuagaggcgacaccaauuucuacgggaaacagggaauccaguuuuauacacagcugaagaccaucacgucucaauggaaagaggaggaugccacacucagcuccccggccguugucaugccuaccaugggccgguga

SEQ ID NO: 65725 - RNA, 1620 nt, Artificial Sequence
  derived and/or modified sequence opt5 from ALDH7A1__Homo_sapiens__NP_001173
auguggagacugccccgggcccucugcgugcacgcugccaagaccagcaaacuguccggcccuuggucucgcccggcggcuuucaugagcacacuucugaucaaccagccccaauacgccuggcucaaggagcuggggcuuagagaagagaaugaaggagucuauaacggcuccuggggagggcggggcgagguuauuacgaccuacuguccugccaauaacgaacccaucgcucgcgugagacaggccucuguggcugacuaugaggagacagucaaaaaggcccgggaagcguggaaaauuugggccgauaucccugcucccaagcgcggggagauugugagacagaucggagacgcccugcgggaaaagauccagguucucggcagccuggugucccuggagaugggcaaaauucucgucgagggggugggagaaguucaagaguacguggauaucugcgacuaugcugucggccugucucgcaugauugggggaccuauccuuccgagcgaaagauccggccaugcccugauugagcaguggaaucccguggggcucgugggaaucauuaccgcguuuaacuucccugucgccguuuacggcuggaauaacgcuaucgccaugaucuguggcaaugugugccuguggaagggggcucccacaaccagccuuauuucuguggccgucacaaaaaucauugccaaggugcuggaagauaacaaacucccuggagcuaucuguucccugaccugcggcggggcggacauuggaacggccauggcuaaggaugagcggguuaaucugcucagcuuuaccggcucuacacagguggggaagcaggucggacugauggugcaagagcgcuucggcagaucccuucuggaacucggcgggaacaaugccaucaucgccuuugaggacgcugaucugagccuuguugugcccucugcccuguucgcggcugucggaaccgccggccagcgguguacaaccgcccgcagacucuuuauucacgaauccauccaugacgagguggucaaccggcugaaaaaggcuuaugcccagauuagaguggggaauccgugggauccuaacguucuguacggaccccuccacacgaaacaggcugugagcauguuccugggcgccgucgaagaggcgaagaaagaagggggcacagugguuuacggaggcaaggugauggaccgcccugggaacuaugucgagcccaccaucgugacaggacuuggccaugaugccuccauugcucacaccgagaccuuugcccccauccuguacguguucaaauuuaagaaugaagaggaaguuuucgcuuggaacaaugaggucaagcaagggcucucuagcuccaucuuuacaaaagaccugggacggauuuucagauggcuuggcccuaaggggagcgacugcggcaucgugaacgugaauauuccgacgucuggagccgagaucggcggggcguucggaggcgaaaaacacaccgggggaggccgcgaguccgggagcgaugccuggaagcaguauaugcggagaucuacauguaccauuaacuacagcaaagaccugccccucgcucagggcaucaaguuucaauga

SEQ ID NO: 65726 - RNA, 1557 nt, Artificial Sequence
  derived and/or modified sequence opt5 from ALDH9A1__Homo_sapiens__NP_000687
auguuccugagagccggccucgcugcccugagcccccuucugcggucccuccgcccuucuccgguggcggcuaugagcaccgggacauuugucguuucccagccccugaacuacagaggaggcgcccggguggagccugccgacgcuucugggacggaaaaggccuucgagcccgcuaccggacgcgugaucgccacauuuaccugcagcggcgaaaaagaggucaaucuugcggugcaaaacgccaaggcugccuucaaaauuuggucccagaagucugggauggaaagaugucggauccugcucgaggcugcccgcauuaucagagagcgggaagaugagauugcgacaauggaaugcaucaauaacggaaaaagcaucuuugaggcccgccuggacauugauaucuccuggcagugucuggaguauuacgcuggccucgccgcuagcauggccggcgaacacauucagcugccugggggaucuuucggcuauaccagacgggagccccuugggguuugcgugggaaucggcgccuggaauuacccuuuucaaauugcuuccuggaagucugcgccggcccuggcuugugggaacgccauggucuucaagcccucuccuuuuacacccguguccgcccuccugcuugcugaaaucuauagcgaggccggaguuccucccggccuguucaaugugguccagggcggggcggcuaccggacaguuucucugccagcauccggacguggccaaagugucuuucacgggcuccgucccuaccgggaugaagauuauggaaaugagcgccaaaggaaucaagcccguuacacuggagcugggcgggaaauccccucucaucauuuuuagcgauugugacaugaacaaugcugugaagggagcccugauggcuaacuuccuuacccaaggccaggugugcuguaauggcacacgcgucuucgugcagaaggagauccuggauaaauuuaccgaagagguugugaagcagacgcaaagaauuaaaaucggggacccccuccuggaagauacacggaugggaccccuuauuaaccgcccucaccuggagagaguccucggcuucgugaagguugccaaagaacagggggcgaaggugcugugcggaggcgacaucuacgucccggaggaucccaaacugaaggacggguauuacaugcggccuugugugcucaccaauugcagagaugacaugacaugcgucaaggaggaaaucuuuggccccgugaugagcauucuguccuucgacaccgaggccgaaguucuugagcgcgcuaacgauaccacauuuggacuggccgcuggcguguucacgcgggacauccagagagcccaucgcgucguggcggaacuccaagccgggaccuguuuuauuaauaacuacaacguuagcccuguggagcugcccuucggaggcuauaaaaagucuggguuuggacgggagaauggcagagucacaaucgaauacuauucccagcuuaaaaccgugugcguggagaugggggauguugaaagcgcuuucuga

SEQ ID NO: 65727 - RNA, 1257 nt, Artificial Sequence
  derived and/or modified sequence opt5 from ALDOA__Homo_sapiens__NP_001230106
auggccagacggaagcccgagggcagcuccuucaacaugacccaccugucuauggcuauggccuuuagcuucccuccgguggcguccgggcagcuccauccccaacugggaaauacacagcaccagacggaacuuggcaaagagcuggcuaccacaucuaccaugccuuaccaguaucccgcccucacaccugaacaaaagaaagagcugagcgacaucgcccaucgcauugucgcucccgggaagggaauccuugccgcugaugaauccaccggcucuauugccaaaagacugcagagcaucgggacagagaacaccgaggaaaaucggcgcuuuuacagacagcuccugcugacggcggacgaucggguuaacccuugcauuggaggcgugauccucuuccacgagacccuguaucagaaggccgacgauggccgcccguuuccccaagugaucaaguccaaagggggagucgugggcauuaagguugacaaagggguggucccucuugcuggaacaaauggcgaaaccacaacccaggggcuggauggacucagcgagagaugugcccaguacaagaaagacggcgcugauuucgccaaguggcggugcgugcugaagaucggcgagcauacgcccucugcgcuugccauuauggaaaacgcuaauguucuggcccgcuaugcuuccaucugucagcaaaacgggauugugccuaucgucgagcccgaaauucucccggacggagaucacgaccugaaaagaugccaguacgugacagagaaggugcuggccgccgucuauaaagcucucagcgaucaccauaucuaccuggaaggcacccuucugaagccuaauaugguuacacccgggcacgcguguacccagaaauuuucucaugaggagaucgccauggcuaccgugacagcccuccggcgcacggugccucccgccgucaccggaauuacauuccuguccggcgggcaaagcgaagaggaggcuucuaucaaccuuaaugccauuaacaagugcccccugcucaaaccuugggcgcugaccuuuuccuacggcagagcucugcaggccagcgcccucaaggcuuggggaggcaagaaagaaaaucugaaggccgcucaggaagaguaugugaaacgggcccuugcgaacucccuggccugucaggggaaguacacaccgucuggacaagcuggcgccgcugccagcgagucccucuucguuagcaaucacgcguauuga

SEQ ID NO: 65728 - RNA, 1095 nt, Artificial Sequence
  derived and/or modified sequence opt5 from ALDOB__Homo_sapiens__NP_000026
auggcccacagauuccccgcucugacccaggaacaaaagaaagaacucagcgagaucgcccaguccauuguggcgaacggcaaggggauccuggcugccgacgaaucugucggaacaaugggcaaucggcuucagcgcauuaaaguugagaacacggaagagaauagacggcaguuucgcgagauccuguucagcguggauuccucuauuaaccaaagcaucgggggagugauccucuuucaugaaacccuguaccagaaggacucccagggcaaacuuuucagaaauauucugaaggagaaggggaucgucgugggaauuaaacucgaucagggcggcgccccucuggcugggacaaacaaggaaaccacaauccaaggacuggacggccucucugagcggugcgcccaguauaaaaaggaugggguugacuuuggaaaauggcgcgcugugcugagaauugccgaucaguguccgagcucccuugcgauccaggagaaugccaacgcucuggcccgguacgcuagcauuugccaacagaauggccucguccccaucguggaaccugagguuauccccgacggggaucacgaccuggaacauugucaguaugugaccgagaagguccuugccgcgguguacaaggcccugaacgaucaccauguguaucucgaaggaacacugcugaaaccuaauauggucaccgcuggccacgccugcacgaagaaauacacccccgagcaaguugcuauggccacagugaccgcccuccaccgcacagugccugcugcggucccgggcauuuguuuccugucugggggaauguccgaggaagacgccacccuuaaccugaaugcuaucaaccucugcccccugccuaagcccuggaaacuuagcuuuucuuauggcagagcccugcaggccuccgcucucgccgcguggggagggaaggcugccaauaaagaggccacgcaggaggcuuucaugaagcgggccauggcuaacugucaggccgcgaagggccaauacgugcauacagggagcucuggagccgcuuccacccagagccuguuuacagccugcuacaccuauuga

SEQ ID NO: 65729 - RNA, 1095 nt, Artificial Sequence
  derived and/or modified sequence opt5 from ALDOC__Homo_sapiens__NP_005156
augccccacagcuacccugcccuguccgcugagcagaagaaagaacucucugacaucgcccugagaauuguggcgccgggcaaggggauccuugcugccgaugagagcgucggauccauggccaaacggcugucucaaauuggcguugaaaacaccgaggaaaaucgcagacucuaucgccaggugcuguucagcgcugacgaucgggugaagaaaugcaucgggggagucaucuuuuuccaugagacacuuuaccagaaggacgauaacggcgugcccuuuguuagaacgauucaggacaaggggaucguggucggaauuaaaguggauaagggcguugugccucuggccggcaccgacggggagacaaccacacaaggacucgauggccuguccgaacggugugcucaguauaaaaaggacggggccgauuucgcgaaauggcgcugcguccugaagaucucugagagaacccccagcgcccucgcuauucuggaaaaugccaacgugcuugcucgguacgccuccaucugucagcagaauggaauugugccuaucgucgagcccgagauucugccugacggcgaucacgaccucaagcgcugccaauauguuacagaaaaagugcuggcggccguguacaaggcucuuagcgaccaucacgucuaucuggaggggacccuccugaaaccgaacauggugacgcccggacaugccuguccuaucaaguacacccccgaagagaucgcuauggccacaguuaccgcccugagacggacagugccucccgcugucccgggcgugaccuuucucucuggcgggcaguccgaagaggaggcgagcuucaaucugaacgccauuaaucgcugcccucuucccagaccuugggcucugacguuuucuuacggacgggcccuccaggccuccgcucugaacgccuggcgcggccagagagauaaugcgggggcugccacagaagaguucaucaaacgggccgaaguuaacggacuugcugcccaaggcaaguaugaggggagcggagaagacggcggcgcugccgcgcagucucuguacauugccaaucacgcuuauuga

SEQ ID NO: 65730 - RNA, 1422 nt, Artificial Sequence
  derived and/or modified sequence opt5 from ALG10B__Homo_sapiens__NP_001013642
auggcccagcuggagggcuacugcuucagcgcugcccucuccuguaccuuucuggugucuugccuucuguucagcgcguuuuccagagcucuccgggaacccuauauggacgagaucuuccaccuuccucaagcccagcgcuacugugaagggcauuuuucucuuagccagugggauccgaugauuacaacgcugcccggacucuaucuggucuccguuggcguggugaagccugccaucuggauuuucggguggucugagcacgucgugugcagcaucggaaugcugagauuuguuaaccuccuguucuccgugggcaauuuuuaccuucuguaucuccuguuccauaaaguccagccccggaacaaggcugccagcucuauucaacgcgugcuuuccacccugacacucgcuguuuuuccuacccuguacuucuuuaauuuccuguauuacacagaagccgggagcauguucuuuacccucuucgcguaccugaugugucuuuauggaaaccacaaaacaucugccuuucugggcuucugcggcuuuauguucagacagaccaauaucaucugggcuguguuuugugccgggaacgucauugcucagaagcucacggaggccuggaaaaccgagcugcagaagaaggaagaccggcuucccccuaucaaaggaccguucgcggaguuucgcaagauucugcaauuccuccuggccuacuccaugagcuuuaaaaaucugucuaugcucuuuugccugacauggcccuauauccuucugggcuuucucuucugugcuuucgugguggucaacgggggaauuguuaucggcgauagauccagccaugaagccugccugcacuuuccucagcuuuucuacuuuuucuccuuuacccuguucuuuucuuucccccaccuccugagcccuuccaagauuaaaacauuucugagccucguguggaagcaugggauccuguuccuuguggucacccuggugucuguuuuucucguguggaaguucacguaugcucacaaauaccugcuggccgacaaucggcauuauacauuuuacgucuggaagcgcguguuccagagauacgccauccuuaaauaucuccugguucccgcuuacauuuucgcgggaugguccaucgccgauagccugaagucuaaaccgauuuucuggaaccucauguucuuuaucugucuguucauugugaucgucccucagaagcugcuggaguuucgguauuucauccuccccuacgugauuuaucgccugaauaucacccugccucccacaagcagacuugucugcgagcucuccugcuacgcuauugugaacuuuaucaccuucuauauuuuucugaauaaaaccuuccaauggcccaacucucaggacauccagcgguuuaugugguga

SEQ ID NO: 65731 - RNA, 1422 nt, Artificial Sequence
  derived and/or modified sequence opt5 from ALG10__Homo_sapiens__NP_116223
auggcccagcuggagggcuacuauuucagcgcugcccucuccugcaccuuucuggugucuugucuucuguucagcgcguuuuccagagcucuccgggaacccuacauggacgagaucuuccaccuuccucaagcccagcgcuauugcgaagggcauuuuucucuuagccagugggauccgaugauuacaacgcugcccggacucuaccuggucuccaucggcguuauuaagccugccaucuggauuuucggguggucugagcacgugguguguagcaucggaaugcugagauuugucaaccuccuguucuccgugggcaauuuuuaucuucuguaccuccuguucugcaaaguucagccccggaacaaggcugccagcucuauccaacgcgugcuuuccacccugacacucgcugucuuuccuacccuguauuucuuuaauuuccuguacuacacagaagccgggagcauguucuuuacccucuucgcguaucugaugugucuuuacggaaaccauaaaacaucugccuuucugggcuucugcggcuuuauguucagacagaccaauauuaucugggcuguguuuugugccgggaacguuauugcucagaagcucacggaggccuggaaaaccgagcugcagaagaaggaagaccggcuucccccuaucaaaggaccguucgcggaguuucgcaagauucugcaauuccuccuggccuauuccaugagcuuuaaaaaucugucuaugcuccugcuucugacauggcccuacauccuccugggcuuccuguuuugcgcuuucguggucgugaacgggggaauugugaucggcgauagauccagccacgaagccugucugcauuucccucagcucuuuuauuucuuuuccuucacccuguuuuucucuuuuccccaccuucucagcccuuccaagaucaaaacauuccugagccuugucuggaagcggcgcauucuguuuuucguugugacccucgugucugucuuucugguguggaaguucacguacgcucacaaauaucugcuugccgacaauagacauuacacauuuuacguuuggaagcggguguuccagcgcuaugagaccgucaaauaccuccuggugcccgccuauaucuucgcugggugguccauugcggauagccugaagucuaaaagcaucuuuuggaaccucauguucuuuauuugccuguucacaguuaucgugccgcagaagcugcuggaguuuagauacuucauccucccuuaugucauuuaccggcugaauaucccccugccucccaccucccgccuuauuugugaacucucuugcuaugccguggucaacuuuaucaccuucuuuauuuuccugaauaaaacauuucaauggcccaacagccaggacauccagagauucaugugguga

SEQ ID NO: 65732 - RNA, 1479 nt, Artificial Sequence
  derived and/or modified sequence opt5 from ALG11__Homo_sapiens__NP_001004127
auggccgcuggcgagagaagcuggugccuguguaagcuccugcgguucuuuuacucccuuuucuuucccgggcugaucgugugcggaacccucugugucugccugguuauugugcuuuggggcauccgccugcuccugcagagaaagaagaaacuggugucuacaagcaagaacgggaaaaaucaaauggucauugccuucuuucacccuuauuguaacgcgggaggcgggggagaacgggugcucuggugcgcucugcgcgcccuucagaagaaguacccggaggccguuuauguggucuacacgggcgacgugaauguuaacggccagcagauccuggaaggggcuuucagacgguuuaauauucgccucauccaucccgugcaauucgucuuucugagaaaacgguaucuuguggaggauucccuguacccucacuucacccuccugggacagucucugggcagcaucuuucucgggugggaagcccugaugcagugugugcccgacgucuauauugauuccaugggauacgcuuucacacuuccucuguuuaaguacaucggcgggugccagguuggaucuuaugugcauuaccccaccauuagcacagacaugcucuccguggucaaaaaccaaaauaucggcuucaacaaugccgcguucauuacccgcaacccuuuucugagcaaggugaaacuuaucuauuacuaucuguucgccuuuauuuacggccucguugggucuuguuccgauguggucauggugaauagcucuuggacacugaaccacauccugucccucuggaagguuggaaauugcaccaacaucguguauccgcccugugacguccagacguuccuggauauuccucuucaugagaagaaaaugacccccggccaucugcucgugagcgucgggcaguuuagaccugagaagaaucacccccugcagauccgggcuuucgccaaacuucugaacaagaaaaugguggaaucuccgccuucccucaagcugguucugauuggaggcugccgcaacaaagacgaugagcucagagugaaucaacugcggcgccuuagcgaagaccuggggguccaggaguacguggaguuuaagaucaacauucccuucgaugaacucaagaauuaccuguccgaggcuacaaucggacugcacaccauguggaacgaacacuuuggcaucggcguuguggagugcauggccgcggggacaauuauccuugcccauaauucuggaggcccuaaacucgacauugucgugccccacgaaggggauaucaccggauuccuggcugagagcgaggaagacuaugccgagacgauugcucacauccuguccaugagcgccgaaaagagacuccagauccggaaaucugccagagcuuccgugagccgcuuuucugaccaagaguucgaaguuacauuucugagcuccgucgagaaacuuuucaaauga

SEQ ID NO: 65733 - RNA, 1467 nt, Artificial Sequence
  derived and/or modified sequence opt5 from ALG12__Homo_sapiens__NP_077010
auggccggcaaggggagcuccggaagacggccccugcuccugggccuucugguggcugucgccaccguucaccucgugaucugcccuuacacaaaaguggaggaaucuuucaaccugcaggcgacgcaugaccuucuguaucacuggcaagaucucgagcaguacgaccaucuggaauuuccgggggucgugccccgcaccuuccugggaccuguugugauugcugucuuuagcucccccgccguguauguucucucucugcuugagaugagcaaguucuacucccagcugaucgugagaggcguccucgggcugggagugauuuuuggccuuuggacacugcagaaagaagugcggcgccacuucggcgccauggucgcuaccauguuuuguuggguuacagccaugcaauuccaucucauguuuuauugcaccagaacacugccuaaugugcuggcucuccccgugguccugcuugcccuggcggccuggcuccggcacgagugggcucgcuucaucuggcugucugccuuugcuauuaucguguucagaguugagcuuugucuguuucucgggcugcugcuccugcuugcccugggaaaccggaaggugagcgucgugcgcgcgcucagacacgccguuccugcuggcauccugugccuugggcugaccguggccgucgauuccuacuucuggcggcagcucacguggccggaaggaaaagugcugugguauaauaccguccugaacaagagcucuaauuggggcacaagcccccuccugugguacuucuacuccgcucugccucgcgggcugggauguucucuccuguuuauuccccugggccuuguggacagacggacccaugccccuacaguucucgcccugggcuucauggcucuguauucccuccugccccacaaggagcuucgcuuuaucauuuacgcguucccgaugcugaacaucaccgccgcuagagggugcagcuaucuccugaauaacuacaaaaagucuuggcuguauaaagccggaucccuucucgugauuggccaucuggucgugaaugccgcuuacagcgccacggcgcuguauguuucccacuuuaacuacccugggggaguggcuaugcagcggcuccaccagcuggugcccccucaaacagauguccuucugcauaucgacguggccgccgcucagaccggcguuucuagauuccuccaggucaauagcgccuggcgcuacgauaagcgggaagacgugcagcccgggacaggaaugcuggcuuauacccacauucugauggaggccgcgcccggccuucucgcccuguacagagauacccaucgcgugcuggcuuccgucgugggcacaacggggguuagccucaaccugacccaacuuccuccguuuaaugugcaccuucagacaaaacucguccugcuggagcggcuucccagaccuucuuga

SEQ ID NO: 65734 - RNA, 3414 nt, Artificial Sequence
  derived and/or modified sequence opt5 from ALG13__Homo_sapiens__NP_001093392
augaagugcguguucgucaccguuggcacaacgagcuuugacgaucugaucgccuguguguccgcucccgacucucuccagaaaauugagagccugggguacaacagacuuauccugcaaauuggacggggcaccguggucccugaaccguucuccacagagucuuuuacccucgauguguaucgcuacaaggacagccugaaagaagauauccagaaggccgaccuuguuauuucccacgcgggggcuggaucuugccuggagacacucgaaaaaggcaagccccugguggucgugaucaaugagaagcugaugaacaaucaucagcucgagcuggccaaacagcuucacaaggaagggcaucuguucuauuguaccugcagaguucucacauguccuggacaagccaaaagcaucgcuuccgcccccggcaagugccaggauagcgcugcccugaccucuacggcguuuuccggccuugacuucgggcugcucagcggauaccugcacaaacaggcccuggugaccgcuacacauccuaccuguacacuccuguuucccucuugccacgccuucuuuccucuuccgcugacccccacgcucuauaagaugcacaagggcuggaaaaacuacuguucccagaaaagccugaaugaggcuucuauggaugaauaucuugggucccugggacucuuccggaaacugacagccaaggacgcgagcugccuguuucgcgccauuuccgagcaacucuucuguucucagguccaucaccuggagaucagaaaggcuugcgugagcuacaugcgggaaaaccagcagaccuuugaguccuacguggaaggcagcuucgagaaguaucuugaacgccugggggauccuaaagagucugccggacaacucgagauuagagcucugucccuuaucuacaaucgggacuucauucuguaucgcuuucccggcaagccucccacauacgucaccgauaacggcuaugaagacaagauccuccugugcuacagcucuagcgggcauuaugacuccguuuacucuaaacaguuccagagcuccgccgccgugugucaagcugugcuguacgagauucucuauaaggaugucuuugugguugacgaagaggaacugaaaaccgcgaucaaacuuuucagaagcggaucuaagaagaaucggaacaaugccgugacaggcuccgaggaugcucacacggacuacaagagcucuaaccagaaucgcauggaggaauggggagccugcuauaacgccgagaauaucccggaaggguacaacaaaggcaccgaggaaacaaaguccccugagaaccccagcaaaaugccuuuucccuauaagguccugaaagcucucgaucccgagauuuacagaaauguggaguucgacguuuggcuggauucccggaaggaacugcagaagucugacuauauggaauacgccgggcgccaguacuaucuuggagauaaaugucaagugugccucgagagcgagggcagauacuauaacgcgcacauccaggaagucggcaaugagaacaauuccgugaccgucuuuauugaggaacuggcugaaaagcaugugguuccucuggccaaccucaaaccggugacacaggucaugucugugcccgccuggaaugcuaugccuagccggaaggggagaggauaccagaaaaugcccggcggguauguuccugagaucgugauuuccgagauggacaucaagcaacagaagaaaauguucaagaaaauccgcggaaaggaagucuacaugaccauggccuauggcaaaggggauccccugcuuccgccucggcugcagcacagcaugcauuacggccacgaucccccuaugcauuacucucagacggcuggaaacgugauguccaaugagcacuuucacccccaacauccuagccccagacagggccgcggguauggaaugccgcggaacucuuccagauucauuaaucgccacaacaugccuggccccaagguggacuuuuaccccgggccuggaaaacgguguugccagagcuaugacaauuucucuuacagaagccgcuccuuucggagaagccaucgccagaugucuuguguuaacaaggaaucccaauauggcuucacaccggggaauggccagaugccccggggacucgaggaaaccaucaccuucuacgaggucgaggaaggcgacgagacagccuauccuacccugcccaaccacgggggaccuagcacaauggugcccgcgacguccggcuacugcguggggagacggggacacucuagcggcaagcagacccugaaccuugaagaggggaauggccaauccgaaaacggacgcuaccaugaggaguaucucuacagagccgaaccugauuaugagacaucuggcgucuacagcaccacagcuuccaccgccaaucugucucugcaggaccggaaaagcuguuccaugagcccccaggauacggugaccucuuauaacuacccgcagaagaugauggggaauauugcugccguugcggccuccugcgcuaacaaugugccugcccccguccucagcaacggagcugccgccaaucaagcuaucucuacaaccuccgugagcucucagaacgcgauucagccucuguuuguuagcccucccacacacggcagacccgugaucgccucccccuccuauccuugucauagcgcuaucccccacgccggggccucucuucccccuccgcccccucccccucccccuccgcccccucccccucccccgccuccgcccccucccccuccgcccccucccccugcucuggacgucggagaaaccagcaaucuccagcccccgccuccccugccucccccucccuacuccugcgauccgucuggcagcgaccugccucaagauacgaaagugcuucaguacuauuucaaccucgggcugcagugcuacuaucauuccuacuggcacucuaugguuuaugugccccagaugcaacagcagcugcacgucgagaauuaccccguguauacagagccuccgcucguggaccaaaccgucccccaguguuacagcgaaguucgccgggaggauggcauucaggccgaagcguccgcuaacgacacauuuccuaaugccgauucuagcuccgugccccauggagccguguacuauccugucaugagcgaccccuacggccagccuccgcugcccggguucgacucuugccuuccugugguucccgauuauuccugugugccucccuggcacccggucggaaccgcuuacggcgggagcucucaaauccauggagccauuaacccuggccccaucggcugcauugcgcccuccccucccgcuagccacuaugugccucaggggauguga

SEQ ID NO: 65735 - RNA, 1395 nt, Artificial Sequence
  derived and/or modified sequence opt5 from ALG1__Homo_sapiens__NP_061982
auggccgcuagcugccuggugcuccuggcccuuugucugcuccugccccuucugcuccugggcggguggaagagauggcggcgcggcagagcggcucggcacgucguugccguggugcugggagacgucgggcgcuccccuagaaugcaguaccaugcccucucucuggcuaugcacggauucagcgugacccuucugggcuuuugcaacuccaagccgcaugaugagcuccugcaaaauaaccggauccagauuguugggcuuacagaacugcagucucucgccgugggaccccgcgucuuccaguauggcgugaagguugugcugcaagcuauguaccugcucuggaaacugauguggagagagccuggcgccuauaucuuucuucagaaucccccugggcugcccagcauugcggucuguugguucgugggaugccucuguggcuccaagcuggugaucgacuggcacaacuacggguauucuauuaugggacuuguccauggcccuaaucacccgcugguucuccuggccaaaugguacgaaaaguuuuucgggcggcugagccaccucaaccugugcgugacgaaugcuaugcgcgaggaucuugccgacaacuggcauaucagagcugugaccgucuaugauaagcccgccuccuuuuucaaagaaacaccucuggaccuccagcaccggcuguuuaugaaacuuggaagcaugcauucucccuuccgcgcgagauccgagccugaggaucccgugaccgaacggagcgccuuuacagagcgcgacgcuggcucuggccugguuaccagacuccgggaaagaccggcccugcugguguccagcacaucuuggaccgaggaugaggacuucuccauccuccuggcugcccuugaaaaauuugagcagcugacgcucgaugggcacaaucugccuagccuggucugugugauuaccggaaagggcccccuucgcgaauacuacucccggcucauccaccaaaaacauuuccagcacauucagguuugcacaccuuggcuggaggccgaagacuauccccugcuccuggggucugcugaucuuggagugugucugcauaccagcuccagcggccucgaccugcccaugaaggucguggacauguucgggugcugucugccugucugcgcggugaacuuuaagugccuucacgagcucguuaaacaugaggaaaauggacugguguucgaggauucugaggaacuggccgcucagcuccaaaugcuguuuuccaacuucccggaccccgccggcaaacuuaaucaguuuagaaagaaccugcgcgaaagccagcaacuccggugggaugagucuuggguccagacagugcugccucugguuauggacaccuga

SEQ ID NO: 65736 - RNA, 564 nt, Artificial Sequence
  derived and/or modified sequence opt5 from ALG1L__Homo_sapiens__NP_001015050
auggagagaagcgccuucauggaacuggacgcuggcucccggcucgugaugcaucugcgcgaguggcccgcccuucuggucucuagcaccggguggacagaauuugagcagcucacgcuggauggacacaaccuuccuucccugguuugcgugaucaccggcucuguggaccucggggucugucugcacaugagcuccucuggacuggaucucccgaugaaggugguugacauguucggcugcugucugcccgugugcgcggucaauuuuaaaugucuucaugaacuggugaagcacgaggagaacgggcucguuuucgaagauagcgaggaacuggcugcccuucaaaugcuguuuuccaauuucccugaccccgccggaaaacucaaccaguuuuggaagaaucugagagagagccagcagcugcggugggaugagucuugggugcaaacaguccucccucuggugauggacauucagcuucugggccagcgccucaaacccagagauccuugcuguccgucccggagcuucuuuucugaaucccagggcaagcccuucuga

SEQ ID NO: 65737 - RNA, 1251 nt, Artificial Sequence
  derived and/or modified sequence opt5 from ALG2__Homo_sapiens__NP_149078
auggccgaggaacagggcagagagcgggacagcgugcccaagccuuccguccuguuccuccacccggaucuggggguuggaggcgcugaacgccuugugcuggacgccgcgcucgcucugcaagccagagggugcucugugaaaaucuggaccgcccauuacgaucccggacacuguuuugcugagagccgggaacuuccuguccgcugcgccggcgacuggcugcccagagggcucggauggggcggccgcggggcugccgugugugcguauguucggaugguguuccuggcccuguacguccucuuucuggcugaugaggaguucgacgugguugugugcgaucaggucuccgccuguauuccuguguuuagacuugcucggcgcagaaagaaaauccuguucuauugccauuuucccgaccuccugcuuacaaagcgggauucuuuccugaaacgccucuacagagccccuauugacuggaucgaagaguauacgaccggaauggcggauuguauucuggugaacagccaguuuacagccgcugucuucaaggaaaccuuuaagucccugucucacaucgacccggauguucucuaccccagccugaaugugacauccuucgacagcguggucccugagaaacuugacgaucuggugcccaagggcaaaaaguuucuccugcuuucuaucaaccgguaugagcgcaaaaagaaucugacccucgcccuggaagcucugguucagcucagagggcggcugacaucccaagacugggagagagugcaucuuauugucgccggaggcuacgaugaacgcgugcuggagaacguugaacacuaccaggagcucaagaaaauggugcagcagagcgaccuggggcaauaugucaccuuccuucggucuuucuccgauaagcagaaaaucagccugcuccacucuugcacgugugugcuguacaccccuuccaaugagcauuuuggaauugucccccuggaagccauguauaugcagugcccggugaucgcuguuaacagcggcggcccucucgaguccauugaccacucugugacaggguuccugugugaacccgauccuguccauuuuagcgaggcgaucgaaaaguucauuagagagcccucccuuaaagccaccaugggacuggcuggccgcgcccgggugaaggagaaauuuagccccgaagccuucacagagcagcucuacagauauguuaccaagcugcugguguga

SEQ ID NO: 65738 - RNA, 1173 nt, Artificial Sequence
  derived and/or modified sequence opt5 from ALG3__Homo_sapiens__NP_001006942
auguuccccgcccaggcuaaggagaacgccggcuuuagcgggugcggaggcgacaccgaaaucgauuggaaagcguacauggcugagguggaaggggucauuaauggaacauaugacuacacgcaacugcagggcgauaccgggccucucguuuauccggccggauucguguacaucuuuaugggccuguauuacgccacauccagaggcaccgacauucggauggcucagaacaucuucgccgugcuuuaucuggcuacacuccugcuugucuuucugauuuaccaccagaccuguaaggugcccccuuucguuuucuucuuuaugugcugugccucuuaccgcgugcauagcaucuucguccucagacuguuuaaugaucccguggcgaugguucugcucuuucuguccaucaaccuucugcucgcccaacgguggggguggggaugcugcuuuuucucucuggcugugagcgucaaaaugaaugugcuucuguucgccccuggccuccuguuucugcuccugacacaguucggguuucgcggagcucugcccaagcugggcauuugugccgggcuccaggugguccugggacuuccuuuccugcucgagaacccguccggcuaucugucucggagcuuugaccugggcagacaguuccucuuucacuggaccguuaauuggcgcuuccugcccgaagcgcuuuuucugcauagagccuuccaccucgcucugcuuacggcccaucugacccuccugcugcucuuugcucugugucgguggcaccgcacaggggaguccauccuuagccugcucagagauccuucuaaacggaaggugcccccucaaccccugaccccgaaccagauuguguccacacuguucaccagcaauuuuaucggaauuugcuucucucgcucccuucacuaccaguucuaugucugguacuuucauacgcucccuuaucugcugugggccaugcccgccagauggcucacacaccuucuucggcugcucgugcugggccugaucgagcuuagcuggaacaccuacccuucuacauccuguagcuccgcugcgcuccauauuugccacgccguuauccugcugcagcucuggcuggggccccaacccuucccuaagucuacccagcacagcaaaaaggcucauuga

SEQ ID NO: 65739 - RNA, 1404 nt, Artificial Sequence
  derived and/or modified sequence opt5 from ALG8__Homo_sapiens__NP_001007028
auggccgcucugaccaucgccacaggcacggggaacugguucagcgcgcucgcucugggagugacccuucugaagugccuccugauucccacauaccacuccaccgacuuugagguccauagaaauuggcuugccaucacacacucucugccuauuagccagugguauuacgaagccaccuccgaguggacacucgauuauccgcccuucuuugcuugguucgaauacauccugucucauguugccaaauauuuugaccaagagaugcugaacgugcacaaucucaacuacagcuccucucggacccugcuuuuccagcgcuuuagcgugauuuucauggauguccuguuuguguaugcuguuagagaauguugcaaguguaucgacggcaaaaagguggggaaagagcucacggagaagccuaaguucauccuguccguccuucugcucuggaauuuuggacugcugauuguggaucauauccacuuccaguacaacggcuuucucuucgggcugaugcuucugagcauugcccgccucuuccagaaacggcacauggaaggagcguuucuguucgccguucuucugcauuuuaagcacaucuaccucuauguggcucccgccuacggcgucuaucugcugagaucuuacugcuucaccgcuaauaaaccugacggcuccauucgguggaagucuuuuagcuucgugcgcgugaucucccucgggcuggucguuuuucuugugagcgcccugucucucggacccuuccuggcgcuuaaccaacugccucagguguuuuccagacucuucccguuuaaacggggccugugucaugccuauugggcucccaauuucugggcccuguacaacgcucucgauaagguccugagcgugauugggcuuaagcugaaauuucucgacccuaauaacauccccaaggccuccaugacaucuggacugguucagcaguuccaacacaccgugcugccuagcgucacaccccuugccacccucaucugcacgcugauugcuauccugccguccauuuucugucucugguuuaaaccucagggcccccgcggguuccugagaugccuuacacugugugcgcucagcucuuuuauguucggauggcacgugcaugagaaggccauccugcuggcuauucuuccuaugucccuccugagcguuggcaaagccggcgaugccucuaucuuucugauccucaccacaaccgggcacuauagccuguucccccuucuguuuaccgcucccgaacucccuauuaagauccugcugaugcuucucuucacaauuuacuccaucucuagccugaaaacgcuguuucggcgcuccuucacccucguggcccaggcgggaguccaguggcaugaccugagcuga

SEQ ID NO: 65740 - RNA, 1836 nt, Artificial Sequence
  derived and/or modified sequence opt5 from ALG9__Homo_sapiens__NP_001071158
auggccagcagaggcgcucggcagcgccugaagggguccggagccucuagcggcgacaccgcgcccgcugccgauaaacucagagagcugcuugggucccgggaagccggaggcgcugagcaccgcacagaacugucugggaacaaggccggacaagugugggcuccugagggcagcacggccuucaaaugccuccuguccgcgagacuuugugccgcucugcucucuaauaucagcgacugcgaugaaaccuuuaacuacugggagccgacacauuaucugauuuacggcgagggguuccagaccugggaauauucccccgccuacgcuauccggagcuaugccuaccugcuccugcacgcguggccugccgcuuuucaugcccgcauucuucagacaaauaagauccuggucuucuauuuucucagaugucugcuugcuuucguuucuugcauuugugagcuguacuuuuacaaagccgugugcaagaaguucggacuccacgugucccggaugaugcuggccuuucugguccucagcaccggcauguucuguucuuccagcgcuuuucugcccucuuccuucugcauguauacaacccuuaucgcgaugacggggugguacauggacaaaaccagcaucgccgugcugggaguugcugccggcgccauucucggguggccuuuuuccgcugcccugggacuucccaucgcguucgaucugcucgugaugaagcaucgcuggaaaucuuucuuucacuggagccugauggcucugauucucuuccuggucccugugguugugaucgacuccuauuacuauggcaaacuugucauugccccgcugaacaucgugcucuacaauguguuuacaccccacggcccugaucuguaugggaccgaacccugguacuucuaccuuauuaacggauuucugaauuucaacgucgccuuugcucucgcccugcugguucucccucugacaagccuuauggaguaucugcuccagagauuccaugugcaaaaucugggccaccccuacuggcugacccuugcuccgauguauaucugguuuaucauuuucuuuauccagccucauaaggaggaacgguuccucuuucccguguacccucugauuugucugugcggggccgucgcgcucucugcccugcagaaguguuaucacuucguguuccagcgcuacagacuugagcacuauacgguuacauccaacuggcuggcucucggaaccguguuucuguucggccugcuuagcuuuucucggagcgucgcccucuuccgcggguaccauggaccccuggaccuguaccccgaauuuuauagaaucgcuacagauccuaccauucacaccgugccggagggccggcccguuaaugugugcgucggcaaggaaugguacagauucccuuccucuuuucuccugcccgacaacuggcaacuucaguucaucccuagcgaguuucgcgggcagcugcccaaaccguucgccgagggaccucucgcgacacggaucgugcccacggauaugaaugaccagaaccuggaggaaccuuccagauauauugauaucagcaagugccauuaccuggucgaccuugacaccaugcgcgaaacaccccgggagccuaaauauucuuccaauaaggaagaguggauuagccucgccuacagacccuuucuggaugcuucucgcuccagcaaacugcuccgggccuucuaugugccguuucuguccgaccaauacaccguuuacgugaacuauacaauccuuaagccuagaaaagcuaagcagauucgcaagaaaucuggcggguga

SEQ ID NO: 65741 - RNA, 1170 nt, Artificial Sequence
  derived and/or modified sequence opt5 from ALKBH1__Homo_sapiens__NP_006011
augggcaagauggccgcugccguggggagcgucgcgacccuggcuacagagcccggagaagacgccuucagaaaacucuuucgguucuaccgccaguccagaccuggcacggccgaucuggaggggguuaucgacuuuucugcugcccacgcugcccggggaaagggcccgggggcgcagaaagugauuaagagccagcuuaacguguccucugucagcgaacagaaugccuaucgcgcuggacugcagcccguguccaaauggcaagccuacggccucaagggcuauccuggguucaucuuuauucccaacccuuuccugcccggauaccaguggcauuggguuaagcagugccuuaaacuguauucucagaagccuaauguguguaaccucgauaaacacaugagcaaggaggaaacccaagaccugugggagcaguccaaagaguuucugagauacaaggaagcuacaaagcggcgcccgagaagccuccuggagaaacuucggugggucaccgugggcuaucauuacaauugggauucuaagaaauacuccgccgaccacuauacacccuucccuagcgaucugggguuucucucugaacagguugcggccgcuugcggauucgaggacuuucgcgccgaggcuggcauccugaacuacuauagacuugauuccacccuggggauucauguggaccggagcgaacucgaucacucuaagccccugcuguccuucagcuuuggacaguccgccaucuuccuccugggcggccuucaacgcgacgaggccccuacagcuauguucaugcacucuggggauaucaugauuaugagcggauuuuccagacugcucaaucaugcggucccccgggugcugccgaacccugaaggcgaggggcuuccccacugucuggaagccccucuccccgcugugcugccccgcgacagcauggucgagccuugcucuauggaggacuggcagguuugugccuccuaccugaaaaccgccagagugaauaugacggugcggcagguccucgcuaccgaucaaaacuucccgcuggaacccaucgaggacgaaaagagagauauuagcacagagggauuuugccaucuugacgaucaaaauucugaagugaaacgcgcccggaucaacccugacagcuga

SEQ ID NO: 65742 - RNA, 786 nt, Artificial Sequence
  derived and/or modified sequence opt5 from ALKBH2__Homo_sapiens__NP_001001655
auggacagauuccuggugaagggcgcccaagggggacuccugcggaaacaggaggaacaggagcccaccggcgaggaaccugcuguccuugggggagauaaggaaagcacacgcaaaagaccgcggcgcgaggcccccggcaacgggggacacuccgcgggcccuucuuggagacauauccgggcugagggccuggacugcagcuacacgguucucuuugggaaggccgaagccgaugagauuuuccaggaacuggagaaagagguggaauauuuuaccggagcucuugcccgcgugcaggucuucggcaaguggcacuccgugcccagaaagcaagcuacauacggggacgccggacugaccuauacauuuucuggccucacccugagcccuaaacccuggaucccuguucuggagcggauucgcgaucauguguccggggucacaggacagaccuucaauuuugugcucaucaacagauacaaggacggcugugaucacauuggcgaacaucgggacgaugagcgcgaacuggcgccggggucucccaucgccagcguuuccuucggagcuugcagagacuuuguguuccggcacaaagauagccgcggcaagucuccuuccagacgggucgccguggugagacuuccccuggcucacgggagccuccugaugaugaaucauccuacgaacacccacugguaucauucucuucccguccgcaaaaagguucuggccccgcgggugaaucucacauuuagaaagauccugcugaccaaaaaguga

SEQ ID NO: 65743 - RNA, 861 nt, Artificial Sequence
  derived and/or modified sequence opt5 from ALKBH3__Homo_sapiens__NP_631917
auggaggaaaagagacggcgcgccagagugcagggcgcuugggccgcgcccgucaaaagccaagcuaucgcccagccugccaccacagcuaagucccaucugcaccagaaaccggggcagacguggaagaacaaagagcaccaucucucugaccgggaguucguuuuuaaggaaccccaacagguggugcgcagagccccugaaccccgggucauugaucgcgagggaguguacgagaucagccuguccccuaccggcguuucuagagugugccuuuaucccggguucgucgacgugaaggaagcugauuggauucuggagcagcucugucaggacguuccuuggaaacaacggacaggaauccgcgaagauauuaccuaccagcagccgagacugacagccugguauggcgagcuucccuacaccuauagccggaucacaauggagccuaauccccacuggcauccugugcugcgcacccucaagaacagaaucgaagagaauacggggcacaccuuuaacucccugcugugcaaucucuaccggaacgaaaaagacucugucgauuggcacagcgacgaugagcccucccugggacgcuguccgauuaucgcgagccuuucuuucggcgccacaagaaccuuugaaaugcggaagaaaccucccccugaggagaauggcgacuauacauacguggaaagagugaagauuccccuggaucaugggacccuccugaucauggagggagcuacgcaggccgacuggcaacaccgcguccccaaggaauaccauucccgggagccuagaguuaaccuuacauuccgcaccguguauccggauccccggggcgcuccuugguga

SEQ ID NO: 65744 - RNA, 666 nt, Artificial Sequence
  derived and/or modified sequence opt5 from ALKBH7__Homo_sapiens__NP_115682
auggccggcaccgggcugcucgcucugagaacacuucccggaccuagcugggugcggggcuccgggccgucuguccugagccgccuccaggacgccgcgguugugagacccggauuccuguccacggcugaggaagagacccuuucucgggaacuggagccugaacuccgcagacggcgcuacgaguaugaucacugggacgccgccauccauggcuuuagagagacagaaaagagccggugguccgaggcuucucgcgccauucugcaaagagugcaggcugccgcguucgggcccggacagacccugcucagcuccguccacgugcuggaucuugaagcccggggcuacaucaaaccucauguugacagcauuaaguuuugcggcgcuacaaucgccgggcugucucuccugucccccagcgugaugcgccuuguccacacccaggagccuggagaguggcuggaacuccugcuggagccgggcucucucuauauucugagaggguccgcucgguacgauuucagccaugaaauccuucgcgacgaggaauccuuuuucggagagagacggauccccagaggccgccggauuucugugaucuguagaagccugccugaggggaugggacccggcgaauccggccaaccucccccggccugcuga

SEQ ID NO: 65745 - RNA, 2004 nt, Artificial Sequence
  derived and/or modified sequence opt5 from ALKBH8__Homo_sapiens__NP_001287939
auguucgccauggacagcaaccaccaguccaauuacaagcugucuaaaaccgagaagaaauuucucagaaagcaaaucaaagcuaagcauacacugcuucggcacgaaggcauugagacggugagcuaugccacccagucccuggucguugcgaacgggggacucggcaauggggugucucgcaaccagcugcuucccgugcuggaaaagugcggacucgucgaugcucugcugaugccuccgaauaaacccuacagcuucgccagauaucggacaaccgaggaauccaagcgcgccuacgugacacucaacggcaaagagguuguggacgaucuggggcagaagaucacccuuuaucugaauuuugucgagaaagugcaauggaaggaacucagaccucaggcucugcccccuggacuuaugguuguggaggaaauuaucucuagcgaggaggaaaagaugcugcucgaguccgucgacuggacagaagauaccgacaaccagaauagccagaaaucucugaagcaucggcgcgugaaacacuucggcuacgaguuucauuaugaaaacaauaacguggauaaggacaaaccccuguccggcgggcucccugauauuugugagagcuuccuggagaaguggcuuagaaaaggauacaucaagcacaagccggaccaaaugacgaucaaucaguacgaacccggccaggggauuccugcccacaucgauacccauucugcuuuugaggacgaaauugucucccugagccucggaucugagaucguuauggauuucaaacaccccgacggcauugccgugccugugaugcugccccggcgcucccuucuggucaugacaggggaaagcagauaucucuggacccauggaaucacaugccggaaguuugacaccgugcaggcguccgagucucugaaaagcggcauuaucacguccgauguuggcgaccugacacucagcaagcgcgggcugagaaccucuuucacauuucggaaagugcgccaaaccccguguaacugcuccuacccucuugucugugauagccagagaaaggagacacccccuucuuuccccgaaagcgacaaggaggccucccggcuggaacaggaguaugugcaccaaguuuacgaagagaucgcuggacacuuuucuagcaccagacauacgcccuggccucacauuguggaguuccucaaagcccugccguccggcagcaucgucgcugauauugggugcggaaauggcaaguaucuugggaucaacaaagaacuguacaugauuggaugugaccgcucucagaaccucguggauaucugccgggagagacaguuccaggccuuugucugugacgcgcuggccgugcccguucgcuccggcagcugcgaugcuuguaucucuauugccgugauccaucacuucgcuaccgccgaacggagagucgccgcucugcaagagauugugcgccuccugcggccuggcgggaaggcgcuuaucuauguuugggccauggagcaggaauacaauaaacagaaguccaaguaccugagaggaaaccgcaauagccagggcaaaaaggaggaaaugaacuccgacacaucugugcaacggagccucgucgagcagaugagagauauggggucccgcgacucugcuagcuccgugccccggauuaaugacagccaggaaggaggcugcaacucuagacagguguccaauagcaaacugccuguucaugucaaccggaccucuuuuuauucccaagaugugcuggugcccuggcaccuuaaggggaauccggacaaaggcaagccugucgagcccuucggaccuaucggcagccaggaucccucuccuguguuucaccgcuacuaucauguuuucagagagggggaacucgagggagccugccggacagugagcgacgucagaauccugcaguccuacuaugaucagggcaacuggugugugauucugcaaaaggccuga

SEQ ID NO: 65746 - RNA, 4863 nt, Artificial Sequence
  derived and/or modified sequence opt5 from ALK__Homo_sapiens__NP_004295
augggcgccaucgggcugcucuggcugcuuccccugcuccugagcaccgcugccgugggauccggcauggggacaggacagagagcgggcucuccugcugccgggccgccccuucaaccucgggagccccugagcuacucccgccuccagagaaagucucuggccgucgacuucguugugccuagccuguuucggguguaugcucgcgaucuccugcuucccccuuccucuagcgaacugaaagccggaagaccggaggcucggggcucccucgcccuggacugcgcgccccuucugcgccuccugggcccugcccccggggucagcuggacggcuggaucuccugcccccgcugaagccagaacccugucccgggugcucaagggcgggagcguucgcaaacugagacgggcgaagcagcuugugcuggagcucggagaagaggccauucuggagggcugugucgggccgccuggagaagcugccgugggccuucugcaguucaaccucucugagcuguuuuccugguggauccgccaaggcgaagggagacugcggauucgccucaugcccgagaaaaaggcuagcgagguuggaagagaaggccggcugucugccgccaucagagcuucccagccucgccuucuguuccagauuuuugggacaggacacagcucccucgagucucccaccaauaugcccagcccuuccccggauuacuucacauggaaccugaccuggaucaugaaggacagcuuucccuuccuuucucaucgguccagauauggccuggaaugcagcuuugauuucccuugugagcucgaauacucucccccucugcacgaccugcgcaaucagagcugguccuggcggagaauccccucugaggaggcgagccaaauggaucuccuggacgggccgggagccgaacgcuccaaagagaugccucggggcagcuuucuucugcucaacacaucugcugauuccaagcauaccauucugagccccuggaugagaucuuccagcgaacacugcacgcuggccguguccguccaucgccaccuucagccuucuggccgguauaucgcccagcuccugccccacaaugaggcugccagagaaauucugcucaugccuacccccgggaaacauggauggacagugcugcagggccgcaucgggcggccggacaacccuuucagaguggcgcuugaguacauuagcuccggaaaucggucucugagcgcugucgacuuuuucgcccucaagaacuguuccgagggcaccagccccgggucuaaaauggcccugcaauccagcuucacaugcuggaauggcaccguucugcagcuuggacaggcuugugauuuucaccaagauugcgcccagggcgaagacgagucucagaugugucgcaagcuccccgugggguucuauugcaacuuugaagacggauucuguggcuggacgcaggggacacuguccccucauaccccgcaauggcaagugagaacacugaaggaugcucgguuucaggaccaccaggaucacgcccuccugcuuagcaccaccgacguccccgcgucugagagcgccacagugacguccgcuaccuucccugcccccaucaaaagcucuccuugcgaacugagaauguccuggcucauucgcggaguucugcggggcaaugugagccugguccuuguggagaacaagacagggaaagagcagggcagaaugguuuggcauguggcugccuacgaaggacucucccuguggcaguggaugguccugccccuccuggaugugucugaccgcuuuuggcuucagauggucgcgugguggggccaggggagcagagccaucguggcuuucgauaauaucuccauuucucuggacugcuaccucaccaucagcggagaggauaagauucugcaaaacacagccccuaaaucccggaaucuguuugaacgcaaccccaacaaggagcuuaaaccgggcgagaauagcccuagacagacccccaucuucgacccuacgguucacuggcucuuuacaaccuguggggcuagcggaccccauggcccgacccaggcccagugcaacaaugccuaucaaaacuccaaucugagcguggaagucgggucugagggcccucugaagggcauucagaucuggaaggugcccgcuacagauaccuacuccaucagcggauauggggcggccggaggcaaagggggaaagaacacaaugaugcggucucacggcguuuccgugcucgggauuuucaaucuggaaaaagacgacaugcuuuacauccuggucggccagcaaggagaggaugcuuguccuagcacgaaccagcucauucagaaggugugcaucggcgaaaauaacgugauugaggaggaaauccgcguuaauagaucuguccaugagugggccgggggaggcgggggaggcggcggggccaccuauguguuuaaaaugaaggacggagugcccgucccccugaucauugcugccggcgggggaggccgggcguacggggcuaagacagauaccuuccacccugaacgccuggagaacaauuccagcgugcuuggacugaacggcaauuccggcgccgccgggggaggcgggggauggaacgacaacacaagccuccugugggcuggcaaaucucuccaggaaggggccaccggaggccacagcuguccgcaagcgaugaagaaauggggcugggagacgagagggggauucggcgggggaggcgggggaugcuccucuggcggcgggggaggcggguauaucggaggcaaugcugccagcaacaaugaucccgagauggacggggaagauggaguuuccuuuauuucuccucugggcauccuuuacacccccgcccugaaggugauggagggccauggggaagucaacauuaaacacuaccucaauuguagccauugcgagguggacgaaugucacauggauccugagucccacaagguuaucugcuucugugaccauggaacagugcuggcugaggauggcgucucuugcauugugagccccaccccugaaccgcaucugccccuuucccugauccucagcguugugacaucugcccuggucgcugcccucgugcuggcguuuuccgggaucaugauuguguaucggcgcaagcaccaggagcuucaggccaugcagauggaacugcaaagcccugaguacaaacucucuaagcugagaaccuccacgaucaugacagacuauaaccccaauuacugcuucgcuggaaaaaccagcuccauuucugaucugaaggaggucccucggaaaaacaucacacuuauuagaggccuggggcacggagccuuuggcgaaguuuaugagggccaggugagcgggaugcccaaugacccguccccucuccagguggcugucaagacccugcccgaaguguguagcgagcaggacgaacucgauuuccugauggaggcccuuaucaucucuaaguuuaaccaucaaaauauuguucgcugcaucggagugucccugcagagccugccccgguucauucuccuggagcuuauggccggcggggaccugaaaucuuuucucagagaaacccgcccucggcccagccagccuuccucucuggcuaugcucgaucugcuucacgucgcgagagacaucgccuguggaugccaauaccuggaggaaaaccacuucauucaucgcgauaucgcugcccggaauugucugcucacaugcccgggccccgggagaguggccaagaucggagacuuuggcauggcucgcgauauuuaucgggccagcuacuacagaaaaggcgggugugcgaugcugccuguuaaguggaugcccccugaggcuuucauggaaggaaucuuuacguccaaaaccgacacauggucuuucggcgugcuucugugggagauuuucagccucggguauaugcccuacccguccaagagcaaccaggagguccuggaauuugugaccucuggaggccggauggauccucccaaaaauugcccugggcccguuuaucgcaucaugacacaguguuggcagcaccaaccugaggacagacccaacuucgccauuauccucgaacggaucgaguacugcacccaggauccggacgugauuaacacggcccugccuaucgaauauggcccccuugucgaggaggaagagaaggugcccgugcgcccuaaggauccggaaggaguucccccucugcuggucucccagcaggcuaaaagagaggaggaacggagccccgccgcgccucccccucucccgacaaccuccucuggcaaggcugccaaaaagcccaccgccgcugagauuagcgugagagugccucgcgggcccgccgucgaaggaggccaugugaauauggcuuuuucccaaucuaacccucccagcgagcugcacaaaguucaugggucccggaauaagccgacaagccuuuggaacccuaccuacggaucuugguucacagaaaagcccacgaaaaagaauaaccccaucgccaaaaaggagccucacgacagaggcaaucuggggcucgagggcuccuguaccgugcccccuaacgucgcgacaggacgccugccgggcgccagccuccugcuugaacccucuucccugaccgcuaauaugaaagaggugccucuguuucggcucagacacuuccccugcgggaacguuaauuauggauaccagcagcagggccugccucuugaagccgcuacagcccccggggccggacauuacgaggacaccauucugaagucuaagaacucuaugaaucaaccgggcccuuga

SEQ ID NO: 65747 - RNA, 1176 nt, Artificial Sequence
  derived and/or modified sequence opt5 from ALLC__Homo_sapiens__NP_060906
auggacauggccagcgaguccgugggcgggaagauccuguucgcuaccgaugacuuuuucgcccccgcggaaaaccucauuaaaucugauagcccuugcuuuaaggagcacgaauacacagaguucggaaaauggauggacggcugggaaacgagacggaagcgcaucccggggcaugauugguguguccugagacuuggcauucagggaguuauccggggguuugacguggauguguccuauuucaccggagacuacgcuccccgcgucucuauucaagccgccaaucuggaggaggauaaacucccugaaauccccgagagaggcacacggaccggcgcugccgcuacaccugaagaguuugaggccaucgcggaacuuaagagcgacgauugguccuaucuggugcccaugaccgagcugaagccugggaacccggccucuggacacaauuacuuccucguuaacagccagcagcgcuggacacauauuagacugaauaucuuucccgacggcgggauugcucggcugcgcguguucggaaccggccagaaagauuggacggccaccgacccuaaggaacccgcugaccucgucgccaucgcguuugggggagugugcguuggcuucuccaacgccaaauuuggccacccuaauaacauuaucggggugggaggcgcuaagagcauggccgaugggugggagacagcuagacggcuggacagacccccgauucuugaaaaugaugagaacggaauccugcucgucccuggcugugagugggccguguuccgccuggcccaucccggggugaucacccggauugaaaucgacacaaaauauuucgagggaaaugcuccugauucuugcaaggucgacggcuguauucuuaccacgcaagaagaggaagcgguuauccgccagaaguggauucugcccgcccacaaauggaagccccuccugccugugacaaaacuguccccgaaccagagccaccucuuugauucucugacccuugagcugcaggacgugaucacacaugcuagacucaccaucguccccgauggcggggugucccggcugagacuucgcggauucccuagcucuauuugccugcuccggcccagagagaagccuaugcugaaauuuuccguuagcuucaaggccaaucccuga

SEQ ID NO: 65748 - RNA, 12510 nt, Artificial Sequence
  derived and/or modified sequence opt5 from ALMS1__Homo_sapiens__NP_055935
auggagcccgaagaccugccuuggccgggagagcucgaagaggaagaggaggaagaggaagaggaggaagaggaagaggaagaggaggcugcugccgccgcugccgccaacguggaugacgucguugugguggaagaggucgaagaggaagcugggcgggagcuggauagcgacucccacuacggaccccagcaccuugagucuauugaugacgaagaggaugaagaggccaaggcuuggcugcaagcccacccuggacggauucugcccccucugucucccccucagcaccgcuauuccgaaggggagagaaccucucuugagaaaauugugccgcugacaugccacguuuggcagcagauuguguaccaaggaaauagccggacgcagauuuccgacaccaacgucgugugucucgaaacaaccgcgcagcgcggaucuggggaugaccagaagacagagagcuggcauugccugccccaagaaauggauuccagccagacccuggacacaucucagaccagauucaauguucggacggaggauaccgaggugacagacuuuccuucccucgaagagggcauucucacccagagcgaaaaccaagucaaagagcccaaucgcgaccuuuucuguucuccucugcucgugauucaggauuccuuugccagccccgaccugccgcuucugacaugccucacccaggaucaagaguucgcuccugacucucuguuucaccaguccgagcugagcuucgcgccccugagaggaaucccugauaaguccgaggacacggaauggucuagccggcccuccgaggugagcgaagcucuguuucaggccacagcggaggucgccucugaucuugcuuccagccgcuucucuguuagccagcacccccugauuggcuccaccgccguggggucucaauguccuuuucucccgagcgaacagggaaacaaugaggagacaaucuccagcguggacgaacugaaaauucccaaggauugcgacagauaugaugaccuuuguucuuacauguccuggaagacccggaaagacacccaguggccugagaacaaucuggcugauaaggaccaggucagcguggccacaucuuucgauaucacggacgaaaacauugccaccaaacgcuccgaucauuuugacgcugcgagaagcuauggccaauacuggacacaggaggauuccucuaagcaggccgaaaccuaucucacaaaagggcugcagggaaagguugagagcgacgugaucacccuggauggccucaaugagaacgcugucgugugcuccgaacggguugccgagcugcaacgcaagcccacgagagaaucugaguaccacagcuccgaccuucggaugcugagaaugagcccugauacagugcccaaagccccgaagcaucucaaagcuggggacaccucuaagggaggcauugccaaagucacccaguccaaucugaaauccggcaucacaaccacaccuguggauucugacaucgggucccaccuuagccugucucucgaggaccugagccagcuggcggucuccagcccccucgaaacgaccacaggacagcacaccgauacacugaaccagaagacccuugcugacacgcaucugaccgaggaaacacucaaggugaccgccauuccugagcccgccgaucagaagacagcuaccccuacgguucugucuuccagccacucccaucgcggcaaacccucuaucuucuaccagcaagggcugccggacagccaccuuacagaagaggcccucaagguguccgcugccccuggacuggcggaucagaccacaggcaugucuacccugaccagcacauccuauucucaucgggagaaacccgggacguuuuaccagcaggaacuccccgagagcaaucugaccgaagaaccucuugaagucuccgccgcuccgggacccguggagcaaaagacaggcauuccuaccguuagcucuacaucccacagccacguggaggaccuccucuucuucuauagacagacccugcccgauggccaucugacggaccaggcccuuaaagucucugcuguguccgggccugccgaucagaagacaggaaccgcgaccgugcucagcacaccccacucucaucgcgaaaagccuggcaucuuuuaccaacaggaguucgccgacucccaccagaccgaagagacacugacgaaaguuagcgcuacccccgggccggccgaucagaagacagaaauuccugcuguccaauccagcucuuauagccagcgggagaaacccuccauccuguacccucaggaccucgccgauucucaucugcccgaggaaggacuuaaggugagcgccguggcuggcccggcggaccagaagaccgggcugccuacaguccccuccucugccuauagccauagagagaagcuccugguguuuuaccagcaggcucugcuugacucccaccucccugaagaggcccugaagguuucugccgugagcggccccgcugauggaaaaaccggcacgcccgccgucaccuccacaagcucugcguccagcucucugggggagaagccuuccgcuuucuaccagcaaacccucccgaacagccaucugacagaagaggcccuuaaaguguccaucguucccggaccuggcgaccagaagaccgggauucccucugccccuagcuccuuuuauagccaccgcgaaaaacccaucauuuucucucagcagacacugccugauuuucucuucccggaggaagcucugaagguguccgccgucagcgugcuggcggcucaaaagaccggaacgcccacaguuucuagcaacucccauucucacagcgagaaauccucuguguuuuaccagcaggagcuuccugacagcgaucucccccgggaaucccugaagaugagcgccaucccuggccugaccgaccagaaaaccguccccacaccgaccgugccuucuggguccuucagccacagagagaagcccuccaucuuuuaucaacaggaauggcccgauucuuacgccacggagaaagcucucaaggugagcacaggcccuggacccgccgaccagaaaaccgaaaucccugcuguccaguccucuagcuauccgcaacgcgagaagcccuccguucuguacccucaggugcuuagcgauucucaucugcccgaggaaucccucaaggugagcgccuucccuggccccgcggaccagaugacagauaccccggccgucccuucuacauuuuauucccaacgggagaaacccgggaucuucuaccagcagacccugccugaaagccaucugcccaaggaggcucuuaaaauuucuguggccccuggacuggcugaccagaagacgggcacccccacaguuaccagcacauccuacucucaacauagagaaaaaccgagcaucuuccaccagcaggcccucccugggacccauauucccgaggaggcccagaagguguccgcugucacgggacccggcaaucaaaagacauggaucccucgcgugcugagcaccuuuuauucccagcgggaaaaaccggggauuuucuaccagcagacacuccccggcucucacaucccugaggaagcgcaaaagguuagccccgugcugggaccugccgaccagaaaaccggcacccccacaccuacguccgcuucuuauagccacaccgagaagccggggaucuuuuaccagcaaguccuucccgauaaccauccuacagaggaagcccugaaaaucuccguggccucugagcccguugaccagaccacaggaaccccugcugugacgagcacauccuauagccaguacagagaaaagcccucuaucuucuaucagcaaucccucccgagcucucaccugaccgaggaagccaagaaugucuccgcggugccuggccccgcugaucagaaaaccgugauucccauccugccuagcacauuuuacucucauaccgagaagcccggggucuucuaccagcagguucuuccucacucccacccgacagaggaagcccugaaaauuagcguggccuccgagcccguggaccaaacgaccggaacaccuaccgucacaagcaccucuuauagccagcauacggaaaagcccuccaucuuuuaccagcagucucucccuggcagccaccugaccgaggaagcuaaaaacguguccgccguucccgggccgggcgaucggaagacaggcauuccuacccuccccucuacauucuauagccauaccgagaagccuggcuccuuuuaccaacaggugcugccccacucucaucuuccugaggaagcgcuggaggucagcguggcucccgggccgguugaccagacaaucggaacgccuaccgugacaucccccagcuccuccuucggcgaaaaacccaucgucauuuauaagcaggccuuuccugaggggcaccucccggaagagagccugaaagugucugucgcccccggaccugugggccaaaccaccggcgcucccacaaucacguccccuagcuacucccagcaccgcgccaagucugggagcuucuaucagcuggcccuucugggaucccaaauucccgaggaagcccucagaguuagcucugcgccuggccccgccgaucagaccacagggaucccgaccauuacauccaccagcuacucuuuuggagagaaaccuaucgugaauuacaagcaggcuuuccccgacggccaucugccugaagaggcccucaaagucagcaucguguccgggcccacggagaagaagacagauauuccggcuggaccucugggcucuagcgcccuuggcgaaaaacccaucaccuucuaucggcaggcccugcuggacagcccccucaacaaggagguugugaaagucucugcugcgccugggcccgccgaucaaaagaccgaaacacugccugugcacagcaccuccuacagcaauagaggaaaaccggugaucuuuuaucagcagacacuuucugacucccaucugcccgaggaagcucucaagguuccucccgucccuggccccgaugcccagaagaccgagacgccuagcguguccucuagccuguacuccuaucgcgagaaaccgaucguguucuaccaacaggcccuccccgacucugaacugacacaggaggcucuuaaggucagcgccgugccucagcccgcggaccagaaaaccgggcuguccacaguuaccagcucuuuuuauucccacacggaaaagccuaacauuagcuaccagcaggagcugcccgauucucaccucaccgaagaggcucugaaaguguccaaugucccgggaccugccgaccaaaagacaggcgugagcaccguuacaucuaccuccuacagccaucgggagaagcccaucgugucuuaucagagagaacuuccccacuucacagaggccgggcugaaaauccuccgcgucccuggacccgcugaucagaagaccggcauuaacauccugccuagcaauuccuacccgcagagagaacauagcgugauuuccuaugagcaagaacuccccgaccugacggagguuacacuuaaagccaucggcgugccugggcccgcggaucagaagaccggcauucaaaucgccucuagcuccucuuacagcaaccgggagaaggcuuccauuuuucaccagcaagaacugccugacgucaccgaggaagcccugaauguguucgugguccccggacagggggaucgcaagacagagaucccgaccguuccucucucuuauuacagcagacgggagaagcccuccgugaucagccagcaggaacugccugacucucaucuuacagaggaagcucugaaagugucccccgucagcauuccggccgagcaaaagacgggaaucccuauuggccucucuuccagcuauucucacucccacaaagaaaagcugaaaaucagcaccgugcauauucccgaugaccagaagacagaguuucccgcugccacccucucuuccuacagccagaucgagaagccuaaaaucagcacaguuauugggcccaacgaucaaaagaccccuucccagacggcguuccacucuagcuacucccagaccgugaaaccgaauauccuguuucagcaacagcuucccgaccgcgaucagucuaagggcauucugaaaaucagcgccgucccugaacugacagacgugaacaccggcaagcccguuucccucucuagcuccuauuuccauagagagaaaagcaacaucuuuucuccucaggaacugcccggcucccacgugacagaggacguccuuaaggugagcaccaucccugggccggcuggacaaaagacgguccugcccacagcccucccuucuuccuucagccaccgggaaaaacccgauaucuucuaccagaaggaccugccugaucgccaucugaccgaggacgcucucaaaauuuccucugcccuuggccaggccgaucagaucacagggcugcaaaccgugcccagcggaaccuauucccacggcgagaaucauaagcugguuucugaacacgugcagagacucauugacaaccugaauagcuccgauagcucuguguccagcaacaauguccuucugaacucucaggcugacgaucggguugugaucaauaaaccggagagcgcgggguuucgcgacgugggauccgaagagauucaggaugccgaaaacucugcuaagacacucaaggagaucagaacgcugcugauggaggccgaaaauauggcccucaaacgguguaacuucccugcuccccuugccagauuucgcgacauuagcgacaucuccuucauccaaagcaagaaagucgugugcuuuaaggagcccucuuccaccggcguuagcaauggcgaucugcugcaucggcagccuuucacagaagagucccccucuagcagauguauucagaaagacaucgggacccaaacaaaccucaagugccgccggggaauugagaauugggaauuuaucuccucuaccacggugagaagcccucugcaggaggcggaauccaaggucucuauggcccuugaggaaacacugcgccaguaccaggcugccaaaagcgugaugcgguccgagccggagggcugcagcgggaccauuggaaacaagaucaucauucccaugaugaccgucaucaaaucugauuccagcucugacgcuuccgauggcaaugggagcuguucuugggacagcaaccucccugaaucccuggagagcguguccgauguucugcucaacuucuuucccuaugugucuccuaagacaagcauuaccgacuccagagaagaggaaggagucucugagagcgaggauggcggcggguccucuguggacagccuugccgcgcacguuaaaaaucugcugcaaugcgaauccagccucaaccacgccaaggagauccugcgcaaugcugaagaggaagagucucgggugagagcccaugcuuggaacaugaaguucaaucuugcccacgauuguggauacuccauuagcgagcugaacgaagacgaucggcgcaaagucgaggaaaucaaggcugagcucuuuggccaugggagaacaacggaccugucuaaaggacugcagagcccccggggcauggggugcaagccggaggccguguguagccacaucauuaucgaaucucaugagaaaggaugcuuccgcacccucacauccgaacacccucagcuugacagacaccccugugcguuucggagcgccggcccuucugagaugaccagaggccgccagaaucccuccagcugccgggcuaagcaugugaaccuguccgccagccuggaucaaaauaacucucacuucaaaguuuggaauagccuccagcugaagucccauucuccuuuccagaacuuuauucccgacgaguucaagaucagcaaagggcuuagaaugccguuugaugagaagauggaccccuggcuguccgagcucgucgaaccugcuuucgugcccccuaaagagguggauuuucacucuagcucccagaugccgagccccgaaccuaugaagaaauucacaaccucuauuacguuuuccagccaccgccauucuaaguguaucuccaauagcucugucguuaaggugggagugaccgagggcucccaaugcacaggggccagcgucggaguguucaacucccacuuuaccgaagaacaaaaucccccucgggaccugaaacagaagacaucuagccccuccagcuucaaaaugcauucuaacucccaagauaaggagguuaccauucuggccgaaggcagacgccagagccagaaacucccuguggacuuugagcggucuuuccaggaagagaagccccuugaaagaagcgauuuuacagggucccacucugagccgagcacccgcgcgaacuguuccaauuucaaggagauccaaaucagcgacaaccauacgcugauuucuaugggcagaccuuccagcacacugggagucaaucggucuuccagccgccucggcgugaaagaaaagaacguuaccaucacccccgaucugccuuccugcauuuuccuugagcagagagaacuguuugagcagucuaaagcuccccgggccgacgaccacgugcgcaagcaccauagcccguccccucagcaccaagauuaugucgcucccgaccuccccucuugcaucuuccuggagcagagagaacuguuugagcaguguaaagccccuuacguggaucaucagaugcgggaaaaucacagcccccucccucaagggcaggacuccauugccagcgaucuuccgucucccaucucccuggagcagugccagagcaaggcuccuggaguggacgaucaaaugaacaagcaccauuucccccugccucagggccaggacugugucguugagaaaaauaaccaacacaagcccaaaucucauaucuccaauauuaacguggaggccaaguuuaauacaguggucagccagucugcgccgaaccacugcacgcucgccgcuuccgccagcaccccucccagcaauagaaaagcucuguccugugugcauaucacacuuugcccuaagaccucuagcaaacuggauuccgggacacucgacgagcgcuuccacucucuggaugccgcgagcaaggcccggaugaacuccgaauuuaauuucgaccugcacaccguuucuagcagaucccucgagcccacaucuaaacuucugaccagcaaaccuguggcucaggaucaggaaucccugggauuucucggccccaagagcucucuggacuuccaagucgugcagccgucccuucccgacagcaacacgauuacccaggaucugaaaacaaucccuucucaaaauucccaaauuguuaccagccgccagauccaggugaacaucucugacuuugaggggcauuccaaccccgaaggcacaccugucuucgccgaucggcuccccgagaagaugaaaaccccucugagcgcuuuuuccgagaagcugagcucugacgccgugacgcagauuacaaccgaaagcccggagaagacacucuucuccucugaaaucuucauuaaugcugaggauagaggacacgaaaucauugagcccggcaaccaaaaacuucggaaggccccuguuaaauuugcgagcuccucuagcgugcagcaggucaccuucucccgcgggacggacggacaaccccugcugcucccuuacaagcccucuggcagcaccaaaauguauuacgugccgcagcugagacagaucccucccuccccugauagcaagucugacacaaccgucgaguccagccauucuggguccaaugaugccauugcucccgacuuuccggcccaggugcuuggaacacgggaugacgaucugagcgcuaccguuaacaucaagcacaaagaaggcaucuauuccaagcgcguggucacaaaagccucucucccugugggggagaagccccugcaaaaugaaaacgccgacgcgagcgugcagguucugauuaccggcgacgagaaucucuccgauaaaaagcagcaggagauccauagcacgagagcugugacagaagccgcccaagcuaaggagaaagaaucucuucagaaggacaccgccgauuccagcgcugccgcggccgcugagcacucugcccaggucggagaccccgaaaugaaaaaccugccugauaccaaggcuauuacacagaaagaggagauccaccggaagaagaccgugcccgaagaggccuggccuaauaacaaagaaucccugcaaauuaauaucgaggaaagcgagugucauucugaguucgaaaacacaacgcgcagcguuuuuagauccgcgaaguucuacauccaccauccggugcaccuccccucugaccaggauauuugccacgagagccugggcaaauccgucuuuaugcggcauagcuggaaggacuucuuucagcaccauccugauaaacaccgcgaacauaugugucuuccccugccuuaucaaaauauggacaagaccaaaacagauuacaccagaaucaagucucucuccauuaacgugaaucuggggaacaaggaggucauggacacaaccaaaagccaggugcgggacuaucccaagcacaacggacagaucuccgauccucagagagaccaaaaaguuacgccggaacagaccacacagcacaccgugucucugaaugagcucuggaacaaguaccgcgagcggcagagacaacagcgccagcccgaacugggcgaucggaaagagcuuagccuggucgacagacucgaucgccuggccaagauucuucagaauccuaucacacauucccugcaagugucugaaagcacccacgacgauuccagaggggaaagaagcguuaaggaguggucuggacgccagcagcagcggaacaaacuccaaaagaaaaagagauucaaaucccuggaaaagagccauaagaauacgggcgagcugaaaaagucuaaagugcucucccaccaccgcgcuggccggagcaaccagaucaagauugaacagaucaaauuugacaaguacauucugucuaagcaacccggguucaauuauaucuccaacacaagcucugauugcagaccuagcgaggaauccgagcuucugaccgacacaaccaccaauauucucagcggaacaacguccaccgucgagucugauauccugacacagaccgaccgcgaaguggcccuucaugagagaagcuccucugugagcacaauugauaccgcucggcugauccaggccuuuggccacgaacgcguuugucucucccccagacggaucaaacuguacucuagcauuacgaaccagcaaagacgguaucuggagaagcgcuccaaacauagcaagaaaguccucaauacagggcacccgcuggugaccucugaacauaccagacggcgccacauccagguggcuaaccacgucauuuccagcgacucuaucuccagcucugccuccagcuuccuuuccagcaauucuacauucugcaacaagcagaaugugcauaugcugaacaaaggcauucaggcgggcaaccucgagaucguuaauggggccaagaagcacaccagagacgugggaaucacauuucccacgccuuccagcucugaggcuaaacuggaagagaacagcgaugucaccuccuggucugaagagaagcgggaagagaaaaugcuuuucacaggcuaccccgaggaccgcaagcugaaaaagaauaagaaaaacagccaugaaggcguguccugguuuguuccuguggagaaugucgaaucuagaagcaagaaagagaacgugcccaauaccugcgggccuggaauuuccugguucgagccgaucacaaagacccggcccuggcgcgaaccucucagagagcaaaacugucagggccagcaccuggaugggcggggauaucuggccggccccgggcgcgaagccggaagagaccuccugcggccuuuuguucgcgcuacgcuucaggagagccugcaauuccacagacccgauuuuauuucucgguccggcgaaagaaucaaacgccucaagcugauugugcaggagcggaaacuucagagcaugcugcaaaccgagagagacgcccucuucaauaucgaucgcgaacggcagggccaucagaacagaaugugcccgcugccuaaacgcgucuuucuggcgauccagaagaauaaacccauuucuaagaaagagaugauccaacgguccaagagaauuuacgaacagcucccugaggugcagaagaaacgcgaagaggagaagcggaaaagcgaauauaaguccuacagacugcgcgcucagcuuuacaaaaagcgggugacaaaccaacugcucgggagaaaaguccccugggacuga

SEQ ID NO: 65749 - RNA, 2106 nt, Artificial Sequence
  derived and/or modified sequence opt5 from ALOX12B__Homo_sapiens__NP_001130
auggccaccuacaaggugagagucgcuacaggcacggaccugcucagcgggacccgggauuccaucucucugacaauuguuggaacccagggcgagagccacaaacaacuucugaaccauuucgggcgcgacuuugccacaggagcggugggccaguauaccgugcagugcccccaggaucucggggaacugaucauuaucagacuucacaaggagcgguacgcuuucuuuccuaaagacccgugguauuguaauuacguccaaauuugcgcccccaacggacgcaucuaucauuucccugccuaccaguggauggauggcuaugaaacacuggcucucagagaggccaccggcaagacgaccgcugacgauucccugcccgugcugcucgaacaccggaaagaggagauccgcgccaagcaggacuuuuaccauuggagaguuuuccugccugggcuucccucuuacgugcacauuccuagcuaucggccgcccguccgcagacaccggaauccuaaccgccccgaauggaauggauacaucccuggcuuucccauucugaucaacuucaaggcgacaaaauuucucaaucugaaccuuagauauuccuuccugaagaccgccagcuuuuucgugcggcucgggccgauggcucuggccuuuaaaguucgcggacugcucgauuguaagcauucuuggaaaagacugaaggacauucggaagaucuucccuggcaaaaaguccguggucagcgaguacguggcugaacacugggccgaggauacauucuuuggguaucaguaccuuaauggagugaaccccggccugauuagacgcugcacccggaucccugacaaauuccccgucacggaugacaugguugcgcccuuucucggcgaggggacaugucugcaagccgaacuugagaagggaaauaucuaucuggcugacuacagaauuauggaaggcaucccuaccguggagcucucugggcgcaaacagcaucacugcgccccgcugugucugcuccacuucggacccgaaggcaagaugaugccuauugcuauccagcugucccagacacccgggccugauugccccauuuuucuuccgagcgacucugagugggauuggcugcucgccaaaaccugggugcgguacgccgaguucuauucccaugaagcuaucgcgcaccuucuugagacccaucugaucgccgaggcuuuuugucucgcccugcugagaaaccucccuaugugccacccccuguacaagcugcugauuccucauacacgcuauacgguccaaaucaauagcauuggacgggccgugcuccugaacgaaggcggccugucugcuaaggggaugucccuuggaguugaaggcuucgccggggugauggucagagcgcucagcgagcugaccuacgacucccuguaucuccccaaugauuuuguggagcgcggaguucaggaccugccuggcuacuauuaccgggaugacucucuugcuguguggaacgcccuggaaaaauacgucacagagaucauuaccuauuacuaucccagcgaugccgcuguggaaggggacccggagcuccaguccuggguccaagaaaucuucaaggagugucugcugggcagagagagcucuggauuuccucgcugccuucggacagugcccgaacucaucagauacguuaccauugugaucuauacgugcuccgccaaacacgcugccgucaacacaggccagauggaguucaccgcguggaugcccaauuuuccugccagcaugcggaacccgcccauucagaccaaggggcugacaacccuggaaacauucauggauacgcucccugacgugaaaaccacauguaucacccugcuuguucuguggacacucucucgcgagcccgacgauagacggccucugggacacuuccccgacauucauuuuguggaggaagcuccuagacgcagcaucgaggccuuccggcagagacugaaucaaauuucccacgauauccgccagagaaacaagugccuucccaucccguacuauuaccucgacccuguccugauugaaaauucuaucagcauuuga

SEQ ID NO: 65750 - RNA, 1992 nt, Artificial Sequence
  derived and/or modified sequence opt5 from ALOX12__Homo_sapiens__NP_000688
augggcagauaccggauccgcguggccaccggggcuuggcuguucagcggauccuauaacagaguccagcucuggcugguuggcacacgcggggaggccgaacuugagcugcaacuccggcccgcgagaggagaagaggaagaguuugaccacgauguggcugaggaccugggccuucugcaguucgugcggcuccgcaagcaucacuggcuggucgaugacgccugguuuugcgauagaauuacggugcaggggccuggagccugugcugaaguugccuucccgugcuaccggugggugcagggcgaggacauccugucucuccccgaaggcaccgcucgccugccuggggauaaugcccuugacauguuucaaaaacauagagagaaggagcugaaagaucggcagcagauuuauuguugggcgacauggaaggaaggacucccccugaccaucgccgcugaccgcaaagaugaccuuccucccaacaugagauuccacgaggaaaagcggcuggauuuugaguggacacucaaggccggcgcucuggaaauggcccugaaacgcgucuacacccuccugagcuccuggaauugccuugaggacuucgaccagauuuucugggggcaaaagucugcgcuggccgagaaagugagacaguguuggcaggaugacgaacucuucagcuaucaguuucugaacggagcuaauccuaugcuucugcggagauccacaucucucccgagccgccugguucugcccuccggcauggaggaacuccaagcccagcuggagaaggaacuucagaacgggagccuguucgaggcugauuuuauccuccuggacggaaucccugccaaugugauucggggcgagaaacaauaccuugccgcuccccuggucaugcucaagauggaaccuaacggcaagcugcagcccauggugauccagauucagccgccuaaucccucuuccccuacccccacgcuguuccuccccagcgauccuccgcuggcguggcuucuggccaaaucuugggugagaaacuccgacuuccaacuccaugagauccaguaucaucugcugaauacccaccuugucgcugaaguuauugccguggccacaaugcgcugccuccccgggcugcacccuaucuuuaaguuccugauuccccacauccgguacaccauggagaucaacacaagagcucgcacccagcucauuagcgauggaggcaucuuugacaaagccgugucuacagggggaggcgggcauguccagcugcuucggagagcggcugcccaacugacguacuguucccucugcccucccgaugaccuggccgaucgcggacugcuuggccucccgggcgcucuguaugcccacgacgcucugcggcucugggaaauuaucgccagauacguggaggggauuguucaccuguucuaucagcgcgacgauaucgugaagggagacccugagcuucaggcguggugucgggaaaucaccgaggucggccugugccaggcccaagauagaggguuucccgugagcuuccagucccagucucagcucugucauuuucugacaaugugcguuuuuaccugcaccgcucaacacgccgcuauuaaucagggacagcuggacugguacgccugggugccuaacgcgcccuguacaaugcggaugccucccccgacgaccaaagaagaugucacaauggccaccgugaugggcagccuuccugacguccgccaggcuugccuccaaauggccaucuccuggcaucugagcagacggcagcccgauauggugccccuggggcaccauaaggagaaauauuuuucuggcccuaagccgaaggcuguucucaaucaguucagaacagaccuggagaaacuugaaaaggagauuaccgcccgcaacgaacaacuggauuggcccuacgaguaucucaaaccuuccuguaucgaaaacagcgugacgauuuga

SEQ ID NO: 65751 - RNA, 1944 nt, Artificial Sequence
  derived and/or modified sequence opt5 from ALOX15B__Homo_sapiens__NP_001034219
auggccgaguucagagugcgggucagcaccggcgaagccuuuggggccggaacaugggacaagguuuccgugucuaucgugggcacgcgcggggagagcccuccccugccgcucgauaaccugggaaaagaguucaccgcgggcgcugaagaagacuuucaggucacacuucccgaggauguggggagaguucugcuccugcgggugcacaaggccccucccguccuuccucugcucggaccccuggccccugacgcuugguucugccgcugguuucaacugaccccgcccagaggcggccaucuccuguucccuuguuaccaguggcuugagggggccggaacacuggugcuccaggaaggcaccgcuaaaguuuccugggccgaucaccaucccgugcugcagcaacagcggcaggaggaacuucaggcgcgccaagagauguaucaguggaaggccuacaauccuggguggccccacugccuggacgagaaaacagucgaagaucucgagcugaacauuaaguauucuaccgcuaagaaugccaacuuuuaccugcaggcuggaagcgccuucgcggaaaugaaaaucaagggccuccuggacagaaaagggcuuuggcggucccugaaugagaugaagcgcauuuuuaacuucagacggacgccggccgcugaacaugccuuugagcacuggcaggaggaugcuuucuuugccucucaauuccucaauggacugaacccugugcuuauccgcagaugucacuaucugcccaaaaauuucccugugaccgacgccauggucgcuagcguucucggccccggcacaucccugcaggcggaacuggagaaggggagccucuuucugguggaucaugggauucuuucuggcauccagaccaacgugaucaaugggaagccccaauucuccgccgcuccuaugacacugcucuaccagagcccgggaugcggcccccugcuuccucuggccauucagcucucucagacccccgggccuaacucccccaucuuucugccgacggacgauaaaugggacuggcugcucgccaagacauggguccggaaugcugaguucagcuuucacgaagcccugacccaucuucugcacucucaccuccugccugaaguguucacacuggcgacccuucgccaacucccccauugucacccucuguuuaaauccaccggaauuggcaucgagggcuucagcgagcugauucagagaaacaugaagcagcucaauuauucccugcuuugccugcccgaagacauccggacaagagggguugaggauauuccuggauacuacuaucgcgacgauggcaugcagaucuggggagcuguggaacgguuugucucugagaucauuggaaucuacuaucccagcgacgaauccgugcaagaugacagagagcuccaggccuggguucgcgagauuuucagcaaaggcuuucugaaccaggaaucuuccgggaucccgagcucucuggagacgcgggaagcccuugugcaguacgucaccauggugauuuucacauguagcgcuaagcaugccgcugucuccgccggccaauuugauucuugcgcguggaugccuaaccucccucccagcaugcagcugcccccgcccaccuccaaaggacuggccacaugugagggcuucaucgcuacccucccucccgugaaugccacgugcgacguuauccuggcucuuuggcugcucagcaaggagccuggggaucagagaccccugggaacauauccugacgaacacuucaccgaggaagcuccccgccggucuauugcgaccuuucaguccagacuggcccaaaucagccgcggcauucaggagcggaaccaggggcuugugcucccguacacauaucuggauccuccccugaucgaaaauucugucuccauuuga

SEQ ID NO: 65752 - RNA, 1989 nt, Artificial Sequence
  derived and/or modified sequence opt5 from ALOX15__Homo_sapiens__NP_001131
augggccuguacagaauccgggugagcaccggggccucccucuaugcuggaucuaacaaucagguccaacuguggcuuguuggccagcacggggaggccgcgcugggaaagcgccucuggcccgcuagaggcaaagaaacagagcugaagguggaagugccugaguaccuugggccgcuccucuucgucaaacugcggaagcgccaucugcucaaagacgaugccugguuuugcaacuggauuagcgugcagggacccggcgccggcgacgaaguuagauucccuuguuaucgguggguggaggggaauggaguccugucccuucccgagggcacggggcgcaccgugggagaagauccucagggccuguuucaaaagcacagagaggaggaacucgaggaacggcgcaagcuguacagaugggggaacuggaaagacggacuuauccugaauauggcuggcgccaagcucuaugaucugcccguugacgagcgguuccuggaagauaaacgcguggacuuugaggucucucucgcuaagggccuggccgaucuugcgauuaaagacagccugaacgugcucacaugcuggaaggaucuggacgauuucaauagaaucuuuuggugugggcaguccaagcuggccgaacgggugcgcgacucuuggaaagaggacgcucuguucggauaccaguuucucaacggcgccaauccugucguucugagacggagcgcucaucugccggccagacucguguuucccccugggauggaggaacugcaggcgcaacuugagaaggaacuggagggaggcacccucuucgaagccgauuucucccugcuugacgggauuaaagcuaacgugauccugugcagccagcagcaccucgccgcuccccuggucaugcugaagcuccagccugauggaaaacugcuucccauggugauccaacugcagcucccgcgcacaggcucuccucccccuccccuguuucugcccaccgacccuccgauggccuggcuucucgccaaguguuggguucgguccagcgauuuccagcugcaugagcugcaaucucaccuccugagaggccaccuuauggcugaggugauugucguggcgacaaugcgcugccugcccuccauccauccuauuuucaaacucaucauuccccaccuucgguauacccuggaaaucaauguuagagcccgcacggggcuugugagcgacaugggaauuuuugaucagaucaugucuaccggcgggggaggccauguccagcuccugaagcaggcuggggccuuccugacauacuccagcuuuuguccucccgacgaucucgccgaccggggccugcuuggagugaaguccucuuucuacgcucaagaugcccugagacucugggagaucauuuaucgcuacgucgaaggcaucgugagccugcacuauaaaaccgacguugcggugaaggacgauccggagcugcagacauggugccgggaaauuaccgagaucgggcuucagggagcucaggacagaggcuuuccugucucccuccaagcccgcgaucaggugugucacuucguuacgaugugcauuuuuacauguaccgggcagcaugccagcgugcaccugggacagcuggacugguacucuuggguccccaacgcuccuugcacaaugcggcugcccccucccaccaccaaagaugccacacuggagacggugauggcuacccuuccgaauuuccaucaagccucccugcagaugagcaucacauggcagcucggcagacggcagccugugaugguugcggucgggcaacacgaagaggaauauuuuucuggccccgagcccaaggccgugcugaaaaaguuccgcgaggaacuggcugcccuugacaaggagaucgaaauuagaaacgcuaaacucgauaugccuuacgaguaucugcggccgagcguggucgaaaauuccguggccaucuga

SEQ ID NO: 65753 - RNA, 657 nt, Artificial Sequence
  derived and/or modified sequence opt5 from ALOX5AP__Homo_sapiens__NP_001191335
augcugaccuucaaccacgacgcccccuggcauacacagaagacgcucaaaaccuccgaguuuggcaaguccuucgggacacugggacacaucggcaauauuucucaucaaugcugggcugggugugccgcgggaggcagagcugugcuuagcggggaaccugaggccaacauggaucaggaaaccgucggaaauguugugcugcucgccaucgugacacugauuuccgucgugcagaacggcuuuuucgcucacaaaguugagcaugaaucucggacccagaauggccgcagcuuucaaagaacagggacccuugccuucgagcggguguacacggcuaaccagaauugcgucgacgccuauccgaccuuucuggcggugcucugguccgccggacugcuguguucucagguucccgcugccuucgcuggccucauguaccuguuugugcgccagaaguauuucgucggguaccuuggagagagaacacaaagcaccccuggcuauaucuuugggaaacggauuauccuguuccucuuucugauguccguggccggaaucuucaacuacuaucuuauuuucuuuuucggcagcgauuuugaaaauuacaucaagacaauuucuaccacgaucagcccccugcuccugauuccuuga

SEQ ID NO: 65754 - RNA, 2025 nt, Artificial Sequence
  derived and/or modified sequence opt5 from ALOX5__Homo_sapiens__NP_000689
augcccagcuacaccgugacagucgccacgggcucccagugguucgcugggaccgacgauuauaucuaccugucucucguuggaagcgccggcugcuccgagaagcaccuucuugacaaaccuuuuuauaacgauuucgaaagaggggcgguggacucuuacgaugugacagucgacgaggaacugggagagauucaacucgugagaaucgaaaagcgcaaauauuggcugaaugaugacugguaccuuaaguauauuacccugaaaacaccgcauggcgauuacaucgaguuucccuguuacagauggauuaccggggacguugaggugguccuccgggauggacgcgcuaagcuggccagagacgaucagauccacauccugaagcagcaucggcgcaaagaacucgagacaagacagaagcaauaucgguggauggaauggaacccuggcuucccccugagcauugacgccaaaugccacaaggaccuuccucgcgauauccaguuugacuccgagaaaggcguggauuucguucugaauuacucuaaggcuauggagaaccucuuuauuaauagauucaugcauauguuucagagcuccuggaacgacuucgccgauuuugaaaagaucuucgugaaaauuagcaauaccaucucugagcgggucaugaaccacuggcaggaagaccugauguuuggguaucaauuccuuaauggauguaaccccgugcugauucgcagaugcacggagcucccugaaaagcugccggugaccacagagauggucgaguguucccuggaacggcagcucagccuggagcaggaaguucagcaaggcaauaucuucaucguggauuuugagcuucuggacgggauugaugcuaacaaaaccgaccccugcacacuccaguuccuggccgcgccuaucugucuucuguacaagaaucucgccaacaaaauugugcccaucgcuauucagcugaaucaaaucccuggagaugaaaaccccaucuuucugccgucugacgccaaguaugacuggcuccuggcuaaaauuuggguccgcuccagcgauuuccacgugcaucagaccaucacgcaccuucugagaacacaucucguuucugagguguuuggcauugccauguaccggcagcugccugcgguccaccccaucuucaagcugcugguggcccacguuagauuuaccauugcuaucaacacaaaggcccgcgagcagcucaucugcgaaugugggcuguucgacaaagcuaaugccaccggaggcggcgggcaugugcaaaugguccagcgggccaugaaggaucugaccuaugcuucccucugcuuuccugaggcgauuaaagccagaggaauggaaagcaaggaggacauccccuacuacuucuaucgcgaugacggccugcuugugugggaagcuauucggacauuuacggccgaggucguggauaucuacuaugagggggaccagguuguggaagaggaucccgaacugcaggacuucgucaacgauguguacguuuauggaaugagaggccgcaaauccucuggguuuccuaagagcgugaagucccgggagcaacucagcgaguaccugaccgucgugauuuucacagccucugcucagcacgccgcggugaauuucggacaguaugacugguguuccuggaucccgaacgcucccccuaccaugagagcucccccucccacagccaaaggcguugucaccauugaacagaucguggauacgcugccggaccgcggccggagcugcuggcaucuuggggccgugugggcccucucucaauuucaggagaaugaacuguuccugggaauguacccugaggaacacuuuaucgagaagcccgucaaagaggcuauggccagauuccgcaagaaccucgaagcgauugugagcguuaucgccgagcggaauaaaaagaagcagcugccuuacuauuaccuuucccccgaccggauuccuaacucuguggcuaucuga

SEQ ID NO: 65755 - RNA, 2532 nt, Artificial Sequence
  derived and/or modified sequence opt5 from ALOXE3__Homo_sapiens__NP_001159432
augcccagaggcgccuuccggccuugccugccggcucucuacuuugccuuccugaccugucccacaccugagcagcgcaugagcgggacgcaagcgcccgacauccaccuuggagaaccugcuagaggcaccgggugcgugcggggaaagcagacauccauucgcguccaggauuguggcagacgggaggaagcccgcgccgcuucuagagagcugcggcgcgaaaaagcccaggagcaucccagagagagcugggcucacccucaaccguaucccgccccucagccccucgcgcugcggccugaaacccagcccugcccggccugucgcuccucuccucccgggagacuucugcuccggccugcucugcccggacaucccuuucugcucccuaucauggccguuuaccgccugugcgugacaaccggcccguaucuuagagcuggcacacuggacaacauuagcgugacccucgucgggacguguggagagucccccaagcagcggcuggauagaaugggccgcgacuucgccccugggucugugcaaaaauacaagguucggugcaccgcggaacuuggagagcugcuccugcugagagugcacaaagagcgcuaugccuuuuuccggaaggauagcugguacuguuccagaaucugcgucacagaacccgacggcagcgugucucauuuuccuuguuaucaguggauugagggguacugcaccguugaacuccgccccggaacagcucggaccaucugccaggauucccugccgcuucugcucgaccacagaacgcgcgagcugcgggccagacaggaauguuaccgcuggaagaucuaugcuccuggcuuccccugcaugguggaugucaauagcuuucaagagauggagucugacaaaaaguucgcccuuacaaaaaccacaaccuguguggaucagggcgacuccagcgggaaccgguaccugccuggauuucccaugaagauugauaucccuucucucauguauauggaacccaaugugagauacuccgccaccaaaacaauuagccugcuguucaacgcuaucccggcgucccucggcaugaagcugcgggggcuucuggaccgcaagggaucuuggaaaaagcucgacgauaugcagaauauuuucuggugccacaaaacguucaccacaaaguaugucaccgagcauuggugugaagaccacuucuuuggcuaccaauaucugaacgggguuaauccugugaugcuucauugcaucagcucccugcccagcaaacuccccgugacaaacgauauggucgccccucugcugggacaggacaccugucuccagacggagcuggaaagaggcaauauuuuccuugcugauuacuggauccuggccgaggccccgacacacugccucaacggccggcagcaauacguggcugcgccccugugucugcuuuggcucucuccucagggggcccugguuccccuggcuauccagcucucccagaccccuggacccgacagcccuauuuuucugcccaccgauucugagugggacuggcuucuggccaagacaugggugagaaauagcgaauuucucguccacgagaacaauacccauuuucugugcacacaucugcuuugugaagccuucgcuauggccacgcuccgccaacugccgcugugccacccuaucuauaaacuccugcuuccccacacccgguacacacuccaggugaacaccauugcuagagccacacugcugaauccugagggccugguugaucaggugaccuccaucgggcgccagggacuuauuuaucucaugucuacgggccuggcgcauuuuaccuacacaaacuucugccugcccgacagccucagagcccgcgggguccuggcuaucccgaacuaucacuaccgggaugacggccuuaagaucugggccgcuauugaauccuuugugagcgagaucgucggauauuacuacccuucugacgccuccgugcaacaggauagcgagcugcaggcguggaccggcgaaauuuucgcccaggcuuuucucgggagagagucuuccggauuccccagccggcuguguacaccuggcgaaaugguuaaguuucugaccgccaucauuuucaauugcuccgcucaacacgccgccgugaacucugggcagcaugacuucggagcuuggaugcccaaugcgcccagcuccaugcgccagccuccgccccaaacgaaaggcacaaccacacuuaagaccuaucucgauacccugccugaggucaacaucucuuguaauaaccugcuccuguuuuggcuugugagccaggagcccaaagaccagagaccucuggggacauaccccgaugaacacuucacggaggaagccccucggcgcuccaucgcugccuuucagagcagacucgcccaaauuucucgggacauccaggagcgcaaucagggccuggcucugccguauaccuaccuugaucccccucugauugaaaacuccguuagcaucuga

SEQ ID NO: 65756 - RNA, 1587 nt, Artificial Sequence
  derived and/or modified sequence opt5 from ALPI__Homo_sapiens__NP_001622
augcagggccccugggugcugcuccugcuugggcugagacuccaacugagccuuggagucaucccugccgaggaagagaacccggcuuucuggaaucggcaggccgcggaagcucuggacgccgccaagaaacuccagcccauucagaagguugcuaaaaaccugauccuguuucucggcgaugggcugggagugccuaccgugacagccacgcgcauucuuaagggccagaaaaaugggaagcugggacccgagaccccucucgcuauggacagauuccccuaccuggcccuuuccaagacauauaacgucgaucggcaagugccugacucugcggccaccgcuacagccuaccugugcggcguuaaagcuaauuuucagaccaucggccucagcgccgcggcccgcuucaaccaguguaauacaaccagagggaacgaagugauuuccgucaugaaucgggcuaagcaagccggaaaaucugugggcguugugacgaccacacgcguccagcacgcuagcccggccgggaccuaugcccauacagugaacagaaauugguacuccgaugcugacaugcccgcgucugcccggcaggagggaugccaggauaucgcuacccaacugaucagcaacauggacauugaugugauccugggcgggggacgcaaguauauguuuccuaugggcacgcccgacccugaguaccccgccgaugccucccagaauggcauuagacucgacgggaaaaaccugguccaggaauggcuugcuaagcaccaaggagccugguauguuuggaaucggacagagcugaugcaggcgagccucgaucagucugugacccaucugaugggccuuuucgaaccgggggacacaaaguacgagauccaccgcgacccuacccuggaucccucccucauggagaugaccgaagcugcccugagacugcucagccggaacccucgcggauuuuaccuguucguggagggcgggagaauugaccauggacaccacgaaggcgucgccuaucaggcucuuacagaggccgugauguuugaugacgcuaucgaacgggccggccaacugacgucugaggaggauacccucacacugguuaccgcggaccauucccacguguucagcuuugggggauacacacuuagagggucuuccauuuucggccuggcccccagcaaagcucaggauuccaaggccuauaccucuauccucuacggaaacggccccggguaugucuuuaauagcggcgugcgcccugacguuaacgaauccgagagcggaucuccggauuaccagcagcaagcugccgugccccuguccagcgaaacgcauggcggggaggacgucgcgguguucgcccggggaccucaggcucaccugguccacggcgugcaggaacagucuuucguugcccaugugauggcuuuugccgccugucucgagcccuauacagcuugcgaucuggcgccucccgccuguaccaccgacgcugcccacccggucgccgcuagccuuccucugcucgccgggacacugcugcuucucggagcguccgcugcccccuga

SEQ ID NO: 65757 - RNA, 3735 nt, Artificial Sequence
  derived and/or modified sequence opt5 from ALPK1__Homo_sapiens__NP_001095876
augaacaaucagaagguggucgccguucugcuccaagagugcaaacaggugcuggaccagcuucugcucgaagcucccgaugugagcgaggaagacaaguccgaggaucagagaugucgggcccugcuuccuucugaacugcgcacccucauccaagaggcgaaagagaugaaguggccguucguccccgaaaaauggcaguauaagcaggcugugggcccugaggacaagacaaaccugaaagauguuauuggggccggacugcagcaacuccuggccagccuuagagcuuccauccuggcccgggacugcgcugccgcggccgcuauuguguuucucgucgaucgcuuccuguauggccuugacgugucugggaagcugcuccagguugccaaaggacugcacaagcugcagcccgcuacgccuaucgcuccccagguggucauuagacaagcgcggaucagcgucaauuccggcaaacuccugaaggccgaauacauccuuucuagccugauuuccaacaauggggcuaccggaacauggcucuaucgcaacgagagcgauaaggugcuggugcagucuguuuguauccagauuagaggccaaauccuucagaaacugggcaugugguacgaggccgcugaacucauuugggccuccaucgugggguaucuggcccugccucagccggacaagaaaggacucagcaccucucugggcauucuugcugauaucuuuguguccaugagcaagaaugacuacgagaaauucaagaacaauccccagaucaaccugucucuccugaaagaauuugaucaucaccuucuguccgcggccgaggcuugcaagcucgccgccgcuuucagcgccuauacaccucuguuuguccugaccgcggugaauauucgggggacaugucuccuguccuacucuagcuccaacgacugucccccugaacuuaagaaucugcaucucugcgaggcuaaagaggccuucgaaaucggacugcugaccaagcgcgacgaugagcccguuacgggcaaacaagaacuucacagcuuugugaaggccgcuuucgggcucaccacaguccauagacggcugcacggagagaccggcacagugcacgccgcuucucagcugugcaaagaagccaugggcaagcucuacaacuuuuccaccagcucucgcagccaggacagagaggcgcugucccaggagguuaugucugugauugcccaagucaaggaacaucuucaggugcagagcuucuccaaugucgaugaccggagcuaugugccggagucuuuugaaugucgccuggauaaacucauccugcacgggcagggagacuuccaaaagauucuggauacguacucccagcaucacacaagcguuugcgagguguucgaaucugacuguggcaacaacaaaaaugagcagaaggaugcuaaaaccggggucugcaucacagcccuuaagaccgagaucaagaacauugacaccguguccacaacgcaggaaaaaccucacugccaaagagauaccggaaucagcuccucucucaugggcaagaauguucagcgggagcugagacgcgggggacggagaaacuggacacauagcgacgcuuuucgcgugucccuggaccaggaugucgaaaccgagacagagcccucugacuauagcaauggcgaaggcgccguguucaacaaaucccucagcgggucucaaaccuccagcgcguggucuaaucuguccggauuuagcucuagcgccuccugggaggaagugaacuaccacguugaugaccggagcgcuagaaaggagccuggcaaagaacaucuugucgauacgcaguguucuacagcccuguccgaggagcucgaaaaugaccgcgaggggcgggcuaugcacagccugcauucccagcugcacgaucuuucucuccaggaacccaacaaugacaaccuggagcccagccaaaaucagccucagcagcaaaugccgcugacccccuucuccccucacaacacccccggaauuuuucucgccccuggcgccgggcugcuugaaggcgcucccgagggaauccaggaggugagaaauaugggcccgcgcaacacaucugcgcauagccggccuuccuauagaucugccagcugguccagcgauucugggcgccccaagaacaugggaacccacccuuccgugcagaaggaagaggcuuucgaaauuaucgucgaguuucccgaaacaaauugcgacgugaaagaucggcagggcaaggagcaaggggaggaaaucagcgagagaggagccggcccuacguucaaagccucucccuccuggguugacccggaaggggagaccgcugagagcacagaagaugccccucuggacuuucaucgggugcuccacaacucucugggcaauauuuccaugcugcccuguagcuccuucacccccaacuggccuguccagaauccggacagccgcaagucuggaggccccguggcggagcaggggaucgauccugacgcuagcacaguugaugaagagggacaacuucucgacuccauggaugugcccugcaccaacggccacgggucucauagacuguguauucugcggcagccucccggacagagagccgaaacgccuaauagcuccgucucuggcaacauccucuuucccgugcugagcgaggacugcaccacaaccgaggaagggaaucagccgggcaacaugcuuaauuguucccaaaacucuagcuccagcucuguuugguggcugaaauccccugccuucagcucuggauccagcgagggcgauucccccuggucuuaccucaauagcuccgggagcucuugggugucccugccuggaaagaugcgcaaagaaauucuggaggcucggacacuucagcccgacgauuuugaaaagcugcucgccggcgucagacacgacuggcuguuccagcgccucgagaacaccgggguguucaagccgagccagcugcauagagcgcacucugcccuucugcucaaauauagcaagaaauccgagcuguggacggcccaagaaacaaucguguaccugggagauuaccuuaccgucaagaaaaagggccggcagcgcaaugccuuuuggguucaucaucugcaccaggaggaaauucucgggagauaugugggcaaggacuacaaagagcagaagggacuguggcaccacuucacagauguggaacggcaaaugaccgcucagcauuaugucaccgaguuuaacaaacgccucuacgagcagaacaucccuacacagaucuucuauauucccucuacgauccugcuuauucuggaagacaagaccaucaaaggcugcauuagcguggagccuuacauccucggggaauuuguuaagcuguccaauaacacaaagguggucaaaaccgaguauaaggccacagaguacggacuggcuuacggccacuucucuuaugaauuuagcaaucauagagacgugguuguggaucuucaagggugggucaccggaaacggcaaaggccugaucuaccucacggacccccagauucacuccguggaucagaagguuuucacaaccaauuuugggaaacggggaaucuucuacuuuuucaacaaucaacacguggaguguaacgaaauuugccaucgccugagccucaccagacccucuauggagaagccuuguacauga

SEQ ID NO: 65758 - RNA, 6513 nt, Artificial Sequence
  derived and/or modified sequence opt5 from ALPK2__Homo_sapiens__NP_443179
augaaggacagcgagggcccccagagaccuccgcugugcuuccuguccacccugcuuucucagaaagugcccgaaaagagcgaugccguucugcggugcaucauuuccgggcagccuaaacccgagguuaccugguacaagaacggacaggcuaucgacggcucugggauuaucagcaauuaugaauuuuucgagaaccaguacauucacgugcugcaucuguccugcuguacgaaaaaugaugccgcgguguaucaaaucucugcuaagaacagcuuuggaaugaucugcuguuccgccagcgucgaaguggaguguucuuccgagaauccucagcuuagccccaaccuggaagacgaucgcgacagaggcuggaagcacgagaccgggacccaugaagaggagcgggccaaucagauugaugaaaaagagcacccuuacaaggaagaggaaucuaucuccccgggaacaccccgcagcgcugacucuuccccuagcaaauccaaccauucucucagccugcagucccugggcaaucucgauauuagcguuucuuccagcgagaacccccugggcgugaaggggacaagacacaccggagaggccuaugacccuucuaauacagaagagaucgcuaacggccuucuguuccucaauagcucccacauuuacgaaaaacaagaucgguguugccauaagaccguccacucuauggccagcaaguuuacggacggggaucugaacaaugacggaccccaugacgagggccuucgcuccagccagcagaacccgaaagugcagaaguauaucucuuucucccugccucucagcgaagcgaccgcccacauuuaccccggggauucugcuguugccaacaaacaaccuagcccccaacuguccuccgaggacucugauagcgacuacgagcugugucccgaaaucacacucaccuauacagaggaauuuuccgaugacgaucuggaguaccuugaaugcucugacgugaugaccgauuauagcaaugcugucuggcagagaaaccugcucggaacggagcacguguuccugcuugaguccgacgaugaagagauggaauuuggcgagcauugucugggcgggugcgagcacuuccucagcggaaugggcugcgggucucggguguccggagacgccggcccuauggucgcgacagccggguuuuguggacaucacagccaaccgcaggaaguuggcgugagaucuuccagagugagcaagcauggccccucuagcccucagaccgggaugacacugauccugggaccccaccaggacggcaccuccagcgucaccgagcaagggcgguacaaacucccuacagcucccgaagccgcugagaaugauuauccgggcauucagggagaaacgcgcgacucucaccaggccagagaggaguucgccuccgauaaccugcuuaauauggacgaaagcgugcgggagaccgaaaugaagcugcucuccggggagucugaaaacagcggcaugucccagugcugggagacagcugcggauaaacgcguuggaggcaaggaccuguggucuaagagagggagccggaaauccgccagagugcgccaaccuggaaugaagggcaaucccaaaaagccuaacgcuaaucuucgggagucuaccacagaagggacccugcaucucuguagcgccaaagaguccgccgaacccccucugacgcagagcgauaagagagagacaucucacaccaccgcugccgcgacaggacgcuccagccaugcugacgcccgggaaugcgccaucucuacccaggcugagcaggaggccaagacacugcaaacguccaccgauagcgucucuaaagaaggcaacacaaauuguaagggggagggcaugcaagugaacacccucuuugaaacaucccagguucccgacuggagcgauccgccucaggugcaaguccaggagaccgugagagagacgauuuccugcagccagaugcccgcuuucucugaacccgccggagaggaaagcccuuucaccggcacaaccacaaucuccuuuucuaaucucgggggaguccacaaagagaacgcgagccuugcccaacacuccgaagugaagccguguaccugcggcccccagcaugaggagaaacaggaccgcgaugggaauauuccugacaacuuccgggaagaccugaaguacgagcagucuaucagcgaagcuaacgaugagacgaugucccccggagucuuuucuagacaccucccuaaggacgcccgcgcugauuuccgggaacccguggccgucagcguggcguccccugagcccacagacaccgcccugacacuggagaauguuugugaugaaccgagagaccgcgaggcugugugcgccauggaauguuuugaggcuggcgaucaagggaccugcuucgacaccaucgauagccuugucggccggccuguggacaaauauucuccccaggaaauuugcuccguggauacagagcucgccgagggacagaacaagguuagcgaccuguguucuuccaaugauaaaacgcuggaagucuuuuuccagacccaagugagcgagacauccgugucuaccugcaagagcuccaaagacggcaacagcgucaugucuccucucuuuacauccaccuucacgcugaauaucagccauacagccucugaaggggcuaccggagagaaccuugcgaagguggagaauagcaccuacccccuggccuccacaguucacgcuggccaggaacagccgucuccuagcaacuccgggggacucgacgagacccagcugcugucuagcgaaaauaacccccuugugcaauuuaaggagggcggggauaaauccccuagccccucugccgccgacacaacggcuacccccgccuccuacagcuccauugucucuuucccuugggaaaagccgacaacccucacagcgaauaacgaguguuuucaggcuaccagagagacggaagauaccagcacagugaccaucgccacagagguucaucccgccaaauaucuggcuguguccauuccugaagacaagcacgccggcggaaccgaggaacgguucccccgcgcgucucacgagaaagucagccaguucccuucccaagugcagcuggaucauauccucagcggcgcuacaaucaagucuaccaaagagcugcuuugcagagcccccuccguuccuggggugccgcaccauguccugcagcuccccgaaggagagggcuuuuguagcaauucuccucuccagguggacaaccuguccggggauaagagccaaacgguggaccgggccgauuucagaucuuacgaagagaauuuucaggaacgcggaagcgagacaaagcagggcguccagcaacagucccuuucucagcagggcagccucuccgcucccgacuuccaacagagccugccuaccaccuccgccgcucaggaggaacggaaccugguucccacagcccacucuccggcgagcuccagagagggggccggacagcgcucuggcugggggaccagagugagcguggucgcugaaacggccggagaggaggauucccaagcucucucuaacgugccuagccuguccgacauucuucuggaagagagcaaagaauaucggcccggcaauugggaggccgggaacaagcucaaaaucauuacacuggaagccucugcuuccgagaucuggcccccucgccagcugaccaauagcgagucuaaggcguccgacggaggccuuauuauccccgauaaaguuugggccgugccugacagccucaaggcugaugccgucgugccggaacuggcccccucugagauugcugcccuggcgcauuccccugaagacgcugagagcgcccucgccgauuccagagaaagccacaagggcgaggagcccacaaucucuguucacuggcggagccuguccucucgcggguuuagccagccuagacuucuggaauccucuguggaccccgucgaugagaaagaacucagcgugaccgacucccugucugcugccagcgagacaggaggcaaggaaaacguuaauaacgugucccaagaucaggaggagaaacagcugaagauggaccauaccgcguucuuuaaaaaguuccuuacgugcccgaagauccuggaaagcucugucgauccuauugacgagaucuccgugauugaauacacccgggcugggaaacccgagccuagcgagacaacaccccagggagcccgcgaaggcgggcaaucuaaugauggaaacaugggccacgaggccgaaauccagccugcuauucuccaggugcccugucugcagggcacaauccucuccgagaauagaaucagccggucccaagaagggucuaugaagcaggaggccgagcagauucagccggaagaggcuaaaaccgccaucuggcaaguccugcagccuagcgaaggaggcgagcgcauucccuccgggugcagcaucggacagauucaagaaucuuccgacggcagccuuggggaggcggagcagucuaagaaagacaaggccgaacugaucagccccacguccccucucucuagcugucugccgaucaugacacaugcuucccugggaguugauacccacaacucuacaggccagauucacgacgugcccgagaaugauaucguggaaccuagaaagcggcaguaugucuuucccgugagccagaagcgcggcaccauugagaacgaacgcgggaagccucuucccuccagcccugaccugacccgguucccgugcacaucuucccccgagggaaauguuacggauuuucucaucagccauaaaauggaggaaccuaagauugaggugcugcagaucggcgaaaccaaacccccuuccucuagcuccucuagcgccaagacacucgcuuucaucuccggggagagagagcuggaaaaagcccccaaacuucugcaggacccgugucagaagggaacccucggcugcgccaaaaagagccgcgagcgggaaaaaucucuggaggcuagagcggggaaguccccuggaacacugaccgccgucacgggcagcgaagaggugaaacgcaagcccgaggcucccggcucugggcaccuugccgaaggaguuaagaaaaagauucugucccggguggccgcucucagacugaaacucgaggaaaaggagaacauccgcaaaaauagcgccuuucugaagaagaugccuaaacuugaaacaucucugucccauaccgaggagaagcaagaucccaaaaagccuagcugcaaacgggaaggcagagcgccgguccugcucaagaagauucaggcugagauguuccccgaacacucugggaacgugaaacugagcugucaguucgccgagauccaugaagacuccaccauuugcuggacaaaggauagcaaauccaucgcccagguccaacggucugcuggagacaacagcaccguguccuuugccauuguucaggcgucuccuaaggaucagggccuuuacuauuguugcaucaaaaauagcuacgggaaggugacagccgaguucaaccugacggcugagguccucaagcagcuguccucucgccaagacaccaaaggaugugaagagaucgaauuuagccagcucauuuucaaggaggauuuucugcacgacuccuacuucggcggcagacuucgggggcagaucgccacagaggaacugcacuuuggagagggcgugcaucgcaaggcuuucagaagcaccguuaugcacgggcugaugcccguguuuaagccuggacaugccugcguccucaaagugcacaaugcuauugccuauggcacacggaacaaugacgaacugauccaaagaaacuacaaacuugcggcccaggaguguuaugugcagaauaccgcucgcuacuaugccaaaauuuacgcugccgaagcccagccccuggagggguucggagagguuccggaaaucaucccuauuuuucucauccaccggcccgagaacaauauuccuuaugcuacggucgaagaggaacugaucggcgaguucgugaaguacucuauuagagauggcaaggagaucaacuuccuccgccgggaauccgaggcggggcaaaaaugcuguaccuuucagcauuggguguaccagaagacaagcggaugccugcuugucaccgacaugcagggcguggggaugaaacugacagauguuggaaucgccacccuggcuaagggcuauaaaggguucaagggcaauuguucuaugacauuuauugaccaauucaaggcccuccaccagugcaacaaauacugcaagaugcugggacuuaaaucccugcagaauaacaaucagaagcaaaaacagcccagcaucggcaagucuaaggugcagacgaacuccaugaccauuaaaaaggccgggccugaaacacccggagagaaaaagaccuga

SEQ ID NO: 65759 - RNA, 5724 nt, Artificial Sequence
  derived and/or modified sequence opt5 from ALPK3__Homo_sapiens__NP_065829
auggagguggccuggcuggucuacguucucggccagcaaccccuggcuagacagggggaaggacagagccggcuugugccuggccgcgggcuggugcucuggcugccgggacuucccagauccucuccuagcuggcccgccgucgaccuggcgccucucgcucccgcccggccucgcggcccgcugaucugccacaccgggcaugagcaggccggaagagaacccggcccuggcuccucuacaaaggggcccgugcugcacgaucaagacacgcggugugcuuuccucccucgccccccgggaccucugcagaccagacgguauugccgccaucagggcagacaggggagcggacuuggcgccgggcccggagcuggcacaugggccccugcgccccccggcguuuccaaaccucgguguccggggcgcgccagacccggagagggccaacagcaggugaccacagcucggccucccgccauuaaccgcggggcuagacagccucgggccggagcggccgcugccggcagagggcccggagcuggcgccuggcgcaccggcgaagccgcugcgucugccgggccggcugucggagagggcggggccaugggaagccggagagccccuucccgcggcuggggggcuggcggacggagcggcgccgggggagauggcgaggacgaugggcccguguggaucccuucucccgcguccagaagcuaccugcucucuguucgcccugaaacaucccugagcucuaaucggcuuucccaccccagcuccggaagaucuaccuuuugcagcauuaucgcucaacugacggaggaaacccagccgcucuucgagacaacccugaagucccgcagcgugucugaggacuccgauguccgguuuacauguauugugaccggcuauccugaacccgaggugacgugguacaaagacgauacagaacuggacagauauugcgggcuccccaaguacgagaucacccaucagggcaaccgccacacacugcaacuuuaucgguguagagaagaggaugccgccaucuaccaggcuagcgcccagaauucuaaaggaauugucagcugcuccggcguucuggagguggggaccaugaccgaauacaagauccaccagcggugguucgcuaagcucaaacgcaaggccgcggccaaacugagagagauugaacaaucuuggaagcaugagaaagcugugccuggagaagucgacacacuucggaagcugagcccggauagauuucagcgcaagcggagacucuccggcgcccaggcucccgggccuagcgugcccacgcgcgagccugagggaggcacccuggccgcguggcaggaaggggagacagaaaccgcccaacacucuggccugggacucaucaacuccuucgcuagcggcgagguuacaaccaauggggaagccgcucccgagaacggagaggacggcgaacaugggcugcuuacguauauuugugacgccauggagcugggaccucagagagcccucaaagaagagucuggcgcuaagaaaaagaaaaaggaugaggaauccaaacaggggcugcggaagcccgagcuugaaaaggcggcccagagccgcagauccucugagaauugcaucccgagcuccgacgaaccugauucuuguggcacacaaggacccgugggcgucgagcaggugcagacccagccucgggggcgcgcugccagaggacccggcagcuccgggaccgacagcacacggaaaccggccucugcuguuggaaccccugauaaggcccaaaaagcgcccggcccuggccccgggcaggagguguacuuuucccugaaggacauguaucucgaaaacacacaggcuguccgcccccugggagaggaaggcccucaaacgcugagcgugagagccccgggggagucucccaaaggaaaggccccucuccgggcucgcuccgaaggcguccccggggccccuggacagcccacccacagccugacaccucagccgaccagacccuucaaucggaagagauuugcgccucccaaaccuaagggcgaggcuacaaccgauucuaaacccauuagcucccuuagccaggccccggagugcggcgcccaaucucuggggaaggcuccuccccaggccuccgugcagguucccacgccucccgcucgccggagacacggaacccgcgacagcacacuccagggccaagccgggcaucggaccccuggagaagugcuggagugccagacaaccacggcgccgacaauguccgccucuagcuccucugaugucgcuagcaucggcguguccaccucugggagccagggaaucauugaacccauggacauggagacacaggaagauggcagaaccuccgccaaccaacgcaccggcagcaaaaagaauguucaggcugacgggaagauccagguggacggacggacaagaggcgaugggacgcaaaccgcccagcgcacacgggccgacagaaaaacccaggucgaugcuggaacacaggagucuaagcggccucaauccgaccgcagcgcgcagaaaggcaugaugacccaggggagagccgagacgcagcuggaaacaacccaagcuggagagaagauucaggaagaucggaaagcccaggccgacaagggcacccaggaggaucgcagaaugcaaggcgagaaggggaugcagggagaaaaaggcacacagucugagggguccgcucccaccgccauggaaggacagagcgagcaagaaguggcgacaucucuuggcccucccucccggacgccgaagcucccucccaccgcugggccuagagccccccugaacaucgaguguuucgugcagacaccugagggaagcugcuuucccaaaaagccgggcugucugccucgcuccgaagaggccguugucaccgcuagccggaaucacgaacagacagugcucggcccccugucugggaaccuuaugcugcccgcccaaccuccgcaugagggaagcguggaacaggucggcggggagagaugccgcggaccccaguccucuggcccuguggaggcgaaacaggaagacagccccuuccaauguccuaaggaggaacggcccgggggaguuccuugcauggaucagggcggcuguccgcucgcugggcugucccaggaggugcccaccaugccuucucugcccggaacgggccuuaccgccagcccuaaagccgggcccugcuccacaccgaccucucagcacggaagcacagcuaccuuucucccuuccgaagaccaaguccugaugagcucugcccccacacugcaucucggccuggggacccccacgcagucccacccucccgagacaauggcuaccagcucugagggagccugugcgcaggugccugauguugaaggcagaaccccgggcccccgcuccugcgacccugggcuuauugauagccugaagaauuaccuccugcugcuucucaagcuguccucuacagagaccagcggagccggcggggaaucccaggugggagcugccacgggcgggcugguccccagcgcuacacucaccccuacaguggagguugccggccugucuccccggaccuccagacgcauccuugagagaguggaaaacaaccaccugguccaaagcgcccagacacuccugcugucuccguguaccagccggcgccuuacgggacuccuggacagagaggugcaggcuggccggcaagcgcuggccgcugcccgcggguccuggggaccuggccccucuagccucaccgugccugccaucgucguugacgaagaggaucccgggcuggcuuccgaaggagccucugagggcgagggggaagugagcccugagggccccggacuucugggcgcgucccaggaaagcucuauggcugggagacucggagaggccggcgggcaggccgcuccgggacagggcccuuccgccgaaagcauugcgcaagagcccucccaggaggaaaaauuccccggggaggcccugacaggccugccugcugccaccccggaagagcuugcucugggagcccggagaaagcgcuuccuccccaaagugcgggcugccggcgacggggaagcgacaaccccugaggagagagaaucucccacggucagcccucgcggaccccggaagucccuggugccuggcucucccgggacaccgggaagagagcggcgcagcccuacccagggcagaaaagccuccaugcucgaaguuccccgggcugaggaggaacuggccgcuggcgaucuugggccuagccccaaggccggaggccuggacacagagguggcccucgaugaagggaagcaggagacccuggcuaaaccgcgcaaggcgaaagaccugcuuaaggccccucaagucaucagaaaaauucggguggaacaguuucccgaugcuucuggaucccugaagcucuggugccaguucuuuaauauccugagcgacucuguucucaccugggccaaggaucagcgccccgugggcgaggucgggagauccgccggagacgagggcccugcugcccuggcgauugugcaagccagccccguugauugcggcguguaucgguguacaauccauaacgaacacgggucugcuagcacggacuucugccuuuccccugagguccugucuggauuuaucagccgcgaagagggcgaagugggggaggagauugaaaugaccccgaugguguucgccaaaggacucgcugauuccggcuguuggggggacaagcuguuuggaagacuggucagcgaggaacuucggggcggcggguacggaugcggccugagaaaagccucccaggcgaagguuaucuaugggcucgagcccauuuucgaaucuggacgcacauguaucauuaaagugagcucccugcucguguuuggcccuucuagcgagaccucccuggucgggcggaauuacgacgugacaauccagggaugcaagauucagaacaugucuagagaguacuguaagaucuucgccgcugaagcccgcgcugcccccggcuuuggcgagguuccugaaaucauuccccuuuaucugaucuaccggccugcuaauaacauuccguaugccacccuggaggaggaucucgggaaaccccuggaaagcuacugcuccagagaguggggaugugcggaagccccuacggcuagcggcucuuccgaggccaugcaaaagugccagacauuccagcauuggcuuuaucaauggaccaaugggagcuuucuggugaccgaccucgcuggagucgauuggaaaaugacagacgugcagaucgccaccaagcugcgcggcuaccaggggcucaaagaaucuuguuuccccgcccugcuugaucgguucgcguccagccaccagugcaacgcuuauugcgagcugcugggacucacaccucugaagggccccgaggccgcucacccgcaagccaaagccaagggcucuaaguccccuagcgcugggagaaaaggaucccagcuuagcccccagccccagaagaaaggccugccuucuccccaagggacgcgcaagagcgccccuuccucuaaagcgaccccgcaggccagcgaacccguuacaacccagcuccugggacagccucccacacaagaggaaggcuccaaggcucaggggaugcgguga

SEQ ID NO: 65760 - RNA, 1608 nt, Artificial Sequence
  derived and/or modified sequence opt5 from ALPP__Homo_sapiens__NP_001623
augcugggccccugcaugcuccugcuucugcuccugcuugggcugagacuccagcugagccugggaaucauuccuguggaggaagagaacccggacuucuggaaucgggaagccgcugaggcccucggcgcggcuaagaaacugcaacccgcccagaccgccgcuaagaaccuuaucauuuuucugggggauggaaugggcgucuccacaguuacggccgcucgcauccucaaagggcagaagaaagacaagcugggaccugaaauuccccuugccauggauagauucccuuacguggcgcugucuaagaccuauaauguggacaaacacguccccgauagcggcgccacagcuaccgccuaccucuguggcgugaaggggaacuuucagacaaucggacuguccgcugccgcgcgguucaaucaaugcaacaccacacgcggcaaugagguuaucucugugaugaacagagccaaaaaggcugggaaaagcgucggagugguuaccacgacccgggugcagcaugccuccccugcuggcacauaugcccacaccgucaaucgcaacugguacucugacgccgaugugccggcuagcgcgagacaggaggggugucaggacauugccacacaacugaucuccaauauggauauugacgugauccucggaggcggccggaaguauauguuucgcauggggacccccgauccugaauaccccgacgauuauagccagggaggcacgagacuggacgggaagaaccuuguccaggaguggcuggcuaaacggcagggagcccgcuacguuuggaauagaacagaacucaugcaagccucucuggacccuuccgugacccaucuuaugggccuguucgagcccggggauaugaaguacgagauucaccgggacagcacacucgauccgucucugauggaaaugaccgaggcugcccugcgccuccuguccagaaacccucggggauuuuuccuuuuuguggaaggcggcagaaucgaccaugggcaccacgagagccgcgcguaucgggcucugaccgaaacaauuauguucgaugacgccaucgagagagccggacagcucacgucugaggaagauacccugucccuugucacagcugaccauagccacguguuuuccuucggcggguacccccugcgcggaucuagcaucuuuggccucgccccugggaaagcucgggauagaaaggccuauaccguucugcuguacggcaauggacccggcuaugugcucaaagacggggcgcgccccgaugucacagaguccgaaagcggaucuccugaguaccggcagcaauccgccgugccgcuggacgaagagacccaugcuggcgaggacguugccguguucgcuagagggccccaggcccaccuuguccacggagugcaggaacagacguucauugcgcaugucauggccuuugcugccugccuggagccuuauacagcuugugaucucgcucccccugccggcaccaccgacgccgcgcaccccgggcgcagcgugguuccggcccugcugccucuucucgcuggcacacugcugcuccuggaaaccgccacagcccccuga

SEQ ID NO: 65761 - RNA, 1599 nt, Artificial Sequence
  derived and/or modified sequence opt5 from ALPPL2__Homo_sapiens__NP_112603
augcagggccccugggugcugcuccugcuugggcugagacuccaacugagccuuggaaucauuccugucgaggaagagaacccggacuucuggaaucggcaggccgcugaagcccugggcgcggcuaagaaacuccagcccgcccagaccgccgcuaagaaccugaucauuuuucugggggauggaaugggcguuuccacagugacggccgcucgcauccucaaagggcaaaagaaagacaagcugggaccugagaccuuccuugccauggauagauuucccuacguggcgcugucuaagacauauagcgucgacaaacacgugccugauuccggcgccaccgcuacagccuaccucugcggcguuaaggggaauuuccagaccauuggacugucugcugccgcgcgguuuaaccaguguaauacaacccgcggcaacgaagugaucagcgucaugaauagagccaaaaaggcugggaaauccgugggaguugugacgaccacacggguccagcaugccucucccgcuggcgccuaugcccacaccgugaaccgcaauugguacagcgacgcugaugugccugcguccgccagacaagaggggugccaggacaucgcuacacagcuuauuagcaacauggauaucgacgucauucugggaggcggccggaaguauauguucccgauggggacccccgauccugaguaccccgacgauuauucucagggaggcacgcgccucgacgggaagaaucugguucaagaauggcuggccaaacaucagggagccagauacguguggaaccggacagagcuccugcaggcuucccuugacccuagcgugacccaccugaugggccucuuugaacccggggauaugaaguacgagauccaucgcgacucuacacuggauccgucccuuauggagaugaccgaagccgcgcugcuccugcugagcagaaauccucggggauucuuucucuucgucgagggcggccgcauugaccacgggcaccaugaaucuagagcuuaucgggcccugaccgagacaaucauguuugaugacgccauugaaagagcuggacaacuuacguccgaggaggauacccugagccucgugacagccgaccacucccauguuuucucuuuuggcggguacccccugcgcggaagcuccaucuucggccuugcuccugggaaagcccgggauagaaaggcguauaccgugcugcucuacggcaacggacccggcuauguccugaaagacggggcccgccccgaugugacagaaagcgagucuggauccccugaauaccggcagcagagcgcuguuccgcuggacggcgagacccacgccggggaagacguggcugucuucgccagaggaccccaggcgcaccucgugcauggcguccaagagcagacguuuaucgcccacgugauggcuuucgccgcuugucuggagccuuauacagccugcgaucuugcuccccgcgccgggaccaccgacgcggcccauccuggccccucuguugugccggcucugcucccucugcuggccggaacacuucuccugcugggcaccgccacagcucccuga

SEQ ID NO: 65762 - RNA, 2862 nt, Artificial Sequence
  derived and/or modified sequence opt5 from ALS2CL__Homo_sapiens__NP_001177636
augugcaaccccgaggaagccgcucugcucagacuggaggaaguguucagcgccacccuugcgcacgucaauucccugguucuccagccucugcuuccggcugcccccgacccuucugaucccuggggccgggagugucugcgccuccugcaacagcugcauaagagcucccagcagcucugggaagugacagaggagucucugcacagccuucaagaaagacugcgguacccugacuccacggggcucgagucucugcuucugcuccgcggagccgauagagugcugcaggcucauaucgaauauauugagagcuacaccuccugcauggucgugcaggccuuucagaaagcugccaagcggcgcagcgaguauuggagaggccaacggaaagcgcugcgccagcuccugucugggguuuccagcgaaggaucugugggcgccucccuugggcaggcucugcaccagccccucgcccaucacguccaacaguacgugcugcuucugcucagccugggagacacaaucggcgagcaccauccuaccagagaacugguugugaacgcugucacacucuucggcaaucugcagucuuuuaugaagcaagagcuugaucaggccguggcgacccaggcccuguggcacacacuccgggggcgccugagagacgugcuuuguaccccggcucaucggcugcuccaggauucccaagacguccccguuacgguggccccucugcgcgcugaaagagugcuccucuucgaugacgcccugguccuucugcagggacacaacgugcacaccuuugaucucaaacugguuuggguggaccccggccaggaugggugcacauuccaucugcuuaccccugaggaggaauuuagcuucugugccaaggacucccagggacaagcugucuggcaguggaaggugacaugggcgguucaccaggcccuccauggcaaaaaggacuuucccgugcugggggcuggacuggagccgucucagccucccgauugccggugugccgaauauaccuuccaagccgagggcagacucugccaggcuacguacgaaggcgaguggugucgcgggcggccucacggaaaaggcacacugaaguggcccgacgggagaaaucaugucggaaacuuuugccagggccuugagcacggguucggcauucgccugcucccccaggccagcgaagauaaauuugacuguuauaagugccacuggcgggagggauccaugugcggcuacgggaucugugaauacagcaccgaugagguguauaagggauacuuccaagaaggccugagacauggguucggaguccuggagucuggcccucaggcgccgcagcccuuucgcuauacagggcacugggagcggggccaaagauccggauacggcauugaagaggacggggaucgcggagaacgguauaucggcauguggcaggcugggcagagacauggaccuggcgugaugguuacccaggccggggugugcuaccaaggcaccuuccaggccgacaaaacagucggacccggcauccuucucagcgaggaugacucucuguaugaggggacguuuacccgcgaucugacacucaugggaaagggcaaagugaccuucccuaauggguuuacacuggaaggcagcuucggauccggggcuggccggggacuucacacccagggcguucuggacacggccgcucugcccccggacccuucuagcacauguaagagacagcugggggugggagccuuucccgucgagucccgguggcaaggcguguacagcccuuuccgcgauuuugugugcgcggggugucccagagaccugcaggaagcccuucucggauucgauguucagucuucccgggagcugagacgcagccaggacuaccugucuugcgaacggacccacccugaggauuccgucggcagcauggaggacauucucgaggaacugcuucaacauagagaacccaaagcucugcagcucuaucugcgcaaggcccuguccaacucucuucacccgcucgggaaacugcugagaacccucaugcugacauuucaggcuaccuacgccggcgugggagcgaauaagcaucuucaagagcuggcccaggaagaggugaagcagcacgcucaggagcucugggccgcuuaucggggccugcugcgcgucgcccuugaaagaaaagggcaagcccuggaggaagaugaggacacagaaacgcgggaucuccaggugcauggacugguucucccucugaugcuucccagcuucuacuccgagcuguuuacccucuaucugcugcuucacgagcgcgaagacucuuucuacagccagggcaucgcuaaccugucccucuuccccgauacacagcugcucgaguuucuggacgugcaaaagcaccuuuggccucugaaagaucucacccugacaagcaaucagagauauucucugguccgggacaaguguuuccuuuccgcgaccgaaugccugcagaaaauuaugacgaccguggacccgcgcgagaagcucgagguucuggaaagaacauacggggagaucgaaggaaccgugagccggguccucggccgcgaguacaagcugcccauggaugaccuucugccucugcucauuuaugugguuucuagagcccggauccagcaucugggcgcugaaauucaccuuaucagagauaugauggaccccaaccauacagggggacuguacgauuuucuccugaccgcccucgaguccuguuaugagcacauccaaaaagaagacaugcgccugcaucggcuuccuggccacuggcacagcagagagcugugguga

SEQ ID NO: 65763 - RNA, 1269 nt, Artificial Sequence
  derived and/or modified sequence opt5 from ALS2CR12__Homo_sapiens__NP_001120863
auguaccccaacccucugaucuauugcaccuguugggacccguggaaucucggccccagaaagcugauuaaaacaccucagcuuccccggaagaacagcacgggguccucuaaacugaccccucucgugcccgccccuaagaaucacaacuaccugcaaccgacaaaacccgucguuagcccuaagaugaagauccauuccgcucgccaggaggaaaccaauaaaucuuucuaugaggugauuaacgugagccccggauaccagcuugucagaaaucgggaacagaucuccgugacacugggcgaugagauguuugaccgcaagaaaagaugggaaucugagauuccugauaaggggcgguucagccgcaccaacaucaucuccgaccucgaggaacaaauuagcgagcugacagccaucauugaacagaugaauagagaucaccagucugcgcagaaacugcucuccagcgagauggaccugcggugcgcugagaugaagcaaaacuuugaaaauaagaaccgcgagcuuaaagaagcccaugaggccgaacugucugagcucgagaauaacuauaaggcugcccugaaagcugaaaaacuugccgcgcaggagaagcuggaagagaugggaaaggaauacaaauaucucaagaauauguucagaaccuaccaggauuccaucuacgacgagauggaggaaaaguggagcaaacagaaggccaaauggaagaaagaugagaaguuugaacgggagaacauucugcugcaacagaagaaaaagaugacgaaaaaguucgaaauggagucuggcgaggaagacaaaaagaucaacgaguccuguagcgcuguuuuugaaaauuucauucaggagaaggaggaacuccugaaacaacaccaguccgauacccuucagcuggaggaacuccgcaagacaaaagaggugaugcaggaggaacugcaugcccaagcucuuauccuggagucucucaacaccaaucuguauuacacacagcuggaacuccagaaggagaaagccaucgucgggaaccuggaaaagaugcuucagaccaaguuugcggagacggaagagaaauauaagcacacaauucaaauccugaccgaggaaaauauucaccucaaacagaagaucauuagcaaaaacgaggaaaucugcgagggauguuccggcagacuggccagcaucacagugucuaaggacgauuccgacaccguucaggacggcagcaaaaaggggcaggaaucuuga

SEQ ID NO: 65764 - RNA, 1191 nt, Artificial Sequence
  derived and/or modified sequence opt5 from ALS2__Homo_sapiens__NP_001129217
auggacagcaagaaaagauccucuaccgaggccgaaggcagcaaggagcgggggcuggugcacaucuggcaggcuggauccuuccccauuacaccugaacgccucccgggcuggggaggaaaaacgguccugcaagccgcgcuuggcguuaagcauggggugcugcucaccgaggauggagaaguguacucuuuuggcacacugcccuggagaagcggcccugucgagaucugccccuccucuccuauucuugagaacgcucugguggggcaguauguuaucaccguggccacagggagcuuccacuccggcgccgucaccgacaaugggguggcuuacauguggggagaaaacagcgccggccagugugcuguugccaaucagcaauaugugcccgagccuaacccggucucuauugcggauuccgaagccagcccccuccuggcugugcggauccugcagcucgccugcggggaggagcauacacuggcucuuucuaucucccgcgaaauuugggccuggggaaccggcugucagcugggccucaucacgaccgcguuuccugugacaaaaccccagaaggucgagcaccuggccgggagaguugugcuucaaguggcuugcggagccuuccauagccuggcucucguccagugucugccuucucaggaccugaagcccgugccggaacggugcaaucaguguucccaacuccugauuaccaugacagauaaagaggaccacguuaucauuagcgauucccacugcuguccucuuggcgugacccugacggaaucucaggccgagaaccaugccagcacagcucucucccccagcaccgagacacuggaccgccaggaagaggucuuugaaaauacccuuguggcgaacgaucaaucuguugccaccgagcugaaugcuguguccgcccagaucacaagcucugacgccaugagcucccagcagaacgucauggggacgaccgaaauuucuagcgcuagaaauaucccuuccuaccccgauacacaagccgugaacgaguaucuccggaagcugagcgaccacucuguccgcgaggauuccgaacauggagagaaacccgugccuagccagguuccggcgcaguucuacaagaucaaagugugccuggaacucaauuguaugggcuuuucucuggagacccuuaaguga

SEQ ID NO: 65765 - RNA, 981 nt, Artificial Sequence
  derived and/or modified sequence opt5 from ALX1__Homo_sapiens__XP_005269222
auggaguuccugagcgaaaaguuugcccucaaaucucccccuuccaagaacagcgacuucuacaugggcgcugggggaccgcuggagcacgugauggaaacccuugauaaugaguccuuuuauucuaaagccagcgcgggcaagugcguccaggcuuucgggccccugccuagagccgaacaucacguucggcucgagcgcacaucccccugucaagacucuagcgugaacuacggaaucacgaaaguggagggccagccucugcauaccgaacuuaauagagccauggauaacugcaauucccugcggaugagccccgucaaggggaugcaggagaagggagaacucgacgagcugggcgauaaaugugacucuaacguguccagcucuaagaaacgcagacaccggacaaccuuuacaucccugcagcucgaggaacuggagaagguuuuccagaaaacccauuauccugauguguacguccgcgaacaacuugcucugagaacagagcucaccgaagcccgggugcagguuugguuucagaaucgcagagcuaaguggcggaagcgcgagagauauggccaaauucagcaggccaaaagccacuucgcggccacguacgacaucucugugcugccgcggaccgauuccuauccccagauucaaaacaaucuuugggcugggaacgccagcggaggcuccgucgugacaucuugcaugcugccucgcgacaccagcuccuguaugacacccuacagccacucuccuagaaccgauuccagcuacacgggguuuucuaaucaucagaaccaguucagccacgugccccucaauaacuuuuucacagacucccugcugaccggagcuacaaauggccaugccuuugagaccaagccggaguucgaacggagaucuagcuccaucgcgguccuccgcaugaaagccaaggaacacaccgcuaacauuagcugggccauguga

SEQ ID NO: 65766 - RNA, 1236 nt, Artificial Sequence
  derived and/or modified sequence opt5 from ALX4__Homo_sapiens__NP_068745
augaacgccgagaccugcgugagcuacugugaaucccccgcugccgcgauggacgcuuauuacucuccugucagccaguccagagagggcucuagcccguuccgggccuuucccgggggagauaaguucggcacaacguuucuguccgccgcugccaaagcucaaggguucggagacgccaagucucgcgcgagauauggcgccgggcagcaggaucucgcuaccccucuggaaagcggagccggcgcucggggcuccuuuaauaaauuccagccccaaccuagcacaccccagccucagccgcccccucagccccaaccucagcagcagcaaccccagccgcagccucccgcccaaccucaccuuuaccugcagcgcggggcgugcaagaccccucccgacggaucucucaaacugcaggagggcuccagcgggcauucugccgcucuccagguucccuguuaugccaaggaauccagccugggagagccggagcuucccccugauucugacacagugggcauggauuccagcuaccuguccgugaaggaagcuggggucaaaggaccccaagacagagccucuagcgaucugccuagcccccucgagaaggccgacuccgaaucuaacaaaggcaagaaacggcgcaauagaaccacauuuaccuccuaucagcuggaggagcuugaaaagguguuccagaagacgcacuacccggauguuuacgcucgggagcagcuggcgaugcgcaccgaccucacagaagccagagugcaagucugguuucagaaccggcgcgcuaaauggagaaagcgggagcgcuucggccagaugcagcaagugagaacccauuuuagcacagccuaugaacugccucuucugacccgggccgagaauuacgcucagauccagaaccccucuuggcucgggaauaacggagccgcgagcccuguucccgcuugcguggucccuugugaucccgugccggccugcauguccccucacgcccauccucccggcucuggggcuagcuccgugacggacuuccugagcgucucuggagccggcucccacguugggcagacacacaugggaagccuguuuggcgcugccucucucucccccggccugaauggguaugagcuuaacggagaaccggacagaaaaaccagcuccauugcggcccugcgcaugaaggcuaaagagcauucugccgcuaucagcugggccacauga

SEQ ID NO: 65767 - RNA, 795 nt, Artificial Sequence
  derived and/or modified sequence opt5 from ALYREF__Homo_sapiens__NP_005773
augcccgacagcgccccugcuauggccgauaagauggacaugucccuggaugacaucauuaaacucaacagaucucagcggggcgggcgcggaggcgggagaggacggggccgcgcggggagccaaggaggcagaggcgggggagcucaggccgccgcucgggugaaucgcggcgggggaccgaucagaaaccggcccgccauugcucgcggcgccgccgggggaggcggcagaaaucggccugcgcccuacucccgcccuaagcagcugcccgauaaauggcagcacgaccuuuucgauucuggguuuggaggcggggcuggagucgagaccggcgggaagcugcucguuagcaaccuggacuucggaguguccgaugccgacauccaagaacuuuuugcugaguucggcacacugaaaaaggccgcggugcauuaugauagaucuggccggagccucgggacggccgacguccacuuugaacgcaaggcugaugcccugaaagcuaugaagcaguacaauggagugccucuggacggcagaccgaugaacauucagcucguuaccucccagaucgacgcccaacggagacccgcccagagcgugaaucgcgggggaaugacacggaacagaggcgcugggggcuucggaggcgggggaggcacccgccgggggacaagaggaggcgcgcgcgggcggggcagaggagccggccgcaauucuaaacagcagcuguccgcugaggaacuugaugcccaacuggacgccuauaacgcucggauggauaccagcuga

SEQ ID NO: 65768 - RNA, 1185 nt, Artificial Sequence
  derived and/or modified sequence opt5 from AMACR__Homo_sapiens__NP_001161067
auggcccugcagggcaucagcguggucgagcucuccgggcuggcucccggaccuuucugcgccaugguucuugcggacuuuggcgcuagaguggugcgggucgaucgcccggggucuagauacgacgugagccggcugggacgcggcaagagaucccucguucuggaucuuaaacaaccccggggagccgccgugcugcgcagacucuguaagcggucugacguccugcuggaaccuuuccgcagaggagugauggagaaacuccagcugggccccgaaauucuucagcgggagaacccucgccugaucuaugcuagacucagcggcuuugggcaguccggaucuuucugccggcuggccggccacgauauuaauuaccuugcucugagcgggguucucuccaagaucggacgcagcggcgaaaaccccuaugccccucugaaucugcucgcggacuuugccgggggaggccugaugugugcucuuggcauuaucauggcccuguucgauagaacccggacagggaaaggacaagugaucgacgcuaacauggucgagggcacggccuaccucucuuccuuucuguggaagacccagaaacuuagccugugggaggcgccgagagggcagaauaugcucgauggaggcgcccccuucuauacaaccuaccgcacagcugacggggaauuuauggccgugggagcuauugagccucaguucuaugaacugcugaucaagggccucggccugaagucugaugagcuucccaaccaaauguccauggacgauuggccugagaugaaaaagaaauuugccgacguguucgccgaaaagaccaaggcugaguggugccagauuuuugacgggacagaugcgugugucacccccguucugacguucgaagagguggugcaucacgaccauaauaaagaacgggggagcuucaucaccucugaggagcaggaugucuccccgagaccugccccucuccugcuuaacacacccgcuauucccagcuuuaagcgcgaccccuucaucggcgaacacaccgaggaaauucuggaggaauuuggguucucccgggaggagaucuaccagcucaauucugauaaaaucauugaaagcaacaaggccggauccaaauuuuggauccuguacccuacacauagcaauauucaaaaguga

SEQ ID NO: 65769 - RNA, 1344 nt, Artificial Sequence
  derived and/or modified sequence opt5 from AMBN__Homo_sapiens__NP_057603
augagcgccuccaagaucccccuguucaaaaugaaggaccucauucugauccuuugccugcucgagaugucuuuugcugugccuuucuuuccgcagcaaagcggcacccccgggauggccucccugucucuugaaacaaugagacagcugggaagccuccagcggcugaacacgcugucccaguacucucgcuauggcuucgggaaauccuuuaauagccucuggaugcacggacugcuuccuccccauagcucucugccuuggaugagaccccgggagcacgaaacccaacaguacgaguauucccucccuguccauccgcccccucugcccagccagccuucucuuaagccccagcaaccgggccugaaaccuuuccuccaguccgcggcugccacaaccaaccaggccacagcucugaaggaagcccugcagcccccuauucaccucgggcaucugccccuucaagagggagagcugccccucguucagcagcaaguggcuccuagcgauaagccgcccaaaccugaacugcccggcguggacuuugccgauccucagggccccucucuuccggggauggacuucccugauccccagggaccuucccugcccggccucgacuuugcggauccucaggggagcaccaucuuccaaauugcccgccugaucucccacggacccaugccgcagaauaagcagucuccucuguaccccggcaugcucuauguccccuuuggggcuaaccagcugaaugccccugcuagacuuggaaucaugagcuccgaggaaguggccggcggccgggaggacccgauggcguacggggccauguuccccggauuuggcgggaugcgcccuggauucgagggcaugccccacaacccugcuaugggaggggauuucacacuggaauuugacagccccguugccgcuaccaaaggcccugagaaugaagagggcggggcccaaggaucucccaugccggaagccaacccugauaaucucgagaaccccgcuuuccugacggagcuugaaccugcgccccaugccggccugcucgcucugccgaaggacgauauuccugggcugcccagauccccuagcggaaaaaugaagggccuccccucugugacccccgccgccgcugacccucugaugacaccggagcuugccgacgucuaucggaccuacgaugcggacaugacaaccagcguggauuuucaggaagaggcuacgauggacacaaccauggcccccaauucccugcagacaucuaugccugggaacaaggcccaggaacccgagaugaugcacgaugcuuggcauuuccaagagccuuga

SEQ ID NO: 65770 - RNA, 1059 nt, Artificial Sequence
  derived and/or modified sequence opt5 from AMBP__Homo_sapiens__NP_001624
augagaagccugggcgcccuccugcuucugcucuccgcuugccuggccgugucugcggggcccgucccuaccccgcccgacaacauccagguucaagagaauuucaacauuagccggaucuacggaaagugguauaaucuugcuauuggcuccacauguccuuggcugaaaaagaucauggaucgcaugacggugucuacccucgugcugggggaaggagccacagaggccgaaauuagcaugaccuccacaagauggcggaaaggcgucugcgaggaaaccucuggggcuuacgagaagacagacaccgauggaaaauuucuguaucacaagagcaaguggaacaucacgauggaguccuacgugguucauaccaauuaugacgaauacgccaucuuccucaccaaaaaguuuagccgccaccauggccccacaauuacagcuaaacuguauggcagagccccucagcuucgggagacccugcuccaggauuuccgcguggucgcgcagggggugggaauccccgaagacucuauuuuuacgauggccgauagaggcgaguguguuccuggggagcaagaaccggagcccauccugauuccucgggugcgcagagcuguccuuccccaggaagaggaaggauccggcgggggacagcuggugacagaggugaccaagaaagaggacagcugccagcucggcuacucugccggcccuuguauggggaugacaucccgguacuucuauaacggaaccagcauggcuugcgaaaccuuucaauacggcggguguaugggaaauggcaacaauuucgucacagagaaggaaugccugcagacgugucgcaccguugccgcgugcaaccugcccaucgugagagggccgugucgggccuuuauucagcucugggcuuucgaugccgugaagggaaaaugcguccuguuuccuuauggcggcugccaggggaauggaaacaaguucuacucugagaaagaaugucgcgaguauugcggcgugcccggggacggagaugaggaacuucugagauuuuccaauuga

SEQ ID NO: 65771 - RNA, 3906 nt, Artificial Sequence
  derived and/or modified sequence opt5 from AMBRA1__Homo_sapiens__NP_001254711
augaaggugguccccgagaaaaacgccguuagaauccuguggggccgggaacgcggggcuagagccaugggagcgcagcggcuccugcaagagcuuguggaagacaagacccgcuggaugaaaugggagggcaagagaguggaacugccugauagcccgcgguccacauuccuccuggcuuuuucucccgaccgcacgcuucuggccagcacccacgucaaucauaacauuuacaucacagaggugaaaaccgggaagugcguucacucccucauuggacauagacggacaccuuggugugugaccuuccaccccacaaucucuggccugauugccagcgggugccuggauggagagguccgcaucugggaccuccauggcggcuccgaaucuugguuuaccgauagcaauaacgcuaucgccucccuggcuuuccacccuacggcccagcuucugcucauugcgaccgccaaugagauccacuuuugggacuggagcagacgggaacccuucgcugugguuaagacagccucugagauggagcgcgugagacugguccgguuugauccucuugggcauuaucugcucaccgcuauugugaacccguccaaucagcagggagacgaugaacccgagaucccuauugacggcacagaacugagccacuaccgccaaagagcccugcuccagucucagcccgugcggagaaccccucugcuucauaacuuccugcacaugcucuccagccggucuuccgggauccagacggagcccuuucacccgccugaacaagcgagcuccacacagcaggaucagggacugcuuaaucgccccucugccuucagcaccguccaauccagcacagcuggcaacacccugagaaaucucucucuggggccuacccgccggucccugggaggcccccucagcucucaucccagcagauaucaccgcgagauugccccuggccugacaggguccgaguggacgcggaccguucuuucucugaacagcagauccgaagcugagagcaugccgcccccucgcacaucugccuccagcgugucucuccuguccgugcuucggcagcaggaaggaggcagccaagccuccgucuacaccucugcuacagaggggagaggauuucccgcgagcggccuggccaccgaauccgacgggggaaauggcucuagccagaacaauuccggcagcauccgccaugagcuccagugugaucugcggagauucuuucuggaguaugaccggcuccaggaacuggaccaaucucuuuccggggaggcuccucagacgcagcaggcccaagaaaugcugaacaacaauaucgagagcgaacgccccggaccgucucaccagccuacaccccauuccagcgagaacaauucuaaccucagcagaggccaccugaaucggugcagagccugucacaaccugcuuaccuucaauaacgauacccuccgcugggagcggacaaccccuaauuacuccagcggggaggcuucuuccagcuggcaagugcccuccucuuucgaaagcguuccuuccucuggaagccagcugcccccgcuggaaagaacagagggccagacgccuuccucuagccgccucgagcuguccagcucugccagcccccaggaagagagaaccgugggggucgcguuuaaccaggaaacaggccauugggagcggauuuauacccagagcucucgcuccggaacagugagccaagaagcccuucaccaggacaugcccgaggagucuuccgaagaggauagccugagacggcgcucccucgcucugagcccuagacuggaauacucuggcgccauccuugcucauugcaaacuccggcugccggggagcugucacucccccgccucugcuagccagguugccggaaccacgggcgcgcaccaucacgcccgccugauuuucgcuuuucucguggagauggaguuccaucacgucucccaagccgggcuggaacuucugaccucuggagaccucccuacaagcgcuucccagucugccggcaucaccggggugagccauagagcguggccccggcugcuggaguccagccuuauuucucucucccgcuacgauggcgccggaagcagagaacacccuaucuaucccgacccugcucggcugucucccgccgcuuacuaugcccagagaaugauccaguaccugucccgccgggauagcauuagacaacgcuccaugcgguaucagcagaauagacuccgcucuagcacauccuccucuuccagcgacaaccagggcccgucugucgaggggaccgaucuggaauuugaggacuucgaagauaauggagaccggagcagacaccgcgccccucggaacgcuagaauguccgcgcccucucuuggccgguuugugccucgcagauuccugcuccccgaguaccugccguaugccgggaucuuucaugagcggggacaaccuggccuggcuacgcacagcuccguuaaucgcgugcuugccggggccgucauuggcgacggacagucugcuguggccagcaacaucgcgaacacaaccuacagacuccaguggugggauuucacaaaguuugaccugcccgaaauuuccaaugcuagcguuaacgugcugguccagaauugcaaaaucuacaacgaugccucuugugacaucuccgccgauggccaacuccuggcugccuucauuccuagcucccagcggggguuucccgacgagggaauccuugcgguguauucucuggcuccccauaaucucggcgaaaugcuguacaccaagagauucgggccuaacgccauuagcgugucccugucuccgaugggacgcuauguuauggucggccuugccagccggagaauccugcuccaccccuccaccgagcauaugguggcucagguguuccgccugcaacaggcccacgggggcgagacaagcaugcggagagucuuuaaugugcucuacccuaugcccgcugaucagcgccggcacguuucuauuaacuccgccagauggcugccugaacccggacuuggccuggcguaugggacgaauaaaggagaccucgugaucugccgcccugaggcccugaacagcggcgucgaauacuauugggaucagcugaaugagaccguguucacaguucauucuaacuccagaagcucugaacggccggggaccagccgcgcuacauggagaaccgaccgggauaugggacuuaugaaugccauuggccugcaaccccgcaacccugcuacguccgugacaucucagggcacccagacccucgcccugcagcuccaaaaugccgagacacagaccgagagagaaguccccgagccugggacagcugcgagcggacccggcgaaggggagggauccgaauacggcgccagcggggaggacgcucugucccggauccagagacuuauggccgagggaggcaugacggccgugguucagcgcgaacaaucuaccacaauggcuagcaugggcggguuuggaaacaacaucauugugucccaccggauccauagaucuagccagaccggcacagagccgggggccgcgcacaccuccucuccucagcccagcacgucccgcggacugcuccccgaagcuggccagcuggccgagcgggggcugagcccuagaaccgccucuugggaucaacccggaacaccuggccgggaaccgacccagcccacacuuccuuccagcucucccgucccuauucccgugucccugccgagcgcugagggcccuacccuccacugugagcugacaaauaacaaucaucuccuggacgggggaucuucccgcggcgacgccgcggggcccagaggagaaccucggaaccgcuga

SEQ ID NO: 65772 - RNA, 918 nt, Artificial Sequence
  derived and/or modified sequence opt5 from AMD1__Homo_sapiens__NP_001274143
auggaggccgcucacuucuuugaaggcaccgagaagcugcucgaagugugguucagcagacagcaacccgacgccaaccagggguccggagaucugcggacaaucccuucugagagcuccauguuugucucuaaacgcagauucauucuuaagacgugcggcaccacacugcuccugaaagcgcuuguuccgcugcucaagcuggcucgggacuacagcggguuugauuccauccagucuuucuuuuauagccgcaaaaauuucaugaagcccucccaucagggauacccucacagaaacuuucaagaagagauugaguuccugaaugccaucuuucccaacggcgccgcuuauuguauggggcggaugaauagcgacugcugguaccucuauacccuggauuucccugaaucucgcgugauuucccagcccgaccagacacuugagauccugaugagcgaacucgauccugccgugauggaccaguuuuacaugaaggauggagucaccgcuaaagacgugacaagagagucuggcauccgggaucugauuccgggcuccguuaucgacgccaccauguucaaccccuguggguauagcaugaauggaaugaagucugauggcacguacuggaccauucauaucacaccugagcccgaguucuccuacgugagcuuugaaaccaaccuuucccaaacaucuuaugacgaccugauucgcaaagucguggaaguuuucaagccugggaaauuugugaccacacucuucgucaaucagagcuccaagugcagaacggugcuggcgagcccccagaagaucgagggauuuaaacggcuggauugucagucugccauguucaacgacuacaauuuuguguucaccuccuuugcuaagaaacaacagcagcaacagagcuga

SEQ ID NO: 65773 - RNA, 576 nt, Artificial Sequence
  derived and/or modified sequence opt5 from AMELX__Homo_sapiens__NP_001133
augggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacuga

SEQ ID NO: 65774 - RNA, 579 nt, Artificial Sequence
  derived and/or modified sequence opt5 from AMELY__Homo_sapiens__NP_001134
augggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacuga

SEQ ID NO: 65775 - RNA, 3408 nt, Artificial Sequence
  derived and/or modified sequence opt5 from AMER1__Homo_sapiens__NP_689637
auggagacccagaaggacgaagccgcucaagccaaaggcgcggcugccagcggguccacaagagagcagacggccgaaaagggagcuaaaaacaaggccgcugaggccaccgaaggccccacaucugagccuagcuccucugggccgggacggcugaaaaagaccgcgaugaaacucuucggcgggaaaaagggaaucugcacacugcccagcuuuuucggcggcgggcgcuccaaaggaucuggcaaggggagcuccaaaaagggacuuagcaagucuaaaacccacgauggccuguccgaggccgcucaugggccugaagacguggucagcgagggaacaggcuuuucucucccccugccugaacuucccugucaguucccuuccagccagucugcccacggcgcucuggagaccggguccagaugcaagacgagcguugccggagcgaccgagaaagccguggcugaaaaguuuccguccaugcccaaaccuaagaaaggccucaagggguucuuuucuagcauucggcgccauagaaaguccaaagugacaggagccgagcaaagcgaacccggcgcuaaggggccugagcggguccgcgccagaccccacgaacaugugucuuccgccccgcagguuccuuguuucgaggagaccuuucaggcuccccggaaagaaaaugcgaacccucaggaugcccccggacccaaggugagcccuacaccggagcccucuccucccgcuaccgaaaagauggccugcaaggacccugagaagcccauggaagccugugcuagcgcccacguccaaccgaaaccugcgcccgaggcuuccucucuggaggaaccucacagccccgagacgggcgaaaaggugguugccggcgaggugaauccucccaacgggccggucggagauccucugucccuccuguucggcgacgugacaagccuuaaaucuuuugauucccugaccgggugcggagacaucauugccgaacaggauauggacagcaugacagauucuauggcuuccggcgggcagcgcgccaauagagacggcaccaagcggagcuccugucucgugaccuaccagggaggcggggaggagauggcucugcccgaugacgacgaugaagaggaagaggaggaagaggaagucgagcuugaagaggaggaagaggaaguuaaagaggaagaggaggacgaugaccuggaauaucucugggagacagcccaaauguacccccgcccuaacaugaaucugggauaucauccgacgaccucucccggccaccauggguacaugcugcucgauccugugagaagcuaucccggacuggcgccuggcgaacuucugacaccccaguccgaccagcaagagucugccccuaacagcgaugaaggguacuaugacuccaccacacccggcuucgaggaugacagcggagaggcucucggccuggugcggcgcgauugccuuccgagagacucuuacuccggggacgcccuguacgaauuuuaugagccugaugacagccucgaaaauucucccccuggagaugacugucuguacgaucugcacggccgguccagcgagauguucgaccccuuccucaacuuugagccguuccugucuagcagaccucccggggcuauggaaaccgaggaggaacgccuugucacgauccagaagcagcugcucuauugggaacugcggagagagcagcuugaggcccaagaagcgcgcgcccgggaggcucacgccagagaagcucaugcccgcgaggccuacacacgggaggcuuauggaagagaagcguacgcccgcgaggcucacaccugggaagcccauggccgggaggccagaacccgcgaagcucaggcccgggaggugagaugccgggaaacacagguucgcgagacccaggcgagacaagagaagccugugcuggaauaucagaugcggccccucgggcccuccgucaugggccuggcugccggagugagcggcacaucucagauuucccacagagggaucacgagcgccuuuccuaccacagcuuccucugagccggauuggcgcgacuuccggccccuggagaaaagauacgaaggaaccuguagcaagaaagaucaguccacaugccucaugcaacuguuucagucugacgccauguucgagccugauaugcaggaagcgaauuuuggcgggagcccccgcagagcuuacccuaccuauuccccucccgaggacccggaagaggaagagguugagaaggaaggaaacgccacggugucuuucagccaggcccuugucgaguuuaccuccaauggcaaccuguucagcucuauguccugcagcucugauuccgacagcucuuuuacacaaaaucuccccgaacugccucccauggugaccuucgacaucgcugaugucgagcgggacggggaaggcaaaugugaggagaacccugaauuucauaacgaugaggaccuggccgcuucccuugaagccuucgagcucggauacuaucacaagcacgcguucaauaacuaccauagccgcuuuuaucagggccugcccuggggaguguccagccugccgagauaccucggacugccuggccuucacccccggcccccucccgccgcuauggcccugaaucgcagaucucggagccucgauacagcugaaacccuggagauggagcuguccaacucucaucuuguucagggguaucucgaaagcgacgagcugcaagcccagcaggaagauuccgacgaggaggaugaagaggaagaggaaggagaguggucucgcgacagcccucugucccucuacacggagccgcccggcgccuacgauuggccugcuugggcgcccugcccucugcccgugggcccggggccugccuggauuucucccaaucagcuugacagaccuagcucccaaagccccuaucggcaggcuacauguugcaucccucccaugaccaugucuauuucccugagcgucccggaaucucgcgccccuggagaguccggcccccagcucgccagacccagccaucugcaucugccuauggggccguguuacaaccuucagccccaagcuagccagucuaugcgggccagaccucgcgaugugcuccugcccguugacgaaccuagcugcuccuccucuuccggaggcuucagccccucuccucugccgcaggcgaagcccguggggaucacacacgggauuccucagcucccccgggucagaccugagcacccccaaccgcagccuacccacuauggccccagcucccuggaccuuucuaaagaacgcgcugagcagggcgccagccuggccaccuccuacucuagcacagcuaugaaugggaaccucgccaaguga

SEQ ID NO: 65776 - RNA, 2016 nt, Artificial Sequence
  derived and/or modified sequence opt5 from AMER2__Homo_sapiens__NP_689917
auggagaccagcagaucccggggcgggggaggcgccgugucugaacgcgggggagcuggcgccagcgucgggguuugcagacggaaggcggaggcuggagccggcacaggcacgcuggccgcugacauggaucuccacugugacugcgccgcugaaacccccgccgcggagccuccguccgggaaaaucaacaaggccgcuuucaaacuguuuaagaaacgcaagucuggaggcacaaugcccagcauuuucggggugaagaauaaaggagauggcaaguccucugggccuaccggacuugugagaagccggacacaugacggccuggccgaaguccucgugcuggaguccggccgcaaagaggaacccagagggggaggcgauagcgggggaggcgggggaggccggccuaaccccggcccuccgcgcgcugccgggcccggaggcgggucucuugcguccagcucuguugccaagucccacagcuuuuucucucugcucaaaaagaauggaagauccgagaacggcaagggggaaccuguggacgcuagcaaagccggcggaaagcagaaacggggccugcgcgggcuguuuuccggaaugagauggcaucggaaggauaaacgcgcuaaggccgaggccgcugagggcagagcgcccgggggaggccucauccugccugggucucuuaccgccagccuggaaugugucaaagaggaaacaccccgggcugccagagagccggaagaaccuucccaagacgcuccccgcgauccugccggcgagcccgccggaggcgaagaggugcccgcgccugcugaccgggccccggccagaagcugccgcgaagcugaggggcucgcccaccccggagauaccggcgcuagaggggaagacgccgcgggacaucggcgcgccgagccuggccccggggagguucggacggcugaagaugccucuagaaccggcgcugugccugucaagacagugccccugguggacuccgagggaggcagcgggcgcgccccggcggccccugaccccgcuucugucgauccucccagcgacccuuccgccgaucggauuugucuuauguucucugacguuaccagccugaaguccuuugauagccucacaggaugcggcgacaucauugcugaucaggaagaggaagccgggcccucuugugacaaacacgugccgggaccuggcaagcccgcccuguccaaaaagaaucccgggguggucgcuuaccagggcggaggcgaggagauggcgagcccugaugaaguggacgauaccuaucugcaggaguucugggacaugcucucucaaacggaggagcaggggccggagccccaggaaggagccgcuaaaguugccgccgcucuggagacaaagguggucccugaaacccccaaggacacaagaugcguggaggccgcgaaagaugcuuccagcguuaagcgccggagacuuaaccggaucccuaucgaaccccacccuaaagaggagcccaagcauccggaaaaagagcagcaagaaggcgugccuaauuccgacgagggguacugggauucuaccacccccggaccugaagaggacagcuccucuagcggcaagaaggccggcauuccccgcgauuccuauagcggggacgcccuguacgaucucuaugcugacccggauggaucuccugccacacugcccggcgggaaagacaacgaggaaacguccagccuuucuagacugaagccugucucccccggaaccaucacauguccccuccggaccccuggcagccugcugaaagauucuaagauuccgaucagcauuaaacaccucacaaaucugcccuccagccauccugugguccaccagcagcccucuagauccgagaugccucgcaccaagauccccgugagcaagguucuugugcggagagucuccaaccgcgggcuggcgggaacgacaauuagagcuaccgccugccacgacucugccaaaaagcucuga

SEQ ID NO: 65777 - RNA, 2586 nt, Artificial Sequence
  derived and/or modified sequence opt5 from AMER3__Homo_sapiens__NP_001098663
auggagcugaagagaggcaaaaccuucaucaagagcucccuccaggugucucacgaaaaacccccugacccggccgcugucgccgcggcucgggaggggacaggacccuggagcguucugccuggcgggcaacagcgcccccauuccgaaaagggaccucaggccucucccagcgcccaggaguacgauagaugcccuaacaaaggcgcucaacuugacccgaaagggggacccgccgcucuguguggcgccacguuuaagccugugcggaaaugcaagacccacgauuccaugucuggcgcggggcgcgccacagcugccaccggacagcucgugggcagcgcuuccuuccccgggagcccuggaucuagacggaugauugacuaucgccauuuugucccccagaugccguucgugccugccguugcgaaauccauccccagaaagcggauuagccugaaacgcccuaagaaguguuuuagaaaucuuuuccacauccggcgcaacaaaacagaagaucuggccucucucgcugccgagggcaagucccugcccagccccggggacccuucugauccgggaggcagacgguccaaggcuuuucugcccccuggcgaggggcccggacucgacggccugugccaggaucuucuggacagcgaacuccuggccgaugccuccuucgggcuuugucgcgcucugugcgaggacguggcgucucuccagagcuuugauucccugaccggauguggcgaagucuucgccgacgagagcucugugccuucccuggagcucaaugaagggcccgagagcccgacacaagcugcccagggacuggaaucuaagguuccuagaggcccccuucagggcagcguggagcaacuggccuccccugcucagaacgaagccucugacuuuacccgguucugggauagcgucaauagauccgugcgccagcaacagcgggcgcuccuggggcccuggcuuagcggaccucagggcacggacagagaucagucucgccuggacaccgcugggcucgccgagcugccccugugcccgugucgggauccuagauccggaagcaaagccucuuccauugacacaggcacccccaagagcgagcaacccgaauccgugucuacaagcgaugagggguacuaugacuccuuuucuccuggccucgaagaggauaaaaaggaagcugagagcccgggaacccccgccgcuacguucccucgcgacuccuacagcggcgaugcccuguaugagcuuuuccaugaccccucugaagggccucugggacccuccccugacgaugaccucugcgucagcgagucucuguccggccccgcgcuugggacaccgcugagcaucuguucuuuucggguuggagccgaagagaaccucgcuccugcccccggcccugaucugcugagccagggguuccuccaguccagcuggaagggcaaagaaugccugcuuaagcugugcgacaccgagcucgcuaucacaaugggaauugugucuuggcugagacgcggccccaccccgcgggccccucccaccccugggcagcccgcggcucccccuggaucccaaggcgccccgagagcccccacagagaaacuugggggacgcgaaggccuugcuagcgaugccgggggcgccacgguguguuccgcuccuucucggcaggagcucugggcgcaccccggaaccacaggccugcuggccggggaaagcaaggcucucggaggcgccacccaggggacaggaacccuguccagagacgccucucgggaggaggaaacgcgcggccacagcgaggggcuguuuuccucuauggaaagcgcugccacauccaccaccgauacaagcggcaaaaauaaggcgccuguccccucuaccuggccuugcucccagaaggagccgggacccccuggcgugcugggguguuucagaggacccuggcggccuggccaugggggagacacacucgaugcugaacccaugcuggccggcugcguugccagaguggcugcccugaaaaucagcucuaacgagcaaccgccugcggcuuggccuccccgccaggacaugggcuccgggcuuuuuggacagcggugggccagaggccccgauaugcucgagcagaagcaaucuagcuccagccccuccaugacgaccauucacgggcugccuuacagcgccucuacacaggaccagcgcuguagagaucggguccaagaccugagcuggcuccgcguggaaccgaccggacugggcguucaggcuugggccuccguggaggaccagccccuucagcugucuacagaagcugucgagcaaguggcccaugggagccagcucgauuccgaaccuagaucugcgcccgccgcucgguggagcucccagggacaccacccugagucucugggccugacccuuaauagccagcaagagggcggggucuccgccagcgcucccgaaugccgcuguucucuccuggccagagagggacugcucugcggccagccggaagugggggccuccggaccugcuauggcggagccccaucuguga

SEQ ID NO: 65778 - RNA, 1932 nt, Artificial Sequence
  derived and/or modified sequence opt5 from AMFR__Homo_sapiens__NP_001135
augccccuucucuuccuggagagauuuccuuggccgagccuucggaccuacacaggccuguccgggcucgcccugcuuggaacgaucauuucugcuuaucgcgcccugagccagcccgaagcgggcccuggggagcccgaccaacucaccgcuucccugcagccugaacccccugccccggccagacccucugcuggaggcccucgggcccgcgauguggcucaguaccugcucagcgacucccuguucgucuggguucuugugaacacagccugcugugugcugaugcucgucgcgaagcugauccagugcauuguguuugggccccuuagaguuucugagcggcaacaccugaaagauaaguucuggaauuuuaucuucuauaaauuuauuuucaucuuuggagugcucaacguccagaccguggaagagguugugauguggugucugugguucgccggccuggucuuucuccaucugauggugcagcuuugcaaggaccgcuucgaguaccugagcuuuuccccuacaacccccaugagcucucacggcagagugcucucccugcuugucgcuaugcugcucagcuguugcgggcuggccgcuguuuguucuaucacaggauauacccauggcaugcacacgcuggccuucauggcggccgaaucccuccuggugaccgugcggacagcucaugucauucuucgcuacgugauccaccugugggaucucaaucacgaggggaccugggaaggaaaaggcacauauguuuacuacaccgacuucgugauggagcugacgcuucugagccucgaucugaugcaucacauucauaugcugcucuuugggaacaucuggcugucuauggccucccuugucauuuucaugcagcugagauaucucuuucacgaggugcaacggcgcaucagacggcacaagaauuaccugcgcguugugggaaacauggaagcuagauucgccgucgccacaccggaggaacuggcugugaauaacgacgauugcgcgauuuguugggacagcaugcaggccgcucggaagcugccuugcggccaucucuuucacaauuccugucugagaucuuggcuggagcaggauaccagcugccccacaugccgcaugucccucaacaucgccgacaauaaccgggucagagaggaacaucagggcgagaaucuggaugaaaaccuugugccuguugccgcugccgaggggcgcccccggcugaaucaacacaaccauuucuuucacuucgacggaagcagaaucgcgucuuggcuccccuccuuuagcguggaagucaugcacaccaccaacauucugggcaucacacaggcuucuaauagccagcugaacgccauggcccaucaaauucaggagauguucccucaggugccguaucaccuuguucuccaggaccugcaacugacgcgcuccguggaaaucaccacagauaauauucucgaggggcggauccagguccccuuuccuacccagagaucugacagcauccgccccgcucugaacuccccuguggagcggcccagcucugaucaggaagagggagaaacauccgcccaaaccgagagagugccgcuugaccugagcccucgccucgaagagacgcuggauuucggcgagguugaagucgagcccucugaaguggaggacuuugaggcucggggguccagauucagcaaauccgccgaugaacggcagcgcaugcuggugcagagaaaggacgagcuucuccagcaagcgcggaaaagauuccugaauaagucuagcgaagaugacgccgcuuccgagucuuuucugccuagcgaaggagccuccagcgaucccgucacacuccgccggagaaugcuggcugccgcggccgagcgcagacuucagaaacagcagaccucuuga

SEQ ID NO: 65779 - RNA, 1683 nt, Artificial Sequence
  derived and/or modified sequence opt5 from AMH__Homo_sapiens__NP_000470
augagagaccugccccucaccagccuggcccuugugcuguccgcucucggcgcccugcuugggacagaggcgcugcgggcugaagaaccugccgucggaacgucuggccucaucuuccgcgaagaucuggacuggccgcccgggagcccucaggagccccugugccucguugcccugggaggcgauuccaacgggucuagcuccccucuuagaguggugggagcucugucugccuacgaacaggcuuuucucggcgccguccaacgggcgcgcuggggccccagagaccuggccaccuucgggguguguaauacaggagaucggcaggcugcccuuccuagccugcgcagacucggcgcuuggcugcgggaccccgggggacagcgccugguugugcuccaccuggaggaggucaccugggaacccacaccuucccuuagauuucaagagcccccucccggcggggccggaccgccugaacuggcgcuccuggugcuuuaucccggcccuggccccgagguuaccgugacacgggccgggcugcccggagcucagagccucugcccuucucgcgauaccagauaccugguccuggccguggaccggccggcuggcgccuggcgcggguccggacucgcccugacgcuucagcccagaggcgaggauagccggcugucuaccgcuagacuccaggcgcugcuuuucggggacgaucaucgcuguuuuacacggaugaccccugcccugcuccugcugcccagauccgaaccugcuccccucccggcccacggacaacuggacacagugccuuucccgccuccccgcccuagcgccgagcuugaagagucucccccguccgcugauccuuuucuggaaacccucacgcggcuggucagagcccugcgcguuccgcccgcgcgggcuagcgccccuagacuugcccucgacccggacgcucuggccggcuucccccagggccuggugaaccucuccgauccugcugcccuggagcgccuucuggacggggaggaaccccuccugcugcuucuccggccuacagcggccaccacaggagaucccgcuccucugcaugaccccaccucugccccgugggcuaccgcccuggcgagacgcguggccgcugagcuccaggccgcugccgccgaacugcggagccuuccuggccugcccccugcuacagcgccccuccuggccagacugcuugcucucugccccgggggaccuggcgggcugggcgauccccugcgggcccuccugcuucugaaggcccuccagggacugcgcgucgaguggagaggccgggacccuagagggcccggacgcgcucaacgguccgccggcgcgacggcugccgaugggcccugugcccugagagaacuuagcguggaccuccgcgcugagagaucuguucugauuccugagaccuaucaggccaauaacugccagggaguguguggcuggccgcaauccgaucggaauccccgcuacgggaaccacgucgugcugcuccugaaaaugcaggcgagaggcgcugcccuugcccggccucccugcuguguuccuacagcuuaugccggaaagcugcucaucagccugucugaggagcgcauuagcgcucaucacgugcccaauauggucgccaccgaaugcggcuguagauga

SEQ ID NO: 65780 - RNA, 1437 nt, Artificial Sequence
  derived and/or modified sequence opt5 from AMHR2__Homo_sapiens__NP_001158162
augcugggcagccucgggcugugggcccuucugcccaccgcuguggaggccccuccgaacagacggacaugcgucuucuuugaagcgcccggaguucgcggcuccacgaagacccucggggagcugcuugacacaggaaccgaacugccuagagcuauccggugucucuacucucgcugcuguuucggcauuuggaaucugacacaggauagagcccaaguggagaugcaggggugccgggacagcgaugaacccggaugugagucccugcacugcgacccuucuccccgcgcccauccuagcccgggcuccacccucuuuacauguucuugcggcaccgauuucuguaacgcuaauuauagccaucugcccccucccggguccccuggaacgcccggcagccaggggccgcaggccgcuccuggagagucuaucuggauggcccuugugcugcucggccuguuucuucugcuccugcugcuccugggguccauuauccuugcgcugcuccaacgcaaaaacuaccggguccgcggagaacccgugccugagcccagacccgacagcggccgggauuggucuguugaacugcaggagcuuccugagcugugcuucucccaggugauucgcgaaggcgggcacgccgucgugugggcuggacagcuccaaggcaagcugguugccaucaaggcuuuuccgcccagaagcguggcccaguuccaggcggagcgggcccuguaugaacucccugggcugcagcacgaccauaucguccgcuuuauuaccgcuucuagaggaggccccgggcggcuucuguccggaccucuccuggugcuugagcugcaccccaaaggcagccucugucacuaccugacacaauauaccuccgauuggggcucuagccugagaauggcccucucccuggcucaggggcuugccuuccugcaugaagagagauggcagaauggacaauacaaaccgggcaucgcccaccgggaccucagcucucagaacgugcugauuagagaggauggguccugcgcuaucggagaccugggccuugcgcucguccugccugggcugacacagcccccugccuggacccccacgcagccucaaggccccgcugccauuauggaagccggaacacagcgcuauauggcuccggagcuccuggauaagacccuugaccugcaggacuggggcauggcccuccggagagcggauaucuacagccuggcucugcuucucugggaaauucugucucgcugcccugaccugcggcccgccguucaucaccccagcaauuggccuaugagacagaacugggccaucccgcucccccugauguccuacgggccuuggcaaugucgccggggaggcgugcccacaucucacccucccggggcugcccuuccucagacccugaugggauga

SEQ ID NO: 65781 - RNA, 1185 nt, Artificial Sequence
  derived and/or modified sequence opt5 from AMICA1__Homo_sapiens__NP_001091996
auguucugcccccugaagcucauccugcuuccugugcugcucgacuacagccugggccuuaacgaucugaaugucuccccgcccgagcucaccguucacgugggggacucugcccugaugggauguguguuucaaagcacagaagauaaaugcauuuucaagaucgacuggacgcuguccccuggcgagcaugcuaaagaugaauauguccucuacuauuacucuaaccugagcgugcccauugggagauuucaaaaucggguucaccuuaugggagacauccuguguaacgauggcucccuccugcuucaggacgugcaggaggccgaucaggggaccuauauuugcgaaauccgccugaagggagagucucaagucuucaaaaaggcggugguucuccaugugcugccugaggaacccaaggagcugaugguccacgugggcggccucauccagaugggguguguguuucagagcacagaagucaaacauguuaccaagguggaguggauuuucuccggaagacgggcuaaagaggaaaucguguuucgcuacuaucacaagcugagaaugagcgucgaguacucucaguccuggggccacuuccaaaaucgggugaaccuuguuggggacauuuuucgcaaugauggaagcaucaugcugcagggcgugagagaaucugacgggggaaacuacacaugcuccauucaucucggcaaucuggucuucaaaaagaccaucgugcuucacguuagcccugaggaaccgcggacacuggugacccccgccgcccuccgcccucugguccugggcgggaaccagcucgugauuaucgucggaaucgugugugcuacgauucugcuucugcccguucucauccugauugugaagaaaaccugcggcaauaagucuuccgucaacagcacagugcuuguuaaaaauaccaagaaaacaaacccugagaucaaggagaaacccugucauuuugaaagaugcgagggggaaaagcacauuuauuccccgaucaucgugcgggaggucauugaagaggaggaaccuucugaaaagagcgaggccaccuacaugacgaugcaccccguguggccuucccugcgcagcgauagaaauaacucucucgagaaaaaguccggaggcgggaugcccaaaacacagcaggcuuucuga

SEQ ID NO: 65782 - RNA, 1569 nt, Artificial Sequence
  derived and/or modified sequence opt5 from AMIGO2__Homo_sapiens__NP_862830
augagccugagagugcacacccuccccacacugcuuggcgccgucguucggccugggugccgcgagcugcucugucugcuuaugaucacggugaccgugggaccgggcgcuuccggggucugccccacagccuguauuugcgcgaccgacaucgugucuuguacaaacaagaaucugagcaaaguuccuggaaaccucuucagacugauuaagcggcuggaucucuccuacaaucgcaucggccugcuugacucugaauggauucccgugagcuuugcuaaacugaacacccucauccugagacauaauaacaucacauccauuucuaccgggagcuucuccacgaccccuaaucuuaagugccuggaucucagcucuaacaaacugaagacagucaagaaugccguguuucaggagcugaaaguucucgaagugcugcuucuguauaacaaucacaucuccuaccucgaccccagcgccuucggaggccugucucaacuucagaagcuguaucucuccggcaacuuucugacccaguucccuauggaucuguacgucgggcgguuuaaacucgcugagcugauguuccuugacgugagcuauaaucgcauuccgucuaugcccaugcaucacaucaaccuggugccuggaaagcagcucagaggcauuuaccugcaugggaaucccuuugucugugauugcucccuuuauagccugcucguuuucugguaccggcgccacuuuuccucugugauggacuucaaaaacgauuacacauguagacuguggagcgacucccggcacagccgccaagugcugcuccugcaggauucuuuuaugaacugcuccgacagcaucauuaauggaucuuucagagcccuuggcuucauccaugaagcucaggucggggagcggcugauggugcacugugauagcaagaccggaaacgccaauacggacuuuaucuggguuggcccugacaaccgccuccuggagcccgauaaggaaauggagaauuucuauguguuucauaacggcucccuggucauugaaucuccgagauucgaggacgcggggguguacagcugcaucgccaugaauaaacagcggcuucucaacgagacaguugaugugaccauuaaugucuccaacuuuacagugagcagaucucacgcucacgaagccuucaauaccgcuuuuaccacacuggccgcgugcgucgccuccaucgugcugguucuccuguaucuuuaccugacgccuugucccugcaaguguaaaaccaagcgccagaaaaacaugcuccaucaaagcaaugcucacucuuccauucugagcccuggacccgccuccgacgcuucugccgaugagcggaaggccggcgcugggaaaagaguggucuuccuggaaccccuuaaggacacagcggccggacagaacggcaaggugcgccucuuuccuagcgaggcuguuaucgccgaagggauccugaaauccacccggggaaagucugauagcgacuccgugaauagcgucuucucugauacaccguuuguggccuccaccuga

SEQ ID NO: 65783 - RNA, 891 nt, Artificial Sequence
  derived and/or modified sequence opt5 from AMMECR1__Homo_sapiens__NP_001020751
auggccgcuggcugcuguggggugaagaaacagaagcugagcuccucucccccuagcggauccggcgggggaggcggggccucuagcuccucucacugcagcggagagucccaauguagagcgggcgaacucggccucgggggagcuggcacccggcuuaacgggcugggaggccucacagggggaggcagcggcucugggugcacgcuguccccgccccagggauguggcgggggaggcgggggaaucgcccuuagcccucccccuucuugcggcgucggcacccugcucuccacacccgccgcugccaccucuagcucccccagcuccucuagcgcugccuccucuagcuccccggggagccgcaaaaugguugugucugcggagauguguugcuucuguuuugacgugcuguacugccaucuguauggauaccagcagcccagaacaccucgguucaccaaugaacccuaugcccugaaggauagccgcuuuccucccaugacaagagacgagcugccgcggcuuuucuguuccgucucucugcucaccaacuuugaagaugugugcgacuaccuggauugggagguuggcgugcacgggauucgcaucgaguucauuaaugaaaaaggaagcaagagaacggcuaccuaucuuccugaggucgccaaggaacaaggcugggaccauauccagacaauugauucccugcuccggaaagggggcuacaaggcucccaucaccaacgaguuucgcaaaacaaucaagcugaccagauaucggagcgagaaaaugacgcugucuuacgccgaauaccucgcgcaccgccagcaucaccacuuccagaauggaauuggccauccucugccucccuauaaccacuacuccuga

SEQ ID NO: 65784 - RNA, 1362 nt, Artificial Sequence
  derived and/or modified sequence opt5 from AMN__Homo_sapiens__NP_112205
augggcgugcuggggagaguccuccuguggcuucagcugugcgcccucacccaagcuguuagcaagcugugggugcccaacacagacuucgauguggccgcgaauuggucccagaaccggacgccuugugcuggaggcgccgucgaguuuccggccgacaaaauggugucuguucuugugcaggaagggcacgcugucagcgauaugcugcucccccuggacggagagcuggugcucgccuccggcgcuggguucggaguuucugaugugggcagccaucuggacugcggcgccggggaaccugcggucuuucgcgauuccgacagauucucuuggcacgauccccaucuuuggcggagcggagacgaggccccuggccuguuuuucguggaugcugaacgcgugcccuguagacacgacgaugucuuuuucccuccguccgccagcuuucggguugggcucggacccggcgcuucuccugugcgcgugagauccaucagcgcccuggggcggaccuucacacgcgacgaggaccuugcggucuuucuggccucuagagcuggacggcuccgcuuccauggccccggcgcccuguccguggggccugaggauugcgcugaccccagcggauguguuugcggcaaugccgaagcccagccguggauuugugcugcgcugcuccaaccucuugggggaagaugcccccaggccgcuugucacucugcccugcggccucagggccagugcugugaucugugcggggccgugguccuccugacccacggacccgcuuuugaccuugagcgcuacagagcccggauccuggauacauuccucggccugccccaauaucauggccuccagguggcgguuuccaaggugccuagaagcucccgccugcgggaagcugacaccgagauucaggucgugcuggucgagaacgggccggaaacaggaggcgccgggagacuugcccgcgcucugcucgccgauguggcugagaauggagaagcccugggcguucuugaggcgaccaugcgggaaucuggggcccacguguggggcagcuccgcugccggacuggcuggcggggucgccgcggccgugcuccuggcucugcucguucugcuuguggcucccccucugcucagacgcgccggacggcugagauggcgccggcaugaggccgccgcucccgcgggcgccccucugggguucagaaaccccgucuuugacgugacggcuagcgaggaacuuccgcucccucgccggcugucucuggugcccaaagccgccgcugauuccaccagccacucuuacuucguuaauccucucuuugccggagcggaggcugaagccuga

SEQ ID NO: 65785 - RNA, 2028 nt, Artificial Sequence
  derived and/or modified sequence opt5 from AMOT__Homo_sapiens__XP_005262147
augcccagagcccagccuagcuccgcuucuuaccaaccggugcccgccgacccuuucgcgaucgucagccgggcucagcagaugguugagauucuguccgaugaaaaccgcaaucucagacaggagcuggaaggcugcuaugagaagguggcccggcuucaaaaaguggaaaccgagauccagcgcgucucugaggccuacgaaaaccugguuaagagcuccucuaaaagagaggcucucgaaaaggccaugcggaauaaacuggagggggagauucgcagaaugcacgacuuuaaccgggaucuucgcgaaagacuggagacagcuaauaagcagcucgccgaaaaggaguaugaaggaagcgaggacacgcggaaaaccaucucccagcuguucgcgaagaacaaagagagccaacgcgaaaaggagaaacuggaagccgagcucgcuacagccagaucuaccaaugaagaucagcggcgccauauugagaucagagaccaggcucuguccaacgcccaggcgaagguggugaaacuugaggaagaacugaaaaagaaacaagucuacguggauaagguugaaaagaugcagcaggcccucgugcaacugcaggcugccugugagaagcgggaacagcuugagcacagacugcgcacacggcucgagagagaacuggagagccugcgcauccagcaacggcagggcaauugccagcccaccaacgucucugaauauaaugcugccgcccucauggagcugcuuagagagaaagaggagcgcauucuggcucucgaagcggacaugacaaagugggagcagaaguaccuggaagagaacgugaugcggcauuuugcccuugaugcugccgccaccguggcugcccaaagagacacgaccgucaucucccacagcccuaauacaucuuaugauaccgcgcuggaggcucgcauucagaaagaagaggaagagauccucauggccaacaagcggugucuggacauggaagggagaauuaaaacacugcaugcccagaucauugagaaggaugcuaugaucaaaguucuccagcaacgcucccggaaggagcccagcaagaccgaacagcuguccugcaugagaccugccaaaucucuuaugagcaucuccaaugcuggaagcggccugcucucucacuccagcacgcugacagggucuccgauuauggaggaaaagcgggacgacaaaagcuggaagggaucccuuggcauccugcucggcggggauuaccgcgccgaguacgugcccucuaccccuagccccgugccucccuccacaccgcugcugagcgcgcacucuaaaaccggauccagagacuguagcacccagacagaacggggcacggagucuaacaagaccgccgcugucgccccuauuuccgugcccgcuccuguugccgcggccgcuacagccgcugccaucaccgccacagcugcgaccauuacgacaaccaugguggccgcugcccccgucgccguggcugccgcggcugcccccgccgcugccgcggcuccuagcccggccaccgccgcugccacagcugccgcgguuucccccgccgcugccgggcagaucccugcugccgccucuguggcuagcgcggccgcugucgcccccuccgccgcugccgcggcugccgugcaagucgccccugcugcccccgcgccggugccugcucccgcccucguuccugugcccgccccugcugccgcucaggccucugcgcccgcccagacccaagcuccgacaagcgccccugcugucgcccccacgcccgccccuaccccgacacccgcuguggcgcaggccgagguuccugcuucccccgccaccggaccuggcccccauagacugagcaucccuucucuuacaugcaaccccgauaagaccgacgggccgguguuccacuccaauacgcuggaacgcaaaaccccuauucagauccucggacaggagcccgaugccgaaauggucgaguaucugauuuga

SEQ ID NO: 65786 - RNA, 2721 nt, Artificial Sequence
  derived and/or modified sequence opt5 from AMOTL1__Homo_sapiens__NP_001287936
auguggagagccaagcugcggcgcgggaccugcgagcccgcugugaaagucgaagacccucucuguaacuuccacagcccgaauuuucugagaaucuccgagguugaaaugcggggcucugaggaugccgcggcuggaacagugcuucagcgccugauucaagaacagcucagauacggcacgcccaccgagaacaugaaucugcuugccauccagcaucaggccacagggagcgcuggaccugcccaccccaccaacaauuucuccucuacagagaaccugacccaagaagacccucagaugguguaucagagcgcucggcaggagccccaaggccaggaacaucaggucgauaauacagugauggagaagcagguucgcuccacccaaccucagcagaacaaugaggaacucccgacguacgaggaagccaaagcgcaaucucaguuuuucagagggcagcagcaacagcagcagcaacagggagccgugggccacggcuauuacauggcugggggaaccagccagaagucccggacagagggccgccccaccgucaacagagccaauagcgggcaggcucauaaagacgaagcccugaaggagcugaagcaaggacacgugcggucucucuccgagcgcauuaugcagcugagccuugaaagaaacggcgcgaaacagcaucugccugggucuggaaauggcaagggcuuuaaaguugggggaggccccuccccugcccagcccgcugggaaggugcucgauccgcggggaccucccccugaguaucccuucaaaacaaagcaaaugaugagccccgucucuaagacccaggaacacggccuguuuuacggggaccagcacccuggaaugcuucaugagauggugaaaccguaucccgccccucaacccgugcgcacggaugucgcuguucugagauaccagccucccccggaauacggcgugacaucccggccuugccagcuccccuucccuagcaccaugcagcaacacucccccaugucuagccagacauccagcgccucuggcccucugcacuccgugagccugccccucccgcugccuauggcccuuggggcuccccagcccccuccggcggccucucccagccagcaacugggaccugacgcuuuugccaucgucgagagagcccagcagaugguggagauucucaccgaagagaaccgcguucugcaucaggaacuucaaggcuauuacgauaaugcugacaagcugcacaaauucgagaaggaacuccagcggaucuccgaggccuaugagucucuggugaaaagcaccacaaagagagaaucccuggauaaagcgaugcgcaacaagcucgagggggaaauccggagacugcaugacuuuaaccgcgaucuucgggacagacuggagacggcuaaucgccagcucagcucucgggaguacgaaggacacgaggacaaggccgccgaaggccauuaugcuucccaaaacaaagaguuccugaaggaaaaagagaaacuugagauggaacuggccgcugucagaaccgccagcgaggaucaccgccggcacauugaaauccucgaccaggcgcugucuaaugcccaggcuagagugauuaaacuggaggaggagcuccgggagaagcaggccuacguugaaaagguggagaaacugcaacaggcucuuacacagcugcaguccgccugugaaaagcgcgagcaaauggaaagacggcucagaaccuggcuggagcgcgagcuggaugcgcuucggacacagcagaaacaugggaacggccagcccgccaauaugccugaauauaacgcucccgcccuccuggagcuggucagagaaaaggaggagcgcauccucgcucuggaagccgacaugaccaaaugggagcaaaaguaccuugaagagagcacgauuagacacuuugccaugaaugcugcggccacagcugccgccgaacgggauaccaccaucauuaaccauucccgcaauggaucuuacggcgagagcucccuggaggcucacaucuggcaggaagaggaagaggugguccaggccaacagacggugccaggacauggaauauacaaucaagaaucuccacgcgaaaauuaucgagaaggaugcuaugauuaaagugcugcaacagcgcucuagaaaggacgccgggaaaaccgauagcuccagccugcggccugcccgcucuguucccuccaucgcugccgcgacaggaacgcauagcagacagaccucucuuacauccagccaacucgcugaggaaaagaaggaggaaaagaccuggaagggcucuauugggcugcugcucggaaaagagcaccaugaacacgccagcgccccgcugcuuccucccccucccacauccgcucugagcucuaucgccuccaccacggcugccagcuccgcgcaugccaagaccggcucuaaagacagcuccacacagaccgauaagucugcugaacucuucuggccgagcauggccucccugccuucucgggggcgccugagcacaacccccgcucacuccccugugcuuaaacaccccgccgccaagggcacggcugagaagcucgaaaacagccccggacauggcaaaucuccugaccacagagggcgggucuccagccugcugcauaagccggaguuccccgacggagaaaugauggaggugcucaucuga

SEQ ID NO: 65787 - RNA, 1785 nt, Artificial Sequence
  derived and/or modified sequence opt5 from AMPD2__Homo_sapiens__XP_011539550
augagaaagcugacccacggcacagggccccggccucgcgugggaagcggccagccguacagaggggucguugccgcucauguggcgccccggaaacgcaagaaauggagaggaggcguggggcggcgcagacggggacaagccggcgcuggcccucgcgccgccgagcccggggcugaaccugccagauucugguggggacucacgugcugugucacacccccucaguccggccgggggucuccgacccugaacgcucagggagugcuucgcgagaucuggaccagcuuuggcuccagaucucuggggagcacauggcccaccucccucucuauugccggacugggcggccgggacacagggguugcgcuucgcccugugagacugccccggagcgccggaguccaccucagaccugcuggcaauuucgaacgccugcccuauuuuccgcaucuguccgcccgggcuggggcccucggagugaccuggcugggcagcguugcgagaucuccuugccgccccuccgggccuggacuuagcgccgugcagacgucucggggccaaccuccccugggcaccagagcuuccuggccccaggaacucuucacacgcagccuggccgagucugagcuucgguccgcuccguacgaguuucccgaagagagcccuaucgaacagcuggaggagagacgccagcggcucgaaagacaaauuucccaggaugucaagcuggagcccgacauccugcuccgcgccaaacaggauuuccugaagaccgacucugauagcgaccuucagcuguauaaggaacaaggggagggacagggcgaucggucccucagagaacgggacgugcuggagcgcgaguuucagagagugacaauuagcggggaagagaaauguggagucccuuucaccgaucuucuggacgccgcuaagucuguugugcgggcgcucuuuaucagagaaaaauacauggcccugucccugcagagcuucugccccacgacacgccgguaucuccaacagcuggcugagaagccgcuugaaaccagaacauacgagcagggcccugauacccccgugucugccgacgccccuguccaucccccugcucuggagcaacaccccuaugaacacugugagccgagcaccaugccuggggaucucggccugggacuucgcauggugagaggcguugugcacgucuacacacggcgcgaacccgacgagcauugcuccgaaguggagcugcccuacccugaccuccaggaguuuguugccgaugugaacguccugauggcgcugaucauuaaugggccgaucaaaucuuucuguuauagacggcuccaguaccugagcuccaaguuucagaugcacgugcuucugaacgaaaugaaggagcucgcugcccagaaaaaggucccccaucgcgacuucuauaauauuagaaaaguggauacgcacauccacgccagcucuugcaugaaccaaaagcaucugcugcgguucauuaaacgcgcuaugaagagacaccuugaagagaucguucauguggagcagggacgggaacagacccuccgcgaggucuuugaauccaugaaucugacagccuacgaccugagcguggauacccucgacguucacgcugauagaaacacauuccaucgguuugacaaauucaaugccaaguauaacccuauuggcgagucugugcugagagaaaucuuuaucaagaccgauaaucgcgucuccgggaaauacuucgcgcacauuaucaaguga

SEQ ID NO: 65788 - RNA, 2331 nt, Artificial Sequence
  derived and/or modified sequence opt5 from AMPD3__Homo_sapiens__NP_000471
auggcccugagcuccgagcccgcugaaaugccuagacaguucccgaagcucaacaucucugagguggacgaacaaguccggcugcuugccgagaagguuuuugcgaaggugcugcgcgaagaggauagcaaagacgcucucucccuguucaccgugcccgaggauugcccuauuggccagaaggaagccaaagagagagaacuucagaaggagcuggccgagcagaagucugucgaaacagcuaaacggaagaaauccuuuaagaugauccgcagccaaucucucagccugcagaugcccccucagcaggacuggaaagggcccccugccgcuuccccggccaugagccccacgaccccugugguuacaggagcgaccucucugcccaccccugcccccuacgcuaugccggaguuccaaagagugaccauuuccggcgauuauugugccgggaucacacucgaagacuacgagcaggcugccaagagccuggcgaaggcccuuaugauucgggaaaaauaugcucgccuggccuaccacagauuuccucggaucaccucucaguaucucggacauccccgcgcugauacggccccucccgaggagggccugcccgacuuccacccuccgccccuuccucaggaagaucccuacugccuggacgaugccccucccaaucucgacuaucugguccauaugcaagggggaauccuguuuguguacgauaacaagaaaaugcucgagcaccaggaaccgcauucccugccuuaccccgaccuugagaccuauacaguugacaugagccacauucuggcucucaucaccgauggcccuacaaagaccuacugucacagacggcugaauuuccuugaaucuaaauuuucccugcaugagaugcucaacgagaugagcgaguucaaggaacugaaauccaauccccaccgcgacuuuuauaacgugagaaaggucgauacgcauauucacgcggccgcuugcaugaaucagaagcaucugcuccgguucaucaaacacacauaccaaaccgaaccugaccgcacaguggccgagaagagaggccggaaaauuacccugagacagguguuugaugggcuucacauggaccccuaugaucugaccgucgacucucucgauguucaugccggacgccagacauuccaccgguucgacaaguuuaacagcaaauacaauccggugggcgcuuccgaacugagagaucuuuaucugaagacggagaacuaccucgggggagaguacuucgcccgcauggugaaggaagucgcgcgggagcuggaagagagcaaauaucaguacucugagccuagacuguccaucuauggccgcagccccgaagaguggcccaaucucgcuuacugguuuauucaacauaagguguauucuccuaacaugcgguggaucauccagguuccgagaauuuacgacaucuuccgcagcaaaaagcugcuucccaauuuugggaaaaugcuggaaaacauuuuccucccucuguuuaaggccaccaucaauccccaggaccaccgggagcugcaccuuuuccucaaguaugugacaggauuugauuccgucgacgaugaaucuaaacauagcgaccacauguucuccgauaagagcccuaaccccgacguguggaccucugagcagaacccucccuacuccuacuaucuguacuauauguacgccaauauuaugguucugaacaaucucagacgcgagcggggccugagcacauuucuuuucagaccgcauuguggcgaagcugggucuaucacccaccugguguccgccuuucucacggcugauaacaucagccacggacugcugcuuaaaaaguccccuguccuccaauaucuguacuaucuggcccagauucccaucgcgaugucuccucucagcaauaacucccuguuccuugaguacucuaaaaauccccugcgggaguuccuccauaagggccugcacgugagccuguccacagacgauccgaugcaguuucauuacaccaaggaagcccuuauggaagaguaugcuauugccgcucaggucuggaaacucagcacaugcgaccugugugagaucgcccgcaacucugugcugcaauccgggcucagccaccaggaaaagcagaaauuccugggacagaauuacuauaaggagggcccugaagggaacgauauuagaaaaacaaauguugcgcaaauccggauggccuuuagauacgagacccuuugcaacgaacugucuuuccucuccgacgcuaugaaaagcgaggagaucacagcccugacgaauuga

SEQ ID NO: 65789 - RNA, 2088 nt, Artificial Sequence
  derived and/or modified sequence opt5 from AMPH__Homo_sapiens__NP_001626
auggccgacaucaagaccggcauuuucgcuaaaaacgugcagaagagacugaaucgggcccaagagaaaguccuccagaagcuggggaaagcggaugaaacaaaggacgagcaguuugaagaguacguucagaacuucaagcgccaagaagcugagggaacgagacuucagcgggagcugcgcggcuaucucgccgccaucaaagggaugcaggaagcuagcaugaagcugaccgagucccuucacgaaguguacgagcccgauugguauggaagagaggacgugaaaauggucggcgaaaagugcgaugugcugugggaggacuuucaucagaaacucguugaugggucucugcugacacucgacaccuaccugggacaauucccugauauuaagaaucggaucgccaagcgcagcagaaaacuuguggacuaugauuccgcucggcaccaucuggaagcccuccagucuagcaagcgcaaagacgaguccagaauuucuaaggcggaagaggaguuucagaaagcccagaaggucuucgaagaguuuaacguggaucugcaagaagaacuuccgagccuguggucccggcgcguuggcuucuacgugaauacauuuaaaaacgucagcucucucgaagcuaaguuccacaaggagaucgccgugcugugucauaaacuguaugaggugaugaccaagcucggcgaccagcacgcugacaaagccuuuacaauccagggggcgcccuccgauagcggaccucugagaauugccaagacccccucuccucccgaagaaccuuccccgcuucccagcccuacggcuucucccaaucacacccuggccccugcuucccccgccccggcccggccucgcagccccucccaaacaagaaaaggcccucccguucccccucucccgaaggucacccccacaaaggaacugcagcaggagaacaucauuucuuucuuugaagacaauuucgugccugagaucagcgugaccacgcccucccagaacgaggucccugaagugaaaaaggaggaaacacuucuggaucucgacuucgaucccuuuaaaccggagguuaccccugcugggagcgcgggagugacacauucucccaugucccaaacccugccuugggaccuguggaccacaagcacggaucucguccagcccgccucuggcgggagcuucaauggauuuacccagccucaggacacaucccuguucaccaugcaaacagaucagucuaugauuugcaaccuugcugagagcgaacaggcucccccgaccgagccuaaggccgaggagccccuggccgccgugacgcccgcgguuggccucgaccugggcauggauacacgggcugaggagccuguggaggaagccgucaucauuccgggggccgacgcugacgccgcugugggaacccuugucuccgccgcggagggcgcccccggggaagaggcugaagccgagaaagcuaccgugccugccggagagggcguuagccuggaagaggcgaagaucgggacagaaaccacagagggagccgaaucugcucagcccgaggccgaggaacucgaggcuacggugccucaagaaaaggucauccccuccgugguuauugagccugccagcaaucacgaggaagagggcgaaaacgagaucaccauuggcgccgaacccaaagagacaaccgaggaugcugcgccgccugggcccacaucugaaaccccugagcuggccacggaacagaagcccauccaggacccgcagccuacccccuccgcuccugccaugggagccgcugaucaacuggccagcgcgagagaggcuucccaggaacucccucccggcuuucuguacaaaguggagacacuucaugacuucgaggccgccaauucugaugaacugacccuccagcgcggggacgucgugcuggugguucccagcgauuccgaggcugaccaagaugccggauggcuggucggcgugaaggaaucugacuggcuucaguaccgggaucucgcgacauauaaagggcuguuuccggagaacuucaccagacgccuggacuga

SEQ ID NO: 65790 - RNA, 1212 nt, Artificial Sequence
  derived and/or modified sequence opt5 from AMT__Homo_sapiens__NP_000472
augcagagagccgugagcgucguugcucggcugggcuuccgccuccaagccuuucccccugcgcugugcagaccgcuuuccugugcucaggaggugcugcggcgcacaccccucuacgacuuccaccuggcccaugggggaaagaugguggccuuugcuggcuggucucuuccuguccaguauagagauagccacaccgacucccaucugcacacgcggcagcauugcucucucuucgaugugagccacaugcugcaaaccaaaauccugggguccgaccgcguuaagcucauggaaucucugguggucggagauauugccgagcuuagacccaaccagggcacacugagccucuuuaccaaugaagcugggggaauccuggacgaucuuauugugacaaacaccuccgagggccaccuguacguugugagcaaugccggcuguugggaaaaagaccucgcgcugaugcaggauaagguccgggagcugcagaaccaagggcgcgacgugggacucgaggugcuggauaaugcccuucuggcucuccagggcccuacagccgcucagguccugcaggccgggguugcggacgaucuuagaaaacugcccuucaugaccucugccgugauggaaguguuuggagucuccggcugccgggugacgcgcuguggguauaccggagaggacggcguugaaaucagcgugccugucgcuggcgccgugcaucucgcuacagccauucugaagaacccggagguuaagcuggccgggcucgcugcgagagacucucugcggcuugaggccggacugugccucuacggcaaugauaucgacgaacacaccacacccguggaggggucccugagcuggacccuuggaaaacgcagacgggcugccauggauuucccuggcgccaaggucaucgugccccaacugaaagggagaguccagcgccggagagugggacucaugugugaaggcgcuccuaugcgcgcccauucucccauucugaacauggagggcacgaagaucgggacaguuaccuccggaugcccgagcccuucccugaaaaagaauguggcgaugggcuauguccccugugaauacucucggccugggacaaugcuccugguggagguuagacgcaagcagcaaauggcuguggucagcaaaaugcccuuugugcccaccaacuauuacacccuuaaguga

SEQ ID NO: 65791 - RNA, 1497 nt, Artificial Sequence
  derived and/or modified sequence opt5 from AMZ1__Homo_sapiens__XP_011513452
augcugcagugcagacccgcccaagaguucagcuuuggcccucgggcucucaaggacgcccugguguccaccgaugcggcucuccagcagcuguacgucucugccuucagcccggccgaacgccucuuucuggcugaggccuauaacccccagagaacacuuuucuguacgcugcucauccggaccggguuugacuggcugcugucccgcccugaagcucccgaggauuuccaaacauuucacgccucucuccagcauagaaaaccucggcuggcgcgcaagcacauuuaccuucagcccaucgaccugagcgaggaaccuguuggauccucucuccugcaucagcuuugcagcuguaccgaggccuucuuucugggccucagagugaaaugccugccguccguggcugccgcuagcauucgguguucuucccgccccagcagagauucugaccggcugcaacuccacacagaugggauccuguccuuccuuaagaauaacaaaccuggagacgcccugugcguccucggccugacccuuagcgaucuguauccccaugaagcguggucuuuuacauucuccaaguuucucccugggcacgaggugggaguuuguagcuucgcccgcuucuccggcgaauuucccaagucuggcccgagcgcuccugaccuggcccugguggaggcugccgccgaugggcccgaggcuccucuccaggacagaggaugggcgcugugcuucuccgcccuuggcaugguccaguguugcaaagugaccugucacgaacugugccaucuccuggggcuuggaaauugccgguggcugcgcugucucaugcagggcgcucugagccuggaugaggcccucagacggccccuggaccuuugccccauuugucugagaaagcuccaacacguucugggguuucgccugaucgaacgguaccagagacuuuauacguggacccaggccguggucggaacauggccuucucaagaggcuggcgaaccguccgugugggaggacacacccccugccagcgcggauucuggcaugugcugugagagcgacuccgaacccgggaccucugugagcgagccucucacccccgaugcuggaucccauacguucgccagcggcccggaagaggggcugucuuaccuggccgcuuccgaagccccucuucccccuggaggccccgcugaggccaucaaagagcacgaacgcuggcuggcgaugugcauucaggcccuucagcgggaggucgcugaagaggaccugguucagguggauagagccguggacgcucucgaucgcugggaaauguuuacagggcaacugccugccacccggcaggaucccccgagcucuagagacuccgucggacugcgcaaggugcuuggcgacaaauucagcucccuccggagaaagcugucugcgcgcaagcuggcccgggcugagagcgccccuagacccugggauggcgaggaauccuga

SEQ ID NO: 65792 - RNA, 591 nt, Artificial Sequence
  derived and/or modified sequence opt5 from ANAPC10__Homo_sapiens__NP_001243638
augggcggggugaaggagaccaacauccugaaaaugacaacgcccaauaagaccccuccgggagccgaccccaaacagcucgaaagaacaggcaccguccgggagauugggagccaagcuguuuggucccugucuagcugcaagccuggauucggcguggaucagcuucgcgacgauaaccuggaaacauacuggcaguccgacgggucucagccccaccucgugaauauccaauuuagacggaaaaccacagucaagacccuguguauuuaugccgauuacaagagcgacgaguccuauacgccuucuaaaaucagcgugcgcguuggaaacaauuuccauaaccuucaggaaauuagacagcuggagcucguggagcccuccggcuggauccacgucccucugaccgauaaucauaagaaaccgacacggaccuuuaugauccagauugcggugcuggcuaaccaccaaaauggccgcgacacacauaugagacagaucaagauuuacacccccguugaagagagcucuaucgggaaauucccucggugcacgacaauugauuuuaugauguaucgcuccaucagauga

SEQ ID NO: 65793 - RNA, 591 nt, Artificial Sequence
  derived and/or modified sequence opt5 from ANAPC11__Homo_sapiens__NP_001002244
augaaggugaaaaucaagugcuggaacggcgucgccaccuggcuguggguugcuaaugacgagaacugugggauuugcagaauggccuucaauggauguugccccgauuguccucuccacggcgaaagcaucucccggugccuggggugguguccgcagcccgugccugugcuuggaggccgcgcgcauccccaagucccuauuaacacagcuucucccacgccugggcagcacaccggaagccugauguccagagaggaaucuagccgguccccggaccccacaccucccgcccucgaucaggagaccucuagccugcuucgcugcacauccccuuggugucuggaccauagcugcgaucucuuuggcaucaccgaccaggugucugccgauggccccagagcuugucggcaaggggcccgcagacggcugccggcuggaguuggcccugugcugccccuccugccucacgcccuucauccccaggucgcggcccgcacagcuggggccgcugcccugccccacgugccuccgggaauggaaguucagggcgugagacccgaccucgcgcuggccgggggagcuuccuga

SEQ ID NO: 65794 - RNA, 225 nt, Artificial Sequence
  derived and/or modified sequence opt5 from ANAPC13__Homo_sapiens__NP_001229304
auggacagcgaggugcagagagauggccggauccuggaccucauugaugacgccuggcgcgaagauaagcugcccuacgaggacgucgcuaucccucuuaacgaacugccggagcccgaacaagauaaugggggaaccacagaguccguuaaagagcaggaaaugaaguggacggaccucgcccugcaguaucuucacgagaacgugccucccauuggcaauuga

SEQ ID NO: 65795 - RNA, 5835 nt, Artificial Sequence
  derived and/or modified sequence opt5 from ANAPC1__Homo_sapiens__NP_073153
augagcaacuucuacgaggaaagaaccacaaugaucgccgcucgggaccugcaggaguuugugcccuucggccgcgaucacugcaagcaucacccuaaugcccucaaccugcaacuuagacagcugcagccggcguccgaacucuggucuagcgacggggcugccggacuggucggcucccuucaggagguuacgauucaugaaaaacaaaaggagucuuggcagcugcggaaaggggugagcgagaucggagaagauguggacuaugaugaggaacucuacgucgccggcaauauggugauuugguccaaggggucuaaaagccaggcucuggccguuuauaaggcuuuuaccguggacucccccguccagcaagcccuguggugugauuucaucauuagccaggacaagucugagaaagcguacuccagcaacgagguggaaaagugcaucuguauccuccagucuuccugcauuaauaugcacagcaucgagggaaaagauuauauugccucucugccuuuucagguugcuaacguguggcccacaaaguacggccuucuguucgaacgcuccgccagcucccaugaggucccucccggcucuccuagagaaccgcuccccaccauguuuagcaugcugcacccucuugacgagaucacaccccugguguguaaauccgggagccucuucggaucuucccgggugcaauaugucguugaucacgcuaugaagauuguguuucugaauaccgacccuagcaucgugaugacauacgaugccguccagaacgugcauucuguuuggacccugcgcagagugaagagcgaggaagagaaugucgugcucaaauucuccgaacagggcgggacgccccaaaacguugcgaccucuagcucccugacagcccaccuucggagccugucuaagggagacuccccggugaccagcccuuuucagaauuacucuuccauucauagccagucccgcucuacaagcucccccucucuccacagcagauccccuagcaucucuaacauggcugcccugucccgggcucacagccccgcccuuggcguccauucuuucuccggggugcagcgcuuuaauaucagcucucacaaccaaagccccaaaagacauuccauuagccacucuccuaauuccaacagcaacggauccuuccuggccccggagaccgaacccaucgucccugagcucugcauugaccaucuguggacggagacaaucaccaauauucgggaaaagaacucucaggcuagcaaaguguucaucacauccgaucuguguggccagaaguuucucugcuuccugguugagucucagcuucaacugcgcugugugaaauuucaggaaagcaaugacaagacccagcucaucuucggcuccgucaccaacauucccgcgaaggaugccgcuccuguggagaaaaucgacacaaugcugguucuugaagggucuggaaaucuggugcucuauacgggcgucgugagaguggggaagguuuuuauucccggacugccggccccuagccugaccauguccaacacaaugccccggccuagcaccccccucgauggcgucucuacaccuaaaccccuguccaagcuucuggggagccucgacgagguggugcugcugucuccggucccugagcuuagagauuccagcaaacuccacgacucucuguacaaugaagauugcaccuuccagcaacugggaacguauauccacuccauucgcgaccccgugcauaaccggguuacacucgagcugagcaauggcuccauggugagaaucaccauccccgaaauugccaccagcgagcuuguccagacaugucugcaggcuaucaaguuuauucucccuaaggagaucgccgugcagaugcugguuaaaugguacaacgugcacucugcgccgggcgggcccagcuaucauuccgaauggaaucuguucgucaccugccuuaugaacaugaugggauacaauacagaucgccucgcuuggacgcggaacuuugacuucgagggcucucugagcccugugauugcccccaagaaagccagaccuuccgaaaccgggucugacgaugacugggaguaucugcucaauagcgauuaccaccaaaacguugaaucccaccugcuuaaccgcucucugugccucagccccuccgaggcuagccagaugaaggacgaggauuuuucucagaaucugucccuggacagcucuacacuucucuucacccauaucccugccauuuuuuucgugcugcaccuggucuacgaagagcucaaacugaacacacuuaugggagaaggcaucuguucccugguggagcuccuggugcaacuggcucgggaucuuaagcucgggcccuaugucgaccauuacuauagagauuacccgacccugguucgcacgaccggccaggugugcacaaucgacccuggacagaccggcuucaugcaccaucccagcuuuuucacauccgaaccucccucuauuuaucagugggugagcuccugucugaagggggagggaaugccgccuuaccccuaucucccuggcaucugcgagcggagcagacuggucgugcuuucuauugcccuguacauccucggggaugaaucccugguuagcgacgagucuagccaauaccugacccgcauuacgaucgcgccccagaaacuucagguggaacaggaggaaaaucgguuuuccuucagacacucuacaagcgucuccucucuggccgagcggcucgugguuuggaugaccaacgugggauuuacacugcgcgaucucgagacccugcccuucggcaucgcucuuccuauuagagacgccaucuaucacugucgggaacaaccggcuagcgacuggcccgaggccgucugccugcucauugggagacaggaucuguccaagcaggcgugugaaggcaaucugccuaaaggaaagagcgugcuuucuuccgacguucccagcggcaccgagacagaggaagaggaugacgggaugaacgauaugaaucaugaagugaugucccugaucuggucugaggaccuccgcguccaggaugugcggagacugcuccaaagcgcccacccugugcgcgucaacguugugcaguaccccgaacuguccgaccaugaguuuauugaggaaaaagagaauagacuucugcagcucugccaacggacgauggcucugccugugggacgcggcauguucacccuguuuucuuaucacccgguccccacagaaccucuucccaucccuaagcugaaccucaccgggagagcccccccgcggaauacaaccguggaucugaacagcggaaauaucgacguuccucccaacaugacguccugggcuagcuuccauaauggcguggccgccgggcucaagauugcucccgcgucucagaucgauuccgccuggauugucuacaacaaaccuaagcacgcugagcuggccaacgaauaugccggcuuucuuauggcucugggacugaauggccaccucacaaaacuggccacccuuaacauccaugacuaccugaccaaggggcacgagaugacaagcauuggacuccugcucggcgugucugcggcuaaacuggggaccauggauauguccaucacacgccuucugagcauccauauucccgcccugcucccuccgacgucuaccgagcuggacguuccccacaaugugcaggucgccgcuguggucggaaucggccuuguguaucaggggacagcccacagacauaccgcggaaguucugcucgcugagauuggccggccucccggaccugaaauggaguacuguacagaccgcgaaagcuacucccuggccgccggccucgcucuggggauggugugccuuggacacggcucuaaccugaucgggaugagcgaucugaauguccccgagcaacucuaucaguacauggugggaggccauagacgguuccagaccggcaugcaccgcgagaagcauaaauccccgagcuaucagauuaaggaaggggacacgaucaacguugaugugaccuguccuggagccacacuggcucuugccaugauuuaccugaagaccaauaacagauccaucgcggacuggcuccgggcccccgauacaauguaucugcucgacuuugucaaaccugaguuccugcuucugagaacccuggcucgcugccucauccugugggaugacauucuucccaauucuaaguggguggauagcaacgugccucaaaucauucgggaaaauuccaucucucugagcgagauugagcuccccugcuccgaagaccugaaccuggagacacucucucaggcccacguuuacaucaucgcuggcgccugucuuagccugggguucagauuugccggauccgaaaaucugagcgcuuucaacugccuccacaaauuugcgaaggauuucaugaccuaucugucugccccgaaugcuuccgucacgggcccucauaaccuugagacaugucugagcguggugcuccugucucuggccauggucauggccggguccggaaaccucaaagugcuucagcugugccgcuuucugcacaugaagaccggcggcgaaaugaauuacggguuccaucucgcucaccacauggcccugggacuucuguuucucggcgggggacgguacagccugucuaccuccaacagcuccauugcggcucugcucugugcccuuuauccccauuuccccgcccacagcacagacaauagauaccaucugcaggcucugcgccaccucuauguucuggccgcggagccucggcuucuggugccggucgacguggauaccaacacgcccugcuacgcucuccuggagguuacauauaagggcacccaaugguacgaacagacaaaagaggaacugauggccccuacccuccuucccgagcugcaucugcucaagcagaucaaagugaaggggccuagauauugggaacugcuuauugaccugucuaaaggaacacagcaccucaagagcauccuguccaaggauggcguccuguacgugaaacuccgcgccggccaacuuucuuacaaggaggaccccaugggguggcagagccugcuggcucagaccguugccaaucggaacuccgaggcuagagccuuuaaaccugaaacgauuucugcguucaccagcgauccggcccuccuguccuuugcugaguauuucuguaagcccacagugaauaugggacaaaaacaggaaauccuugaccuguucucuagcguccucuacgagugcgugacccaggaaacaccugagaugcugcccgccuauaucgcuauggaucaggccauucggcgccugggcagacgggagauguccgaaaccagcgagcucuggcaaaucaagcuugugcuggaauuuuucucuucccgcagccaccaggagagacugcagaaccauccuaagcgggggcucuuuaugaauucugaguuccugcccgucguuaaauguacgauugacaacacacuugaucaguggcugcaagugggaggcgacaugugcgugcacgccuaccucuccgggcagccgcuggaagagagccagcuguccaugcucgcuuguuuucuugucuaucauucugugccugcgccccagcaccugcccccuaucggacuggaaggcagcaccuccuucgccgagcuccuguuuaaguucaaacaacuuaagaugcccguuagagcucugcuccgccuggccccucugcuccuuggcaauccgcagcccauggugauguga

SEQ ID NO: 65796 - RNA, 2469 nt, Artificial Sequence
  derived and/or modified sequence opt5 from ANAPC2__Homo_sapiens__NP_037498
auggccgcugccguggucguugcggagggcgacagcgauuccagacccgggcaggaacugcucguggcuuggaacaccgugucuacaggacuggucccuccggccgcccuuggccuggugagcucccggacgucuggggcuguucccccuaaggaggaagaacuccgcgccgcuguggaaguccugagaggacacggccuucauagcgugcuggaggagugguucguugaagugcuccaaaaugaccugcaggccaacaucucccccgaguuuuggaaugcgauuucucagugcgaaaacagcgccgaugagccucagugucugcuccugcuucuggacgcuuucgggcuccuggagucccggcuugaucccuaccugcgcagccucgaacugcuggagaaauggaccagacucggacugcuuaugggcacaggcgcccaagggcugcgggaagagguccacaccaugcuccgcggagugcuguuuuucucuacaccuagaaccuuucaggaaaugauccagcggcuuuauggcugcuuccugcgcguguacaugcaguccaagagaaaaggggagggaggcacagacccggagcucgaaggggagcuggauagccgguaugcucgcagacgguacuaucgccugcuccaaucuccccugugugccggaugcuccagcgacaagcagcaguguuggugcagacaggcgcuugaacaauuucaucagcugucucagguccuccaccggcugucccuucuggagagaguuagcgccgaagcugugaccacgacccuccaucaagugacacgcgagcggauggaggauagaugucgcggcgaauacgagcgguccuuccugagagaauuucacaaauggauugagcgcgucgugggcuggcuggggaagguuuuccuccaggacggaccugcccggcccgcuucuccugaagccggcaauacccugagacgcuggcggugccacgugcagagauuuuucuaucgcaucuacgccagccuucggauugaggagcuguuuuccaucgucagagauuuccccgacagccggccggcuaucgaagaucucaaguacugucuggagcgcacagaccagagacaacagcugcuugugucucucaaagcggcccuggaaacccggcugcuccauccugggguuaacacgugcgacauuaucacacuguauauuuccgcuaucaaggcccuuagagugcuggaucccagcauggucauucucgagguggccugugagccuauccgccgguaccugagaacccgcgaagacacagucagacagauuguggcuggacugaccggcgauucugacgggaccggagaucuugccguugagcucagcaaaacagaccccgcgucccuggaaacgggccaggauucugaggacgauagcggcgaacccgaggacugggugccugauccggucgacgcugaccccgggaaguccagcucuaaacggcgcuccagcgauaucaucucucugcucguguccauuuauggaagcaaggaccuguucaucaaugaguacagaucccuucuggccgaucggcuccugcaccaauuuucuuucagcccugaacgcgagauuagaaacguugaacugcuuaagcuccgguuuggcgaggcccccaugcauuucugcgaagugaugcugaaagacauggcugauucccgcagaaucaaugccaacauucgggaggaggacgaaaagcgcccugcugaggaacagcccccguuuggggucuaugccgugauccugucuagcgaguucuggccucccuuuaaagaugaaaagcucgaggugccugaggacaucagagcggcccuggaggcuuacugcaaaaaguaugagcagcuuaaagccaugcggacccuguccuggaagcacacacucggacugguuaccauggaugucgaacuggcugacagaacacuuagcguggccgugacccccguccaggcggugauucuccuguacuuccaagaucaggccucuuggacgcuggaggagcucuccaaggcuguuaaaaugccuguggcccugcuucgccggagaaugagcgucuggcugcagcagggcgugcuccgcgaagaacccccggggacauuuucuguuaucgaagaggaacggccucaagacagagauaauauggugcugauugacuccgacgaugagagcgacucuggcauggcuagccaggccgaucagaaggaggaggagcugcuucuguucuggaccuacauccaagccaugcucaccaaccuggaaucccucagccuggaccgcauuuauaauaugcuucggauguuugucgugacaggacccgcucuggcggagaucgaucuccaggaacugcagggcuaccugcagaaaaagguuagagaccaacagcuuguguauucugccggggucuaccgccugcccaaaaacuguuccuga

SEQ ID NO: 65797 - RNA, 2430 nt, Artificial Sequence
  derived and/or modified sequence opt5 from ANAPC4__Homo_sapiens__NP_001273685
augcugagauucccuaccugcuuucccagcuuccggguggucggcgagaagcagcucccgcaagaaaucauuuuucugguuuggucccccaaacgcgaccuuaucgcccuggcuaacacagccggggaggugcuccugcacagacuugcgucuuuccaucggguguggagcuuuccucccaaugaaaacacgggaaaggaggucaccugucuggcuuggcgcccugauggcaaacuccuggccuucgcccuggcugacacaaagaaaauugugcucugcgauguugaaaagcccgagucccugcacucuuuuagcguggaggccccugucuccuguaugcauuggauggaagugaccguugagucuagcgugcuuacauccuucuacaaugcugaagacgagagcaaccugcuccugccgaagcugcccacccugccuaaaaauuauucuaacacauccaagaucuuuagcgaggaaaauucugaugagauuaucaaacuccugggggacgucagacugaacauccucgugcugggaggcuccagcggguucauugaacuuuacgccuauggaauguuuaagaucgcgcgggugaccggcauugccggcacgugccuggcucucugucugucuuccgaucuuaaaagccuguccgucguuaccgaggugucuacaaauggggccagcgaaguguccuacuuccagcucgagaccaaccugcuguauagcuuucuccccgaggucacacgcauggcuagaaaguucacccacaucucugcccugcuucaguacauuaaucugucccucacgugcaugugugaagcgugggaggaaauccugaugcagauggacagccggcuuacaaaguucgugcaagagaaaaacaccacaaccucuguucaggaugaauuuaugcaucugcuccuguggggaaaggccagcgcugagcugcagacccuccugaugaaucagcuuacagugaaaggccugaagaaacucgggcaauccauugagucuagcuauuccagcauccagaagcuggucaucucucaccuucaguccggaagcgaaucucuucucuaccaccuguccgagcugaaaggcauggccagcuggaagcagaaguacgaaccucucgggcuggacgcugccggaauugaggaagccaucacggcugugggcuccuucauucuuaaagcgaacgagcugcuccaaguuaucgauucuagcaugaagaauuuuaaagccuucuuucgcuggcuguauguggcuaugcugagaaugaccgaggaccauguccuucccgaacucaacaaggugaugacacagaaagauauuaccuucgucgccgaguuucugacagaacacuucaacgaggccccggaccuguacaaucggaagggcaaguauuuuaacguggagcgcguugggcaguaccucaaagacgaagaugacgaucugguguccccucccaauaccgagggaaaccaaugguaugacuuccuucaaaauucuagccaucugaaggaauccccucuccuguuucccuacuaucccagaaaaagccugcacuucgucaagcggcgcauggagaacaucaucgaucagugccuucagaaaccugcugacgugauuggcaagucuaugaaucaggccaucuguauuccgcucuacagagauacgcgguccgaagacagcacaagacgccuguuuaaguuccccuuccuguggaacaauaaaaccucuaaccuccacuaccugcuuuuuaccauccuggaggauucccucuauaagaugugcauucugcggagacauacagacaucagccagucuguuagcaaugggcugaucgcgauuaaauucggauccuuuaccuacgcuacaacggagaaggugcgccggagcaucuauucuugucuugaugcccaguucuacgacgacgaaaccgucacaguggugcucaaagauaccguuggcagagaggggcgcgaccggcugcugguccagcucccucugucccuuguguauaacagcgaagauuccgccgaguaccaauuuacaggaaccuauucuacgagacuggacgaacagugcagcgcuauucccacccgcacaaugcacuucgagaagcauuggcggcuccuggaguccaugaaggcccaguacguggcuggcaauggcuuuagaaaagucucuugcgugcugagcuccaaccuucgccacguucggguguucgaaauggauaucgacgaugagugggaacuggacgagucuagcgaugaagaggaggaagccuccaauaagccugucaaaauuaaggaggaagugcucagcgagucugaggcggaaaaccagcaagccggggcugccgcucuggcccccgagaucguuauuaaaguggaaaagcucgacccggagcuggauuccuga

SEQ ID NO: 65798 - RNA, 1932 nt, Artificial Sequence
  derived and/or modified sequence opt5 from ANAPC5__Homo_sapiens__NP_001131031
auggccgagggcgaacugaaggacauggagcaguucuuugaugaccucagcgauuccuucucugggaccgaacccgaggugcacaaaacaagcgucguuggacuguuucuuagacauaugauccuggcuuacuccaagcucucuuucagccaaguguuuaaacuguauacggcccuucagcaguacuuccagaacggcgaaaagaaaaccguggaggacgcggauauggagcugacaucccgggacgaaggggagcgcaagauggaaaaggaggagcucgaugucucugugagagaagaggaaguuagcugcuccggaccucugagccaaaaacaggcugaguuuuuccugucucagcaggccucccuccugaagaaugacgaaaccaaagcccuuacaccggcuagccugcaaaaggagcucaacaaucugcuuaaauuuaaccccgauuucgccgaggcucacuaucugucuuaccucaauaaccugcgggugcaggacgucuuuuccagcacccauucucugcuccacuauuucgaucgccugauucuuacaggcgccgaauccaagagcaauggggaggaaggauacggcagaucccugcgguaugcggcccucaaccuggcugcccuucauugucgcuuuggccacuaccagcaggcugagcuggcccuccaagaagcgaucagaauugcccaggagucuaaugaccacgugugccugcagcauugucugagcuggcucuacguucuggggcaaaagcgguccgauagcuaugugcuucuggagcacucugucaaaaaggcugugcauuucggacucccucgcgccuucgcuggcaaaaccgccaacaagcugauggacgcccuuaaagacuccgaucugcuccacuggaagcacagccugucugaacugaucgacauuagcaucgcucagaaaacggcgaucuggagacucuacgggcgguccaccauggcccugcagcaggcucaaaugcuucugucuaugaauagccucgaggccgugaacgccggaguccagcagaauaacacagaauccuuugcuguugcccugugccaucuggcggagcuucacgcugaacagggcuguuucgccgccgcuagcgaggugcucaagcaucugaaggagcgcuuucccccuaauucucaacacgcccagcuguggaugcucugcgaucagaaaauucaguucgacagagcuaugaacgaugggaaguaucaucuggccgacucccuugugaccggaaucacagcgcugaacagcauugaaggcgucuaccggaaagccgugguucuccaagcucagaaucagaugucugaggcccacaagcugcugcagaaacuucucgugcacugucaaaagcugaagaacaccgaaauggucaucuccgugcugcucagcguugcugagcuguauuggcgcuccucuagccccacgauugcccuuccuaugcugcuccaggcgcuggcccuguccaaagaguacagacuucaguaucucgcuucugaaacagugcugaaucuggccuuugcucaacucauccugggcauuccggagcaggcccuuagccugcuccauauggccaucgaacccauccuggcugauggggcgauucuggacaagggacgggccauguuccuugucgcuaaaugccagguggccuccgccgcuagcuacgaucagccuaagaaagccgaggcgcucgaagcugccaucgagaaccugaaugaggccaagaacuacuuugcuaaggucgacuguaaagaacgcauuagagaugugguuuauuuccaagcccggcuguaccacacccucggcaagacacaggagagaaaucgcugcgcgaugcuguuucggcagcuucaucaggaacugcccucucacggggugccucucaucaaccaccuguga

SEQ ID NO: 65799 - RNA, 1614 nt, Artificial Sequence
  derived and/or modified sequence opt5 from ANAPC7__Homo_sapiens__NP_001131136
auggaccccggcgaugccgcuauccuggagagcucccuccggauucuguacagacuuuucgaaucugugcugccuccgcuccccgccgcgcugcagagccgcaugaacgucaucgaccacguuagagauauggcugccgccgggcuucauuccaaugugcggcugcucucuagccugcugcucaccauguccaacaauaacccugagcuguuuucucccccucaaaaguaucagcuucugguguaccacgcugacagccucuuccaugauaaagaauaucgcaaugccgucuccaaguacacaauggcucugcagcagaaaaaggcccuuagcaaaacgucuaaggugagacccuccaccggaaacagcgcgucuacaccucaaucccagugccugccgagcgagauugaaguuaaguauaaaauggccgaguguuacaccaugcucaagcaggacaaagaugcuaucgccauucuggacggcauccccucucggcagcgcacaccuaagaucaauaugaugcuggcuaaccucuauaaaaaggccgggcaagagagacccuccgugaccagcuacaaggaaguccugcggcagugcccucuugcgcuggaugccauucucggacugcuuucccugucugugaaaggcgcugagguugccagcaugacaaugaaugugauccagaccguccccaaccucgacuggcuguccguguggauuaaggcuuacgccuuugugcacacgggggauaauagccgcgccaucucuaccauuuguucccuggagaaaaagagccuccugagagacaacgucgaucuucugggaucucucgcugaccuguauuuccgggcgggcgacaauaaaaacagcguucuuaaguuugaacaggcccaaaugcuggauccguaccucaucaaaggcauggacguguauggguaccugcuggcucgcgagggaagacucgaagauguggagaaucugggcugccggcuuuucaacauuuccgaccagcaugccgaaccuugggucgugucugggugucacagcuuuuauuccaagcgcuacagcagagcccuguaucucggagcuaaggccauccagcugaacucuaauuccguucaagcgcugcuucucaaaggcgcugcccugcggaacauggggagagugcaggaggccaucauucacuuccgcgaagcuauccggcuggcccccugcagacucgauuguuacgagggacugauugagugcuaccuugcuagcaauucuauccgcgaagccauggucauggcgaacaauguguauaagacacugggcgccaacgcucagacccucacacugcuggccaccguuugucuugaggacccugugacgcaggaaaaagcuaagacacuccuggauaaagcccugacccaacggcccgacuacauuaaggcggucgugaagaaagccgagcuccuguccagagaacagaaguaugaggauggcaucgcccuucugcgcaaugcucucgcuaaccagagcgacugcguccugcaucggauccugggggauuuucuuguggccguuaaugaguaccaggaagccauggaccaauauuccauugcucucagauga

SEQ ID NO: 65800 - RNA, 444 nt, Artificial Sequence
  derived and/or modified sequence opt5 from ANG__Homo_sapiens__NP_001091046
auggugaugggccuggggguccuccugcuuguuuucgugcugggacucggccugacacccccuacccuugcccaggacaacagcagauacacgcacuuucugacccaacauuaugaugcuaagccgcaggggcgggacgaucgcuacugcgaguccaucaugagacggcgcggacucacaucucccuguaaagacauuaauaccuucauccacggcaacaagagaagcauuaaagccaucugcgaaaauaagaacgggaauccucaucgggagaaccugcgcauuuccaaaucuagcuuucaggugacaaccuguaagcugcacggaggcucccccuggccucccugccaguauagagcgacagcuggcuuccggaaugucgugguugccugugaaaacgggcucccugugcaucuggaucaaucuaucuuucgcagaccguga

SEQ ID NO: 65801 - RNA, 1497 nt, Artificial Sequence
  derived and/or modified sequence opt5 from ANGPT1__Homo_sapiens__NP_001137
augaccguguuccugagcuuugccuuccucgcugccauccugacacacauuggcugcuccaaccagagacggucucccgagaauagcgggcgcagauacaaccggauccaacauggacagugugcguauacguuuauucuuccugaacacgacggcaauugccgcgaguccaccacagaucaguacaacaccaaugcucugcagagagacgccccgcaugucgaacccgauuucucuagccaaaagcuccagcaccuggagcauguuauggaaaacuauacacaguggcuucagaaacuggagaauuacaucguggagaacaugaaguccgaaauggcccaaauucagcagaaugcugugcagaaccacaccgccacaaugcucgagaucgggaccucucugcugagccaaacggcugaacagacccggaaacucacagacgucgagacccaggugcugaaucaaacaucccgccuugagauccagcugcucgaaaacagccugucuaccuauaaacuugagaagcagcugcuccagcaaacgaaugaaauucugaagauccacgagaagaacucccugcucgaacauaaaauucuggagauggagggaaagcacaaagaagaacuugauacacugaaggaagagaaagaaaaucuccagggccugguuaccagacagacauacaucauucaggagcuugagaagcaacugaaccgggccaccaccaacaauagcgugcuccagaagcagcagcuggaacugauggacacaguccauaaccucgugaaucuguguacgaaagaggggguucuucugaagggaggcaaacgcgaagaggaaaagccuuuuagagauugcgcggacguguaucaagccggcuucaacaaaucugggaucuacaccauuuacaucaauaacaugcccgagccuaagaaagucuuuuguaauauggaugugaacggaggcggguggacagugauccagcaccgggaggacggaucccucgauuuccagcgcggcuggaaggaauauaagaugggguuuggaaaucccagcggcgaguacuggcugggcaacgaguucauuuuugcuaucaccucucagagacaauauaugcuucggauugagcugauggacugggaggggaaucgcgccuacucccaguaugauagauuccacaucggaaacgaaaaacagaauuaccggcucuaucugaagggccauacagggaccgcuggaaaacaaagcucccugauucuccacggcgccgacuuuucuacgaaggacgcggauaacgacaauugcauguguaaaugcgcccugaugcuuacagggggauggugguucgaugcuuguggcccuagcaaccugaacggcauguucuacaccgccgggcagaaucauggaaagcucaacggcaucaaguggcacuacuuuaaagggccguccuauagccugagaucuaccacaaugaugauccgcccccuggacuucuga

SEQ ID NO: 65802 - RNA, 1488 nt, Artificial Sequence
  derived and/or modified sequence opt5 from ANGPT2__Homo_sapiens__NP_001112359
auguggcagaucguguucuuuacccugagcugcgaccucguccuggccgcugccuacaacaauuucagaaaguccauggauucuauuggcaaaaagcaauaucagguucagcacgggagcuguuccuacacauuucuucugcccgagauggacaacugccggucuagcuccucuccuuaugugagcaaugcggugcagcgcgaugcuccgcucgaauacgacgauuccguccaaagacuucaggugcuggagaacaucauggaaaauaacacgcaguggcugaugaaacucgagaauuauauucaggacaacaugaagaaagaaaugguugagauccaacagaaugccgugcagaaccagaccgccgucaugauugagaucggaacaaaucugcugaaccaaaccgcugaacagacacggaagcucaccgauguggaggcccagguucugaaucaaacaacccgccuugaacugcagcuccuggagcauagccuuucuacgaacaagcuggagaaacagauccucgaccagaccuccgaaauuaauaagcugcaagauaaaaacagcuuccuggagaagaaagugcucgcuauggaagacaagcacaucauucagcugcagucuaucaaggaggaaaaagaucagcuucaaguccugguguccaagcagaacagcauuaucgaggagcucgagaaaaagauugugacagccaccgucaauaacucuguucugcagaaacagcaacaugaccuuauggagacagugaauaaccugcucaccaugauguccacgagcaauuccaaggaucccacaguggcgaaagaagaacagaucucuuuuagagacugugccgaagucuucaagagcggccacaccacaaacgggaucuacacccugaccuuuccuaauuccacagaggagauuaaggcuuauugcgacauggaagccggaggcgggggauggacgaucauucagcggcgcgaggauggcagcguggacuuccagagaaccuggaaagaauacaagguuggcuuugggaaccccucuggagaguacuggcugggcaaugaguucgugucccaacucacaaaccagcagcgguauguccugaaaauccaucuuaaggauugggaagggaaugaggcuuacagccuguaugaacacuuuuaccucucuagcgaggaacugaacuaucgcauucaccuuaaaggacugaccggcacagccgggaagaucuccucuaucagccaaccuggaaaugacuucuccaccaaggauggcgacaacgauaaauguauuugcaaguguagccagaugcucacgggcggguggugguuugacgcgugcggacccucuaaucugaacggcauguacuauccucagagacagaacacaaauaaauucaacgggaucaagugguacuacuggaaaggauccggcuauagccugaaggccaccaccaugaugauucggccggcugauuucuga

SEQ ID NO: 65803 - RNA, 1512 nt, Artificial Sequence
  derived and/or modified sequence opt5 from ANGPT4__Homo_sapiens__NP_057069
augcugagccagcucgccaugcugcaaggcucccuucugcucguggucgcuaccaugucuguugcccagcagacaagacaggaggcggaccgggggugcgaaacgcugguggugcaacacggacauuguagcuacaccuuccuucugcccaaguccgagccuugcccgcccggcccugaagucucucgcgauagcaacacacuccagagagagucccuggcuaauccccugcaccucgggaaacugccuacccaacaggugaagcagcuugaacaggcccugcagaacaauacacaguggcucaaaaagcuggagcgggccaucaaaaccauucuucgcucuaagcuggagcaaguucagcagcaaauggcucagaaccagacagcccccaugcucgaacugggaaccagccugcucaaucagacgaccgcucaaaucagaaagcugacagacauggaggcccagcuucugaaccagaccucccggauggaugcgcagaugccugaaacauuucucagcaccaauaaacuggagaaccaacuucugcuccagcgccagaagcugcagcaacugcagggccaaaauucugcccucgagaaaagacugcaggcucuugaaacgaagcagcaggaggaacuggccuccauucucagcaaaaaggcuaagcugcuuaacacacugucucggcaguccgccgcgcucaccaauaucgagcgcgggcugagaggagugcggcauaacagcucucugcuccaagaccagcagcacucccugcgccagcuucugguccuccugagacaucuggugcaagaacgggccaaugcuagcgccccggcuuucauuauggccggcgagcagguuuuucaggauugugccgagauccagcgcuccggcgcuucugcgagcgggguguauacaauccaagucuccaacgccaccaaacccagaaagguguucugcgaccuucagagcucuggaggccgguggacccucauucagagacgcgaaaaugggacagugaacuuucagcggaacuggaaagauuacaagcaaggauucggcgacccugcuggggagcacuggcugggaaaugaagucguucaccagcugacgagacgcgccgccuauucccuccggguggagcugcaggauugggaaggccaugaggcuuacgcccaauaugagcacuuucaucuuggcagcgaaaaccagcuguacagacucucuguggucggguauagcggauccgcgggccgccagucuagccuggugcugcagaauaccuccuucagcacacuugacucugauaacgaccacugucucugcaaaugugcucaaguuauguccgggggauggugguuugaugccugcggccugagcaaucugaacgggguguacuaccacgcccccgacaauaaguauaaaauggacggaauccgguggcauuacuucaagggcccuucuuauucccucagagcuagccgcaugaugauucggccccuggauaucuga

SEQ ID NO: 65804 - RNA, 1476 nt, Artificial Sequence
  derived and/or modified sequence opt5 from ANGPTL1__Homo_sapiens__NP_004664
augaagaccuucacauggacgcugggcgugcucuuuuuccugcuugucgacaccgggcacugcagaggaggccaguuuaaaaucaagaaaauuaaccaacggcgcuaccccagagccacagaugggaaggaggaagcuaaaaagugugccuauaccuuccugguuccugagcagcggaucacaggaccgauuugcgugaauaccaagggccaggacgcgagcacaaucaaagauaugauuacccgcauggaccucgaaaaccugaaggaugugcuuuccagacagaaacgggagaucgacguccugcaacucgugguugauguggacgggaauaucgucaacgaagugaagcugcugcgcaaagagucuagaaauaugaacagccggguuacgcagcucuacaugcagcugcuucaugagauuauccgcaagagagauaauucccuggaacucucucagcuggagaacaagauucuuaaugugaccacagaaaugcugaaaauggcuacccgguaucgcgagcucgaggucaaguacgccagccugacagaccuggugaacaaucaauccgugaugaucacccuccuggaggagcagugucuuagaauuuuuagccggcaggauacgcacgucucucccccucugguucagguggugccccaacauaucccuaacucccagcaguauacacccggacuccugggcggcaaugaaauucaacgcgacccuggguacccgagagaucuuaugcccccucccgaccuggccaccagcccuacaaaaucucccuucaagaucccgccugucaccuuuaucaacgagggacccuucaaagacugccagcaggcuaaggaagccggccacuccgugagcgggauuuauaugaucaaaccugaaaauucuaacggacccaugcagcucuggugugagaacucccuggaucccggcggguggaccguuauucaaaagcggacagacggaagcgugaacuuuuucagaaauugggaaaauuacaagaaaggcuuuggcaacaucgauggggaguacuggcugggacucgaaaauauuuauaugcugucuaaccaggacaauuacaaacuucugaucgagcucgaagauugguccgacaagaaggucuaugcugaguacagcuccuuccgccuggagccugaaucugaguuuuaucggcuuagacugggcacguaccaggggaacgccggagauagcaugauguggcauaauggcaaacaguucaccacacucgaccgcgauaaggacauguaugcggggaacugcgcccacuuccacaagggaggcuggugguacaaugcuugugcccauuccaaccugaauggcgugugguacagagggggacacuaucggagcaaacaucaagauggcaucuuuugggcugaauaccgcgggggaucuuauucccugcgggccguucagaugaugauuaagccgaucgacuga

SEQ ID NO: 65805 - RNA, 1482 nt, Artificial Sequence
  derived and/or modified sequence opt5 from ANGPTL2__Homo_sapiens__NP_036230
augagaccccugugcgugaccuguugguggcucggccugcuugccgcuaugggggccgucgcgggacaggaagacggcuucgaagggacagaggaaggaagcccucgggaguuuaucuaccugaaccgcuauaagagagcuggcgaaucccaagauaaaugcacguacaccuucauuguuccgcagcagcgggugacaggggccaucugugucaauucuaaggagcccgaggugcuccuggaaaaccgcgugcacaaacaggagcuugaacugcucaauaacgagcugcugaagcaaaagagacagauugagacccuccagcagcugguugaaguggacggaggcaucgucagcgaggugaaacuucugcggaaggaaucccgcaauaugaacucuagaguuacacaacucuauaugcagcugcuucaugagauuauccggaaacgcgauaaugcccuggaacucagccagcuggagaacagaauccugaaucagaccgcugacaugcuccaacuggccuccaaguacaaagaucuugagcacaaguaucagcaucuggcuacacucgcccacaaccagucugaaauuaucgcgcaacuggaggaacauugccagcgggugccuagcgcccgccccgucccucagcccccuccggcugcucccccuagaguguaccagcccccuaccuauaaucggauuaucaaccaaauuuccacgaaugagauccagagcgaccagaaccuuaaagugcugcccccgccucuccccaccaugccuacacugaccucucugcccuccagcacagauaagcccucuggcccuuggcgcgacugucuccaggcccuggaagaugggcacgacaccuccagcauuuaccuugucaagccggagaauacgaacagacugaugcaaguuuggugcgaucagcggcacgaccccggaggcuggacagugauccagagacgccucgaugggucugugaacuuuuuccggaauugggagaccuacaaacagggauuuggcaacaucgacggggaauauuggcugggacuugagaauauuuacuggcugacaaaccaaggcaauuauaagcuccuggucaccauggaagacugguccggcagaaaaguguucgccgaguacgcgagcuuucgccuggaaccugaguccgaguauuacaagcuccggcuggggagauaucauggaaacgccggcgauucuuucaccuggcacaaugggaaacaguuuacaacgcuugaccgcgaucaugacguuuacaccggaaacugugcucacuaccagaagggcggguggugguauaaugccugcgcucacagcaaccugaauggagugugguaccggggcggccauuauagaucccgcuaccaggauggggucuauugggccgaguuccggggaggcagcuacucucucaaaaaggugguuaugaugaucagacccaacccuaauacauuucacuga

SEQ ID NO: 65806 - RNA, 1107 nt, Artificial Sequence
  derived and/or modified sequence opt5 from ANGPTL4__Homo_sapiens__NP_001034756
augagcggcgcccccaccgcuggggccgcgcugaugcucugcgcugccacagccgugcugcuuuccgcucagggaggcccuguccaaucuaagagcccgagauucgccuccugggacgagaugaacguucuggcucacgggcuccugcagcuuggacagggccugcgggaacaugccgagcgcacgagaucucagcucagcgcgcuggaacggcgccuguccgccugugggucugcuugccaaggaaccgagggcagcacagaucucccccuggccccugaauccagaguggaccccgaggugcuucacagccugcagacccagcucaaagcucaaaauucucggauccagcagcuguuucauaaggucgcccagcagcaacgccaccuugagaaacagcaucugcggauucagcaccuccaaucccaguucggccugcuggaucacaagcaucucgaccacgaaguggcgaaaccugccagacgcaagagacugcccgagauggcucagccuguugauccggcccauaacgugagccggcuucaccacgggggauggacagucauccagcgcagacaugacggcucuguggauuuuaaucggcccugggaggcuuacaaggccggguucggagacccucacggcgaauuuuggcuggggcucgagaaaguucauuccauuaccggagaucgcaacagcagacuggccgugcaacuucgggacugggauggcaaugcugaacugcuccaguucucuguccaccugggcggggaggacacagcguauucccugcagcucaccgcccccguggcuggacagcugggcgccacgaccgugccucccagcgggcuuuccgucccguuuucuacaugggaucaagaccaugaccugagacgcgauaagaacugugccaaaagccucuccggaggcuggugguucgggaccugcagccacucuaaucugaacggacaguacuuucgguccaucccucagcagagacaaaaacuuaagaagggcauuuucuggaagacauggcgcggccgguauuacccccugcaggcuaccacgaugcucauccagccuauggccgcggaagcugccagcuga

SEQ ID NO: 65807 - RNA, 1413 nt, Artificial Sequence
  derived and/or modified sequence opt5 from ANGPTL6__Homo_sapiens__NP_114123
augggcaagcccuggcugagagcccuccagcugcuucugcuccugggggcuagcugggcccgggcgggagcuccucgcugcaccuacacauucgugcuuccgccccaaaaauuuacgggcgccgucuguugguccgggccugccucuaccagagcuacacccgaggccgcuaacgccagcgaacuggcggcccuccggaugcgcguuggaagacacgaggaacugcugcgggagcuccagcgccuggcugccgcugacggcgccguggcgggggaagugagagcccuucggaaggagucccgcggacugucugcuagacucggccagcugcgggcccagcuucaacaugaggcuggcccuggggccggacccggcgccgaucugggggcugaaccugcggccgcucucgcccugcugggagagcgcguccucaaugccagcgcugaagcccagagagcggcugcccgguuccaccagcuggacgugaaauuucgcgagcuugcccagcugguuacccaacaguccucucucaucgcuagacuggagcggcuuugcccgggcggggccggaggccagcagcaagugcugcccccucccccucucguccccgugguuccggugagacuggucggcagcacauccgauaccagccgcaugcuggacccugcucccgaaccucagcgggaucagacacaaagacagcaggagcccauggccucucccaugccugcggggcauccggccgugcccaccaagccugugggacccuggcaggacugugcugaagcccgccaagcuggccacgagcaguccggggucuaugaacuccggguuggaagacauguggugagcgucuggugcgagcagcagcuggagggcgggggauggacggugauucaacgccggcaggauggcucuguuaacuucuuuaccacauggcagcacuacaaagccggcuucgggagaccugacggagaauauuggcuuggccuggagcccguguaccagcucaccucccgcggggaucacgaacugcuuguccugcucgaggacuggggaggcagaggggcgcgggcccauuaugauggcuuuagccuggaaccggagucugaccacuaccgccugcggcucggacaauaucauggcgaugcuggggacucccugagcuggcacaaugacaagccuuucuccacaguggauagagaccgggauucuuacagcggaaacugugcccuuuaccagcgcggcggguggugguaucacgcuugcgcccauuccaaucugaacggaguuuggcaccauggcgggcacuacagaagccgguaucaggacggcguguacugggccgaguuuagaggaggcgcuuauucucuccgcaaggcggccaugcugauccggccccugaaacuuuga

SEQ ID NO: 65808 - RNA, 5643 nt, Artificial Sequence
  derived and/or modified sequence opt5 from ANK1__Homo_sapiens__NP_000028
augcccuacagcgugggcuucagagaggccgacgcugccaccuccuuucugcgggcggcucgcucugggaaccucgauaaggcccuggaccaccuuagaaauggagucgauaucaauaccugcaaccagaacggccugaaugggcuccaucuggccagcaaagaaggacacguuaagauggugguggagcuucugcauaaagaaauuauccucgagacgaccaccaagaaaggcaacaccgcucugcacauugccgcucuggccgggcaagacgaagucgugcgggagcucguuaauuauggagcgaacgugaaugcccagucccagaagggcuucaccccucuguacauggcugcccaggagaaccaucuugaagucgugaaguuucugcucgagaauggcgcuaaccaaaauguugccaccgaagauggguucacaccccuggcgguggcccuucagcagggacacgagaacgucguggcucaccugaucaauuauggcaccaaagggaaggugcgccuccccgcccugcauauugcugccagaaacgacgauacgcggaccgccgcuguccugcuccagaacgacccuaaucccgauguucugucuaaaacaggauuuaccccucuucacaucgcggcccauuacgagaaccugaauguggcucaacuccugcuuaaccgcggcgccagcgugaauuucacaccccagaacgggaucaccccucugcacauugccuccagacggggaaaugucaucauggugcgccuccugcuggacagaggcgcucagauugaaacgaagacaaaagaugagcucaccccgcugcacugugccgcgcggaacggccauguucgcaucucugaaauucuucuggaccacggggcucccauccaggccaagacaaagaauggacucagcccuauucauauggccgcucaaggcgaucaccuggacugcgugagacuucugcuccaguaugacgccgagaucgaugacaucacccuggaucaucugacaccccuccacgucgcugcccacugugggcaucaccggguggcgaaaguucugcuugacaagggagccaaaccuaacucccgcgcucugaauggcuuuacaccccuccauauugccugcaagaaaaaccacgugagagucauggaacugcugcuuaagacgggggcuagcaucgaugccgugaccgagucuggacucacaccgcugcacgucgcguccuucaugggccaucugccuauugugaaaaaucuccugcagcggggcgccagccccaacguuucuaaugugaaggucgagaccccucuucacauggcugccagagcugggcauacagaaguggccaaguaccugcuccaaaacaaagccaagguuaacgcuaaagcgaaggacgaucagacaccccugcacugugccgcucgcaucggacauacgaauauggugaaacugcuucucgagaacaaugccaaccccaaucuggccacaaccgcuggccacaccccucugcacauugccgcgcgggaagggcaugucgagacagugcucgcucugcuugaaaaggaggccucccaggccugcaugaccaagaaaggauuuacaccgcugcacguggcugccaaguauggcaaaguuagagucgcggagcuccugcuggaacgcgacgcucaucccaacgccgccgggaagaauggccuuacgccucuccacguggcugugcaucacaacaaucuggauaucgucaaacugcuccugccccggggaggcagcccucacucucccgccuggaacggguacaccccgcuucauaucgcugccaagcagaaucaaguggagguugcgagaucccugcuccaguacggaggcagcgccaacgcugaauccgugcagggggucacaccucugcaccuggccgcucaggagggacaugccgaaaugguggcccuucuccugucuaagcaagcuaauggcaaccuggggaauaaaagcggccucacaccccugcaccuuguugcgcaggagggacacgugccugucgccgacgugcugauuaagcauggcguuaugguggaugcuacaacccgcaugggguauacgccccuccacgucgccucccauuacggaaacaucaaacuggugaaguuccugcuucagcaccaggccgacgugaacgcuaaaaccaagcugggcuauagcccucuccaucaagccgcgcagcaggggcacacagacauugucacccugcuccugaagaauggagcuucucccaacgagguuuccagcgauggcacaaccccgcuugccaucgccaaacggcugggguacauuucugugacggacgugcucaaggucgugacagaugaaaccagcuuuguucugguguccgacaaacacagaaugucuuucccugagacagucgaugaaauccuggacgugagcgaggaugagggcgaggagcuuaucuccuuuaaggcugaacgccgggacagcagagauguugacgaggaaaaagagcugcucgauuucgugcccaagcuggaccaggucguggagucucccgccauuccucgcaucccgugugcgaugcccgaaaccguugugauucgguccgaggaacaagagcaggcuagcaaagaauaugaugaggacucucucaucccuuccagccccgccaccgagacauccgacaauauuucuccugucgccagccccgugcauacgggauuccugguguccuuuauggucgaugcuagaggcgggucuaugcggggaagccgccacaacggccuuagaguugugaucccuccccggaccugcgccgcuccgacaagaauuaccugucgccuggugaagccucagaagcucuccacacccccuccccuggccgaagaggaagggcuggcgagccggaucaucgcccuuggaccgaccggcgcucaauuccugucuccugucauuguggagaucccccauuuugccucccacgggagaggcgaccgcgaacucguugugcugagaagcgagaauggaucugucuggaaagagcaccggucccgcuacggcgaaagcuaucucgaucagauucugaacgggauggacgaggaacuuggaucucuggaggagcuggaaaagaaaagagugugccggaucauuacgacagauuucccucucuacuuuguuaucaugagccgccugugucaggacuacgauaccaucggccccgaagggggaucccuuaagagcaaacuggugccccucguccaggcuaccuucccugaaaaugccgugacaaagagagucaagcuggcccuccaagcucagccggugcccgacgagcugguuaccaaacuucugggcaaccaggcgacauuuucuccuauugugacggucgaaccccggcgcagaaaguuccaucggccuaucggccugcgcauuccccucccuccguccuggaccgauaaucccagagacagcggggagggagauacaaccucccugcggcuucugugcucugugaucggcgggacagaccaggcccaaugggaggauauuaccggaacgaccaaacucguuuaugcuaacgaaugcgccaauuuuacaaccaacgugagcgccagauucuggcuguccgacuguccucgcacagcugaggccgucaauuuugcgacccuccuguacaaggaacuuacagcugugcccuauauggccaaauucgugaucuuugccaagaugaacgacccucgggagggcagacugcgcugcuacuguaugaccgaugacaagguugauaaaacgcuggaacagcacgagaauuucgucgagguggcucggucuagagacaucgaagugcucgaggggaugagccuguucgccgaacuuuccggaaaccugguccccgugaagaaagcggcccagcagcgcucuuuucauuuccagagcuuucgggagaacagacucgcuaugccgguuaaggugcgcgauuccagccgggaaccuggcggcucucuguccuuccucagaaaagccaugaaguaugaggacacacagcacauucugugccaucuuaauaucaccaugccgcccugugcuaaggggagcggagccgaggaucggcgcagaaccccuacaccccuggcucugcgguacucuauucucuccgaaagcaccccuggcucucuguccgggacggagcaggccgaaaugaaaauggcggucaucagcgagcaccuuggacuguccugggccgagcucgcucgcgaacugcaauuuagcguggaggacauuaacagaauccggguugaaaauccgaacucucugcucgagcagagcguggcccuucugaaucugugggucaucagagaaggccagaacgcuaauauggagaaccucuauacagcccugcaguccauugaucgcggggagaucgugaauaugcuugaaggaucuggccggcaaagcagaaaccugaagcccgaccgccggcacaccgauagagacuacucccucucuccuagccagaugaauggcuacuccucucugcaggacgagcugcucagccccgccucccuugggugcgcucugagcucuccucugcgcgcggaucaguauuggaacgaaguugccgugcucgacgcuauuccccuggccgccacagagcaugauaccaugcuugaaauguccgacaugcaagucuggagcgcuggacugacaccgucucucgugaccgccgaggauuccagccuggaguguuccaaagcggaagacucugaugccacgggccacgaguggaagcuggaaggggcucucagcgaggaaccucggggacccgagcuuggcucccuggagcugguggaagacgauaccgucgacagcgaugccacaaaugggcucaucgaccugcuugagcaggaagagggacagagaucugaggaaaaacugccuggcuccaagcgccaggaugacgcuaccggcgccgggcaagacagcgagaacgaaguuucucucgugagcggacaucagagaggccaggcgcggauuacacacucccccaccgugucucaggucacggagcgcagccaagauagacugcaggacugggaugccgacggguccaucgugucuuaccugcaggaugcugcccaaggaagcuggcaggaagagguuacacagggcccucacuccuuccaggggaccagcacaaugaccgagggacucgaacccggcggcucucaagaguaugaaaaagugcuugucuccgugagcgagcauaccuggacagaacagccggaggcugaguccucucaggccgaccgggaucgcagacagcaagggcaggaggaacaaguucaggaagcuaagaauacguuuacccaagugguccagggaaacgaguuccagaauauuccuggcgaacaagugacagaggagcaguuuaccgacgaacaggggaacaucgucacaaagaaaaucauucggaaggugguuagacagaucgaucugagcuccgccgacgcggcccaagagcacgaagagguggagcugcgcggaucuggccuccagcccgaucugauugaagggcggaaaggagcucagaucgugaagagagccagccuuaaacgcggcaagcaguga

SEQ ID NO: 65809 - RNA, 5592 nt, Artificial Sequence
  derived and/or modified sequence opt5 from ANK2__Homo_sapiens__NP_001120965
augaccaccaugcugcagaaguccgacuccaacgccucuuuccucagagcugcccgggcgggcaaucuggauaagguggucgaguaccuuaaagggggaaucgacauuaacacgugcaaucaaaacggccugaaugcucuccaccuggccgccaaggaagggcauguuggacuugugcaggagcugcucggccgcgggagcuccguggauucugcuaccaagaaaggaaacaccgcccugcacaucgcuagccuggccggccaggcggaagucgugaagguucucgugaaggagggcgccaauauuaacgcucagucccaaaauggguuuacaccccuguauauggccgcucaggaaaaccauaucgacgucgugaaauaccuucuggagaauggagccaaccagucuaccgcgaccgaggauggcuucacaccucucgccguugcucugcagcaagggcacaaucaggccguggcuauucuucuggaaaacgacaccaagggaaaaguccggcuccccgcccugcauaucgccgcucggaaggaugacacgaaaagcgcggcccugcuccugcagaaugaucacaacgcugacgugcaguccaagaugauggugaaccgcaccacagagagcggcuuuacaccccuucacaucgccgcccauuaugggaaugucaacguugcuacacugcuccugaauagaggagccgcgguggauuucaccgcucggaacggcauuacgccucuucacguggccucuaagcgcggcaauacaaacauggucaaacugcuccuggacagagggggacaaaucgaugccaagacccgggacggccugacaccccuccauugugcugcccgcuccgggcacgaccaggugguugaacugcuucuggagagaggagcuccucuccuggcccggaccaaaaauggccuuagcccccugcacauggcggcccagggggaucauguggagugcgucaagcaccuccugcaacauaaagcuccuguggacgauguuacccuggacuaccucacagcccugcacguggcugcccauuguggacacuaucgcgucacgaaacuucugcucgauaaaagagcgaacccgaaugcccgggcucugaacggcuuuacaccccugcacauugccugcaagaagaaucgcaucaaagugauggaacuucucgucaaguacggcgcuucuauucaggccaucacagaguccgggcugaccccuauucauguggccgcuuucaugggacaccugaacaucguucuccugcuucugcagaauggcgcgagccccgacgugacaaacaucagaggggaaaccgcccuccauauggcugcccgggccggacaggucgaggugguuagaugucugcugcgcaauggcgcucuuguggaugcccgggcgagagaggaacaaacgccucuccacauugcuucucgccuggggaaaacagagaucguccagcugcuccugcagcacauggcccaucccgacgccgcuaccaccaacggcuauacaccgcuucacauuuccgcccgggaaggacagguggauguggcgagcguucugcucgaggcuggcgccgcccauucccuggcuaccaagaaaggguuuacaccucugcacgucgccgcuaaguacggaucucuugacguggccaagcuccugcugcaaagacgcgcggccgcugauagcgccggcaaaaacgggcucacgccccugcauguggcugcccacuacgacaaucagaaggucgcccuucugcuccuggaaaaaggagcuuccccucacgcgaccgccaagaacggcuauacaccccugcauaucgcugccaaaaagaaucagaugcagauugccagcacccuucucaacuacggggcugagacaaauaucgugaccaagcaaggcguuacgccccugcaccuggccucucaggaaggacauaccgacauggugacacuccugcuugauaaaggcgcgaacauccacauguccaccaagagcgggcugacaucucuccaucuggcugcccaggaggacaaagucaauguggccgauauucugaccaagcacggagcugaccaggaugcccacacgaaacuuggcuauacaccucugaucguugcgugccauuacgggaacgugaagauggucaauuuccuccugaagcaaggagcuaacgugaaugccaaaaccaagaacggcuauacaccgcuccaccaggccgcucagcaagggcauacccacauuaucaauguucugcuucagcacggcgccaaacccaacgcuaccacagccaauggaaacacggcgcuggccauugcuaagcggcucggcuacaucagcguggucgacacccugaaaguggugacagaggaagucaccacaaccacgacaaccaucaccgagaagcauaaacugaacguuccugaaacaaugaccgaggugcuugauguguccgacgaagagggggaugacacaaugacgggagauggcggggaguaucugagacccgaagaccucaaggagcugggagaugacucucucccuagcucccaguuucuggacggcaugaauuaccuucgcuacagccuggaagggggccggucugauucccuccgcagcuucucuuccgacagaagccacacccugucccaugccucuuaucugcgggauagcgcugucauggacgauuccgugguuauucccucucaccaggugagcacacuugccaaggaggccgagagaaacuccuaccggcugagcuggggaaccgaaaaucucgacaacgucgcucugucuuccagcccgauccauucuggccgcgcguccccuugucucgagagagauaauagcucuuuucuggugagcuucaugguugacgccagagggggagcuaugagaggcugccgccacaacgggcuucggauuaucauucccccuagaaaauguacagcccccacccgcgugacgugcagacuggucaagcggcaccgccuggccaccaugccucccaugguggaaggagagggccucgcuuccagacugaucgaaguuggcccgagcggggcccaauuucuuggaaaacugcaucucccuacagcgccgcccccucugaaugagggcgagucucucgugucccggauucugcagcuugggccgcccggaaccaaguuccugggcccugucaucguggaaaucccccacuucgcugcccugcgcgggaaagagagagaacucgugguccugcggagcgagaacggagauuccuggaaggaacauuuuugugacuauacagaggaugagcuuaaugaaauucugaacggcauggacgagguucucgauucuccugaagaccuggagaagaaacgcaucugcagaauuaucacccgggacuucccccaguacuuugccguggugagccgcauuaagcaggauuccaaucucaucggcccugaagggggaguccugucuagcacagugguuccccaagugcaggcugucuucccggagggcgcccuuaccaaaagaauccggguggggcugcaggcgcagccuaugcacuccgagcugguuaagaaaauucucggaaacaaggccacguuuucucccaucgugacacuggaaccuagacgccggaaguuccacaaacccauuaccaugaccaucccggucccuaaggcuagcuccgacgugaugcuuaauggcuuugggggagaugcccccacacugagacuccugugcagcauuaccggcggcacgaccccugcucaaugggaggacaucaccgggacaacaccccucacauucgucaacgaaugugugucuuuuaccacgaauguuuccgcccgcuucuggcugaucgauugccggcagauucaggagagcgugaccuuugcuucucaagucuauagagagaucauuugugugcccuacauggccaaauucguuguguuugcgaagucccaugacccuaucgaagcccgccuucggugcuucuguaugacagaugacaaagucgauaagacccuggagcagcaggaaaacuucgcugagguggccagaagccgcgacguggaaguucuggagggaaagccgauuuaugucgauugcuuuggcaaccucgugccccugacaaaaucugggcagcaccauaucuucuccuuuuucgcuuuuaaggagaaucggcuuccucuguucgugaaagucagagacaccacgcaagaacccuguggacggcucagcuuuaugaaggagccuaaauccacacgcggccuggugcaccaggccaucugcaaccugaauauuacccuccccaucuacacaaaggaaagcgagucugaccaggaacaggaggaggaaauugauaugaccagcgagaaaaacccucaagacgaacaggagagaaucgaggaacggcuugccuacauugcugaucaucugggguucuccuggaccgagcuggcgcgcgaacucgacuuuacagaggaacagauccaccagauuagaaucgagaauccgaacucucugcaagaucagagccacgcccuucugaaguauuggcucgagcgggacggaaagcaugcuacggauaccaaucugguugaaugucugacaaaaaucaacagaauggacauugugcaccucauggagaccaauacagaaccccuucaggagcgcaucucccauucuuacgccgaaauugagcagaccaucacgcuggaucacagcgagggcuucuccguccugcaagaggaacucugcacagcccagcacaagcagaaagaggaacaagcugugucuaaggaaagcgagaccugugaccauccucccauuguuuccgaggaagauaucagcgugggcuauucuaccuuucaggacggggucccuaaaacagagggagauuccagcgccaccgcgcuguucccccagacacacaaggaacaggugcaacaggacuuuucuggcaagaugcaggaccuuccggaggaauccagccuggaguaccagcaagaguauuucguuacgaccccugggacagaaaccuccgagacacagaaagccaugaucgugcccucuagccccuccaagaccccugaagaggucagcacgcccgcugaggaagagaaacucuaccugcagaccccuacaucuuccgaacggggaggcagcccgauuauccaggagcccgaggaaccuucugagcauagagaagagagcagcccccgcaagaccucucuggugauuguggaaagcgccgauaaccaaccugagacaugcgaacggcucgacgaggaugcugccuucgagaaaggggacgauaugcccgaaaucccgccugagaccgucacagaagaggaauauauugacgagcacggacauacgguugugaagaaggugaccagaaaaaucauccgccgguacgucuccucugagggcacagaaaaggaggaaauuauggugcagggcaugccccaggagccuguuaauaucgaggaaggggauggauacagcaaagugauuaagagagucgugcuuaaauccgacaccgagcaaagcgaagauaacaaugaguga

SEQ ID NO: 65810 - RNA, 5586 nt, Artificial Sequence
  derived and/or modified sequence opt5 from ANK3__Homo_sapiens__NP_001191332
auggccagcuccgcuucuagcucccccgccggcaccgaggacucugcgccugcucaaggcggguucgggagcgauuacuccagaucuagccggaaguccgacgccaacgccagcuaucugagagcugccagagcugggcaccucgaaaaagcccuggauuacaucaagaauggaguggacauuaacaucugcaaucagaacggccuuaaugcgcugcaucucgccucuaaagaggggcacgucgaaguuguguccgagcugcuucagcgggaagcuaacguggaugccgcuaccaagaaaggaaauacggcccugcauauugcgagccucgccggccaggcugaggucgugaagguucuggugaccaacggcgccaaugucaacgcucagucucaaaauggguuuaccccucuguauauggccgcccaggagaaccaccucgaagugguuaaguuccugcuugacaauggagcuucccagagccuggcgaccgaggauggcuuuaccccucucgccguggcucugcagcaagggcaugaccaggucgugucucuucugcucgaaaacgauaccaaaggaaaggugcgccugcccgcccugcacaucgccgcuagaaaagacgauaccaaggccgcggcucuccugcuucagaaugacaacaacgccgaugucgaguccaaaagcggcuucacaccccugcacauugccgcucauuacgggaauaucaacguugccacgcuccugcuuaaucgggcugccgcgguggacuuuaccgcccgcaacgacaucacaccccugcacguggcuuccaagagaggaaaugccaacauggucaagcuccugcuggaucggggcgcuaaaauugacgccaagacccgcgauggccucacgccccugcauuguggggcgagaucuggacacgaacaggugguugaaaugcuucuggaccgggccgcuccuauccucagcaaaaccaagaauggccuguccccgcuucacauggccacccaaggggaucaucugaacugcgugcagcuccugcugcagcacaauguccccguggacgauguuacaaacgacuaucucaccgcucugcauguggccgcccacuguggacauuacaaagucgcuaaggugcuucuggauaaaaaggcgaauccuaacgccaaggcucucaauggcuucacaccccugcacauugccugcaaaaagaaccgcaucaaagucauggagcugcuucucaagcacggggccagcauucaagcugugaccgaaucuggacugaccccuauccauguugccgcguuuaugggccacgugaauauugucucccagcugaugcaucacggcgcuagccccaacacaacgaacgugagaggggagaccgcccuccacauggccgcucggucuggacaggccgaaguugugcgcuaucugguccaggacggcgcgcaaguggaggcuaaagccaaggaugaccagacaccgcuucauaucagcgccagacuggggaaggcugacaucgugcagcagcuccugcaacagggagccuccccuaaugcugccaccacaucuggcuacacaccccugcaccuuagcgcgcgggaggggcaugaagauguugccgcuuuccuccuggaccacggcgccucccugagcauuacgaccaagaagggauuuaccccucuccaugucgcugccaaauacggcaagcuggagguggccaaccuucugcuccagaaaucugcuucccccgaugcggccggaaagagcggacugacaccccugcacguggcugcccacuaugacaaucagaaggucgcccuucuccugcuggaucaaggcgcuucuccucaugccgcggcuaaaaacggguacacaccgcuccacaucgccgccaagaaaaaucagauggacauugcuaccacacugcuugaauauggagccgaugcgaacgcugugacgagacagggcaucgccuccguucaucuggccgcucaggaggggcacguggacauggucagccuccugcugggccgcaaugccaacgugaaucuuuccaacaagucuggacucacaccccugcaucuggcugcccaagaagaucggguuaauguggcggagguccucgugaaccagggcgcccacguugacgcucagaccaaaaugggguacaccccucugcacgugggaugucauuauggcaauauuaagaucgucaacuuccuucugcaacacagcgccaaggugaaugcuaaaacaaagaacggguacacaccccuccaucaggccgcccagcagggacacacgcacaucauuaacgugcugcugcaaaauaacgcuuccccuaaugagcuuaccgucaacggcaauacagcgcuggggaucgccagacgccucggcuauauuucuguuguggauacccugaaaaucgugacagaagagaccaugacgacaaccacagucaccgaaaagcauaaaaugaacgugcccgagaccaugaaugaaguucucgacaugagcgaugacgaggugcggaaggcuaacgccccggagaugcuguccgacggagaauacauuagcgaugucgaggaaggcgaggacgccaugacaggggauacggacaaauaccuuggaccucaggaucugaaggagcucggcgacgauucucugcccgcugaaggguauaugggauuuucccugggcgccagaagcgcgucucuucgcuccuucagcucugaccggagcuacacccugaauagauccagcuaugcucgcgauucuaugaugaucgaggaacuccuggugccuuccaaggagcagcaccucacauuuacccgggaguucgacagcgauucccugagacauuacucuugggccgccgacacacuugauaacguuaaucuggugagcucccccauccacucuggguuccucgucagcuuuaugguggacgcucgcggcggauccaugcggggcucuagacaucacgggaugcggauuaucauuccuccccgcaaaugcaccgccccgacgagaaucacaugucggcugguuaagagacacaaacuggcgaacccuccgcccaugguggagggagagggccuugccagccgccuggucgaaauggggccugcuggagcccaguuccucggcccggugauuguggagaucccccauuuuggcuccaugcgggggaaggaaagagagcugauuguccuccgcagcgaaaauggagagaccuggaaagagcaccaauucgacucuaagaacgaagaucugaccgagcuucugaauggcauggacgaggaacuggauuccccugaggaacucgggaagaaaagaaucugccggaucauuacaaaggacuuuccccaguauuucgcuguugugagccgcaucaaacaggagucuaaccagauuggaccugaaggcgggauccuguccagcaccacagugccccuuguccaagccucuuuuccugagggagcucugacgaagcgcauucgggugggccuccaggcccagcccguuccggaugaaaucgugaaaaagauccugggcaacaaggcgaccuucuccccuauugucacaguggagccccgcagacggaaauuucauaagccuaucaccaugacaauucccguuccgccucccagcggggagggaguguccaauggcuacaaaggggacaccacgccuaaccuccgccugcuuuguagcaucaccggaggcacaucucccgcccaaugggaagauauuaccgggacaacaccccugacauucaucaaggacugcgucagcuuuaccacgaauguguccgcuagauucuggcuggccgauugucaccagguccucgagacagugggacuggcuacccagcuuuaucgggaacugaucugcguuccuuacauggccaaauuuguggucuucgccaagaugaacgacccgguggagucuagccuccgcugcuucuguaugaccgaugacaagguugacaaaacacuggaacagcaagagaauuuugaggaaguggcuagauccaaggauauugagguccucgaaggcaaacccaucuacguggacugcuauggcaaccuggcgccucuuaccaaagggggacagcagcugguguucaauuuuuacucuuucaaagagaaccggcugcccuuuagcauuaagaucagagauacgucccaggaaccuuguggccgccucucuuuccugaaagagcccaagacaaccaaggggcuuccucaaacagccguuugcaaucugaacauuacccucccggcucacaaaaagaucgagaaaacagaccggagacagagcuuugccucccuggcccuccgcaagcgguauagcuaccugaccgaacccggaaugucuccucagucccccugugagagaacggauauccgcauggcuauugucgccgaccaucuuggccugagcuggaccgaacuggcgcgggagcucaauuucucuguggaugaaaucaaccagauuagaguggagaauccuaacucccugaucagccaauccuuuaugcuucugaaaaagugggucacacgcgacgggaagaaugccaccacagaugcucucaccucugugcugacgaaaauuaaccggaucgacauuguuacacugcucgagggacccaucuucgauuauggcaauaucagcggcaccagauccuuugccgacgaaaacaacguguuccacgauccggucgacggguacccuagccuucagguggagcuggaaacacccaccggacugcauuauacacccccuacacccuuucagcaggacgauuacuucucugacauuuccagcaucgagucuccucuccggacgccgagccgccuguccgauggccuuguucccucucaagggaauauugagcacagcgcugacggaccucccguggucaccgccgaagaugcgucccuggaggacucuaagcucgaagauagcgugccucugacagagaugcccgaagccguugacguggaugagucccagcuggagaacgucugccucagcuggcagaaugaaaccucuuccggcaaccuugagagcugugcucaagccagacgggugacagggggacugcuggaccgccucgaugacuccccggaucagugcagagacucuaucaccagcuaccugaaaggcgaagcuggcaaguucgaggccaaugggucccauacggaaauuacaccugaggcuaaaaccaagucuuauuuucccgagagccagaacgacgugggaaagcaguccaccaaagaaacacuuaagccuaaaauccacggcagcgggcacgucgaggaacccgccucuccucuggcggccuaccaaaagucccucgaggaaaccagcaaacugaucauugaggagacaaagcccuguguuccggugucuaugaagaaaaugucccggacgagcccugcugauggaaagcccagacugucucuccaugaagaggaaggcagcuccgggucugagcagaaacagggagagggcuucaaggugaaaaccaagaaggaaauccgccacgucgagaaaaagagccauuccuga

SEQ ID NO: 65811 - RNA, 2292 nt, Artificial Sequence
  derived and/or modified sequence opt5 from ANKFN1__Homo_sapiens__NP_694960
auggaggccagccugaccagacggcuccuguucaaggaccgccacuuuacaugcuccaaaaucauuggcagacgguucgcuuguuuugcccagcgccuuucucauagacggaagcaaagccagugcgaucugcucaacgaauccacggggcagcugcccaccacauguucuagcgcggcuuccaauucuaucaacuggaauugccgcgugaaaaugacccagcaaaugcagaaccuucaccugugucagagcaagaaacauuccgccccuagcucuccgaaugccgcuaagagacucuaccggaaccuguccgagaagcugaaaggaagccacucuuccuucgacgaagccuauuuucgcacaagaaccgaucggcucagccugcgcaagacaucugucaauuuccagggcaacgaggcuauguuugaagccguugagcaacaggacauggaugcggugcagauucuucuguaccaguauacccccgaggaacucgaccugaauacgccuaacuccgaggggcuuacaccccuggauaucgccauuaugaccaauaacgugccuaucgcuagaauccuccugcggaccggagcccgcgaaagcccccauuucgucucccuggagucuagagcuaugcaccucaauacacuggugcaagaggcccaggaacggguuagcgagcuuuccgcccagguggaaaacgagggcuuuacccuggacaauacggaaaaagagaagcaacucaaagcgugggaguggagauaccgccuguaucggagaaugaagacaggguucgaacacgcucgcgccccugagaugccgaccaacgucugccuuauggugacaagcucuaccucccugaccguuagcuuucaggaaccccucucugugaacgcugccgucgugacacgguacaagguggaguggagcauguccgaagauuucucuccucuggccggagagauuaucauggacaaucugcagacgcucagauguaccauuacaggccugaccaugggccagcaauauuuuguccagguuagcgcuuacaacaugaaaggguggggacccgcgcagacaaccacgccugccugcgcuucccccagcaauuggaaggauuacgacgaucgcgagccgcggcauaaaggccagucugaagugcuugaggggcugcuccaacaggugagagcccugcaccagcauuauuccugucgcgaaagcacaaaacuucagaccaccggacggaagcaaucugucuccagaagccugaagcaccucuuccacuccucuaacaaauucgugaagacacugaagcgcggccuguacaucgccguuaucuuuuauuacaaagacaauauucucgugaccaacgaggaccaggucccuauuguggaaaucgaugacagccauacauccucuaucacgcaggauuuccugugguuuaccaaacuuagcugcaugugggaggacauucgguggcugagacaguccauccccauuucuagcuccagcucuacaguucuccaaacccggcagaagaugcuggcugccacagcgcagcugcaaaaucuucucgggacccacaaccugggacgcguguauuacgagccuaucaaggauagacauggcaauauucugaucgucacgauccgggaaguggagaugcucuauuccuucuuuaacggcaaauggaugcagauuagcaagcugcagucucagagaaagagccuuuccacccccgaggaacccacagcucuggacauccuccugauuaccauccaagauauucugagcuaccacaaacgcucucaucagcggcuuuucccugggcucuaccugggauaucugaagcucuguuccagcgucgaccagaucaaagugcugguuacacagaaacuuccgaauauccugugccacgugaagauuagagagaacaauaacaucucccgcgaagagugggaauggauucaaaagcucucuggcagcgaguccauggaaucugucgaucacaccagcgacugccccaugcagcuguuuuucuacgagcugcagauggccgugaaggcccuucuccagcaaaucaauauuccucugcaucaggcuagaaacuuucggcuguauacgcaggagguucucgaaauggggcacaacguguccuuccugcuucugcuccccgccucugaugacgucuguacagcuccuggacaaaauaaccccuacaccccgcauagcggcuuucugaaucugccucuucagauguucgagcucgggaucguggccugcuuuacauga

SEQ ID NO: 65812 - RNA, 3513 nt, Artificial Sequence
  derived and/or modified sequence opt5 from ANKFY1__Homo_sapiens__NP_057460
auggccgaggaagagguggcuaagcuggaaaaacaccucaugcugcuuagacaggaguacgucaagcugcagaaaaagcucgccgaaaccgagaaacggugcgcgcugcuugcugcccaggccaacaaggagagcuccucugaauccuucaucucccgccugcucgcuauuguugccgaccuguaugagcaggaacaguacucugaucugaagaucaaagugggcgacagacauauuagcgcucacaaguuugugcucgccgcgcgguccgauucuuggagccuggccaaucuuuccagcacaaaagagcuggaccucucugaugcuaaccccgaggucacgaugaccaugcugcgcuggaucuauacagacgaacuugaguucagagaagaugacguguuucugaccgagcucaugaagcuggccaaucgguuccaacugcagcuccugcgcgaaagaugugagaaagggguuaugucccuugugaacguccggaauugcauucgcuuuuaccagacagcugaggaacugaacgccagcacccucaugaauuauugugcggagaucaucgccucucauugggaugaccugagaaaggaagauuucuccagcaugucugcucagcuucuguacaagaugauuaaauccaagacagaguauccucuccacaaagccaucaagguggaacgggaggacguuguguuucuguaccugauugagauggauagccaacucccgggaaaacugaacgaagcugaccauaauggcgaccuugcccuggaucucgcccugucccgcagacuugagucuaucgcuaccacgcuggucagccacaaggcggacguggauaugguggacaaauccggguggagccuccugcacaaggggauucagcggggcgaucuguucgccgcuaccuuucucaucaagaacggggccuucgucaaugccgcuacacugggagcccaggaaaccccucuucaucugguugcgcucuacucuuccaaaaagcacagcgcugacgugaugucugagauggcccagauugccgaagcucugcugcaagccggcgcuaaccccaauaugcaggauagcaaaggccgcacaccccuucauguguccaucauggccgggaacgaguaugucuuuucucagcuccugcaaugcaagcagcuggaccucgagcugaaagaucacgaaggaagcaccgcgcuuuggcuggccgugcagcacaucacgguuuccagcgaccagucugugaauccuuucgaggauguccccgugguuaacggcacauccuuugacgaaaacagcuucgcugccagacucauucaacgggggucucauaccgacgcuccugauacagccaccggaaauugucugcugcagagagcggccggcgcugggaacgaggccgcugcccuuuuccucgccaccaauggagcucacgugaaccaucgcaauaaguggggcgagacaccgcugcacacggcgugccggcauggccuggccaaccucaccgcugaacugcuucagcagggggccaaucccaaccugcaaacagaggaagcccucccucugcccaaggaggcugccucccugaccagccuugcggacuccguccaccuccagacaccucugcacauggcuaucgccuacaaucaucccgauguggucucugugauucuggaacagaaagccaacgcucuccacgccaccaauaaccugcagaucauuccggacuuuagccuuaaggauuccagagaccaaacgguucugggacucgcgcuguggacaggcaugcauaccaucgcugcccagcugcuugggucuggagccgcuaucaaugauaccaugagcgacggccagacacuccugcacauggccauucagcgccaagauuccaaaagcgcucuguuccuccuggagcaccaggccgacaucaacgugucucggacccaggauggggagacagcgcuucaacuggccauuagaaaucagcucccucuggucguggacgcuaucuguacgcgcggagccgauauguccguucccgacgaaaagggcaacccuccccuguggcuugcucuggccaacaaucucgaggacauugccagcacccuggugcggcauggcugcgaugcuacauguugggggcccggaccuggcgggugccuccagacccugcuucacagagcgaucgacgaaaacaaugagccgacagccuguuuucugauccgcucuggaugcgaugucaacagcccccggcagccuggcgcuaauggggaaggcgaggaggaagccagagacggacaaacgccccuccaucuggccgcuagcuggggccuggaggaaaccgugcagugccuucuggaguucggggccaacgugaaugcgcaggaugcugaaggacgcaccccuauucacguugccaucucuagccagcauggcgucauuauccaacuccuggugucccaccccgacauucaccucaacgugcgggauagacaggggcugacaccguuugccugugcuaugaccuucaaaaauaacaagagcgccgaggcgauccuuaagcgggagucuggagcugccgaacaggucgacaauaaaggccgcaacuuucugcauguggccguucaaaauuccgauauugagagcguccucuuccugaucuccgugcacgcuaacguuaauucuagagugcaagacgccagcaagcugacaccucuucaucuggcugugcaggccggguccgaaaucauuguccggaaccuccugcucgcgggcgccaaagugaacgagcugaccaagcacagacagacggcccuucaucuggcugcucaacaggaucugcccacaaucugcucuguucuccuggagaauggaguggacuuugccgccgucgaugaaaacggcaauaacgcgcuucaccuggcugugaugcacgggcgccucaauaacauucgggugcugcucaccgaguguacagucgacgccgaggcuuucaaucugagaggacagagcccucuucauauccugggccaguaugggaaagaaaacgccgccgcuauuuuugaccuguuccucgaaugcaugcccggauacccucuggauaagcccgacgccgauggcuccaccguucuucugcucgcguauaugaaggggaaugcuaaccugugucgcgccaucgugagaucuggcgcccggcucggagugaauaacaaucaaggcgucaacaucuuuaauuaccagguggcuaccaaacagcugcuuuuccgccugcuggacaugcucagcaaggagccgccuuggugcgauggguccuauuguuacgagugcacagccagauucggaguuacgacccggaaacaccauugucgccacugcggcagacugcuuugucacaagugcagcacaaaagaaauucccaucauuaaguuugaccugaacaaacccgugcgggucugcaacaucuguuucgaugugcucacccugggaggaguuucuuga

SEQ ID NO: 65813 - RNA, 7854 nt, Artificial Sequence
  derived and/or modified sequence opt5 from ANKHD1-EIF4EBP3__Homo_sapiens__NP_065741
augcugaccgacagcggcgggggaggcaccuccuucgaggaggaucucgacucuguggcccccagaagcgcuccugccggggccuccgagccgcccccucccggaggcguggggcugggaauccggacgguucgccuuuuuggcgaagcuggcccugccucuggggugggaagcuccggcgggggaggcucugggagcggaaccggcggcggggaugccgcucuggacuucaagcucgccgcugccgugcugcggaccggaggcgggggaggcgccuccgggagcgaugaggacgaagucucugagguggaguccuuuauucuugaucaggaagaccuggauaaccccguucucaaaaccacaagcgagaucuuccugucuuccaccgccgaaggagcugaccugcggacaguggauccugagacccaagcccgccucgaggcucugcuugaagccgccggcauuggcaagcugagcacggccgacgggaaggcuuuugccgauccggagguccucagacggcugaccucuuccgugagcugcgcucuugacgaagccgccgcugcgcugacacgcaugaaggccgaaaauucccacaacgcuggacagguugacaccagaucucucgccgaagccuguagcgauggcgacgugaaugcuguccggaaacugcuggaugaggggcgcuccgugaacgagcauacagaagagggagaaagccuccugugccuugccuguucugcgggcuacuaugagcuggcucaggugcuccuggccaugcacgccaaugucgaagacagagggaacaagggcgauaucacaccccuuauggcugccuccagcggaggcuaccuggacauuguuaagcuccugcugcuccaugaugcugacgucaauucucagagcgccacggggaacacagcgcugaccuaugccugcgcuggaggcuucguggauaucgucaaagugcuucugaaugagggggccaacaucgaggaccacaaugaaaacggacauacaccucucauggaggcugccuccgcgggccacguugaaguggcccggguccugcuugaucacggggcuggcauuaauacccauucuaacgaguuuaaggaaagcgcccugacccucgcuuguuacaaaggacaccuggacauggugcgcuuccugcucgaggccggcgccgaccaagagcauaagacagaugaaaugcacacggcucugauggaggcgugcauggacgggcacguugaaguggccagacuucugcucgauuccggagcucaggucaauaugcccgccgacagcuuugagucuccucugacccuggccgcuuguggcgggcauguggagcuugccgcgcuccugaucgaacggggagcuaaccuggaggaagucaacgaugagggcuauacaccccucauggaagccgcccgcgaggggcacgaggaaaugguggcucugcuucuggcccagggcgcgaauauuaacgcucagaccgaggaaacacaagagaccgcccucacgcuggccugcuguggaggcuucuccgaaguugcugacuuucugaucaaagccggggcugauauugagcuuggaugcagcacaccgcucauggaggccucucaggaaggccaucuggagcuggugaaguaccuccuggcguccggggccaauguccacgcuaccaccgccacaggagacaccgcucuuacauaugccugugaaaacggccauacggauguggccgacguucugcuccaggcuggggcggaucuggagcacgaaagcgagggcggaagaaccccucugaugaaggccgcucgggccggccaccuuugcacagugcaguuccucaucuccaaaggggccaaugucaacagagcuaccgccaauaacgaccauacaguggugucucuggcgugcgcuggaggccaccuggccguugucgagcuccugcuugcccauggggcugaucccacccaccgccugaaggacggaagcacgaugcucauugaagccgcgaaaggcggccacaccaaugugguguccuaccugcuggacuacccuaacaauguccuuucugugcccacaaccgauguuagccaacugcccccuccgucccaggaccagagccaagugccccgggucccuacacauacccuggcuauggugguucccccucaggagcccgauagaacgucucaggaaaacuccccggcccugcucggggugcagaagggaacaagcaaacaaaagucuuccagccugcaggucgccgaccaggaucuucugccuucuuuucaccccuaucagccucucgaguguaucguggaggaaaccgagggcaaacugaaugaacuggggcaacgcaucagcgcuauugagaaggcccagcuuaagucccuggaacucauccagggagagccccugaacaaagacaagauugaggaacucaaaaagaaucgggaggaacagguucagaagaagaagaaaauccugaaggagcuucagaaaguggaaagacagcugcagaugaagacacaacagcaguucaccaaagaguaccucgagaccaagggccaaaaggauacagucagccugcaucagcagugcucucaccgcgggguguucccugaaggagagggcgacggcucccugcccgaagaucauuuuagcgagcuuccccagguggacacgauucuguucaaagauaacgacgucgaugacgaacaacaguccccucccucugcugagcagaucgacuuuguucccgugcagccucucagcuccccgcaauguaacuucucuagcgaucugggguccaauggaaccaacucucucgagcugcagaaggugagcggcaaucagcagaucgucgggcaaccccagauugccaucacaggacacgaccagggccuucuggugcaagaaccugaugggcucaugguugcgacccccgcccagacacugaccgacacgcuggaugaccuuauugcugccguguccacacgggucccuaccggaagcaacucuuccagccagaccacagagugccugacccccgaaucuuguucccagacaacgagcaauguggcuucucaauccaugccucccguuuauccgagcguggauaucgacgcccacaccgaguccaaccaugauacagcccucacccuggcuugcgcgggcggccacgaggaacucgucagcgugcugauugccagagacgcuaaaaucgagcaucgcgauaagaaaggguuuacaccucuuauccuggccgccaccgcuggacacguuggcguggucgaaauucugcucgacaaagggggagacaucgaggcccagucugaacggacgaaggauaccccgcucagccuugcguguuccggcgggagacaggaggugguggaccugcuccuggcucgcggagccaauaaagagcaucggaacgucucugauuacacaccucucagccuggccgcuuccggcggcuauguuaauauuaucaagauucuucugaacgccggggcggaaaucaauucuagaaccggaagcaaacugggcauuagcccccucaugcuggccgcuaugaacgggcacgugccggccgugaaacuucugcucgacaugggaucugauaucaaugcucagaucgagacaaaccggaauaccgcccugacacucgcuugcuuccaaggccgcgccgaagucgugagccugcuucuggacagaaaagcgaacguugagcaccgggccaagaccgggcugacgccucucauggaagcugccuccggaggcuacgcugaggugggcagaguccugcuugauaaaggggccgacgugaacgcgcccccuguucccagcucucgcgauacagcucugaccauugcggccgacaagggacauuauaaguuuugugagcuccugauccaccggggcgcucauauugaugugagaaauaaaaaggggaacacaccccucuggcuggccuccaauggaggccacuucgacgucgugcagcuucugguccaggccggggcugauguggacgccgcggacaaccgcaaaaucacaccucugaugagcgccuuuagaaagggacacguuaaagugguccaguaccucgugaaggaaguuaaucaauucccgucugauauugagugcaugcgguacaucgcuaccaucacggacaaggaacugcuuaaaaagugucaucagugcguggagacaauugucaaagccaaggaucagcaggcugccgaagcgaacaaaaaugccuccauccugcucaaggagcuggaccuggagaagucccgcgaagaguccagaaaacaagcucucgccgcuaagcgggaaaaacgcaaggagaaaagaaagaagaaaaaggaggaacagaaacggaagcaggaggaagaugaggaaaacaaacccaaggaaaauucugagcuuccugaagacgaggaugaagaggaaaacgacgaggauguggagcaagaagugcccauugagccucccagcgccaccacaaccacaaccaucggcauuuccgcuacgagcgccaccuuuacaaauguuuucggcaaaaagcgcgcgaacgucgugaccacaccuucuaccaauagaaagaacaaaaagaauaaaacgaaggaaacaccgcccaccgcccaccugauccugccugagcagcauaugucccucgcucagcagaaagccgacaagaacaagaucaacggggaaccccggggaggcggggcuggaggcaauagcgauucugacaaccuggauagcacagacugcaauuccgagucuagcuccgggggaaaaucucaagagcuuaacuuugugauggacgucaauagcuccaaguauccuagccugcuccugcacucucaggaagagaaaaccuccaccgccacaagcaagacgcagacccgccuggaaggcgaggugacacccaacucccucucuaccagcuacaaaacaguuucccuuccgcugucuagcccuaauauuaagcugaaccucaccucccccaagagaggccagaaacgggaggaaggguggaaggagguggucagacgcagcaaaaagcugucugugcccgccuccguugugagccggaucaugggaagaggcggguguaauauuacggcgauccaagaugucacaggagcucauauugacguggauaaacagaaggacaagaacggcgaacgcaugaucaccaucagagggggcaccgagucuacaagauaugccguucagcuuauuaaugcucugauccaggauccugccaaagaacucgaggaccugauucccaagaaccacauccgcaccccugccuccacaaaaagcauucacgcuaauuucucuagcggagugggcacgaccgccgcguccucuaagaacgccuucccgcugggggcucccacacucgucaccagccaagccacaacccuuuccacguuucagccugcuaauaaacugaacaagaaugugcccaccaacgugcggagcuccuucccugucucucugccccucgccuacccgcauccucacuuugcgcugcuugccgcucagacaaugcaacagaucagacauccccgccugccuauggcccaguucggaggcaccuuuagccccuccccuaacacaugggggcccuucccgguucggccugugaaucccggaaacaccaauucuagccccaagcacaacaauacauccagacucccuaaccagaauggcacggugcugccgucugagagcgcugggcuggccaccgcuuccugccccauuacagucagcucugugguugccgcgucccaacagcucugugugaccaacacccggacaccuagcucuguccgcaaacagcuuuuugccugcgugcccaagacguccccucccgcuaccguuaucagcucugugacauccaccuguagcucccugccuagcgucucuagcgccccgaucacauccggccaggcucccaccacguuccugccugccucuacaagccaagcccagcucuccucucagaaaauggagagcuuuuccgcggugcccccuaccaaggagaaagucucuacccaggaucaacccauggcuaaucugugcacaccgagcuccaccgccaacagcuguucuuccagcgccucuaauacaccuggagcucccgaaacccaccccuccagcuccccuacgcccacaucuagcaacacccaggaggaagcccagccuuccagcgugucugaccuuuccccgaugagcaugcccuucgcuucuaauagcgagccugcgccccugacacucaccuccccuagaaugguugcggccgauaaccaggacacgucuaaucugccccaacuggcugugccggccccucgggugagccaucgcaugcagcccagaggcuccuuuuauucuauggucccuaacgcuaccauucaccaggauccccaaagcaucuucguuacaaacccugugacccucacacccccgcaggggccucccgccgcggugcagcuuuccagcgccgucaauauuaugaacggaucucagaugcauaucaaucccgcuaacaagucccugccuccgaccuuuggccccgccacacuguucaaucacuucagcucccucuuugacucuagccaagugccugcuaaccagggguggggagacggcccccuguccucucggguugccaccgaugcuagcuucacggugcaguccgccuuucuugggaauagcguccugggccaucucgagaacaugcacccugacaauucuaaagcgcccggauucagaccucccucccagcgcgugagcacaucuccggucggccugccuuccauugaucccagcgggucuuccccuagcucuagcuccgcgccccuggcuagcuuuuccggaaucccgggcacccggguguuccuccaagggccugcccccguuggaacccccucuuuuaacagacagcacuucagcccucaucccuggacauccgccucuaauagcuccaccucugcuccuccgacacuuggccagcccaagggcgugagcgccucccaggaccgcaagaucccucccccuauugggacggaacggcuggcgagaauccgccaaggaggcagcgucgcucaggcccccgccgggaccucuuuuguggcuccuguuggacacuccggcauuuggagcuucggggugaacgccgucucugagggacuguccggcuggagccagucugugaugggcaaucauccgaugcaccaacagcucuccgaucccagcacauuuucucagcaccagccuauggaacgggacgauuccgggaugguggcucccagcaacaucuuccaucaaccuauggccagcggauucguugacuuuuccaaaggccugcccauuucuauguacgggggaaccaucaucccgagccacccucagcuugcggauguccccggcgggccccuguucaauggacuccauaacccugaccccgccuggaacccuaugauuaaggugauccaaaauuccacagagugcaccgaugcucagcaggccucucugcugccgagcgugcccgcucucaaaggcgaaauuccuucuccccaacuuacgagaccuaagaaacgcaucggcagacccauggucgccuccccgaaccagcggcaccaggaccaucugcgcccuaagguucccgcgggggugcaagagcugacccacuguccugauacaccccuccugccgccuagcgacuccagaggacacaauagcucuaacucccccagccuucaggccggcggggcugagggagccggcgaccgggggcgcgauaccagauga

SEQ ID NO: 65814 - RNA, 7629 nt, Artificial Sequence
  derived and/or modified sequence opt5 from ANKHD1__Homo_sapiens__NP_060217
augcugaccgacagcggcgggggaggcaccuccuucgaggaggaucucgacucuguggcccccagaagcgcuccugccggggccuccgagccgcccccucccggaggcguggggcugggaauccggacgguucgccuuuuuggcgaagcuggcccugccucuggggugggaagcuccggcgggggaggcucugggagcggaaccggcggcggggaugccgcucuggacuucaagcucgccgcugccgugcugcggaccggaggcgggggaggcgccuccgggagcgaugaggacgaagucucugagguggaguccuuuauucuugaucaagaagaccuggauaaccccguucucaaaaccacaagcgagaucuuccugucuuccaccgccgaaggagcugaccugcggacaguggauccugagacccaagcccgccucgaggcucugcuugaagccgccggcauuggcaagcugagcacggccgacgggaaggcuuuugccgauccggagguccucagacggcugaccucuuccgugagcugcgcucuugacgaagccgccgcugcccugacacgcaugaaggccgaaaauucccacaacgcuggacagguugacaccagaucucucgccgaagccuguagcgauggcgacgugaaugcuguccggaaacugcuggaugaggggcgcuccgugaacgagcauacagaagagggagaaagccuccugugccuugccuguucugcgggcuacuaugagcuggcucaggugcuccuggccaugcacgccaaugucgaagacagagggaacaagggcgauaucacaccccuuauggcugccuccagcggaggcuaccuggacauuguuaagcuccugcugcuccaugaugcugacgucaauucucagagcgccacggggaacacagcgcugaccuaugccugcgcuggaggcuucguggauaucgucaaagugcuucugaaugagggggccaacaucgaggaccacaaugaaaacggacauacaccucucauggaggcugccuccgcgggccacguugaaguggcccggguccugcuugaucacggggcuggcauuaauacccauucuaacgaguuuaaggaaagcgcccugacccucgcuuguuacaaaggacaccuggacauggugcgcuuccugcucgaggccggcgccgaccaagagcauaagacagaugaaaugcacacggcucugauggaggcgugcauggacgggcacguugaaguggccagacuucugcucgauuccggagcucaggucaauaugcccgccgacagcuuugagucuccucugacccuggccgcuuguggcgggcauguggagcuugccgcgcuccugaucgaacggggagcuaaccuggaggaagucaacgaugagggcuauacaccccucauggaagccgcccgcgaggggcacgaggaaaugguggcucugcuucuggcccagggcgcgaauauuaacgcucagaccgaggaaacacaagagaccgcccucacgcuggccugcuguggaggcuucuccgaaguugcugacuuucugaucaaagccggggcugauauugagcuuggaugcagcacaccgcucauggaggccucucaggaaggccaucuggagcuggugaaguaccuccuggcguccggggccaauguccacgcuaccaccgccacaggagacaccgcucuuacauaugccugugaaaacggccauacggauguggccgacguucugcuccaggcuggggcggaucuggagcacgaaagcgagggcggaagaaccccucugaugaaggccgcucgggccggccaccuuugcacagugcaguuccucaucuccaaaggggccaaugucaacagagcuaccgccaauaacgaccauacaguggugucucuggcgugcgcuggaggccaccuggccguugucgagcuccugcuugcccauggggcugaucccacccaccgccugaaggacggaagcacgaugcucauugaagccgcgaaaggcggccacaccaaugugguguccuaccugcuggacuacccuaacaauguccuuucugugcccacaaccgauguuagccaacugcccccuccgucccaggaccagagccaagugccccgggucccuacacauacccuggcuauggugguucccccucaggagcccgauagaacgucucaggaaaacuccccggcccugcucggggugcagaagggaacaagcaaacaaaagucuuccagccugcaggucgccgaccaggaucuucugccuucuuuucaccccuaucagccucucgaguguaucguggaggaaaccgagggcaaacugaaugaacuggggcaacgcaucagcgcuauugagaaggcccagcuuaagucccuggaacucauccagggagagccccugaacaaagacaagauugaggaacucaaaaagaaucgggaggaacagguucagaagaagaagaaaauccugaaggagcuucagaaaguggaaagacagcugcagaugaagacacaacagcaguucaccaaagaguaccucgagaccaagggccaaaaggauacagucagccugcaucagcagugcucucaccgcgggguguucccugaaggagagggcgacggcucccugcccgaagaucauuuuagcgagcuuccccagguggacacgauucuguucaaagauaacgacgucgaugacgaacaacaguccccucccucugcugagcagaucgacuuuguucccgugcagccucucagcuccccgcaauguaacuucucuagcgaucugggguccaauggaaccaacucucucgagcugcagaaggugagcggcaaucagcagaucgucgggcaaccccagauugccaucacaggacacgaccagggccuucuggugcaagaaccugaugggcucaugguugcgacccccgcccagacacugaccgacacgcuggaugaccuuauugcugccguguccacacgggucccuaccggaagcaacucuuccagccagaccacagagugccugacccccgaaucuuguucccagacaacgagcaauguggcuucucaauccaugccucccguuuauccgagcguggauaucgacgcccacaccgaguccaaccaugauacagcccucacccuggcuugcgcgggcggccacgaggaacucgucagcgugcugauugccagagacgcuaaaaucgagcaucgcgauaagaaaggguuuacaccucuuauccuggccgccaccgcuggacacguuggcguggucgaaauucugcucgacaaagggggagacaucgaggcccagucugaacggacgaaggauaccccgcucagccuugcguguuccggcgggagacaggaggugguggaccugcuccuggcucgcggagccaauaaagagcaucggaacgucucugauuacacaccucucagccuggccgcuuccggcggcuauguuaauauuaucaagauucuucugaacgccggggcggaaaucaauucuagaaccggaagcaaacugggcauuagcccccucaugcuggccgcuaugaacgggcacgugccggccgugaaacuucugcucgacaugggaucugauaucaaugcucagaucgagacaaaccggaauaccgcccugacacucgcuugcuuccaaggccgcgccgaagucgugagccugcuucuggacagaaaagcgaacguugagcaccgggccaagaccgggcugacgccucucauggaagcugccuccggaggcuacgcugaggugggcagaguccugcuugauaaaggggccgacgugaacgcgcccccuguucccagcucucgcgauacagcucugaccauugcggccgacaagggacauuauaaguuuugugagcuccugauccaccggggcgcucauauugaugugagaaauaaaaaggggaacacaccccucuggcuggccuccaauggaggccacuucgacgucgugcagcuucugguccaggccggggcugauguggacgccgcggacaaccgcaaaaucacaccucugaugagcgccuuuagaaagggacacguuaaagugguccaguaccucgugaaggaaguuaaucaauucccgucugauauugagugcaugcgguacaucgcuaccaucacggacaaggaacugcuuaaaaagugucaucagugcguggagacaauugucaaagccaaggaucagcaggcugccgaagcgaacaaaaaugccuccauccugcucaaggagcuggaccuggagaagucccgcgaagaguccagaaaacaagcucucgccgcuaagcgggaaaaacgcaaggagaaaagaaagaagaaaaaggaggaacagaaacggaagcaggaggaagaugaggaaaacaaacccaaggaaaauucugagcuuccugaagacgaggaugaagaggaaaacgacgaggauguggagcaagaagugcccauugagccucccagcgccaccacaaccacaaccaucggcauuuccgcuacgagcgccaccuuuacaaauguuuucggcaaaaagcgcgcgaacgucgugaccacaccuucuaccaauagaaagaacaaaaagaauaaaacgaaggaaacaccgcccaccgcccaccugauccugccugagcagcauaugucccucgcucagcagaaagccgacaagaacaagaucaacggggaaccccggggaggcggggcuggaggcaauagcgauucugacaaccuggauagcacagacugcaauuccgagucuagcuccgggggaaaaucucaagagcuuaacuuugugauggacgucaauagcuccaaguauccuagccugcuccugcacucucaggaagagaaaaccuccaccgccacaagcaagacgcagacccgccuggaaggcgaggugacacccaacucccucucuaccagcuacaaaacaguuucccuuccgcugucuagcccuaauauuaagcugaaccucaccucccccaagagaggccagaaacgggaggaaggguggaaggagguggucagacgcagcaaaaagcugucugugcccgccuccguugugagccggaucaugggaagaggcggguguaauauuacggcgauccaagaugucacaggagcucauauugacguggauaaacagaaggacaagaacggcgaacgcaugaucaccaucagagggggcaccgagucuacaagauaugccguucagcuuauuaaugcucugauccaggauccugccaaagaacucgaggaccugauucccaagaaccacauccgcaccccugccuccacaaaaagcauucacgcuaauuucucuagcggagugggcacgaccgccgcguccucuaagaacgccuucccgcugggggcucccacacucgucaccagccaagccacaacccuuuccacguuucagccugcuaauaaacugaacaagaaugugcccaccaacgugcggagcuccuucccugucucucugccccucgccuacccgcauccucacuuugcgcugcuugccgcucagacaaugcaacagaucagacauccccgccugccuauggcccaguucggaggcaccuuuagccccuccccuaacacaugggggcccuucccgguucggccugugaaucccggaaacaccaauucuagccccaagcacaacaauacauccagacucccuaaccagaauggcacggugcugccgucugagagcgcugggcuggccaccgcuuccugccccauuacagucagcucugugguugccgcgucccaacagcucugugugaccaacacccggacaccuagcucuguccgcaaacagcuuuuugccugcgugcccaagacguccccucccgcuaccguuaucagcucugugacauccaccuguagcucccugccuagcgucucuagcgccccgaucacauccggccaggcucccaccacguuccugccugccucuacaagccaagcccagcucuccucucagaaaauggagagcuuuuccgcggugcccccuaccaaggagaaagucucuacccaggaucaacccauggcuaaucugugcacaccgagcuccaccgccaacagcuguucuuccagcgccucuaauacaccuggagcucccgaaacccaccccuccagcuccccuacgcccacaucuagcaacacccaggaggaagcccagccuuccagcgugucugaccuuuccccgaugagcaugcccuucgcuucuaauagcgagccugcgccccugacacucaccuccccuagaaugguugcggccgauaaccaggacacgucuaaucugccccaacuggcugugccggccccucgggugagccaucgcaugcagcccagaggcuccuuuuauucuauggucccuaacgcuaccauucaccaggauccccaaagcaucuucguuacaaacccugugacccucacacccccgcaggggccucccgccgcggugcagcuuuccagcgccgucaauauuaugaacggaucucagaugcauaucaaucccgcuaacaagucccugccuccgaccuuuggccccgccacacuguucaaucacuucagcucccucuuugacucuagccaagugccugcuaaccagggguggggagacggcccccuguccucucggguugccaccgaugcuagcuucacggugcaguccgccuuucuugggaauagcguccugggccaucucgagaacaugcacccugacaauucuaaagcgcccggauucagaccucccucccagcgcgugagcacaucuccggucggccugccuuccauugaucccagcgggucuuccccuagcucuagcuccgcgccccuggcuagcuuuuccggaaucccgggcacccggguguuccuccaagggccugcccccguuggaacccccucuuuuaacagacagcacuucagcccucaucccuggacauccgccucuaauagcuccaccucugcuccuccgacacuuggccagcccaagggcgugagcgccucccaggaccgcaagaucccucccccuauugggacggaacggcuggcgagaauccgccaaggaggcagcgucgcucaggcccccgccgggaccucuuuuguggcuccuguuggacacuccggcauuuggagcuucggggugaacgccgucucugagggacuguccggcuggagccagucugugaugggcaaucauccgaugcaccaacagcucuccgaucccagcacauuuucucagcaccagccuauggaacgggacgauuccgggaugguggcucccagcaacaucuuccaucaaccuauggccagcggauucguugacuuuuccaaaggccugcccauuucuauguacgggggaaccaucaucccgagccacccucagcuugcggauguccccggcgggccccuguucaauggacuccauaacccugaccccgccuggaacccuaugauuaaggugauccaaaauuccacagagugcaccgaugcucagcagauuuggccgggcacgugggcgccccacaucggcaacaugcaucugaaauaugugaauuga

SEQ ID NO: 65815 - RNA, 1479 nt, Artificial Sequence
  derived and/or modified sequence opt5 from ANKH__Homo_sapiens__NP_473368
auggugaaguuccccgcccugacccacuacuggccucucaucagauuucuggucccgcuuggcauuacaaacaucgcuauugacuucggggagcaggcccugaaucggggaaucgcggcuguuaaagaagaugccguggagaugcucgccagcuauggccuggcuuacucccuuaugaaguuuuucacggggcccaugucugacuuuaaaaacgugggacuggucuucgugaauagcaagcgcgauagaaccaaagccguucucugcaugguggucgcuggcgccauugcggccguguuucauacacugaucgcuuauuccgaccugggguacuauaucauuaacaagcuccaccauguugaugaaucugugggaagcaagacccggcgcgccuuccuguaccuugcugccuuuccuuucauggacgcgauggccuggacacacgcuggcauccugcucaaacauaaguauuccuuucuggucggcugugccucuauuagcgaugugaucgcucaaguggucuucguugccauucuucugcacucccaccucgagugcagagaaccccugcugaucccuauucucagccuguacaugggggcccuugugcgguguaccacacugugccucggauacuauaaaaauauccaugacaucauucccgaucgcucuggcccugagcuugggggagacgcuaccaucagaaagaugcuguccuuuugguggccgcuggcgcucauucuggccacgcagcggaucagccgccccauugugaaccuguucgucucuagagaucucggcggguccagcgcugccaccgaggccguggcuauccugacagccaccuacccuguuggacacaugcccuauggcuggcuuacagaaauccgggcgguguacccugcuuucgacaaaaauaaccccucuaauaagcuggucuccaccagcaacacggugacagccgcccauauuaagaaauuuaccuucguuuguauggcucucucccugacacuuugcuuugugauguucuggaccccgaaugucucugagaagauccugauugauaucauuggcguggacuuugccuucgcugaacucugugucgugccucugcgcaucuuuagcuucuuucccguuccugugaccgucagagcccaccugacaggguggcucaugacgcugaaaaagaccuucgugcuugcgcccuccagcguucugcggaucauugugcucaucgccucucuggucgugcugcccuaucuuggagugcacggcgcuacacucgggguuggaucccugcuggccggcuuugucggggagagcaccaugguggcuauugccgcgugcuacguguaucgcaaacagaagaaaaagauggagaacgaaucugccacagagggagaagacagcgcuaugaccgauaugccuccgacggaggaagucacagacaucguggagaugagagaggaaaaugaguga

SEQ ID NO: 65816 - RNA, 2298 nt, Artificial Sequence
  derived and/or modified sequence opt5 from ANKK1__Homo_sapiens__NP_848605
auggccgcugaccccaccgagcugagacucggcagccugccuguguucacacgggaugacuuugaaggggauuggcgccuugucgccuccggaggcuucucucagguuuuucaagcgagacaccggcgcuggagaacggaguacgcuaucaagugcgccccgugucugcccccugacgccgcuagcuccgaugugaacuaucucauugaagaggccgcuaaaaugaagaaaaucaaguuccagcauauugugucuaucuacggggucugcaaacagccccugggaauugugauggaauuuauggccaauggcagccuugagaagguucuguccacccacucucucuguuggaagcugcgguuccgcaucauccaugagacaagccuggcgaugaacuuucuccacuccauuaaaccuccccugcuucaucuggaccucaagccugggaauauccugcuugauagcaacaugcacgugaaaauuucugacuucggacuguccaaguggauggaacagagcaccagaaugcaauauaucgagcggucugcccuccgcggcaugcuguccuacauuccgcccgaaauguuucuggagagcaauaaagcuccuggccccaaguaugaugucuacucuuucgccaucgugauuugggagcuccugacacagaagaaaccuuauuccggguuuaacaugaugaugaucaucauuagaguugcugccggaaugcggcccagccuucagccgguguccgaccaguggccuucugaagcgcaacagauggucgaucugaugaagcgcugcugggaccaggaucccaaaaagagaccuuguuuccucgacaucaccauugagacagacauccugcuuagccugcuccagucccggguggccgugcccgaaagcaaagcucuggcccgcaaggucucuugcaaacugucccucagacaacccggcgagguuaaugaagauauuagccaggagcugauggacucugauagcgggaacuaccuuaagcgggcucugcagcucuccgacagaaagaaucuggugccucgcgaugaggaacuuuguaucuacgagaacaaagugaccccgcugcacuuucucgucgcccaaggaucuguggaacagguucggcugcugcucgcccaugagguggacgucgauugccagacggcuagcggcuauacaccccugcuuaucgcggcccaggaccaacagccugaucugugugcucuccugcuggcccacggggccgacgcuaauagaguggaugaagacggaugggcgccccuucauuucgccgcucagaacggcgacgauggcaccgcccgccuccugcuggaccacggggccugcguugaugcucaggagcgggagggauggaccccucuccaccuggccgcucaaaauaacuucgaaaauguggccagacuucuggucucccgccaggcggaccccaaccuccaugaggccgaaggcaagacaccgcugcacguggcugccuacuuugggcaugucagccuggugaaacuucucaccucucagggagcugagcuggaugcccagcaacggaaccugagaacgccucuccaccuggcgguugaacgcggcaaggugcgggccauucagcaucuucugaaauccggggcuguccccgacgcccucgaucagagcggauauggcccucugcacacagcugccgccagaggcaaguaccugaucuguaagaugcuucuccgcuauggggcuucucuggagcugcccacccaccagggauggacaccucuccaucuggcggccuacaaaggccaccuugagauuauccaucugcucgcugaaucccacgccaauaugggggcccugggagcugugaacuggacaccccugcaccuugccgcgcggcauggcgaggaagcuguugugagcgcccuccugcaaugcggggccgacccgaaugcugccgagcaguccggcuggaccccucugcaccucgcgguccagagaucuaccuuccugagcgugauuaaccuucuggagcaucacgcuaaugugcaugcccggaacaagguuggauggacgcccgcccaccucgcugcccugaaaggcaauaccgcuauccugaagguccuuguggaagccggggcgcaacuggaugugcaggacggagucuccugcacaccccuccagcuggcccuccgcucuagaaaacagggcaucaugagcuuucuggaggggaaggaaccuuccguggcuacccuuggaggcagcaagccgggggccgagauggaaauuuga

SEQ ID NO: 65817 - RNA, 1956 nt, Artificial Sequence
  derived and/or modified sequence opt5 from ANKLE1__Homo_sapiens__NP_001265373
auguggacccccgugagacggggcgccgcuuggcuggggacacuccugggaccuggcgaggggccgcccgaaccucgcggaggcgccgcgcacgcucacaagcccccugccgggagcagaaaauccacggaccaggccguccgguucggacccucucaaggcaugugcagcgaggcucgccuugccagacggcugcgcgaugcucucagagaagaggaaccuugggccguugaggagcugcuucgguguggcgcggacccgaaccuggugcucgaagauggggccgcugccgugcaccuggcugccggagcgcgccaucccagaggccugcggugccucggggcccugcuucgccagggaggcgacccuaaugcuagauccgucgaggcccugacaccccuccacguggcugccgccugggggugucggcgcggacuggaacuucugcucucucagggcgcugauccugcgcugagagaccaggauggccugcggccccucgaccuggcccuucaacaggggcaucuggagugcgcuagaguucuccaggaucuggacacccgcacccggacaagaacccgcaucggagccgagacacaggaaccggagccugcccccggcaccccugggcuuagcggacccacggaugaaacccuggacuccauugcucuccaaaagcagcccugucggggcgauaacagagacaucgggcuggaggccgacccuggaccgcccucucugccugugccccucgaaacagucgauaaacacggcagcuccgcgagcccucccggccacugggacuacucuuccgaugcuagcuuugugaccgccguugaggugucuggggccgaggacccggcuuccgauacaccucccugggccggaagccugccucccacccgccagggccuucugcaugucgugcacgcuaaucagcgggugccuagaucucaagggacggaagccgagcucaacgcgcgccugcaggcccuuacacugacacccccgaaugcugccggauuccaguccagcccuuccucuaugccccuccuggaccggagccccgcucauuccccuccgagaacccccaccccuggcgccagcgauugccacugucugugggaacaccaaaccucuauugacuccgauauggcgacacucuggcugacggaggacgaagccagcucuaccgggggccgcgagcccgucggaccuugccggcaucuucccguuagcacaguguccgaucuggagcuccugaagggccugagagcucuugggccugaauuuucuggacacagccucgagcuggccgcugcccugcggaccggcuguauccccgacgugcaggccgacgaagaugcucucgcgcagcaguucgagcaaccggacccugcccgcagauggcgggaaggggucgugaaauccagcuuuacauaucugcuucuggaucccagagagacccaggaccucccugcucgcgccuucucucugacgcccgccgagcggcugcagacauuuauuagagcuaucuucuacguuggaaagggcacccgcgccagaccguaugugcaucuuugggaagcgcucgggcaccauggccggucccgcaagcagggaagcagacggucuccuacccgcuccaaaggcacagcuauggagugguggcaagccgggcaucugcuggucgccggagcuuggggcugcaccuguugcacagugcccagccucuccucuuggcugaaggccagcgauuccuuuaucccuagaacgucucggcccggggcggaaugcuggggaguuggccaccccgcuuggggcgagauguucgaguguagcuccugcccuaugcuuaccgccgccccgauuagcggguuucgcagaggagugugugucugcgugugugucugcguguguguuugcgugugucugugcgucugugugugcguuuga

SEQ ID NO: 65818 - RNA, 2817 nt, Artificial Sequence
  derived and/or modified sequence opt5 from ANKLE2__Homo_sapiens__NP_055929
augcuguggcccagacucgccgcugccgagugggcggcucuggccugggaacuucugggcgccagcgugcuccugaucgcuguccgguggcuuguucgcagacuggggccucggccgggaggccucgggcgcuccggaacccccgugccucccccuucugccgcugccgcgcccgccagcggcgagaugacaauggacgcucugcuggccagacucaagcugcuuaacccugaugaccugcgggaagagauugugaaagcugggcucaagugcggaccgaucacguccaccacacgcuucauuuuugagaaaaagcuggcccaggcgcuucuggagcaaggcggcagacucucuagcuucuaccaccaugaggccggggucaccgcucugucccaggauccccagcggauccugaaaccugccgaaggaaaucccacagaccaggcuggcuuuucugaggaucgcgacuucggguauagcgugggacucaacccucccgaagaggaggccguuaccuccaagacauguagcgugccgccuucugauaccgacacguacagagccggcgcuaccgcguccaaggaacccccucuguauuacggggucugccccguguaugaggauguucccgcccggaaugaacgcauuuacguguaugagaacaaaaaggaagcccuucaagccgucaaaaugaucaagggaagcagauuuaaagccuucucuacacgggaggacgcugagaaguuugcccgcggcaucugugauuacuucccuuccccgagcaagaccucucugccccucuccccugugaaaacagcgccccuguuuagcaaugacagacuuaaggauggccugugccucuccgaaucugagaccgugaacaaagaacgggcuaauagcuacaagaacccuagaacgcaggaccugacagccaaacugcgcaaggccgucgagaaaggggaagaggacaccuucuccgaucucauuuggagcaauccccgguaucugaucggaucuggcgacaacccgacaauuguucaggagggguguagauacaaugugaugcacguggcugccaaggaaaaccaggcuuccaucugccaacuuacccuggauguccucgagaauccugacuuuaugcgccugauguaucccgaugacgaugaagccaugcuucagaagcggauuagauacgugguugaccuguaucucaacaccccugauaaaaugggauacgacacaccccugcauuucgcguguaaguuuggcaaugccgauguggucaacgugcugagcucucaccaucucaucguuaaaaacagccgcaauaaguaugacaaaacgccugaggacgugauuugcgaacgguccaagaacaagucugucgagcugaaagagagaauccgcgaauaccuuaaggggcacuacuaugugccccugcuccgggcugaggaaaccagcuccccggucaucggagagcuguggagcccugaucagacagccgaggcuucucacguguccagauacggcggcagcccccgcgaccccguucugacccuucgggccuucgcggggccucucucuccggccaaagcugaagauuucagaaagcuguggaaaacacccccucgggagaaggccggauuucugcaucacgugaagaaauccgaccccgaacgcggcuucgagagagucgggcgggaacucgcucaugagcugggauauccuuggguggaguacugggaauuucuuggcuguuucguugaucugagcucccaggaggggcuccaaagacuggaagaguaucugacccagcaggaaauuggcaagaaagcccaacaggagacgggagagcgcgaagccucuugccgggacaaggcuacaaccagcggcuccaauucuaucagcgugagagcguuucuugaugaggacgauaugucccucgaagagauuaaaaaccgccagaaugccgcuagaaacaauucucccccuaccgucggggccuucggacacacacgguguagcgccuuuccccuggaacaggaggcugaccugaucgaggccgcggaaccgggcgggccucacuccagccgcaacggacucugccauccccugaaucacucuagaacccuugcuggcaagcggccuaaggcuccccgcggggaggaagcccaucugccgccuguguccgaucucacaguggaguucgacaaacugaaccugcaaaauauuggcagaagcguuucuaagacgcccgaugagagcaccaaaacaaaggaccagauccuuaccucccggaucaacgcugucgaacgcgaccuccuggagccuagccccgccgaucagcugggaaauggccacagacggacagaaucugagauguccgcgcgcauugcuaaaaugagccucucccccucuagcccuagacaugaagaccagcuggaggugacccgggagccggccagacgccuuuuucuguucggggaagaacccuccaagcucgaucaagacgugcuggccgcucuggaaugcgccgaugucgacccucaccaguuucccgcugugcaccgguggaaaucugccguucuuuguuacagcccuuccgauagacagucuuggcccagcccugcggugaagggacgcuucaagucccagcucccggaccugagcggcccccauucuuauuccccugggcggaacagcgucgccggaucuaaucccgcuaaaccuggccuggggucccccggcagauacagcccggugcacggaucucaacuccgccggauggccagacuggcugagcuugccgcccuguga

SEQ ID NO: 65819 - RNA, 3093 nt, Artificial Sequence
  derived and/or modified sequence opt5 from ANKMY1__Homo_sapiens__NP_001269700
auggagggcgcccacgcuagccugucccucgaagacgaggugucuggggccggaagcagacagcggccccuggaaggcaaagggggagagaccccugcggcugaggagccgggcucccuuaagaacuacgccgucuucgccacacgcgauguuucugcugcccccgagaaggaagaggaagaggcugaggggccucugagagcccaagaccuccgggaaagcuauauccagcuggugcagggagugcaggaguggcaagauggcugcauguaccagggcgaauuugggcuuaauaugaaacugggauauggcaaguucuccuggcccacgggggagucuuaccauggacaguuuuaucgcgaccacugucauggccucgggaccuacauguggccugauggaagcuccuucacaggcaccuuuuaucugagccacagagaaggcuacgggacaauguacaugaaaacccggcuguuccagggacucuauaaggcggaccaacgcuuuggccccggggucgagacauacccugauggaucucaggacgugggccugugguucagagagcagcuuauuaagcugugcacccagaucccguccggguuuagccuccugcgguaucccgaguucucuuccuuuauuacgcauagcccugcccgcaucucucuuuccgaagaagagaaaaccgaauggggacugcaagagggccaggaucccuucuuuuacgacuauaagagauuccuccugaacgauaaucugacacucccucccgagauguacguuuauagcaccaacuccgaccaucugccgaugacaucuagcuuccggaaagaacuugaugcucgcauuuuucugaaugagaucccucccuucguggaagacggcgagccuugguuuaucauuaacgaaacgccccuccuggucaagauccagaaacaaaccuacaaguucagaaauaagcccgcccacacauccuggaacaugggggcuauucuugagggaaaacggagcggcuuugccccuugugggccgaaggagcagcugucuauggaaaugauccucaaagcggaggaaggaaaucacgaguggauuugccgcauccugaaggacaacuucgccuccgcugauguggccgacgcuaaaggcuacaccguucuggccgccgcugcgacacacugucauaaugauauugugaaccuccugcuugacugcggggccgaugucaauaaguguagcgacgagggccugaccgcucucucuaugugcuuucugcuucacuaucccgcccagagcuucaaaccuaacguggccgaaagaaccauccccgagccucaggaacccccgaaguuuccugugguccccauccuguccucuagcuucauggauacaaaucucgagucccuguacuaugaaguuaacgugccuagccaaggaucuuacgagcugcggcccccucccgcuccgcuccugcuuccuagaguguccggcagccacgaagggggacauuuucaggacacgggccagugugggggaucuauugaucaccgcuccagcucccugaagggcgacucuccccucgucaaagggagccugggccauguggaauccggacuggaggauguucuuggcaacaccgaccgggggucucucugcagcgccgaaacaaaguucgaguccaaugugugugucugcgacuuuagcaucgaacugucucaggcgaugcuggagagauccgcucaaagccacucucuccugaaaauggccucccccagcccuugcaccucuagcuucgauaagggaacaaugcgccggauggcccuuuccaugauugagagacgcaaacgguggagaaccaucaagcugcuccugcgccggggcgcugacccgaaccuguguugcgugcccaugcagguucuuuuccucgccgugaaggcuggggaugucgacggagugagacugcugcucgaacauggcgcccgcacggauauuuguuuuccuccccagcugagcacacuuaccccucugcacaucgcggccgcucuccccggggaggaaggcguccagaucguggagcugcugcuucacgccauuaccgacguugaugcuaaagccucugacgaagaugacacauauaagccuggaaaacucgaucugcugcccuccagccucaagcuguccaaugagccgggcccuccccaagcguacuauucuaccgacacagcccuuccugaggaagggggacggacggcucugcauauggccugcgagagagaagaugacaacaaaugugcucgggacaucgugcgccuccugcugagccacggcgccaaucccaaccuucucugguccgggcauucuccgcugagccuguccauugccucuggaaaugagcucgucgugaaggagcugcuuacccagggcgcugauccuaaccugccccucacaaaggggcugggcagcgcgcugugcguugccugugaccuuaccuacgaacaccagagaaauauggauuccaaacuggcucucaucgaccggcugauuagccacggagccgauauccucaagccugugaugcugagacagggcgagaaagaagccgucgggacagcuguggacuacggauauuuccgcuuuuuccaagaucggagaaucgcccgcugccccuuucauacccuuaugcccgcggagagagaaacguuccuggcucggaagcgccuccuggaguacaugggccugcagcuuagacaggccguguuugccaaagagucucaaugggacccuaccuggcuguaucucuguaagcgggcugaacugauuccgucccaccgcaugaagaaaaaggggcccagccucccuagaggacuggauguuaaagagcagggccagauccccuucuuuaaguucugcuaccaguguggccggucuauugggguccgccuucugccuugccccagaugcuauggaauccucacauguuccaaauacugcaagaccaaagccuggacagaauuucauaagaaggacuguggcgaucugguggcgauugugacccaacuggagcaggucagccggcgcagagaagaguuccaguga

SEQ ID NO: 65820 - RNA, 663 nt, Artificial Sequence
  derived and/or modified sequence opt5 from ANKRD10__Homo_sapiens__NP_001273650
augagcgccgcuggcgccggggcgggaguggaggcuggcuucuccucugaggaacugcucagccugagauuuccccuucaccgggccugccgcgacggggaucuggccacccucuguucccugcuucagcaaacaccucaugcucaccuggccucugaagacagcuucuacggauggacgccgguccauugggcugcccacuuuggcaagcucgagugccugguucagcuggugagagcgggggccacccucaacguguccacaacccgguaugcucagacacccgcccauaucgcugccuucggaggccacccucagugucuggucuggcuuauucaagcgggcgccaauaucaacaaacccgauugcgaaggggagaccccuauucacaaggcugcccgcucuggaagccuggaguguaucuccgcucucguggccaauggcgcccauguugaauuuauuagccagucuuccgugcacagcugccugcccggggagcuucagcauggagucacauucgacccuucugugcugauccagugucucaaaccggaaaagugccaauggcccgauuccagcagacacuguaccaacccuggcuuuccccggguuugcccugugucucuggagcccccggagcuguccagcgaaccuuuccucuga

SEQ ID NO: 65821 - RNA, 7992 nt, Artificial Sequence
  derived and/or modified sequence opt5 from ANKRD11__Homo_sapiens__NP_037407
augcccaagggcgggugcccuaaagcuccccagcaggaagaacugccccucagcuccgacauggucgaaaagcagaccggcaagaaggauaaagacaaggucucucugacaaagacgccuaaacuugaaagaggcgaugggggaaaggaaguucgggaacgcgcuagcaaaagaaagcugcccuucaccgccggcgcgaacggggaacagaaagacuccgauacagagaagcagggaccugaacggaagcgcaucaaaaaggagcccgugaccagaaaagcuggccuccuguuuggcauggggcuuucuggcauucgggccggcuacccucugagcgaacgccaacagguggcccuccugaugcagaugacagcugaggaguccgccaauucucccgucgacaccacacccaagcacccuagccaguccaccgugugucaaaaagggacgcccaacagcgcuucuaagaccaaagauaagguuaauaagagaaacgaacggggagagacacgccugcacagagccgccauccggggcgacgcccgcagaauuaaagaacucaucuccgagggggcugaugugaaugucaaggacuucgccggauggaccgcucugcacgaagccugcaaccggggcuauuacgauguggccaaacagcuucuggccgcuggcgccgagguuaauacaaaggggcucgacgaugacaccccucugcaugacgcugccaacaauggacacuauaaaguggucaaacuucugcuccgcuacggcgggaacccccagcagagcaauagaaagggagagacgccccugaaaguggccaacucuccuacaauggugaaucugcuccugggcaaggggaccuauacauccagcgaagagucuuccaccgaaagcuccgaggaagaggaugcucccucuuuugcgccuagcuccagcgucgacggaaacaauaccgauucugaguucgaaaaaggccuuaagcauaaagccaagaaccccgagccccaaaaggcuacagccccuguuaaagacgaauacgaguuugaugaagacgaugagcaggaccgggugccgcccguggaugacaagcaucugcucaaaaaggauuauagaaaagagacgaaguccaacagcuucauuucuaucccuaagauggaagucaaaagcuacaccaagaauaacacaaucgcccccaaaaaggcuucccaccgcauucugucugacaccagcgacgaggaagaugccuccgugacaguuggcaccggggagaaacuucggcugagcgcgcauacgauccucccuggaucuaagacaagagagcccuccaaugcuaaacagcaaaaggaaaagaacaaagugaagaaaaagcgcaaaaaggagaccaagggccgggaagucagauuugggaaacgcagcgacaaguucuguucuuccgagagcgaauccgagucuagcgaguccggagaagaugaccgggauucucugggcagcuccgggugccugaaaggcagcccgcucgugcugaaggacccuucucuuuuuagcagccugucugccuccagcaccucuagccacggauccagcgccgcucagaaacagaaucccucucauacagaucagcacaccaagcacuggagaacagacaacuggaagacgauuuccagcccugccugguccgagguuucuagccucuccgauucuacccgcacacggcugaccagcgaauccgacuacucuagcgagggcuccagcguggaaucucuuaaacccgucagaaagcgccaagagcaucggaaaagagcuucccugagcgagaagaaaucuccuuuccucuccagcgccgaaggggcggugcccaagcuggauaaggagggaaaagucgugaagaaacacaagacaaaacauaagcacaaaaauaaggaaaagggccaguguucuaucucccaggagcugaaacucaagagcuuuaccuaugaauacgaggacuccaaacaaaagagcgauaaagccauucugcuugagaacgaccugucuacggaaaauaagcucaagguucugaaacaugaccgggaucacuucaagaaagaggaaaagcugagcaaaaugaaacuugaggagaaggaauggcucuuuaaagacgagaagucccugaaacgcaucaaggauaccaacaaagacauuucucgcagcuuccgggaagagaaggauagauccaauaaggcugaaaaagagcgcucucugaaggagaaaagcccgaaggaagagaaacuccggcuguauaaggaagagagaaagaaaaaguccaaagaccgcccuucuaaacuugagaagaagaacgaucugaaagaggacaagaucagcaaggagaaagaaaagaucuucaaagaggauaaggaaaaacucaagaaggagaaaguguacagagaagacuccgccuuugaugaguauugcaauaagaaccaauuccuggagaaugaagacacaaaauuuagccugucugaugaccagcgggaccgcugguucuccgaucuuagcgacucuuccuuugauuucaagggggaggacagcugggauucccccgucaccgacuacagagauaugaaaucugacagcguggcuaagcucauucuggaaacaguuaaggaggauuccaaagagcggcgcagagacagccgggcccgcgaaaagagagauuaucgggagcccuuuuuccgcaaaaaggacagagacuaccuggauaaaaacucugaaaagcggaaggagcagaccgaaaaacacaaguccgugccuggauaccucagcgagaaagacaagaaaagacgcgagucugcggaagccggccgggauagaaaggacgcucuggagagcuguaaagaacgccgggaugggagagccaagccggaggaagcucaucgcgaggagcuuaaggaaugcggcugugaguccggauuuaaagacaagucugauggcgacuucgggaaaggacuggaacccugggagcggcaccauccugccagagaaaaggagaaaaaggauggccccgacaaggagcgcaaagaaaagacgaaaccugagcgguauaaggaaaagagcuccgauaaggacaagucugagaaaagcauccucgagaagugccagaaagauaaggaguuugacaaauguuucaaggagaagaaagacacaaaggaaaaacacaaggauacccacgggaaagacaaggagagaaaagccucccuggaucaaggaaaggaaaagaaagagaaggcuuuucccggcauuaucagcgaggacuucucugagaagaaggaugacaaaaaggggaaggagaaauccugguacauugcggauaucuucacagacgaaagcgaggaugaccgggauuccugcaugggcucuggauuuaagaugggcgaagccagcgaccugccucgcaccgaugggcuucaggagaaagaggaaggaagagaggcuuaugccuccgaccggcaucgcaagucuagcgacaaacagcaccccgaaagacagaaggauaaggagccgcgggacagacgcaaagaucggggcgccgcugacgccgggagagauaagaaagaaaaggucuucgagaaacauaaggagaagaaagacaaggaauccaccgagaaauacaaggaucgcaaagaccgggcgagcguggauucuacacaagacaagaagaacaaacagaagcucccugaaaaagcugagaagaaacacgccgccgaggauaaggcuaaauccaagcauaaggagaaaagcgacaaggagcacucuaaagaaagaaaguccagccgcucugccgacgcggagaaaagccugcuggaaaagcucgaggaggaagcucugcacgaguaucgggaagauuccaaugacaagaucucugaggugagcuccgauagcuuuacggacagaggacaggaacccggccuuaccgccuuccuggagguuuccuuuacagagccucccggggaugacaaaccgcgcgaaucugccugccucccugagaagcugaaagaaaaggagagacaucggcacagcuccucuagcuccaaaaagucucaugaucgcgaaagagcuaagaaagagaaggccgagaaaaaggaaaaaggcgaggacuacaaggaaggaggcagccggaaggauuccgggcaauaugagaaagacuuccuggaggcugaugccuacggagucagcuacaacaugaaggcggacauugaagaugagcuugacaaaaccaucgaacucuuuucuacagagaagaaagacaagaaugauuccgaacgcgagcccagcaaaaagauugagaaggaacugaaaccuuauggaucuuccgccaucaacauucugaaggagaaaaagaaaagagaaaagcaccgggagaaguggagagacgaaaaagagcgccaucgggauagacacgcugacgggcuccugcgccaccaucgggaugagcuucugagacaccaucgggacgaacagaagcccgccacccgcgauaaagacucucccccuagagugcucaaggauaaaucccgggacgagggaccgcgccugggcgaugcuaagcugaaggaaaaauucaaggacggcgccgagaaagaaaagggggaccccgugaaaauguccaauggaaacgauaaggucgccccuagcaaggaccccggcaaaaaggaugcuagaccucgggagaaacuucugggggacggagaucucaugaugacguccuuugagcgcaugcugagccagaaggaccucgaaaucgaggaaagacacaaacggcacaaggagcgcaugaaacagauggagaagcugagacaucggucuggcgaucccaaacuuaaagaaaaggcgaaaccugccgacgaugggagaaagaaaggacuggacaucccggcuaagaagcccccuggccucgaucccccuuucaaagacaagaaacugaaggagagcacacccauuccgccugccgccgaaaauaaacugcaccccgcuuccggcgccgauucuaaggacuggcuugcggggccccauaugaaggaggugcugccugcuagcccccgcccugaccaaucccggccgaccggaguucccaccccuacaucugugcucagcugucccuccuacgaagaggucaugcacaccccuagaacacccucuugcagcgccgaugacuaugccgaucugguguuugacugugcugauucccagcauagcacgccgguuccuaccgcccccacaucugcgugcuccccuagcuucuuugaccgcuucucuguggcuuccagcggccucuccgagaacgccucucaggcccccgcucggccucugagcaccaaucuuuacagauccgucagcguggauauccgccggacacccgaagaggaguucucuguuggggacaaacuguuuagacagcaauccgugccggccgcuagcucuuaugauagcccuaugccgcccuccauggaggaccgcgccccucucccgcccgucccugcggaaaaguucgccugucugucucccggauacuauagcccugauuacggccugcccuccccuaaaguggacgcccuucacugcccgcccgccgcuguggucaccguuacgccuucucccgaggggguguuuagcucccugcaggccaagccuagccccucuccgcgggccgagcuccuggugccuucccucgaaggagcucugccgcccgaucuugacaccagcgaggaccagcaggcgacagccgcuauuaucccucccgaaccuuccuaccuggagccgcuggaugaaggccccuucucugccgucauuaccgaggagccuguggaaugggcccaccccagcgagcaagcucucgccuccucucugaucggcgggacaagcgaaaacccuguuuccuggcccgugggaagcgaccuucugcucaaaucuccgcagagauuuccugagucccccaagcgcuucuguccugcggauccccugcauagcgcugccccuggccccuuuucugccuccgaggcuccguauccugcgccgcccgcgagcccugccccguacgcucuccccgucgccgaaccugggcuggaggacgugaaggauggaguugacgcugugcccgccgcuauuucuaccuccgaagccgcgccuuaugcgcccccuagcggccuugagucuuucuuuagcaauugcaaaucccugcccgaagcuccgcuggaugucgccccugagcccgcuuguguggccgccguugcucagguggaggcgcucgggccucuggaaaacagcuuccuugacggaucccggggccugucucaccucggccaagucgagcccgugccgugggccgaugcuuuugccgggccugaagacgaucuggaccucggacccuucagccugcccgagcuuccucugcagacaaaggacgccgcugauggcgaagccgagcccguggaggaaucccuggcgccuccggaggaaaugcccccuggggcccccggagucaucaauggcggggacguuucuaccgugguggcugaggaaccucccgcccucccuccggaucaggcuagcacgagacugcccgccgagcuugagccugaacccuccggagagccuaaacuggacgucgcgcucgaagccgcuguggaggccgagacaguucccgaagaaagagcuagaggcgauccggacucuagcguggaaccugcccccgugcccccugagcagcggccccugggcuccggggaucaaggagcugaagccgagggcccuccggcggccagccucugcgcucccgacgggccugcccccaacaccguggcucaggcccaggccgcggauggagcuggcccugaggacgauaccgaagccucucgcgcugccgcccccgcugaggggccgccuggaggcauccagcccgaagccgcggagccuaagcccacagccgaagcuccgaaagccccuagaguugaggagauuccccaacggaugaccagaaaucgggcucagaugcuggccaaccaguccaagcagggacccccucccagcgaaaaggagugugcgccuacgccggcccccgugacacgcgcuaaagccagagggucugaagacgaugacgcucaagcccagcauccucggaagcgcagauuccagcgguccacccagcaacuucagcagcaacugaacacaagcacccagcagacacgcgaggucauccagcaaacccuggcugccauuguggacgcgaucaaacucgaugccauugaacccuaccacucugacagagcuaauccuuauuuugaguaccugcagauccggaagaaaaucgaggaaaagcgcaaaauucuuugcugcaucacgccccaggccccucaguguuaugcugaguacgucaccuacacaggauccuaucugcucgauggcaagccgcugagcaagcugcacauucccgugaucgccccucccccuucucucgccgaaccccuuaaagagcuguucagacaacaggaggcgguucgggggaagcugcgccuccagcauuccauugaaagagagaaacugaucgugagcugcgaacaggagauccuucggguccacugucgcgcugccagaaccauugccaaccaagcugugccguuuagcgccugcacaaugcugcucgacuccgaaguuuacaauaugccucuggagucucagggagaugagaacaagagcgugcgggacagauucaaugcucgccaguuuaucuccuggcugcaagaugucgacgauaaauaugaccggaugaagaccugucuccuuaugagacagcagcaugaagccgcggcccugaacgcugugcagcgcauggaguggcaacugaaggugcaggaacucgaucccgccggccacaaaucucugugcguuaaugagguccccagcuucuacgugccuaugguggacgucaacgaugacuuugugcuucugcccgcuuga

SEQ ID NO: 65822 - RNA, 6120 nt, Artificial Sequence
  derived and/or modified sequence opt5 from ANKRD12__Homo_sapiens__NP_001190985
augcccaagagcggcuucaccaaaccuauccaguccgaaaacucugacagcgauuccaauaugguggaaaagccguacgggagaaaaucuaaggacaaaauugcuagcuauuccaagacccccaagaucgaacggucugaugucagcaaagaaaugaaggaaaaauccagcaugaagcgcaaacugccuuuuacgauuucucccuccagaaacgaagaacgggacagcgauaccgaaaaggaaggaccugagaagaaaaagaccaagaaggaagcuggcaauaaaaagucuacccccguuuccauccucuucggguacccucugagcgagcgcaaacaaauggcccuucugaugcagaugacggcgagagacaacucuccggauuccacccccaaucacccuagccagacaacccccgcucagaagaagacgccuuccucuagcucccggcaaaaagacaaggugaacaaacgcaaugagagaggagaaacaccccuccauauggccgccauucggggcgaugugaagcaggucaaagagcugaucagccuuggggcuaacgugaauguuaaggacuuugccggauggacaccgcugcacgaggcuugcaacgugggcuauuacgaugucgccaagauccucauugcggccggcgcugacgugaauacccaggggcuggaugacgacacaccucugcaugauucugccuccagcggacaccgcgacaucguuaaacuccugcuuagacauggcgggaaccccuuccaggcuaauaagcacggagagcggccuguggaugucgccgaaaccgaggagcuggaacuccugcuuaaacgcgaggugccccugucugacgaugacgaaagcuauacggauuccgaggaagcgcaaucugugaaccccagcuccgucgacgagaauauugauagcgagacagaaaaggacucucucaucugugaguccaaacagauucugccuagcaagaccccgcugcccucugcccucgaugaauacgaguuuaaggacgacgaugacgaagagaucaacaaaaugauugaugacagacacauccugcggaaggagcagcgcaaagaaaacgagccugaagcugagaagacacaucuuuucgccaaacaggagaaggcuuuuuaucccaaguccuucaaaagcaagaaacaaaagccuuccagaguucuguacucuagcaccgaauccucugaugaggaagcccuccagaauaaaaagaucagcaccuccugcagcgugauucccgagacaucuaacuccgacaugcagacgaaaaaggaauacguggucagcggcgagcacaagcaaaaagggaaggugaaacggaagcugaaaaaucagaacaagaauaaggagaaccaggaacuuaaacaggagaaggaaggaaaagagaauaccagaaucacaaaccugaccguuaauacaggccucgauuguucugaaaagacccgcgaggagggcaacuuucggaaauccuucagcccgaaggacgauacgucucugcaucuguuucacauuagcacagggaaguccccuaaacacagcugcggacucucugaaaagcaauccacaccccugaaacaggagcauaccaagacaugucuuagcccuggcuccucugaaaugagccugcagcccgaccucgugagauaugauaauaccgaguccgaguuccugccugagucuagcuccgucaaaucuugcaagcacaaggagaaaagcaagcaucagaaagacuuucaccuugaguucggggagaaguccaacgccaaaaucaaggaugaagaccauagccccacauucgaaaauucugacuguacgcugaaaaagauggauaaggagggaaaaacccucaagaaacacaagcugaaacacaaggaacgcgagaaggaaaaacauaagaaagagauugaaggcgagaaggagaaauacaagacaaaggacuccgcuaaagaacugcaacggagcguggaguuugauagagaguucuggaaggagaacuuuuucaaaucugacgaaaccgaggaucucuuucugaauauggagcacgaaucccuuacacuggagaagaaaagcaagcucgaaaagaacaucaaagacgauaagucuaccaaagagaagcauguuuccaaagaacgcaacuucaaggaggagcgggacaagaucaaaaaggaaagcgagaaauccuuuagagaagagaagauuaaagaucugaaggaggaacgcgagaauaucccgacggacaaagauagcgaguucaccucucuggggaugagcgcgauugaggaauccaucggacuucaccucguggagaaggagauugacaucgaaaagcaggagaaacacaucaaggaaucuaaagagaagccugaaaaacggagccagauuaaggagaaggauaucgagaaaauggaaagaaagacauuugagaaagaaaagaaaauuaagcaugagcacaaguccgaaaaagacaagcuggaccugucugagugcgucgauaaaaucaaggagaaagacaagcucuauagccaucacaccgaaaagugucauaaagagggcgaaaaguccaaaaacacagccgcuauuaagaaaaccgaugaccgcgagaagucucgggagaaaauggauagaaagcacgacaaggaaaaacccgagaaggaacggcaccuggccgagagcaaagaaaagcaucuuauggagaaaaagaauaagcaguccgauaacagcgaguacucuaaauccgaaaagggcaaaaauaaggagaaagaccgcgaacuggauaagaaggagaaaagcagagacaaggaaucuaucaacauuacaaauuccaaacacauccaagaggagaagaaaagcuccaucguggaugggaacaaggcccagcaugaaaagccccucucucugaaagagaagacaaaagacgaaccucugaagaccccggacggaaaagagaaggauaaaaaggacaaggauauugaccgguauaaagaaagagauaagcacaaagacaagauccagauuaauagccuucucaaacugaaguccgaggcugauaagcccaaaccuaagagcucucccgccuccaaagacacacgcccuaaggagaaacggcuggucaacgaugaccucaugcagaccagcuucgaaagaaugcugucucuuaaggaucuggagaucgaacaauggcauaagaaacacaaggagaaaauuaagcagaaagagaaggaacgccucagaaaucggaacugccuggagcugaagaucaaagacaaggagaagaccaagcacacacccacggagagcaaaaauaaggaacuuacccgcuccaagucuagcgaggugacagaugcguacaccaaagagaagcagccuaaagacgcuguuuccaacagaucucaaagcguggacacaaagaaugucaugacccucggcaaauccagcuuugugucugauaacucccugaaccggagcccccgcuccgaaaaugagaagccggggcugucuagcagauccguuucuaugaucagcguggccuccagcgaagacucuugucauacgacagucaccaccccucggcccccuguggaguaugauuccgacuucaugcucgaaagcucugagucccagaugagcuuuucucagagccccuuccuguccauugccaaaucuccggcccuucacgagcgcgaacuggauagccucgccgaccugccugagagaaucaagcccccuuacgcuaaccggcuguccacaagccaucuucgcuccucuagcguggaagauguuaagcucauuaucuccgagggaagacccaccauugaaguccggagaugcucuaugcccagcgugaucugcgagcacacaaaacaguuccaaacgaucuccgaggaaucuaaucagggcagccugcugaccgugccuggggacacauccccgagccccaagccugaggucuuuucuaacgugcccgaacgcgaucucuccaauguuagcaacauucacucuuccuucgccaccagcccuacaggcgcgucuaauuccaaauacgugagcgccgaccggaaccugaucaagaauaccgcucccgucaacacggugauggauuccccuguucaucuugagccgagcucucaggugggagucauucagaauaaaagcugggagaugcccguggacagacuggaaacccucuccacacgcgauuuuaucuguccuaacucuaauauucccgaccaagagagcucccugcagucuuucugcaacagcgaaaauaagguucugaaggagaacgccgacuuucuuucccugcggcagaccgaacucccuggcaacucuugugcucaggaucccgccagcuucaugccgccucaacagcccugcuccuuucccagccagucucuguccgacgcggagagcaucucuaaacacaugucccucagcuauguggccaaucaagagccugggauccugcagcagaagaacgcuguccagauuaucuccucugcccuugauacagacaaugaaagcaccaaagauacagagaacaccuucgugcugggagacgugcaaaagacggaugcuuuuguccccguuuacuccgacagcacaauucaggaagccucuccuaauuucgagaaagccuauacccucccggugcugcccuccgaaaaggauuuuaacggcagcgacgcuucuacccagcugaauacacauuacgcguucagcaaacuuaccuauaaauccucuagcgggcacgagguggagaacuccacgacagauacccaggucaucucucaugaaaaggagaauaaacuggaaagccucgugcugacacaccucuccagaugugacagcgaccugugcgagaugaacgccggaaugccuaagggcaaucuuaacgaacaagaucccaaacacuguccugagucugagaagugccugcucuccauugaagacgaggaaagccagcaguccauccugucuagccuggagaaucauucccagcaaucuacccagcccgagaugcacaaguacgggcagcuuguuaaaguggaacuggaggaaaacgcugaggaugacaagacagaaaaucagauuccgcaacgcaugacccggaacaaagccaauacgauggccaaccagagcaagcagauccucgcuuccuguacccugcucagcgagaaagauucugaguccagcucuccuagaggccgcauccggcugacagaagacgaugacccccaaauucaucacccuagaaagcggaaagucucccgcgugccccagccuguucaggugagccccucucuucugcaggccaaggagaagacccaacagucccuggcggcuaucgucgauagccucaaacuggacgaaauucagccguauucuagcgagagagccaacccuuacuuugaauaccuucacauccggaagaaaauugaggagaagcgcaaacugcucugcuccgugaucccccaggcuccccaauauuacgaugaauauguuacauucaauggaagcuaccugcucgacggcaacccucuguccaagaucuguauuccgaccaucacgcccccucccucucuuagcgauccucugaaggagcuguucagacagcaggaagugguccggaugaaacucagacugcagcauuccauugagcgcgaaaaacuuaucgugucuaaugagcaagaggugcugcggguccacuauagagccgcccgcacacucgcgaaccagacccugcccuuuagcgcuugcacaguucuccuggacgccgaaguguacaaugugccucuugacucccagucugaugacagcaaaaccuccguccgggauagauucaacgcccgccaauuuaugagcuggcugcaggacguggaugacaaguucgauaaacugaagaccugccuccugaugcggcagcagcaugaggcugccgcucuuaaugccguucaaagacuggaauggcagcucaagcugcaggagcucgacccggcgacauauaaaucuauuuccaucuacgagauccaggaauuuuacgugccccuggucgaugugaacgacgauuucgagcuuacgccuauuuga

SEQ ID NO: 65823 - RNA, 2979 nt, Artificial Sequence
  derived and/or modified sequence opt5 from ANKRD18A__Homo_sapiens__NP_671728
augagaaagcuguucagcuuuggccggcgccucgggcaggcccugcuuuccucuauggaccaagaguacgcuggacccggcuaugauaucagagacugggaacugcggaaaauucaccgcgccgcgaucaagggggaugcugccgagguggaaagaugccucacccggcgcuucagagaccuggaugcccgggaccgcaaagauagaacaguccuucaccuggcuugugcccacggacggguucagguggugacgcuccugcugcaucgcagaugccagauugacaucugugaucggcucaaccgcaccccucugaugaaggcuguccacagccaggaggaagccugcgcgauugugcuucuggaguguggcgccaauccgaacaucgaggacaucuacgggaauacagcucuccauuaugccguuuacaacaaaggaaccucccuggcugaaagacuucugucucaccacgccaauauugaggcgcucaacaaggaaggcaauacaccccugcuguuugccaucaacagccggagacaacauaugguggaguuccuccugaagaaucaggcuaacauucacgccgucgauaauuuuaaacgcaccgcucuuauccuggccgugcagcauaaccucuccucuauuguuacacugcuucugcagcaaaauauccggauuagcucccaggacauguucggccagaccgccgaggauuaugcucucugcagcgaccugagaucuauccgccagcaaauccuggaacacaagaacaaaaugcucaagaaucaccuucggaacgacaaccaggagacggcggccaugaaaccugcuaaucuuaagaagagaaaagaacgcgccaaggccgagcauaaccugaaaguggcuuccgaagagaagcaggagcggcuccaaagaagcgaaaauaaacagccccaggauucucaguccuacgggaagaaaaaggacgccauguauggaaacuuuaugcugaagaaagauauugcgaugcuuaaggaggaacuguacgcuaucaaaaaugacagccuccgcaaggagaaaaaguacauucaagaaaucaagucuauuaccgagaucaacgccaauuucgagaaauccguccggcugaacgaaaagaugaucacaaaaaccguggccagauauagccagcagcugaaugaucucaaggcugagaacgcccgccuuaauuccgaacuugagaaagaaaagcacaacaaggagcggcuggaggcugaaguggagucucuccauagcucccuggccacagcgauuaaugaauacaacgagaucgucgagagaaaagaccuggaacuuguucucuggcgggccgaugacgugagccgccacgagaagaugggcucuaauauuucccagcugaccgauaaaaacgaacugcucacggagcaagugcauaaggcuagagucaaauuuaacacacugaaggggaagcugcgggaaaccagagacgcccugcgcgagaaaacacucgcucugggaagcgugcagcuggaucuucggcaggcccagcacagaaucaaggagaugaaacaaaugcacccuaauggcgaagcgaaggagucucagagcauugggaaacagaacucccucgaagaacgcaucagacagcaagaacuggagaaucugcuccuggagcggcagcuugaagacgcccgcaaggagggagacaacaaagaaaucguuauuaauauccauagagauugucuggagaacggcaaggaagaccuccuggaggagcggaauaaggaacugaugaaagaguauaacuaccuuaaggaaaaacuccugcagugcgagaaggagaaagcugaacgcgaggugauugucagagaguuccaagaggaacugguggaucaccucaagaccuuuucuaucagcgagagcccccuggagggcaccucccauugucacauuaaucuuaacgaaacauggacgucuaagaaaaagcuguuccagguugagauccagccugaagagaaacacgaagaguuucggaaacucuucgagcugauuucccugcuuaauuauaccgccgaccagauccgcaagaagaacagagaacucgaggaagaggcuacaggguacaagaaaugccuggaaaugaccaucaauaugcugaacgccuucgccaaugaggauuuuagcugucauggagaccucaacacagaucaacugaagauggacauucuuuucaaaaagcugaaacagaaguuuaacgaucucguggcugagaaggaagcggucucuuccgagugcgugaaucuggccaaagacaacgaaguccugcaccaggagcuucugagcaugcggaaugugcaggagaagugcgaaaaacucgagaaggauaaaaagaugcuggaagaggaaguucucaaccugaaaacccauauggagaaggacaugguggagcuuggcaagcugcaagaauauaaauccgagcucgaugaacgcgcuguccaggagaucgaaaagcuggaggagauucaucugcagaaacaggccgaauacgagaagcaacuugaacagcugaauaaagacaacacggccucucucaagaagaaagagcugacacucaaggacguggaauguaaauucagcaagaugaaaaccgcuuacgaggagguuaccacagaacuggaggaauuuaaggaggccuucgcgggggcugugaaggccaauaacuccaugucuaaaaagcugaugaaaagcgauaagaaaaucgccgucauuuccaccaagcuguuuacagagaagcagagaaugaaauauuuccucagcacgcugccgacccggcccgaaccugagcugcccugcguggaaaaucuuaacucuaucgagcugaauagaaaguacaucccuaaaacagcuauucgcauccccaccuccaacccgcaaacaagcaauaacuguaagaauuuucucaccgaagugcugcucugcuga

SEQ ID NO: 65824 - RNA, 960 nt, Artificial Sequence
  derived and/or modified sequence opt5 from ANKRD1__Homo_sapiens__NP_055206
augauggugcugaaggucgaggaacucguuaccggcaaaaagaacgggaauggagaggccggcgaguuccugcccgaggacuuuagagauggggaauacgaggcugccgugacacuugagaaacaggaagaccugaagacgcuccuggcgcacccugugacccuuggagagcaacaguggaaaagcgaaaagcagcgggaggcugagcugaagaaaaagaaacucgaacagcgcuccaagcuggagaaccuggaagaucucgagaucauuauccaacugaaaaagagaaagaaauaucggaagacaaaagucccggugguuaaggaacccgagccugagauuaucaccgaacccguggacgucccuacauuccuuaaagccgcccuggagaauaagcuccccgugguugaaaaauuucugucugauaagaacaauccugacgugugcgaugaguacaagcgcaccgcccuucauagagcuugucuggaaggccaccucgcuauugucgagaaacugauggaggccggggcgcagaucgaguuccgggacaugcuggaaagcacagccauccauugggcuucccgcggaggcaaccucgaugugcugaaacuucugcucaauaagggcgccaagauuucugcuagagacaaacugcuuagcaccgcccugcacguggcgguccggacggggcauuaugaaugcgccgagcaccucaucgcuugugaagccgaucugaacgcuaaggaccgcgagggagauaccccgcugcacgacgccguuagacucaaucgguacaagaugauucgccugcuuaucauguauggcgccgaccugaacauuaaaaauugcgcugggaagacacccauggaucucgugcugcauuggcagaacggaaccaaagcgaucuuugacucccuuagagaaaauucuuacaagacaagccggauugccaccuucuga

SEQ ID NO: 65825 - RNA, 918 nt, Artificial Sequence
  derived and/or modified sequence opt5 from ANKRD23__Homo_sapiens__NP_659431
auggacuucaucagcauucagcaacugguguccggcgagagagucgaagggaagguucucggauuuggccacggggugcccgauccuggagccuggccgucugacuggcggcgcggcccccaggaggcuguggccagagaaaaacugaaacuugaggaagagaagaagaaaaagcuggagcgguucaacagcacccgcuuuaaucucgauaaccuggcggaccuugaaaaucugguccagagacggaagaaacgccucagacaucgggugccuccccgcaagccugagccccugguuaaaccucagucccaagcucagguggaaccggucgggcuggagauguuccucaaggccgccgcugagaaccaggaauaccugaucgauaaauaucuuacagacggaggcgaucccaaugcccacgacaagcugcauagaacggcucuccacugggccugccugaagggccauucucagcuugugaacaaacugcucguugcgggggccaccguggaugcucgggaccugcuggaucgcacaccugucuuuugggccuguagaggaggccaccucgugauucugaagcaacuucugaaucagggggcucgggugaacgcccgcgacaaaaucggaagcacaccccuccacgucgcgguuagaacccggcauccugauugccuggagcaccuuauugaauguggcgcccaucugaaugcucaggacaaggagggggacaccgcccuccacgaagcugugagacacggauccuacaaagccaugaagcugcugcuccuguauggcgccgagcuuggcgugcgcaacgcugcgucugucacacccgugcagcuggcccgggauuggcaaagagggauccgcgaggcucuccaggcccauguugcccacccgcggaccagaugcuga

SEQ ID NO: 65826 - RNA, 5133 nt, Artificial Sequence
  derived and/or modified sequence opt5 from ANKRD26__Homo_sapiens__NP_055730
augaagaaaaucuucagcaagaaaggcgaguccccccuggggucuuuugccagacggcagcgcagcuccgcuggaggcgggggagaaccuggcgagggggccuacucucaaccgggauaucacgugagagaccgggaucucggcaagauucauaaagcggcuagcgccggcaacgucgccaagguucagcagauccugcuucugcgcaagaaugggcucaacgacagagauaaaaugaaucggaccgcucugcaccuugccugcgcuaacggacaucccgaaguggugacacugcucgucgaccgcaagugucagcugaaugugugcgauaacgagaauagaacggcccugaugaaagcgguucaaugucaggaagagaagugcgccaccauucuccuggagcacggcgcugacccuaaccuugccgaugugcaugggaauacagcucugcacuacgccgucuauaacgaagacaucuccguggcgaccaaacuccugcuuuacgaugccaauauugaggcuaagaacaaggacgaucugacaccccuccugcuggccguuucuggaaaaaagcagcagaugguggaauuccucaucaaaaagaaagcuaaugucaacgccguggacaagcuggagagcucccaccaacuuaucagcgaguauaaagaagagcggauuccuaagcauucuucccagaauagcaacucuguggaugaauccagcgaggacucucugucccgccucagcggcaagcccggggucgacgauuccuggccuaccucugacgaugaagaccugaacuuugauacaaaaaauguuccgaagcccagccuugccaaacugaugaccgcuucccagcagagcagaaagaaccucgaggcgacguacggaaccgugcggacaggcaaucgcacccuguucgaggacagagauucugacucccaagaugaaguggucguggagagccugccuacaaccucuaucaaaguucaguguuuuagccaccccacguaucaguccccugaccuccugcccaagccgucucauaagagccuugccaacccuggccugaugaaagaagagcccacaaagccugggauugcuaaaaaggaaaauggaaucgauauuaucgaguccgccccccucgagcaaaccaacaaugacaaccugacauacguggacgaaguccacaaaaauaaccggagcgauaugaugucugcccuuggccuggggcaggaggaagacauugagucccccugggauagcgaaucuaucuccgagaauuucccucagaaguacguggacccgcucgcuggagccgcggauggcaaggagaaaaacaucgggaaugaacaggcugaggacguuuuuuauauucccagcugcauguccggaucucgcaacuucaagauggccaaacuggaagauaccagaaaugugggcaugccugucgcccacauggagagccccgagcgguaccugcaucucaagccuaccaucgaaaugaaagacuccgugcccaacaaggcuggcgggaugaaggauguccaaacaucuaaagccgcugagcacgaccuggaaguggccagcgaggaagagcaggagagagaaggauccgagaacaaucagccgcagguugaagaggaacgcaagaaacaucggaacaaugagauggaggugagcgcgaacauucacgauggcgccacggacgaugcugaagacgacgaugacgaugacgggcuuauccaaaagagaaaaucuggagagaccgaucaucagcaguuuccucgcaaggaaaauaaagaguaugccuccagcggccccgcucugcagaugaaggaagucaagucuacagagaaagagaagcggaccuccaaagaaagcgugaacucuccuguuuucgggaaggccagccuccugacaggcggacugcuucaaguggacgaugacuccagccucucugagauugaugaagacgagggcagacccaccaaaaagacguccaaugagaagaacaaagucaagaaucagauccagagcauggaugacguggaugaccugacacaguccucugaaaccgcgagcgaggacugugaacugccucacuccucuuacaaaaacuuuaugcuccugaucgagcaacuugggauggaaugcaaggauagcgugucccugcucaaaauucaggacgccgcucugucuugugagcgccugcuugagcucaagaagaaucacugcgaacugcugaccguuaaaaucaagaaaauggaggauaaggucaacgugcuccagcgggaacugagcgagacaaaagaaauuaagucccaacuugagcaucagaagguggagugggaaagagagcuguguagccuccgcuucucucugaaucaggaagaggaaaaacggagaaacgccgacacccuguaugagaagauccgcgagcagcuucggagaaaagaagagcaauaccggaaggaagucgaggugaaacagcagcucgagcugucccugcagacacucgaaauggagcugcgcacgguuaagagcaaucuuaaccaagugguccaggaaagaaacgaugcucagcggcagcugucuagagagcaaaaugcccgcaugcuccaggacggaauucugaccaaccaccuguccaaacagaaggaaaucgagauggcccaaaagaaaaugaauagcgagaacucucauucccacgaagaggaaaaggaucuuagccacaaaaauuccaugcuccaggaggaaaucgcuaugcugcggcuggagauugacacaaucaagaaccagaaucaggagaaagaaaagaagugcuuugaggaucucaaaauugugaaggaaaaaaacgaggaccugcaaaagaccaucaaacagaaugaagagacacuuacccagacgauuagccaguauaacggcagacugucuguucucaccgcggagaaugccaugcugaacagcaagcuggaaaaugagaagcaauccaaagaacgccuugaggcugagguggaaucuuaccauagcagacuggccgccgcuauccacgaucgggaccaguccgagacaucuaagcgcgaacucgagcuggccuuccagagagcgcgggacgaaugcagccgccuccaggauaaaaugaacuucgacgucuccaaucugaaggauaacaacgagauucuuucucaacagcuguuuaaaaccgagagcaagcucaauucccuggaaaucgaguuccaucacacaagagacgcucugcgggaaaagacccuugggcuggagcgcgugcagaaagaucucagccagacgcaaugucagaugaaggaaauggagcagaaauaccaaaacgagcagguuaaggugaauaaauauaucggaaagcaggaaucugucgaggaaagacugucccagcuccaaagcgagaacaugcugcuucggcagcagcuggacgaugcccauaauaaggccgacaacaaagaaaagacagugauuaauauccaggaucaauuucacgcuauugugcagaaacuccaggccgagucugagaagcagucccugcugcuugaagagcgcaacaaagaacugaucagcgagugcaaucaccucaaggagagacaauaccaguaugaaaacgagaaagcggaacgggaggucguugugagacagcugcaacaggaacucgcugacacccugaagaagcaguccaugucugaggccagccuugaggugacaucccgcuaccggauuaaucuggaagaugagacccaggaccugaaaaagaaacucggccaaaucagaaaccagcugcaggaagcccaggaucgccauaccgaggcuguccggugugccgaaaagaugcaagaccacaaacagaagcuugagaaggacaaugcuaaacugaaggugacaguuaaaaagcagauggauaaaaucgaggaacuccagaagaaccugcucaaugccaaccugagcgaggacgaaaaggagcaacuuaaaaagcugauggaacugaaacagucucucgagugcaaucuggaucaggagaugaagaaaaacguggaacuugagagagaaauuacgggguucaagaaccugcucaagaugacccgcaaaaagcugaaugaguaugagaacggcgaauuuuccuuccauggagaccucaaaacaagccaguuugagauggauauccaaauuaauaagcugaaacacaagaucgacgaucuuaccgcggaacuggagacagccggcucuaaaugucugcaucucgacaccaagaaccagauucugcaggaagagcuucugagcaugaagacgguccaaaaaaagugcgagaaacuccagaagaauaaaaagaagcuggaacaggaggugaucaaccuccggucccacaucgaaagaaauaugguugagcuggggcaggugaaacaauacaagcaggaaauugaggagcgcgcucggcaggaaaucgccgagaaacuuaaggaagucaaccuguuccugcaggcucaagccgccucucaggagaaucucgaacaguuuagagagaacaauuucgcuagcaugaaaucccagauggagcugcggauuaaggaucuugaaucugagcugagcaagaucaaaacaucccaagaagacuuuaacaagaccgagcucgagaaauauaagcagcuguaccuggaagagcucaaagugcgcaagagccuuucuuccaagcugaccaaaacaaaugaaagacuggcggagguuaacaccaagcuccugguggaaaaacagcaaagccggucccuuuucacaacgcugaccacacgccccgucauggagccgccuugugugggaaaucucaacaacucucuggaucugaauagaaagcucauuccccgggagaaccuugugaucagcaccuccaaucccagagccucuaacaauagcauggaaaacuaccuguccaaaaugcagcaggagcuggaaaagaauaucacacgcgagcucaaagaagcugccgccgagcuggagagcggcucuauugcuuccccucuugggagcaccgacgaaucuaaccugaaucaggaucucgucuggaaggccucccgggaguauguucaagugcugaagaaaaacuacaugaucuga

SEQ ID NO: 65827 - RNA, 3162 nt, Artificial Sequence
  derived and/or modified sequence opt5 from ANKRD28__Homo_sapiens__NP_056014
auggccuuccugaagcucagagaccagcccagccuggugcaagcuaucuuuaacggcgauccugacgagguccgggcccuuauuuucaaaaaggaagauguuaauuuucaggacaacgagaaacgcaccccgcugcacgcggcugccuaccucggggaugccgaaaucauugagcugcuuauccuguccggagcuagagugaaugccaaggacucuaaauggcucacaccccugcaucgggcuguggccagcugcuccgaagaggcgguccaggugcugcucaagcacucugccgauguuaacgcucgcgacaagaauuggcagacgccucugcauauugccgcugccaacaaagcggugaagugugccgaggcucuugucccccugcucagcaaugugaacguuuccgauagagccggccggaccgcucugcaccaugccgccuucucugggcacggagaaauggugaaacuucugcucagccgcggcgcuaauaucaacgcguuugacaagaaagauagacgggccauccacugggcugccuauauggggcauauugaggucgugaagcugcuggugucccacggagccgaagucacaugcaaggacaaaaagagcuacaccccucuccaugcugccgcgucuuccggcaugaucagcguugugaaauaucugcuugaucugggcguggacaugaaugagcccaacgcuuacgggaauacaccucuccacgucgccuguuauaacggacaagacgugguugugaaugagcugauugauugcggcgccaucgucaaccagaagaacgaaaaaggguucaccccgcuucacuuugcugccgcuucuacacauggagcccugugucucgagcugcuggugggcaauggggcggacguuaacaugaaguccaaagauggaaagacgccccuccacaugaccgcccugcauggccgcuucagcagaucucagaccauuauccaguccggcgcugugauugacugcgaagauaagaaugggaacacaccucuucacaucgccgcucgguacggacaugagcugcucaucaauacccugauuacaagcggcgccgacaccgcgaaacgcgggauccacggaauguuuccccuucaccuggccgcucucuccggcuucucugauuguugcagaaagcugcugagcuccggguuugacauugauacgccugacgauuucggacggacaugucuccaugccgcugccgccggcggcaaccuggaaugccuuaaucugcuccugaacaccggggcugacuuuaauaaaaaggacaaauucggacgcagcccccugcacuaugcggccgcuaacuguaauuaccaaugccuuuucgcccucgucggcucuggggccuccgugaacgaucuggacgagagaggaugcacaccgcugcauuacgcugccaccagcgauaccgacggcaagugucucgaguaucugcuucggaaugaugcgaacccugggaucagagacaagcagggcuacaaugcuguccacuauucugccgccuacggacaccgccugugccuccagcugauugcuagcgaaacaccccuggaugugcuuauggagacguccggcaccgacaugcucucugauagcgacaaccgggccacaaucuccccucugcaucuggcggcuuaucacgggcaucaccaggcccucgaaguucuggugcaaagccuucuggaucucgacgucagaaacucuuccggacgcacaccccuggaucuggccgcuuuuaaaggccauguggaguguguugacgugcuuaucaaucagggggccagcauucucgucaaggacuacauccugaaacggacccccauucacgcugccgcgaccaacggacacucugaaugccugagacuccugaucggcaaugccgagccucagaacgcuguggauauucaagacgggaauggccagacgccgcuuaugcuguccgugcucaacggacauacagauuguguuuauagccugcugaauaagggcgccaacgucgacgcuaaagauaagugggggcgcaccgcccuucaccggggagccgugaccggccaugaggaaugcguggacgcucuccugcagcacggggcgaagugucugcucagagauucccgcggacggacacccauccaucugucugccgcuugcggccacaucgggguccuuggcgcccugcuccagagcgccgcuuccauggacgccaauccugcgaccgcugauaaccacggauacacagcccugcauugggccuguuacaauggccacgagacgugcguggaacugcuucuggagcaagaaguuuuccagaaaaccgaggggaacgcuuuuucuccccuccauugugccgugauuaaugacaacgagggagcggcugaaaugcugaucgauacacucggcgccagcauugucaaugccaccgacuccaaggggagaacaccucugcacgcugccgcuuucaccgaucacguggagugccuucagcugcuccugagccauaacgcccagguuaacucuguggacuccacgggaaaaacaccccugaugauggcggccgaaaauggccaaaccaacaccgucgagaugcuugugagcucugcuuccgccgagcugacacuccaggacaauagcaagaacaccgcucugcaccucgccugcucuaaagggcaugaaacgagcgcccugcuuauccuggagaagauuacagaucgcaaucucaucaacgcuaccaaugcggcccugcagacaccgcugcacguugcugcccggaacggccuuaccauggugguccaggaacugcucggaaagggcgccuccgugcuggcuguggacgagaauggguauaccccugcccucgcgugugcucccaacaaagaugucgccgacugccuggcccuuauucuggcuacaaugaugccuguuucuagcuccagcccccuguccucucucacguuuaaugccaucaacagauacaccaauacaagcaagaccguguccuucgaagcgcugccuaucaugcggaacgagcccucuagcuauuguuccuuuaauaacauuggaggcgagcaagaauaccuuuauacagauguggacgagcugaacgauucugacagcgaaaccuacuga

SEQ ID NO: 65828 - RNA, 984 nt, Artificial Sequence
  derived and/or modified sequence opt5 from ANKRD2__Homo_sapiens__NP_001123453
auggccaaggcucccagcugggccggcgugggggcgcuggcuuacaaagccccugaggcccucuggccggcugaagccgucauggacggaaccauggaggauuccgaagcuguucagagagccacagcgcugaucgagcaacggcuugcccaggaagaggagaacgaaaagcugcgcggcgacgcuagacagaaacuccccauggaucugcuugugcuggaggacgaaaagcaccauggggcccagucugcugcccuccaaaaagugaagggacaggagcggguccgcaagacgagccuggaucugagacgggagauuaucgacgugggcgggauucagaaucucaucgaacugcgcaaaaagagaaaacagaagaaacgggaugcgcuugccgcuucccacgagccucccccugaacccgaggaaauuaccggaccuguugacgaggagacauuccugaaggccgcuguggaaggcaagaugaaagucaucgagaaguuucucgccgauggcgggucugccgauaccugcgaccaauuccgcagaacagcucugcaucgggcgagccuugaaggacacauggagauccuggaaaaacuccuggacaacggcgccaccguggauuuucaggaccgccuggacuguacagcuaugcauugggccugcagagggggacaccucgagguugugaagcugcuucagucccacggcgccgauaccaauguccgggacaaagagggggauacggcucugcaugacgccgugcgccucaacagauauaagauuaucaaacugcuucugcuccacggagcggauaugaugaccaagaaucuggcuggcaagacaccgaccgaccuggugcagcucuggcaagccgauacacggcaugcccuggaacaccccgagccuggcgcugaacacaacgggcuugagggacccaaugacucuggcagagaaaccccucagcccgucccggcccaguga

SEQ ID NO: 65829 - RNA, 4026 nt, Artificial Sequence
  derived and/or modified sequence opt5 from ANKRD30A__Homo_sapiens__NP_443723
augaccaagcgcaaaaagacaaucaaccugaauauucaggacgcccaaaaacggacggcucuccacugggccugcgugaacggccaugaggaagucguuaccuuccugguggaucgcaagugucagcuugacgugcuggauggggagcacagaacaccccucaugaaagcgcugcagugccaucaggaggcuugugccaauauccuuauugacagcggagccgauaucaaccuggucgacguguacggcaauaccgcucuccacuaugccguuuacuccgagauucugucuguggucgcuaagcugcucagccauggggccgugaucgaaguucacaacaaggcgucccugacaccucuucugcucucuaucaccaaacggagcgagcaaauuguggaguuucugcuuaucaagaaugccaacgcuaaugccgucaacaaauauaagugcacagcucugaugcucgccgugugucacggauccucugaaauugugggcaugcugcugcagcagaaugucgauguuuucgcggccgacaucugcggggugaccgcugagcauuacgccgugacguguggauuucaccauauucacgaacagaucauggaguauauucgcaaacucagcaagaaccaccaaaauaccaacccggagggcacauccgcuggcacccccgaugaagccgccccucuggcugagagaacacccgacaccgcggaaagccuugucgagaagacgccugaugaagccgcuccccugguggagcggacaccugacaccgccgagucucucguugaaaagacaccggaugaggccgcuucccugguggaagggaccagcgacaagauccagugccuugagaaagccaccucuggaaaguucgaacaguccgcggaggagacaccccgcgaaaucacgagcccugcuaaagagaccucugaaaaguuuacauggcccgccaaaggcagaccucggaagauugccugggagaagaaagaagacacccccagagagaucauguccccggcuaaggagacaagcgaaaaauucaccugggccgcuaaggggagaccucggaaaauugccugggagaagaaggaaacgcccgucaaaacaggauguguggcgcgcguuaccuccaauaagaccaaagugcuggagaagggcagaucuaaaaugaucgccugcccuacaaaggagagcuccaccaaggcuagcgccaacgaucagcgguuucccucugaauccaaacaagaggaagacgaggaauacagcugugauucucgcagccucuucgaguccucugcuaagauucaggucugcauccccgagagcaucuaucagaaagugauggaaauuaacagagaggucgaggaaccuccgaagaaacccuccgccuuuaagccugcgaucgaaaugcaaaauagcgugcccaacaaggccuucgagcugaaaaaugagcagacacugcgggcugacccuauguuucccccggaaucuaagcagaaagauuacgaggaaaacuccugggacagcgagucucucugcgaaacgguuucccagaaggaugugugucugccuaaagccacccaucaaaaggagauugacaaaaucaaugggaaacuugaggaaagccccaacaaggauggacugcucaaagcuacaugcggcaugaaggucuccauuccuaccaaagcccuggagcuuaaggacaugcagacauucaaagccgaacccccuggcaagcccucugcuuuugagccggcgaccgagaugcaaaagagcgugccuaauaaagcccuggaacucaagaacgagcagacgcugagagcugaugaaauccugcccuccgagucuaaacagaaggacuacgaagagaauagcugggacaccgagucccucugugaaacaguuagccagaaagaugugugccugcccaaggccgcccaccagaaggagaucgacaaaauuaacgggaaacuugaaggaucuccugucaaagauggccugcucaaggcuaauugugggaugaaaguguccaucccgaccaaggcccuggagcugauggacaugcagacauucaaggcggaacccccugagaaacccagcgcuuucgagccugccauugaaaugcaaaagucugugcccaacaaagcccuugagcucaagaaugaacagacccugcgcgcugaugagauccugccuuccgaaagcaaacagaaggacuaugaggagucuagcugggauuccgaaagccucugcgagacgguuucucagaaagacgucugucugcccaaggccacacaucaaaaggaaauugauaaaaucaacggaaaacuugaggaguccccggacaaugauggcuuucugaaagcgccuugccggaugaaggugagcauucccaccaaagcucucgaacugauggacaugcagacauucaaggccgagccucccgaaaagccguccgccuuugagccugcuaucgaaaugcagaaaucugugcccaacaaggcccuggagcuuaaaaacgagcaaacccucagagcugaucagauguucccuagcgaauccaagcagaaaaaggucgaggaaaauucuugggacagcgagucccugcgcgaaaccgugucucagaaggacguuugugugcccaaagccacacaccaaaaggagauggauaaaaucagcgggaagcuggaggacuccacgagccucucuaaaauucuggauaccguccauuccugcgaacgggcgagagagcuucagaaggaccacugugaacagcgcacaggaaagauggagcagaugaaaaagaaauuuugcgugcugaagaaaaagcucagcgaagccaaggagaucaaaucucaacuggagaaccagaagguuaaaugggaacaggagcugugcuccgugcggcuuacccucaaucaggaagaggagaagagacgcaacgcugauauucugaaugaaaagauccgggaggaacugggcagaauugaggaacaacaccgcaaggagcucgaggucaaacagcagcuggaacaagcccuucggauccaggacaucgagcucaagagcguggaaucuaaccugaaucagguuucccauacacacgagaacgaaaauuaccugcugcaugagaacuguaugcuuaagaaagagauugcuaugcucaagcuggaaaucgccacccugaaacaccaguaucaagagaaggaaaauaaauacuucgaggauauuaagauccucaaggaaaagaacgccgagcugcagaugacgcuuaagcugaaagaggaaagccucacaaagagagcuucccaguauagcggccagcugaaagugcugauugcggagaauaccaugcuuaccucuaagcugaaggaaaaacaagacaaggagauccucgaggccgaaaucgagagccaccauccccggcuggcuuccgccguccaggaucacgaccagauugugacaucucgcaaaagccaggaaccugccuuucauaucgcuggggaugccugccuccaaagaaagaugaacguggacgucuccucuaccauuuacaauaacgagguucugcaccagccgcuuagcgaagcgcagcggaaauccaagucucugaagaucaaccucaauuaugcuggagaugcccugagagagaacacacuggugagcgagcaugcccagcgcgaccaacgggaaacgcagugucagaugaaagaggcugaacacauguaccaaaaugagcaggacaacgugaauaagcacaccgaacagcaggagucccuugaucaaaaacuguuccagcuccagagcaagaacauguggcugcagcaacagcucguccaugcccacaaaaaggcggacaauaaaucuaagauuacaaucgauauccauuuucuggagagaaagaugcagcaccaucuucugaaagaaaagaacgaggaaauuuucaauuacaacaaucaccucaaaaaccgcaucuaucaguacgagaaggaaaaagcugagaccgaaaauuccuga

SEQ ID NO: 65830 - RNA, 4062 nt, Artificial Sequence
  derived and/or modified sequence opt5 from ANKRD36B__Homo_sapiens__NP_079466
auggagagacugugcagcgacggcuucgccuuuccccacuacuauaucaagccuuaccaucucaaacggauucaccgcgcugugcugagagggaaccuugaaaagcugaaauaucuccugcuuaccuacuaugaugccaauaagcgggaccgcaaagagagaacagcgcugcaucucgcuugugccacgggacagccggaaaugguccaucugcugguuucccggcgcugcgagcucaaccugugugauagagaagaccggacaccccuuaucaaggccgugcaacugcgccaggaggcuugcgccacccuccugcuucagaauggcgcugauccuaacauuaccgacguguucgggagaacagcccugcacuacgcggucuauaaugaggauaccucuaugaucgaaaagcuccugagccacggaacaaacauugaggaauguuccaaaaaugaguaccagccccugcuccuggccgugucucggcgcaagguuaaaaugguggaguuucuucugaagaaaaaggcuaacgucaaugccaucgacuaccucggcagaagcgcucugauccuugccgugacccugggggaaaaggauauuguuauccuccugcugcaacacaacauugacguguucucccgggaugucuauggaaaacucgcggaggacuacgccucugaagcugagaaucgcgugaucuuugaucugauuuaugaauacaagagaaaacgguaugaggaccuuccuaucaacagcaaucccguguccccucagaagcagagagccgagaaagcuacgagcgacgauaaggacucugucuccaacauugccaccgaaaucaaagagggcccgaucagcggcacaguuucuucccagaagcaacccgccgaaaaggcuaccagcgaugagaaagacucuguguccaauauugcgacagaaaucaaggaggggcagcagagcggaaccguguccccucagaaacaaucugcccagaaggucauuuucaaaaagaaggugagccugcucaacaucgcuacgcgcauuaugggcgggggaaaauccggcacaguuagcucucagaagcaacccgccuccaaaaccgccagcgauaagacagacucugcucugaacaccgccaccgagaucaaagaugggcuucagugcggaacagugagcucccagaagcagcaagcgcugaaggcuacgaccgacgaagagggcucugucagcaauaucgccacagaaauuaaagauggcgagaaguccgggaccgugagcucucagaaaaagccugcccucaaagcuacauccgacgaaaaggauagcuuuucuaacaucacccgggagaagaaagacggagagauuuccagaacgguuagcucccagaagcccccggcccugaaagcuacaucugugaaggaagacagcguccugaauaucgcccgcgagaaaaaggauggcgaaaaaucccggaccgugucuuucgagcagccucccgggcucaaggcgaccagagacgagaaggauagccugcuuaacauugcccgcggcaaaaaggacggagagaaaacacggagagucuccagccauaagcaaccuucucugaaagcuaccuccgauaaggaggacagcgugcccaauauggccacagaaacgaaggaugagcagaucucugggaccguuuccugucagaaacagcccgcucucaaggccacaagcgacaaaaaggauucugugagcaacaucccuaccgaaauuaaagacggacaacaguccggcacagucagcucucagaagcagccggcguggaaggccaccuccgugaaaaaggauagcguuuccaauaucgcuacggagauuaaagacggccaaauccgcgggaccgugucuagccagcggagacccgcccugaagacaaccggagaugagaaagacuccgucucuaacauugcucgcgaaaucaaggacggcgaaaagagcgggacaguguccccucagaaacaaucugcccagaaggugauuuuuaaaaagaaaguuagccugcuuaauaucgccacccggaucacgggaggcgggaaguccggcacagaauaccccgagaaccucagaacccugaaagcuacaauugaaaauaaggauagcguccugaacaccgcgaccaagaugaaagaggugcagacaucuacgccugccgagcaggaccucgaaauggcuuccgagggagaacaaaagcggcuggaggaauaugagaauaaccagccccaggugaaaaaucagauccacagccgcgaugaccuugaugacauuauccaaucuucccagaccgucagcgaggauggcgacucucugugcuguaacugcaagaacgugauucuccugaucgaucagcaugaaaugaaauguaaggacugcguucaucugcuuaagaucaaaaauacauucugccucuggaagagacugauuaaacugaaggauaaccacugugagcagcuccgggugaaaaucagaaagcugaagaauaaagccuccguccuucaaaagcgcauuagcgaaaaagaggagaucaagucccagcugaaacacgaaauucucgagcuggaaaaggagcugugcagccuucgguuugccauccagcaagaaaagaaaaagagacgcaacguggaggagcuccaccagaaaguuagagaaaagcugcggaucaccgaggaacaguaccgcauugaggcugacgugacaaaaccgaucaagccugcccugaagucugcggaagucgagcucaaaaccgggggaaauaacagcaaucagguguccgagacggaugaaaaggaggaccugcuucaugaaaacagacugaugcaagacgagauugcucggcuccgccuggaaaaagauacaaucaagaaucagaaccuggagaaaaaguaccuuaaagacuucgagauuguuaagagaaagcacgaagaucuccagaaagcccugaagcggaauggcgagacccuggccaaaaccaucgcuuguuauucugggcagcucgccgcgcugacagacgaaaacaccacacuucgcagcaagcuggagaaacaaagagagucccggcagcgccucgaaacggagaugcagucuuacagaugccggcugaaugcugccagaugugaucaugaccagagccacuccucuaagcgcgaucaagaacuggccuuucagggaaccguggacaagugccggcaccuucaggagaaccugaauagccauguccucauccugucccuccagcugagcaaagcugaaucuaaguccagagugcuuaaaacagagcugcacuauaccggcgaggcccucaaggaaaaagcucugguguucgagcauguccaaagcgaacugaagcagaagcagucucaaaugaaagauauugagaagauguacaaauccggguauaacacaauggaaaaguguaucgagaaacaggagcgcuucugccagcuuaagaagcagaacaugcugcuccaacagcagcuggacgaugcccggaauaaagcggacaaccaggaaaaggccauucucaauauccaagcuagaugugacgcccgcguucagaaccugcaggcugagugccggaaacacagacuucugcucgaagaggauaauaagaugcuggugaacgaacugaaucacagcaaagagaaggagugucaguacgaaaaagagaaggccgaacgcgagguggccguccggcaacuucagcagaagagagacgaugugcugaacaaaggcuccgcuaccaaggcgcuccuggacgccucuagccggcauugcacguaucucgagaauggaaugcaagauucccgcaaaaagcuggaccagaugagaagccaguuucaggaaauucaagaucagcuuaccgcuacaauccggugcaccaaagagauggaaggcgacacacagaagcuggagguugaacacgugaugaugcgcaagauuaucaaaaagcaggaugaccaaaucgagagacuggagaaaauucuccagcauucuucccugaugcuucaggucuucgaaagcuga

SEQ ID NO: 65831 - RNA, 5826 nt, Artificial Sequence
  derived and/or modified sequence opt5 from ANKRD36__Homo_sapiens__NP_001157787
auggaggacggcaagagagaacgguggcccacccugauggagcgccucugcagcgauggguucgccuuuccucaguacccgaucaaacccuaucaccugaagagaauucaucgggcugugcuucacggaaaccuggaaaaacucaaguaccugcuucugacauauuacgacgccaauaaacgcgauagaaaggagcggacggcgcuccaucuggcuugugccaccggccaaccugaaaugguccaccugcucguuucccgcagaugcgagcugaaccuuugugaccgggaggaucgcacaccccugaucaaggccgugcagcucagacaggaagcuugcgccacccugcuucugcagaauggggcuaacccuaauauuacagacuucuuuggacggaccgcccuccauuaugcgguguacaacgaggauacaucuaugaucgaaaaacugcugagccacggcaccaauauugaggaguguuccaagugcgaauaucaaccccuccuguucgccgucucucgcagaaaagugaagaugguugaguuucuucugaaaaagaaggcuaacgugaaugccaucgacuaccucgggcggagcgcucugauccacgccgucacgcuuggagaaaaagauauugugauccugcuccugcagcauaacauugacguucugucccgcgaugcguucagaaagaucgccggcgacuacgcuauugaggccaaaaaucgggugaucuuugaucucauuuaugaauacgagagaaagcgcuaugaggaccugccuaucaacucuaauccggucagcucccagaaacagcccgcucuuaaggccaccagcggcaaagaagacucuaucuccaacauugccacagagaucaaggaugggcaaaagagcggaaccgugucuucccagaaacagccugcucugaaggacacaagcgauaaagacgauucuguguccaauaccgcgacggaaauuaaggacgagcagaaaagcggcacaguccuccccgccguugaacaaugucugaaccggucccuuuacagaccugaugcuguggcccagcccgugaccgagaacgaguucucucuggaaagcgagaucauuuccaagcucuauaucccgaagcgcaaaaucauuagcccucggucuaucaaggacguccugcccccuguggaagaggccguugauagaugccuguaccuccuggaccgcuuugcucagcccgugacaaaagauaaguucgcccuugaauccgagaauauuagcgagcccuauuuuaccaaccggagaaccaucucucaacagagcgcggaaaaucuggacgcugccugugggauugacaaaacagagaacggaaauauguucgaagaucagaacgucgacaaggagggcaaggcccucccugcuacggggcagaaagccaauguguccccggagcaacccccucuguuuacccacacaguuaaggaucgcgaccauaucucuacccgguuccugggaggcauggauagccuuacauccagcgaagagucuuccgaaagacccccucucagcacccugacgcugaaagaggcugaccccucuuccaaggccgcgaugcgccggaaagauagcccgccucccggcaagguguccucucagaagcagccugccgaaaaagcuacaagcgacgauaaggacuccgucucuaacaucgccaccgagauuaaagaggggcccaucagcggaaccguguccagccagaagcaaccugcugaaaaagccacaucugaugagaaggacuccgucagcaauauugcgaccgaaaucaaaaagggccagcagucugggacaguguccccccagaagcaaagcgccuggaaaguuauuuucaagaaaaaggugucucuccugaacaucgcuacgagaauuaugggaggcgggaaaagcggaaccgucuccagccagaagcagccggccucuaaggcuacauccgauaaaaccgacagcgcccuuaauaucgccacagagaucaaggacggccugcagugcggcaccguguccucucaaaaacagccugcucucaaggcgacgaccgaugaagaggacagcguuuccaacauugccacagagaucaaagauggggaaaagucuggaaccgugagcucccagaagcaacccgcucugaaagccacaaccgacgaggaagauucugucagcaauauugccacggagaucaaggacggcgaaaaauccgggacagugagcucucagaagcagcccgcucugaaagccaccacagaugagaaggacuccgugagcaacauugcgaccgagaucaaggauggagaaaaaucuggcaccguuuccagccagaagccuccggcucuuacagccacgucugacgaggaaggguccguccucagcaucgcccgggagaauaaagauggcgagaagucccgcaccgugagcucuagaaaaaagcccgcucugaaagccacaagcgacgaaaaggauuccuuuucuaacauuacccggggaaagaaagacggcgagaucagcagaaagguguccucucaaaaaccucccacacugaaggggaccagcgacgaagaggauuccguccucggaauugcgcgcgaaaacaaagacggcgagaagucucggacggugagcuccgagaagccucccgggcugaaagcuagcucugccgaaaaggauuccguucuuaauaucgccagaggaaaaaaggacggcgagaaaacaaagcgcgugagcucuagaaagaaaccuucccuggaagcuaccagcgaugagaaggacuccuucucuaacauuacccgggaaaaaaaggauggggagaucagccgcaaagucuccagccagaagcccccggcccucaagggcacaucugacgaggaagauuccgugcugggaaucgcuagagagaauaaagacggcgaaaagagccggaccguuucuagcgagaaaccucccgggcugaaggccacauccgaugaaaaagacucugugcuuaacauugcgcgcggaaagaaggacggcgagaaaacgagaaccgucagcucccagaagccucccacacucaaagccaccucugaugaggaagacagcgugcuguccaucgcucgggagaauaaggauggggaaaaaagccgcacaguuucuuccgagaagccgagcggacugaaagccaccuccgcugagaaggacucugugcucaacauugccagaggcaagaaauacggggaaaagacgaaacgggucagcucccgcaagaaaccugcccugaaggcuaccucugaugagaaggacagcgugcuuuacaucgcgagagaaaaaaaggauggcgagaaaucccggacagugagcucucccaagcagccugcccugaaagcuauuugugacaaggaagauuccguccccaauauggccaccgagaagaaagacgagcaaaucagcggaacaguuucuugccagaagcagcccgcccucaaagcuaccuccgauaagaaagacagcgugucuaacaucccuacagaaauuaaggauggccagcaaagcgggaccguguccucucagaagcagccggccuggaaagcgacgagcgucaagaaagacuccgugagcaauaucgcuacagagauuaaggacggacaaaucagaggcaccgggauucuggaauauaccuuuaacguuauguucgaucagaucgaggaaaaauuuacaucccugaauaagucugccggagugagcccccagaaacaguccgcccaaaaggucauuuucaagaaaaaggugucucuucucaacaucgcuacccgcaucacgggcggguggaaaagcggcacagaguacccugagaaucugcccacccugaaggccacaauugaaaacaaaaauuccguucucaacaccgcgacaaagaugaaggacgugcagaccucuacgccugcugagcaggaucuggaaauggccagcgagggagaacagaaacggcuugaggaguaugaaaacaaucaaccccaggucaagaaccagauccacuccagagacgaucuggacgauauuauccagagcucucaaaccguguccgaggacggcgauagccucugcuguaauugcaaaaacguuauucugcugaucgaccagcacgaaaugaaguguaaagauugcgugcaucuucugaagaucaagaauacauuuugucucuggaaacgccugauuaagcucaaagacaaccacugcgagcagcugcgggucaagaucagaaaacuuaagaauaaggccucugugcugcagaaacgcauuuccgagaaggaagagaucaaaagccaacucaagcaugaaauucuggagcuggaaaaagagcuuuguucucugcgguucgcuauccagcaggagaagaaaaagagacgcaacguggaagagguccaccaaaagguucgggaaaaacucagaaucaccgaggaacaguaccggauugaggccgaugugacaaagccuaucaaaccggcucugaaguccgccgagguggaacucaaaaccgggggaaauaacagcaaucaggucuccgagacggacgaaaaggaggaccugcuucaugaaaaccgccugaugcaggaugagauugcgagacuccggcuggagaaggacacaaucaaaaaucaaaaccuggaaaagaaauaucuuaaggauuuugagauugugaaacgcaagcacgaagaccugcagaaggcccucaaaagaaauggcgagacccuggcuaagacaaucgccugcuacagcgggcagcucgcugcccugaccgaugagaacaccacacuucggucuaaacuggaaaagcagagagagagccgccaacggcuggaaacggagaugcaguccuaucacuguagacucaacgccgcucgcugcgaccaugaucagucucacagcuccaaacgggaccaggaacuggcguuccaaggaaccguugauaaguguagacaucuucaggagaaucugaacucucacgugcucauucugagccuccagcuguccaaggccgagucuaaaagccgcguccuuaagacagaacugcacuacaccggcgaggcucugaaagaaaaggcccucguguuugagcauguucaauccgaacugaaacagaagcagagccagaugaaggacaucgagaaaauguacaagucuggcuauaauacaauggagaaaugcaucgaaaagcaagagcgguucugccagcuuaaaaagcagaacaugcugcuccagcaacagcuggaugacgccagaaauaaagcugacaaccaggaaaaggccauucucaauauccaggcgcgcugugaugcuagagugcaaaaccugcaggccgagugccggaagcaccgccuucugcuggaagaggacaauaaaaugcucgucaacgagcugaaucauuccaaggaaaaagagugucaguacgaaaaggagaaagccgagagagaaguggcuguccggcagcuucaacagaagcgcgaugacgugcugaacaaggggagcgccaccaaagcgcuccuggaugccucuuccagacacugcacguaucucgagaauggaaugcaggacagccggaagaaacuggaucaaaugagaucccaguuucaggaaauucaggaccaacuuacagcuaccauccgcuguaccaaggagauggaaggcgauacacagaaacuggagguugagcaugugaugaugcggaagauuaucaagaaacaggacgaucagaucgaaagacuggagaagauucuccaacacucuagccugaugcuucaggucuucgaauccuga

SEQ ID NO: 65832 - RNA, 477 nt, Artificial Sequence
  derived and/or modified sequence opt5 from ANKRD37__Homo_sapiens__NP_859077
augcugcuccuggacugcaaccccgagguggauggccuuaagcaucugcucgaaaccggggccagcgucaaugcuccuccggaccccuguaaacaguccccuguucaccuggccgcgggaucuggccuugcuugcuuccugcucuggcaacugcagacaggggccgaucugaaccagcaggacgugcucggagaggcuccccugcacaaggccgccaaagugggcagccuugaaugucugucccuccuggucgcuucugaugcccaaaucgaccuuugcaauaagaacgggcagacggcggaggaucuggccuggagcuguggauuuccugacugcgcuaaauuccucaccacaauuaaguguaugcagaccaucaaggccuccgaacaucccgauagaaaugacugcguggcuguucugcggcagaaacgcucucugggcagcguggagaacacauccggcaagagaaaauguuga

SEQ ID NO: 65833 - RNA, 2982 nt, Artificial Sequence
  derived and/or modified sequence opt5 from ANKRD44__Homo_sapiens__NP_001182073
auggccgugcugaagcucaccgaccagcccccucugguccaagcuaucuucagcggcgauccggaggaaauuagaaugcuuauccacaaaacagaggacguuaacacgcuggauuccgaaaagcggacaccccuccauguggccgcguuucugggggacgcugagauuaucgaacuucugauucucucuggagcccgcgugaaugccaaagauaacauguggcugaccccucugcacagagcugucgccagccgguccgaggaggcugugcagguucucaucaagcauucugccgacgugaaugcgcgcgauaaaaacuggcagacaccccugcacgucgccgcugccaauaaggcugugaagugcgccgaaguuaucauuccucuucugagcuccgugaacgucucugacagaggcgggcggaccgcgcuccaucacgccgcucugaauggacacguggagauggugaaccuucugcucgccaaaggcgcuaauaucaacgccuucgauaagaaagaccgcagagcccugcauugggcugcguacauggggcaccuggaugucguugcccuccugauuaaucauggagcugaagugaccuguaaggacaaaaagggcuauacaccccuucacgccgccgcuagcaacggccagaucaauguggucaagcaucugcucaaccuggggguggagauugaugagaucaauguuuacggaaacaccgcccuucacauugcgugcuauaacggccaagacgcuguggucaaugaacugaucgacuacggggccaacgugaaucagccuaacaauaacggauuuacgccgcuccacuucgccgcugccuccacccauggcgcucugugucuggagcuccugguuaauaacggggccgaugugaauauccagagcaaagacggaaagucuccccuucacaugacagcgguccauggccgguuuacccgcucccagacacugauucaaaacggcggggaaaucgauugcguggacaaagauggaaauaccccucuccacgucgccgcuagauauggccacgagcugcuuauuaacacgcugaucacaagcggggccgacaccgcuaaguguggcauucauucuauguucccccuccaccuggccgcgcugaaugcccauuccgauugcugucggaaacuccugagcucuggauuugaaaucgacacaccugauaaguucgggagaaccugccuucacgcugccgcugccggaggcaacguggaguguaucaaacugcuccaguccagcggcgccgacuuucacaagaaggauaaaugcgggcgcacaccccugcauuacgcugcggccaauugucacuuccauugcauugagacccugguuacgaccggagcuaacgugaacgaaacagacgacuggggccggaccgcccuucacuaugccgcugccuccgauauggaccgcaauaagacaauccucgggaacgcgcaugauaauucugaggaacuggagagagcucgggaacugaaagagaaggaggccacccucugccuggaauuucuucugcagaacgacgccaauccgagcauuagagauaaagagggauacaacuccauccacuacgcugccgcguauggccaccgccagugucucgaacugcugcuugagcggacgaauagcggguucgaagagucugacuccggcgcuacaaagagcccucuccaucuggccgccuacaacggacaccaucaagcucuggagguccuccugcagucucuuguggaucuggacauuagagaugaaaagggccgcaccgcccucgaccuggcugccuuuaaagggcacaccgagugcguugaagcgcugaucaaucagggagccagcaucuucgugaaggauaacgucacaaaacggacaccccuucaugcuuccgugauuaauggccacacccucugucugagacugcuccuggagaucgccgacaacccugaggcuguggauguuaaggacgccaaagggcaaacgccccuuaugcuggccgucgcuuauggacacauugacgcggugucucuccugcuggaaaaggaggccaauguggauaccgucgacauccuuggcugcacagcucuccaucgcgggauuaugaccggccacgaagagugugugcagaugcugcuggaacaggagguuagcauccucugcaaggauucccggggaagaacaccccugcauuacgccgccgcucgcggccacgccaccuggcuuagcgagcugcuccagauggcgcugucugaagaggacuguugcuucaaagauaaccaaggguauacgccucugcacugggcuuguuacaauggaaacgaaaacugcauugaggugcuucuggaacagaaguguuuucggaaauucaucggcaauccguuuacaccccuccauugcgccaucauuaacgaccacgggaauugcgccucccugcuccugggagcuaucgauagcucuauugucuccuguagagacgauaagggccgcaccccucuucaugccgcggcuuucgccgaccacguggagugccugcagcuccugcugcggcauagcgcccccguuaacgcuguggauaauuccgggaaaaccgcccuuaugauggcugccgagaacggccaggcgggagccgucgacauccugguuaauucugcucaagccgaucucacagugaaggacaaggaccugaacaccccucuccaccuggcuuguagcaaaggccacgaaaagugcgcccuucugauucucgauaaaauccaggacgagucccugaucaaugaaaagaacaaugcccugcagacgccccuucauguggcugcgagaaacgggcugaaagucgugguggaggaacuccuggccaagggagcuuguguccucgccguugaugagaaugccucucggagcaacggcccgcgcuccacaccugggaccgcugugcagaaagaggaauga

SEQ ID NO: 65834 - RNA, 801 nt, Artificial Sequence
  derived and/or modified sequence opt5 from ANKRD45__Homo_sapiens__XP_011507772
auggagagcgaagggcccccugaguccgaaucuagcgaguucuuuucccagcaagaagaggagaacgaagaggaagaggcccaggagccggaagagaccggccccaagaauccucugcuccagcccgcucugacaggagacguggaaggccuucagaaaaucuucgaggauccugaaaacccccaccaugagcaagccaugcagcugcuccuggaggaagacauugucgggagaaaucuucuguacgcggcuugcauggccggacagucugauguuauccgggcccucgcuaaguauggcgugaaccugaaugagaaaacgacccgcggguacacacugcuccacugugccgcugccuggggaagacuggaaacccuuaaggcgcugguggagcucgacgucgauauugaagcccugaacuuucgggaggagcgcgcuagagacguggccgcucgguauagccagacagaaugcguugaguuccuugauugggccgacgcgcgccugacccucaaaaaguacaucgccaaggugucccuggcugucacagauaccgaaaaaggcucuggcaagcugcucaaagaggacaagaauacgauucugagcgccuguagagcuaaaaacgaauggcuugagacccauacagaggccuccaucaaugaacuguuugagcaacggcagcagcucgaagauaucgugaccccuauuuucacaaagaugaccacgccgugccagguuaagagcgccaaaucugugacaucccacgaccaaaagcgcagccaggaugacaccucuaacuga

SEQ ID NO: 65835 - RNA, 699 nt, Artificial Sequence
  derived and/or modified sequence opt5 from ANKRD46__Homo_sapiens__NP_001257308
augagcuacguguucgucaacgacuccucucagaccaauguuccccugcuccaagccugcaucgauggcgacuuuaacuauagcaagagacugcuugaguccggguucgauccuaauauucgggacucucgcggaagaacaggccugcaccucgcugccgcgcgggggaacguggauaucugucagcugcuucauaaauuuggagcugaccugcucgccacggauuaccagggcaauaccgcccugcaccugugcgggcauguggacacaauucaguuccucgucagcaacggacugaagaucgauauuuguaaucaccaaggcgcuaccccgcuugugcuggccaaacgcagaggcguuaacaaggacgugauccggcuccuggaaucccuugaggaacaggaggucaaaggguuuaaucgcggaacacauucuaagcuggaaaccaugcagacagcugagagcgaguccgccauggaaagccacucucuccugaaccccaaucugcagcaaggcgagggggugcucuccagcuucagaaccacguggcaggaauuuguugaggaucugggauucuggcgggugcuucugcucaucuuugucauugcgcugcuuucucugggcaucgccuauuaccgcagaacccuccggcugggguccuucgcucgccaggacagaagccggauucaggccaucuga

SEQ ID NO: 65836 - RNA, 3753 nt, Artificial Sequence
  derived and/or modified sequence opt5 from ANKRD50__Homo_sapiens__NP_001161354
augaagcccccucagcaaagccuguaccuccugguggacuccgucgaugagggcugcaacaucaccgaaggggagcagacaucuacgagccuuuccggaaccguugccgcucugcucgccggccaccaugaguucuuuccgcccuggcugcuucugcucuguucugcgagaaaacagagcaaggcugugacaaaaauguucaccggguuucggaagauuucccuggacgaucugcgcaaagccuauaucgugaaggacguccagcaauacauucuccacagacuggaucaggaggaagcccuucggcagcaucugacaaaggagaccgcugagaugcucaaucagcugcacaucaaaucuagcggaugcuuccuuuaucuggaacgcgugcucgacggcguuguggagaacuuuauuaugcugagagaaauccgggauaucccugggacacugaauggacucuaccuguggcuuugucaacgccuguucgucagaaagcaguuugccaaagugcagcccauucucaacguuauccuggcugccugccggccucuuaccauuacggagcuguaucaugcgguguggaccaagaauaugucccucacacuggaggacuuccagcgcaaacuggauauccucagcaagcugcuugucgacggccugggcaacaccaagauucucuuucacuacucuuucgccgaauggcugcuugaugugaaacacuguacacaaaaguaucugugcaaugcugccgaggggcauagaaugcucgcuauguccuacaccugucaggccaaaaaccugacgccccuggaagcgcaggaguuugcccuccaccugaucaauagcaaccuucaacuggaaacagcugagcucgcccuguggaugauuuggaauggaaccccugugcgggacucucuguccacacuuaucccgaaggagcaggaaguccuccagcugcugguuaaagcuggcgcccaugugaacagcgaggaugaccgcaccucuugcaucgugagacaggcccucgaacgggaggacuccauucgcacccugcuugauaauggggcuagcgucaaccaaugugacuccaauggaagaacacugcucgcgaacgccgcuuacucuggcagccuggaugugguuaaccugcuuguguccagaggggccgaccucgaaaucgaggaugcccacggacacacgccccugacccuggcugcccggcagggccauacaaaggucgugaauugccucauuggcuguggggcgaacaucaaucacaccgaccaggauggauggacagcucugcgcagcgccgccuggggcgggcauaccgagguugugucugcccuucuguaugcuggagucaaaguggacugcgcugaugccgacucccggacggcgcucagagccgcugccuggggcgggcacgaagauauuguccugaaccugcuucagcauggagcugaggugaauaaggccgacaacgaaggccgcacagcgcucaucgccgcugccuacaugggccaccgggagaucguugaacaucugcuggaccacggggcugaggugaaucacgaggaugucgacggaagaaccgcccucagcguggccgcucugugcguuccugcgucuaagggccaugccagcguggucucccuucugauugaucgcggggcugaaguggaccacugugauaaagacggaaugacaccccuccugguggccgccuaugagggccacguugaugucguggaccugcuucucgaagggggcgcugauguggaccauaccgauaacaauggacggaccccucugcuggccgcggcuucuaugggccacgccagcgucgugaacacacuccuguucuggggagccgcuguugacuccaucgauagcgaggggagaacggugcuuucuauugccuccgcgcaaggcaaugucgaggugguucgcacccugcucgaccgggggcuggacgaaaaccauagagaugacgcuggauggacaccccugcacauggccgccuuugagggccaucgccuuaucugcgaagcucugauugagcagggggcccggaccaaugaaaucgauaacgacggcagaaucccguucauucucgcuagccaggagggacacuacgauugugugcagauccugcucgagaauaagucuaacauugaccaacggggcuaugaugggcgcaacgcccugagagucgcggcccuugaaggacaccgggacaucguggagcuucucuucucccauggcgcugauguuaauugcaaagacgccgaugggagaccuacacuguacauucuggcucuugaaaaccagcugaccauggccgaguauuuucucgaaaauggagccaacguggaggcuagcgacgcggagggccgcacggcccugcacgucuccuguuggcaggggcauauggaaaugguccaggugcucaucgcuuaccacgccgaugugaaugccgcugacaacgagaagcggucugcccugcaaagcgcggcuuggcagggccauguuaaaguggugcagcuucugauugaacacggagccgucguggaccauaccugcaaucaaggcgccacagcucucuguaucgccgcgcaggaggggcacaucgauguugugcagguccugcuggaacacggagcugaccccaaccaugccgaucaguucggcagaaccgccaugcgcguggcugccaagaaugggcacucccaaauuaucaagcugcuggagaaauacggagcuucuagccucaacggcugcuccccuagccccguucacacaauggagcagaagccccugcagucucucuccagcaaagugcagucucugaccauuaaguccaauagcucugggagcacgggcggaggcgacaugcaaccuucccuuagagggcugccgaacggacccacacaugccuuuagcucuccuuccgaaagccccgauuccaccgucgaccggcagaaaucuagccuguccaauaacucucucaagagcuccaaaaauucuagccugcgcacaaccuccagcaccgcgacagcccagacggugccuaucgauucuuuccacaaccuuuccuuuaccgagcagauucaacagcauagccugcccagaucucggucccgccagagcaucguuucuccguccagcacaacccaaucccucggccagagccacaacucuccuagcuccgaguucgaauggucucaggugaaacccagccugaaguccacaaaggcuucuaaagggggaaagagcgaaaauuccgccaagucuggcagcgcuggcaagaaagccaagcaguccaacagcucucaaccuaaaguccucgaauaugagaugacccaguuugacagacgggggcccaucgccaaguccggaacggcugcgccucccaaacagaugccggccgaaagccaguguaagauuaugaucccuucugcucaacaggagauuggccgcucccagcagcaauuccugauccaucagcagagcggggaacagaaaaagagaaauggaauuaugacaaaccccaauuaccaccuucaauccaaccagguguuucugggccgggugucugucccccgcaccaugcaggauagagggcaccaagagguucuggagggauauccuagcuccgaaaccgagcucagccugaagcaggcccuuaaacugcagaucgaaggcucugacccguccuucaauuacaagaaagagacaccccucuga

SEQ ID NO: 65837 - RNA, 1845 nt, Artificial Sequence
  derived and/or modified sequence opt5 from ANKRD55__Homo_sapiens__NP_078945
augaugagacaggccaccauggacuucagcacacccuccguguuugaucaacagcggggcgacucuagcgaggaagucgaucugacgaugguuuaccaggcugccuccaacggggacgugaaugcgcucaccgcugugauccgcgaggauccuucuauucuggaaugcugugacagcgagggaugcacaccgcuuaugcacgccgucuccggcagacaggccgauaccgugaagcugcuccugaaaaugggggcuaacaucaauaugcaagacgccuauggacggacaucucuuugucuggcuaccuaccucggcuggcuggaagggugcguuagccugcuccgcaacggagccaagcauaauauucccgauaaaaacggcagacugccucuucacgcggccacagcugagcccgacaugcggcugcucaccgugcugcuucagcaguccaauaucagcgagauuaaccaucaggauaaugaaggcaugacgccucugcacugggccgcuuuccauaaccaaccccagcacacccagaugcuccugaagaaaggggccgacccuacacuggucgauaaggacuuuaagaccgcgcuccacugggccgugcagucuggaaaucgcauccuguguuccaucauucuuagccaucaccaaggcccgucuaucauuaacuaugacgaugaguccgggaaaacaugcguucauaucgcugccgcugccggauucagcgacauuauccacgaacuggccagagugcccgaguguaaucuccaggcucuggaugucgacgaucggaccccucuucacugggcggccgcugccggcaaggccgagugcgugcagucucugcucgaacuggggauggacuccaaccugcgcgauauuaaugagagcacgccccucgcuuacgcccuguauuguggacauacagcgugcgugaaacuucugucccaagaaucuagaaccgagccuacacggcccccgccuagccaguccagccgcccccagaagaaagaaagacgguuuaacguccucaaccagaucuucuguaagaauaagaaagaggagcaacgcgcucaccagaaggacccuucuagagaucgguacagagaagaggacaccuccgaaguuaacgauaucauuaccacauuugacagcaucgugggcacgaauugccaggagcagcccggcgaccaaguggccauggucgaauuuaaaaagaaaaccucugauaacagcaaguaucugcuucccgagaaaaagccucuggcccgcaaggggcucccgcccauucggacacagucccugccucccaucacccugggaaauaacuuccucacagcuucucauagagccaccagccacgcuggccuguccagcgccccucaucacauggcgcagcgcucucagaaaucccggagcgagcaagaccuucugaauaacagaacggggugccagaugcuccuggauaaucccuggaagucugacuccaaccagguguucagcuacaaaguuuggacaguguccucuagcgauaagcugcuugaccgccuccuguccguccggccgggacaccaggaagugucuguuccuccccaucugagacaccuccauaauccuagcuccggccaaaacuuucagcaccugagccccaaucgccacaaaauucgggaucuuccuuucaccagaaacaaucuggcuccccucccggaccagaaguuucugucuggggagccucugcgcaccaaccgggugcuucccgccauccccucccaaagacggcauagcacagccgcugaagagucugaacacuccgccaacccuaccagcgaugagaauuga

SEQ ID NO: 65838 - RNA, 2184 nt, Artificial Sequence
  derived and/or modified sequence opt5 from ANKRD6__Homo_sapiens__NP_001229738
augagccagcaagacgccguggcugcccuguccgagagacuccuggucgcggcuuacaagggccagaccgaaaacguugugcagcuuaucaauaaaggggcccggguggccgucacaaagcacggacgcacgccccugcaucucgcugccaacaaaggccaccuuccugugguucagauucuucugaaggcugggugcgaucucgacgugcaagaugacggagaucagaccgcccugcauagagcgacagucgugggcaauaccgagaucauugccgcucugauccacgaagggugugcccucgaccggcaggauaaagacggaaacacagcucugcaugaggccucuuggcacggcuucagccaguccgcgaagcugcugauuaaggccggcgcuaauguucucgccaaaaacaaggcugggaauaccgcccugcaccuugccugccaaaacucucauagccaguccacacgcgugcugcuccuggcuggaucuagagcggaucugaaaaauaacgccggcgacaccugucuccacgucgcugcccgguauaaucaucugagcaucauccgccuucugcucacggccuuuugcuccgugcacgaaaagaaccaggcuggggauaccgcccugcacguggcggcugcccuuaaucauaaaaaggucgccaagauucugcucgaggcuggagccgacacaaccaucguuaacaaugcuggccagacaccgcuggagaccgccagauaccacaacaaccccgaaguggcgcugcuccugacgaaagccccucaagugcuucgguucagccgcgggagaucucugcggaagaaacgcgagagacucaaggaagaacggcgcgcucaguccguccccagagaugagguggcccagagcaaaggaucuguuuccgcuggcgacacaccuagcucugaacaagccguggcgcggaaggaggaagccagagaggaauuucuguccgcuagccccgagccucgcgccaaagacgaucggagacgcaagucccggccgaaggucucugcuuucagcgaccccaccccucccgccgaucagcagccuggccaucagaaaaaucuucacgcccauaaccaccccaagaaaagaaaucgccaccgguguuccagcccgccucccccucaugaguuuagagcuuaucaacuguacacacucuaucgcgggaaggacggaaaagugaugcaggcgcccauuaacggcugccggugugaaccccugaucaauaagcuggagaaccagcucgaagccaccguugaggaaauuaaggcugagcuggggucugugcaggauaaaaugaauaccaagcugggacaaauggagaacaaaacacagcaccagaugagaguccuggacaagcucaugguggaacgccuguccgccgagcggacggaaugccugaauagacuucagcaacauagcgauaccgagaaacacgaaggcgagaagcggcagaucucucucgucgacgagcugaagacaugguguaugcugaaaauucagaaccucgaacagaagcugagcggggauucccgcgccugcagagcuaaaucuaccccuagcacaugugaguccagcaccggaguggaccaacuuguugugacggccggcccggcggcugccucugauuccucucccccugucgugcggcccaaggaaaaagcccuuaauagcacagcuacccagagacuccagcaagagcuguccagcuccgacugcaccggcucucgccugcggaacguuaaggugcagacagcccuucucccuaugaaugaggcggcuagaagcgaccagcaggccgggcccugcgucaaccgcggaacccaaacaaagaaauccggcaagucugggccgacgagacaccgggcccagcagccugcugccagcuccaccuguggacagcccccucccgcuacaggcagcgaacaaaccgggccucauauccgcgauacaucucaggcccuggagcugacccaguacuucuuugaagcgguguccacgcagauggagaaaugguaugaaagaaagaucgaggaggcccggagccaagcuaaucagaaagcccagcaagacaaggcuacccucaaagaacacauuaagucucuggaggaggagcuugccaagcugcgcacaagagugcagaaagaaaacuga

SEQ ID NO: 65839 - RNA, 765 nt, Artificial Sequence
  derived and/or modified sequence opt5 from ANKRD7__Homo_sapiens__NP_062618
augaacaagcuguucagcuuuuggaaaagaaagaaugagacccggucccagggcuacaaccuccgcgaaaaagaccugaagaaacuucacagagccgcuucugugggggaucugaagaagcucaaagaguaucugcaaaucaagaaauacgacgucaauaugcaggauaagaaauaucggacaccccuucaucuggccugcgcgaacggacacacggacguugugcuuuuccugauugaacagcaguguaagaucaaugugcgcgauagcgagaacaaguccccucugauuaaagcuguccaaugccagaaugaagacugugccaccauccuccugaacuuuggcgccgauccggaccuuagagauauucgguacaauacagugcugcauuaugcuguuugcgggcagucucucagccugguggagaagcuccuggaguacgaagccgaccucgaggcuaaaaacaaggauggauauacaccccugcuggucgccgugaucaauaacaauccuaaaaugguuaaguuccuccuggaaaaaggcgcggacgugaacgccuccgauaauuaccagcgcaccgcucuuauccuggccgucucuggggagcccccuugucucgugaagcugcuucugcaacagggaguggagcucugcuacgaaggcauugucgacagccagcugagaaacauguuuaucuccaugguucugcuccaccgguauccccaguucaccgcuagccauggcaagaaaaagcacgccaaauga

SEQ ID NO: 65840 - RNA, 3405 nt, Artificial Sequence
  derived and/or modified sequence opt5 from ANKS1A__Homo_sapiens__NP_056060
augggcaaggagcaggaacugcucgaggccgcuagaaccgggcaucugcccgccguggaaaaacuucugagcggaaagcggcucuccucuggcuucgggggaggcgggggaggcggcagcgggggaggcgggggaggcuccgggggaggcggcgggggacugggcucuagcucccacccucuuucuagccugcucuccauguggcgcgggccgaacgucaauugcguugacagcacaggauacacgccccugcaccaugcggcucugaacggccacaaagaugugguggagguccuccugagaaaugacgcccuuaccaacguggccgauucuaagggguguuauccucugcaucucgcugccuggaaaggagacgcucaaaucguucggcugcuuauucaccagggccccucccacacacgcgugaaugaacagaacaaugauaacgagaccgcccugcauugcgcggcccaguacggccacacagaggucgugaagguucuccuggaagaacugaccgacccuacaaugagaaauaacaaguuugaaacgccccucgaucuggcugcccuuuaugggcggcuggagguggucaaaaugcuccugaaugcucauccuaaccuucugagcuguaauaccaagaaacacaccccgcuccaccuggccgcgcgcaacggacauaaggccguggugcaaguccugcucgacgcuggcauggauucuaauuaccagacagagaugggguccgcccugcacgaagcugcccuuuucggaaaaaccgacguugugcagauccugcucgccgcuggcacagaugugaacauuaaggacaaccaugggcugaccgcgcuugauacggucagagagcugcccagccagaagucucaacagaucgccgcucucauugaagaccacaugacaggcaaacgguccaccaaggagguggacaaaacaccucccccucagcccccgcugaucagcuccauggauucuaucagccagaagucccaaggagacguugaaaaagccgugaccgagcugauuaucgauuuugacgccaaugcugaggaagagggcccuuaugaagcccucuacaacgcgauuagcugccauucucuggauuccauggcuagcgggcgcucuagcgaccaggauuccaccaauaaggaggccgaagccgcuggagucaaacccgccggcgugagaccucgggagagacccccucccccggcuaagcccccucccgacgaggaagaggaagaucacaucgacaagaaauauuucccucuuacagccucugagguucugagcaugcgcccccggauucacggguccgcggcccgcgaagaggaugagcauccguacgaacuccugcugacggcugagaccaagaaagugguccuuguggacggaaagacaaaagaccacagacgguccucuuccagcagaucucaggauuccgccgaaggccaagacgggcaggucccugagcaguuuagcggccuccugcauggauccucucccgugugugagguuggccaggauccuuuccaacugcucugcaccgcugggcagagccaccccgacggauccccucagcagggcgccugucacaaggcgucuaugcaacuggaagagacaggggugcaugcccccggagcuagccagccguccgcccuugaucagagcaagcgcgucggcuaccugaccgggcucccuacgacaaacucucggucccaccccgaaacccugacccauacagcuagcccccacccuggcggagccgaggaaggcgacagaucuggggcccgcucccgggcuccgcccaccagcaaaccuaaggcggagcugaaacuuucuagaagccucuccaagagcgauucugaccugcugacaugcucccccacggaggaugccaccaugggaagccgcuccgaaucucucagcaauuguuccaucggcaaaaagcggcuggagaagucuccuagcuuugcuuccgaaugggacgagauugagaaaaucaugucuagcaucggggagggaauugauuucucccaggagagacaaaagaucagcggccuucgcacacuggaacagucugugggggaguggcucgaauccauuggccugcagcaguaugagagcaaacugcuucucaacggauuugacgauguucauuuccugggcucuaaugugauggaggaacaagaccugcgggacaucgggauuuccgauccccagcacagacgcaagcuccugcaggccgcccggagccuuccuaaagucaaggcucugggauacgacggcaacucucccccguccgugccuagcuggcucgauucccuggggcugcaagacuaugugcacagcuuucuuucuagcggauacuccucuaucgauaccguuaagaaucucugggagcuggaacuggucaacgugcucaaagugcagcugcuuggccauagaaagcggaucauugccagccuggcggaccgccccuaugaggaaccuccccagaaaccgccuagauucucccagcuccggugccaagaucugcugucucagacaagcagcccccuuucucagaaugacagcuguaccggcagauccgcugaucugcuccugccucccggggacacgggacgccggagacacgauagccuccaugaccccgccgccccuucucgcgcugagagauuucggauccaggaggaacaccgcgaggccaagcugacccuuagaccgcccucccuggcggcuccuuacgcccccguccaaagcuggcagcaucagccugaaaaacucauuuucgagucuugcggcuaugaagccaacuaccugggguccaugcugaucaaggaucuucggggaacagagagcacccaggacgcuugcgccaaaaugcgcaaguccacagagcacaugaagaaaauucccaccaucauccugucuauuacguacaagggcgugaaauucaucgacgcuagcaauaagaacguuauugccgaacacgagaucagaaauauuuccugugcggcccaagauccugaagaccucugcacauuugcuuauaucaccaaagaucugcagacaagccaucacuacugucauguguucucuaccgucgacgugaaccucaccuaugagauuauccugacacuugggcaggccuuugaaguugcuuaccaacuggcccuccaggcccagaagucccgggcuacgggagcgagcgccgcugagaugaucgagaccaagucuagcaaaccggugcccaagccucgcgucggcgugagaaaauccgcccuggaacccccugauauggaccaggaugcccaaucucacgcuagcguuuccuggguggucgaccccaagccggauucuaaacggagccuguccacaaacuga

SEQ ID NO: 65841 - RNA, 1074 nt, Artificial Sequence
  derived and/or modified sequence opt5 from ANKS1B__Homo_sapiens__NP_001190995
auggccaacggcuucgacaaugugcaguuuauggggagcaacgucauggaggaucaagaccugcucgaaaucggcauucuuaauuccggacacagacagcggauccugcaggcuauucagcugcuccccaagaugcgcccuaucgggcaugauggauaccacccgaccucuguugccgaguggcuggacagcauugaacuuggcgauuauacaaaagcguuccugaucaacggguacacguccauggaccuccugaagaaaaucugggagguggaacugauuaaucaaucuagcgugugcgagaucuggaccaaccagaaugcuggauuucccuucuccgccauucaucagguccacaacacaggcgauuggggcgagccuucuaucacccucagacccccuaaugaagccacagcuagcacccccgugcaguauuggcaacaucacccugagaagcugauuuuucaguccugugacuacaaagccuucuaucuugggagcaugcugaucaaggaacuccggggaacagagucuacccaggaugcuugcgccaagaugcgcgcgaacugucagaaauccacggagcaaaugaagaaaguuccgaccauuauccugagcgugucuuacaagggcgucaaauuuaucgacgccacaaauaagaacauuaucgcugaacacgagauuagaaauaucuccugcgccgcucaggaucccgaagaccuuagcaccuucgccuauauuacaaaggaucugaaaucuaaccaucacuacugucauguguuuaccgcguucgacguuaaucucgccuacgagaucauccugacgcuggggcaggcuuuugaaguggccuaucaacucgcucugcaggcccggaagggaggccacuccagcacacuuccugaguccuucgagaacaaacccucuaagccuauucccaaaccgcgcgucagcaucagaaaguccgugauugacccuagcgaacagaaaacccuggccaaccuccccuggaucguggagccugggcaggaagcuaagcggggaauuaauacaaaguacgagaccaccaucuuuuga

SEQ ID NO: 65842 - RNA, 1254 nt, Artificial Sequence
  derived and/or modified sequence opt5 from ANKS4B__Homo_sapiens__NP_665872
augagcaccagauaccaccaggccgcuuccgacucuuaucuggagcuccugaaggaagccacaaaacgggaucuuaaccugagcgacgaggauggcaugacgcccacccuccuggcggcuuaccaugggaaucuugaagcccuggagaucauuugcucccgcggaggcgacccugauagaugugacaucugggggaacacaccgcuccacuucgccgcuucuaauggacaugcccacugcgugagcuuucuggucaacuucggcgcuaauauuuuugcccuggauaacgaccuccaaacaccccuggaugcggccgcuucccgggaacagaaugaguguguugcccuucuggacaaggcugccaccgcgcagaacaucaugaauccuaaaaaggugacccgccucaaagagcaggcccaaaagaacgcuagacggcagauuaaggaaugcgagcgccugcaggaaaaacaucagaauaagauggcccacacauauucuaaagaggagagcgggacccuuuccagcucuaagggaacguucuccagaagcucucccuccaacgcuagcgccccuggcaccuuuggcucucuguccaaagggaucaaggauacauucaagaucaaauuuaagaaaaauaaggacaccgccgaacaagugggaaaagagggccggagcgggcagcgcaacgucauggaaguguucagagaggaagaggaggauuccuuuucuggagacuucaaggaaaaacuccagcugagcgcugaggaagacggcuccguucaccaugagagcauucugaaucggcccgggcucggaucuaucguguuucgcagaaaccggauuuccagcccugaagauaucucugacagcaagcgcgaguucggcuuuaagcugccguccgagcuucugcagagacaaggcgcgucugaagccgaugagggggcugccgacgaagagggagaagagaacggccucaaagaugaccugcccugggaugacgaugaggucgaaugggaggaagacgugguugaugccacaccucuugagguguuccugcucagccagcaccuggaggaguuccugcccauuuuuaagcgggaacagaucgaccucgaagcucugcuucuguguuccgacgaggaucuccaaagcauucagaugcagcuggggccucgcaaaaagguccuuaaugccaucaacagacggaaacaggugcugcaacagcccggacagcucguggacaccucucuguga

SEQ ID NO: 65843 - RNA, 2616 nt, Artificial Sequence
  derived and/or modified sequence opt5 from ANKS6__Homo_sapiens__NP_775822
augggcgaagggggacugcccccugccuuccagcuccugcuuagagcuugcgaccaaggcgauaccgaaacagcccggcgccugcucgagccgggggcggcugaacccgccgagagaggagccgaaccugaggcuggcgccgagcccgcuggggccgaaguggcgggaccuggcgccgcugccgcuggcgccgucggggcgcccguuccuguggacuguagcgaugaggccggaaacacggcucugcaguuugccgcugccggcgggcacgaaccgcuugugcgguuccugcuccgcagaggagccuccgucaauucucggaaccauuacggcuggagcgcucugaugcaggcggcccgcuuugggcacguguccguugcucaucugcuccuggaccacggagccgaugugaaugcccagaacagacuuggcgcuucuguccugaccguggccagccggggcgggcaucucggaguugugaagcugcuucuggaggcgggcgcuuucgucgaccaccaccaucccuccggggagcaacucggacugggcgggucucgcgaugaaccucuggacaucacagcccucauggccgcuauucagcacggacaugaggccguggugagacugcuuauggaauggggcgcugaucccaaucacgccgcgcggaccgucggcuggagcccucugaugcucgccgcucugacagggcgccuuggaguugcccagcagcugguggagaaaggcgcuaaccccgaccaccucuccgugcuggaaaagaccgccuuugaggucgcgcuggauugcaaacauagagaccucguggauuaucuggacccgcuuacaaccguucggccuaagacggacgaggaaaaacgcagacccgauaucuuccacgcccugaagauggggaauuuucaacucgugaaggagauugcugacgaagauccuagccaugucaaccuggugaauggagacggcgccacaccccuuaugcuggcugccguuaccgggcagcucgcccuggugcagcugcucgucgagcggcacgcugauguggacaaacaggauucuguccauggcuggaccgcgcugaugcaagccacauaccacggaaacaaggaaaucgugaaauaucuucugaaucagggcgcugacguuacccucagagccaagaacggguacacggccuucgaucuggugaugcugcuuaaugaccccgauacagagcucguccgccugcuggcuuccguguguaugcagguuaacaaagacaagggacggccuagccaccaaccgccccucccucauucuaaggugagacagcccugguccauuccuguccugcccgacgauaaaggcgggcuuaagagcugguggaaucgcaugucuaaccgguuuagaaaacugaagcucaugcagacccugccgcgcggacuguccagcaaccagccucuucccuucuccgacgagccugaacccgcccucgauucuacaaugcgggcggcuccucaagacaaaaccagcagauccgcccugcccgaugccgcuccggugaccaaggacaauggcccugggagcacacgcggcgagaaagaagauacgcugcucaccacaaugcugcggaacggagcgccccuuaccagacugcccucugacaagcucaaggccgugaucccuccguuucugcccccuuccagcuucgagcuguggucuagcgaucgcucccggacaagacacaauggcaaagcugaccccaugaagaccgcccuuccucagcgggccucucgcgggcaucccguuggaggcgggggaacggauacaaccccugucagacccgugaaauuuccgagccucccucggucccccgcuagcucugccaacuccggcaauuucaaccacagcccucacucuuccgggggcagcuccggagugggcgucucuagacaugggggagaacugcugaaucgcagcggcggguccaucgacaacgugcucucucagauugcugcccagcggaagaaagcggccggacugcuugagcaaaagcccagccacagauccagcccgguuggcccugcucccgggucuuccccuagcgagcugcccgccucucccgcuggcggauccgccccugugggcaagaaacucgaaaccagcaagcgcccgcccucugggacaagcaccacauccaaaagcacgucuccuacccugacacccuccccuagccccaagggacauaccgccgaguccucugucagcuccucuagcucccacagacagucuaaaagcuccggcgggucuagcuccggaacaaucaccgaugaagacgagcugacgggcauucuuaagaagcucagccuggagaaauaucagccuaucuucgaggagcaggaaguggacauggaggcuuuucugacccucacagauggcgaccugaaggaacuugggauuaaaaccgauggaucucggcaacagauccuggcggccauuuccgagcucaaugcuggcaaggggcgcgagagacagauccugcaggaaacaauccauaacuuccacagcucuuuugaguccagcgccuccaauacccgggccccgggaaacagccccugcgcuuga

SEQ ID NO: 65844 - RNA, 3264 nt, Artificial Sequence
  derived and/or modified sequence opt5 from ANLN__Homo_sapiens__NP_001271230
auggaccccuucaccgagaagcugcucgaaagaacacgggcccgcagagagaaccugcagcggaaaauggcugaacgcccuacggccgcgccgagaagcaugacccacgcuaagcgggcccgccaaccccuuuccgaggccucuaaucagcagccucugagcggcggggaagagaaauccugcacaaagcccucuccuagcaaaaagagauguuccgauaacaccgagguggaagucucuaaucucgagaacaagcagcccguugaaagcacauccgcuaaaagcugcucuccuuccccggugagcccccaagugcagccucaggccgcugacaccaucucugauuccgucgccgugcccgcgagccugcuuggaaugcggcgcggccucaauucuagacuggaggccacagcugccuccagcguuaagacccggaugcagaaacuggcugagcaacgcagacggugggacaacgaugacaugacggaugacauuccugaauccucucuguuuagccccaugccguccgaggaaaaggccgcgagcccuccccgcccucuccugucuaaugccuccgcuacccccguggggagacggggaagacuugccaaccuggcugccacaaucuguagcugggaggaugacgucaaucauucuuucgccaaacagaacagcgugcaggaacagcccggcaccgcuugccucuccaaguuuucuagcgcguccggggccagcgcucgcauuaauucuuccagcguuaagcaagaggccacauucuguucucagcgggauggagacgccucccugaacaaagcucuuagcuccucugccgaugacgcgagccuggugaaugcuuccaucucuagcuccgucaaggccaccagcccugugaaaucuacgacauccauuaccgacgccaagagcugcgagggccagaacccggaacuccugcccaaaacaccuaucucuccccugaagaccggcguguccaaaccuaucgucaagagcacccucucucaaacaguucccagcaagggggagcuguccagagaaauuugucuucagagccagucuaaagauaaguccacgaccccgggaggcacagggaucaaaccuuuucuggagcgcuucggagaacggugccaggagcacagcaaggagucccccgcuagaucuaccccucaucgcacacccauuaucaccccuaauacgaaagccauucaagaacggcucuuuaagcaggacacaagcuccucuaccacccaccuggcucagcagcuuaagcaagagagacagaaagaacuggccugucuccgcggccgguucgauaaggggaacaucuggagcgcggagaaaggaggcaacuccaagucuaaacagcuggaaacaaagcaggagacccauugccaaagcacaccccugaagaaacaccagggcguguccaagacgcagagccucccggugaccgagaaagucacagaaaaucagauuccugccaagaacucuuccaccgagcccaaagaagugaucagagagaucgagaugagcguugacgaugacgauauuaauucuuccaaggugaucaacgaccuguuuagcgauguccuugaagagggggaacuggacauggagaagucucaagaagagauggaucaggcucucgccgaguccagcgaagaacaggaagacgcucugaauauuuccagcaugucucuucuggcgccccucgcccaaacagugggaguugugagcccugagucccuggucucuaccccgcgccuggaacucaaagacacgagccgguccgaugagucucccaagccuggcaaauuccagagaacccgggugccccgcgccgagagcggggacucccugggaucugaagauagagaccuucuguacagcaucgaugcuuaucggucccagagauuuaaggagacagaacgcccuagcauuaaacaggucaucgugcggaaggaggacguuaccucuaaacucgaugaaaagaacaaugccuuccccugucaagugaacaucaagcagaaaaugcaggagcugaauaacgagauuaauaugcagcaaacagucaucuaccaggcuucccaggcccugaacugcugcguggacgaggagcacggcaaggggagccuugaagaggccgaggcugaaagacuccugcugauugcgaccggaaaacgcacgcuccugaucgaugagcuuaauaagcugaaaaacgaaggcccucagagaaagaauaaggccucuccccaauccgaguuuaugccgagcaaaggcuccguuacacucucugaaauucggcugccucugaaggcugacuucguguguagcaccguccagaaacccgaugccgccaacuauuacuaucuuaucauccucaaggcuggggccgagaacaugguggcgacaccucuggcuuccaccagcaauucucugaacggagacgcccucaccuucacaacgaccuuuacacugcaggauguguccaaugacuucgagauuaacaucgaaguuuacagccuuguccagaaaaaggaccccucuggccuggauaagaaaaagaaaaccagcaaguccaaagccauuacaccgaagcgccuccugaccucuaucacgacaaagagcaauauucauuccucugugauggcuagcccugggggacuguccgccgugagaaccagcaacuuugcgcuugucggcucuuauacccucucccugagcuccguggggaauacaaaauucguucuggacaaggugcccuuucucucuagccuggagggccacaucuaccuuaaaauuaagugccaagucaacuccucuguggaggaacggggauuccugaccaucuuugaagauguuagcggcuucggggcuuggcaucgcagauggugugugcucuccggaaauugcaucagcuacuggacauauccugacgaugagaaacggaagaaccccauuggccgcaucaaucuggccaacuguacgucuagacagauugagcccgccaaucgggaauuuugcgcucgcagaaacaccuucgagcugaucacaguccggccucagagagaagacgaucgcgagacccuugugucccaaugucgggacacacucugcguuaccaaaaauuggcugagcgccgauacgaaggaagagagagaccuguggaugcagaagcucaaccaggugcuggucgauauucgccuuuggcagccggacgcuuguuacaaacccaucgggaagccuuga

SEQ ID NO: 65845 - RNA, 1884 nt, Artificial Sequence
  derived and/or modified sequence opt5 from ANO10__Homo_sapiens__NP_001191760
augaaggugacccugagcgcccucgacacauccgagucuagcuucacgccccuggucguuaucgaacuugcucaggaugugaaagaggaaaccaaggaguggcugaaaaacagaauuaucgccaagaaaaaggacggcggggcgcaacuccuguuucggccucuucugaauaaguacgaacaggagacacucgagaaccagaaucuguaucuggugggagcuuccaaaauucgcaugcuccugggcgccgaagccgucgggcuugugaaggagugcaacgauaauaccaugagagcuuucacauaccggacccgccagaacuuuaaaggauucgacgauaauaacgacgauuuucugacaauggccgaaugucaauucaucauuaagcacgagcucgagaaucugagagcuaaagacgaaaagaugaucccgggcuauccccaggccaaacuuuacccugggaagucucugcuccggcgccugcugaccagcggaaucguuauucagguguuuccccuccaugauuccgaggcgcugaagaaacuugaagacacgugguauaccagauucgcccugaaguaccagccuaucgauucuauucggggcuauuuuggcgagacaaucgcucucuacuucggguuucuggaauacuucaccuuugcccuuauucccauggcugucaucggacugccuuauuaccucuucgugugggaggacuaugauaaauacguuauuuucgccagcuuuaaccugaucugguccacagugauccuggagcucuggaagcgcggcugcgcgaauaugaccuauagaugggggacgcugcuuaugaaacggaaguucgaggagccgcgccccggauuucacggcguccuggggauuaacagcaucacaggaaaggaggagccucucuaccccucuuauaaaagacaacugcggauuuaccuugugucccugccuuucgugugucucugccuguacuuuagccuguaugucaugaugaucuacuucgacauggaaguuugggcccucggccugcaugaaaauucuggcuccgaguggaccagcgugcuucuguaugugcccucuauuaucuacgcuaucgucauugaaaucaugaaccgccucuauagauacgccgcugaguuucugacauccugggaaaaucaccggcuggagagcgccuaucagaaccaucuuauucucaaggugcugguuuucaacuuucugaauuguuucgccucccucuuuuacaucgcuuucgugcugaaagacaugaaacuucugagacagucucucgcgacccugcugauuaccagccagauccuuaaccaaaucauggaauccuuucucccguacuggcugcagcgcaagcacgggguccgggugaagagaaagguucaggcccugaaagcugauauugacgccacacucuaugagcaagugauccuggagaaggaaaugggaacguaccuuggcaccuucgaugacuaucuggaacucuuccugcaguuuggguacgucagccuguucucuugcguguauccucuugccgcugccuuugcgguccucaauaacuucacagaaguuaauuccgaugcucugaaaaugugucgcguguuuaagcggcccuucagcgagccuucugccaacauuggaguguggcagcuggccuuugagaccaugagcgucaucuccgugguuacaaauugcgcucucauuggcaugucuccccaggugaacgccgucuuccccgaaagcaaagcugaccugauccuuauugugguggccguugaggcggccuccuguaagcuggucagccucccuagauacucuugguccaccaauagcgugccggggacggugaucggacccggcgucuga

SEQ ID NO: 65846 - RNA, 2961 nt, Artificial Sequence
  derived and/or modified sequence opt5 from ANO1__Homo_sapiens__NP_060513
augagagugaacgagaaauacagcacccugcccgccgaagaccgguccguccacaucauuaauaucugcgcuauugaggauaucggcuaucucccuucugaagggacacugcuuaacagccuguccguugacccggaugccgaguguaaauacggacucuauuuccgcgacggcagacggaagguggauuacauucugguguaucaucacaaacgccccucugggaauagaacgcuuguccggcgcgugcagcauagcgacaccccuuccggagcgagaucuguuaagcaagaucacccccugccuggcaaaggggcuagccucgacgccggauccggcgaacccccuauggauuaccaugaggacgauaagcgguuucgcagagaggaauaugagggcaaccugcuggaagccgggcucgagcuggagcgggacgaagauacaaagauccacggagugggcuucgucaaaauccacgcuccguggaaugugcuuugccgcgaggccgaauuucugaagcucaaaaugcccaccaagaaaauguaccauauuaacgagacaagagggcugcuuaagaagaucaauagcguucugcagaaaauuaccgacccuauccagcccaagguggcugaacaccggccucagacaaugaaacgccucucuuaccccuucuccagagagaagcaacaucuguuugaccugagcgauaaagacucuuucuuugauuccaagacccggagcacgauugucuaugagauccucaaaagaaccacauguaccaaggccaaguacucuaugggaauuacaucccugcuugcgaacggcguguaugccgcugccuacccgcugcacgacggggauuauaauggagaaaacguggaguucaaugaccgcaaacuccuguacgaagagugggcucgguauggcgucuuuuacaaguaccagccuaucgaucuuguuagaaaauauuucggcgaaaagaucgggcuguacuuugccuggcucggaguguauacccagaugcugauucccgcgagcaucgugggcauuaucgucuuccuguacgggugcgccacgauggacgagaacauuccuuccauggagaugugugaucagcgccacaauaucacaaugugcccccucugugacaaaaccugcucuuauuggaagaugagcuccgcuugugccacagcucgggccagccaucuguuugauaaccccgccaccguguucuucucuguuuuuauggcucuuugggcggccaccuucauggaacacuggaagagaaaacaaaugcgccugaauuaccggugggaccucacaggauuugaggaagaggaagaggcugugaaggaccauccuagagccgaguaugaagcccgcguccuggagaaaucccuuaagaaagaaagccggaacaaggagaagagacgccacaucccggaggaaucuacgaacaaauggaagcagcgggugaaaaccgcuauggccggcguuaagcugacagauaaagugaagcucaccuggagagaccgguuccccgcguaccugacaaaucuggucagcauuaucuuuaugauugcugugaccuucgccaucguccucggggugauuaucuaccgcaucuccauggccgcugcccuggcuaugaacucuagcccuuccguuagaagcaauauucgggugacggucacagccaccgcggugaucauuaaccuuguugugaucauucugcucgaugaggucuauggaugcaucgccagauggcugaccaagauugaagugcccaaaacagagaagucuuuugaagaacgccugaucuucaaggcuuuucuucucaaauucguuaauuccuacaccccuaucuuuuauguggccuucuuuaaaggccgguucgucggcagacccggggacuacguguauauuuuccgcagcuuuagaauggaggaaugugcuccgggaggcugccugauggagcugugcauccagcucucuauuaucaugcuggggaagcagcuuauucaaaacaaucuguucgaaaucggaaucccuaaaaugaagaagcucauucgguaccugaaacugaagcagcaguccccucccgaucaugaggaaugugugaaacgcaagcaaagauaugaggucgacuacaaccuugagcccuuugccggccucacaccugaauacauggagaugaucauucaguucggguuugugacgcuguucguugcgagcuuuccccuggccccgcuguucgcucuccuuaauaacaucauugaaauccggcuggaugccaaaaaguuugugaccgagcuccgcagaccugucgcugugcgggccaaggacaucggcauuugguauaauauccugcgcggaauuggcaaacuggccguuaucauuaacgcuuucgugaucuccuuuacaucugauuucauccccagacuugucuaccucuauauguacagcaagaaugggaccaugcacggauuugugaaccacacacuguccucuuucaauguuagcgacuuccagaacggcaccgcgcccaacgauccucuggaccucggguaugaagugcagauuugccgguacaaagauuaucgcgagccgcccugguccgagaauaaguacgacaucagcaaagacuuuugggccguccuggcugccagacuugccuucgugauuguguuucaaaaccuggucauguucaugucugauuuuguugacugggugaucccugauauucccaaggacaucucccagcagauucauaaggaaaaagugcucauggucgagcuguucaugcgggaggagcaggauaagcaacagcugcuugagacguggauggaaaaagagagacagaaggacgaaccucccuguaaucaccauaacaccaaggcuugcccugauagccucggaucucccgccccgucccacgcguaccacggcggggugcuguga

SEQ ID NO: 65847 - RNA, 3012 nt, Artificial Sequence
  derived and/or modified sequence opt5 from ANO2__Homo_sapiens__NP_001265525
auggccacccccggcccuagagacaucccgcugcuccccgggagcccucggcgccugucuccccaggcuggauccagaggcgggcaaggaccuaagcacggccagcagugccuuaaaaugcccgggccucgggccccgggacugcagggcggcagcaaccgcgaucccgggcaaccuuguggaggcgaguccacaagaucuagcuccgugauuaauaacuaccucgacgcgaaugaacccgucucucuggaggcucggcuuagccgcaugcauuuccacgauucccagagaaagguugacuaugugcuggccuaccauuaucggaaacgcggggugcaccucgcccagggauuuccuggccauagccuggcuaucgucucuaacggggaaacgggaaaggagccccacgccggcggcccgggggauauugaacugggaccucucgacgcucuggaggaggaaagaaaagagcagcgggaagaguucgagcacaaucuuauggaagccggccuggagcucgaaaaggaucuggagaacaagucccaagggagcaucuuugugcgcauucaugcgcccuggcagguucuugccagagaagcugaguuccugaaaaucaaggugccuaccaaaaaggagauguacgaaaucaaagccggaggcucuauugcuaagaaguuuuccgccgcgcuccagaaacugagcucucaccuucagccccggguccccgagcauuccaauaacaagaugaaaaaucucagcuauccuuucucccgcgaaaagauguaccuguauaacauccaagagaaagacacauuuuucgauaaugccaccagaucucggauugugcacgaaauccuuaagagaacagcuugcagccgcgccaacaauaccauggggauuaacucccugaucgcuaauaacauuuacgaggccgccuacccgcuccacgacggagaguaugauagccccgaagacgauaugaacgaccggaaacugcuuuaccaggagugggcuagauauggcguguuuuacaaguuccagccuaucgaccugauccgcaaguauuuuggcgagaaaauugggcucuacuucgcguggcugggacuguauacaucuuuucucauccccuccagcguuauuggcgucaucguguuccuguacgggugugccaccauugaggaagauaucccuucucgggagaugugcgaccaacagaaugcuuucacgauguguccccuuugcgauaagagcugugacuacuggaaccuguccucugccugcggaaccgcccaggcuagccaucucuuugauaauccggccacaguguucuuuuccaucuucauggcgcugugggcuaccauguuucuugagaacuggaaaagacugcagaugcgccucggcuauuucugggaccugacagggauugaagaggaagaggagcgggcccaagaacacagcagaccugaguacgaaaccaagguccgcgagaaaaugcugaaggaaucuaaucaguccgccguucagaagcucgagacgaacacaaccgaguguggcgaugaagacgaugaggacaaacugacauggaaggaucgguuucccggauaucuuaugaauuucgcuagcauccuguuuaugauugcccucaccuucucuaucguguuuggcgugauugucuacagaaucaccacagcugccgcgcugucccugaacaaagccacgcgcagcaaugugcggguuaccgugacagcuaccgccgucaucauuaaccuugugguuauccucauucuggacgaaaucuauggggcuguggccaaguggcugacaaaaauugaggucccuaagaccgaacagacguucgaggagagacucauccugaaggcguuucuucugaaauucgugaaugccuacucccccauuuucuaugucgccuuuuucaagggacgguuugugggccgcccugggucuuacguuuacguguucgacggauauagaauggaagagugcgcucccggcgggugucucauggaacugugcauccaacugagcaucauuaugcuuggcaaacagcucauccagaacaauauuuuugagaucggagucccgaagcugaaaaagcuguuccggaagcucaaagaugaaacagaggcuggcgagaccgacuccgcccauucuaagcacccugaacagugggaucuggacuacagccuugagcccuauaccgggcugacacccgaauacauggagaugauuauccaauuuggauucgugacccucuuuguugccuccuucccucuggcuccgguguuugcgcugcuuaacaaugucaucgaggugagacucgaugccaaaaaguucgugacagaacugcgccggcccgacgcuguuagaacgaaagauauuggcaucugguuugacauucugagcgggaucggaaaguucucugucauuuccaacgccuucgugaucgccaucaccagcgauuuuauuccucgccucguguaucaguacucuuauucccauaacggcacacugcacggguucgucaaucacacccuuagcuuuuucaacgugucucagcugaaagagggcacacagcccgaaaauagccaauuugaccaggagguucaguucugcagauuuaaggauuaccgggaaccucccugggcuccuaaccccuacgaguucuccaagcaauauugguuuauccucagcgcccgccuggcguucgugauuaucuuucagaaucuggucauguuccuuucugugcucguugacuggaugauuccggauaucccuaccgacaucuccgaccagauuaaaaaggagaaaagccugcugguggauuucuuucucaaggaagaacaugaaaaacugaagcugauggacgagcccgcucugagauccccuggaggcggggaucggucucgcagcagagccgccuccucugcucccagcggacagucccaacucggcucuaugaugagcuccgggagccagcacacgaacgucuga

SEQ ID NO: 65848 - RNA, 2946 nt, Artificial Sequence
  derived and/or modified sequence opt5 from ANO3__Homo_sapiens__NP_113606
auggugcaccauagcggcuccauccagucuuucaagcaacagaaagggaugaacauuagcaaguccgagaucaccaaagaaacaucucugaagcccagccggcggucccucccuugccuggcccagucuuacgcuuauagcaaaucccuuagccagucuacgucccuguuucaaagcaccgagucugaaucccaggccccgacaagcauuacccucaucucuacagacaaggcggagcaggucaauaccgaagagaacaagaaugauuccguucugcgcuguagcuucgcugaccuuuccgauuuuugccuggcccucggaaaagacaaggauuacacagacgagucugaacacgccaccuaugauagaagccggcugauuaacgacuucgugaucaaagauaaguccgaguuuaaaacgaagcugagcaagaaugacaugaacuacaucgcuucuuccggcccccucuucaaagaugggaagaaacgcauugacuauauccugguguacagaaagaccaauauucaguaugauaaacggaacacauuugaaaagaaucuucgcgccgagggacugaugcucgagaaagaaccugcuaucgccagccccgacauuauguucaucaagauucauaucccuugggacacccuguguaaguacgcggagagacuuaacauccggaugcccuuucgcaaaaagugcuacuauacagauggcagaucuaaaagcauggggcggaugcaaaccuacuuccgcagaauuaagaauuggauggcccagaacccuaugguccuggacaaauccgcuuuuccggaucucgaagagucugacuguuauacgggacccuucagccgggcccgcauccaccauuuuauuaucaauaacaaggauacauucuucuccaaugcuaccagaagccggauuguguaccacaugcuggaaagaacaaaguaugagaacggcaucucuaaaguuggcauccgcaagcugauuaacaauggguccuacaucgccgcguuuccuccccacgagggagccuauaaaagcucucagccuauuaagacccauggcccccagaacaaucggcaccuccuguacgaaagaugggcucgcugggggaugugguacaaacaucaaccgcuugaccugauccggcucuauuucggagagaagauuggccuguacuuugccuggcuugggugguauaccggaaugcugaucccugcugccaucgugggccucugcgucuucuuuuacggccuguucacaaugaacaauucccaggugagccaggaaauuuguaaggccacggagguuuuuaugugcccccugugugauaaaaacugcucccuccaaagacugaaugacucuuguaucuaugcuaaggugaccuaccuuuucgauaacgggggaacagucuuuuucgcgauuuuuauggccaucugggcuaccguguuccuggaauuuuggaaacgccggagaagcauucucacauauaccugggaccugaucgagugggaggaagaggaagagacgcuucgcccucaguucgaagccaaguacuacaaaauggagauugugaaucccaucacaggcaagcccgagccucaccagccguccucugauaaggucacccggcugcucguuagcguguccgggaucuucuuuaugauuagccuggugaucaccgccgucuucggagugguuguguauagacuggucgugauggaacaguuugcuucuuucaaauggaacuuuauuaagcaauacuggcaguucgccacauccgcggcugccguuugcaucaauuuuauuaucaucaugcuccugaaccuugccuaugagaaaauugcuuaccugcucaccaaucuggaauauccccgcacagagagcgagugggaaaacucuuucgcccugaagauguuucuuuuccaguuugugaaucucaacuccagcaucuucuacauugccuuuuuccugggccgguucgucgggcacccuggaaaauauaacaagcuguuugacagauggcggcucgaggaaugccaucccucuggcugucugaucgaccuuugccugcagaugggcgugauuauguuccucaaacaaaucuggaauaacuuuauggagcugggguacccucugauccagaauugguggagccgccacaagauuaagagaggaauccaugaugcuuccauuccccagugggaaaacgacuggaaucuucagccgaugaaccuccacggccugauggaugaguaccuggagaugguccuccaauucggguuuacgaccaucuucguggcggccuuuccucuggcuccccuucuggcccuccugaauaacauuaucgaaauccggcuggacgcuuauaaauucguuacacaguggagacgcccucuucccgcccgggcgaccgauauuggaaucuggcucggcauucuggaggggaucggcauucuggccgugaucacaaaugcuuuugucauugccaucaccagcgacuacaucccuagauucguguaugaauacaaguauggacccugugcuaaccauguugagccgucugaaaauugccucaaaggcuacgugaacaauucccugagcuuuuucgaucuuuccgagcuggggaugggaaagucuggcuauugucgcuacagagacuaccgggggccucccuggagcuccaaacccuaugaguucacgcuccaguacuggcacauucuggccgcccgccuggcuuuuaucauugucuucgaacaccuuguguuuggaaucaagucuuucauugcguaucucaucccugaugugccgaagggccugcaugacagaauccggcgcgagaaauaccugguucaggaaaugauguaugaggccgaacucgagcaucugcaacagcagagaagaaagagcgggcaacccguccaccacgaguggccuuga

SEQ ID NO: 65849 - RNA, 2868 nt, Artificial Sequence
  derived and/or modified sequence opt5 from ANO4__Homo_sapiens__NP_001273545
auggaggccagcuccucuggcaucaccaacgggaagacaaaaguguuccaccccgaaggaggcgucgaccugcagggguaccaacucgauaugcagauucugccugacggacccaagagcgauguugacuuuuccgagauccuuaaugcuauucaggaaauggccaaagaugugaacauccuguucgacgagcucgaagcggugucuagccccugcaaggaugacgauucccugcuucauccuggcaaucugacgucuaccagcgacgaugcuuccagacucgaggccgggggagagacaguccccgaacggaacaaaagcaauggccuguauuuucgcgacggcaaguguagaauugauuacauccugguguaucggaagucuaacccucagaccgagaaacgcgaaguuuucgagagaaauauccgggccgaggggcuccaaauggaaaaggaguccagccugauuaacucugacaucauuuuugugaaacuucacgcucccugggaaguccugggacgcuacgccgagcagaugaaugugagaaugccuuuccggcgcaagaucuauuaccucccgagacgguauaaauuuaugucccgcauugacaagcagaucagcagauuccggcgcuggcugcccaagaaaccuaugagacuugauaaggaaacacugcccgaccucgaggagaacgauugcuacaccgcuccuuuuucucagcaacggauucaucacuucaucauccauaauaaagaaacauuuuucaacaaugccaccagaucccgcauuguucaccacauccugcagcggauuaaguacgaggaaggcaaaaacaagaucgggcugaauagacuccugacgaacggaagcuaugaggcggccuuuccccuucaugaaggcuccuaccgcucuaaaaacagcauucggacccacggggcugagaaucauagacaucugcucuaugaguguugggccuccuggggagugugguacaaguaucagccgcuggaccuuguccgccgguacuucggcgaaaagaucggccuguauuucgcuuggcucgggugguacacaggaaugcuguuuccugccgcguucaucggccuguuuguguuccucuacggggugaccacacuggaucacagccaggucucuaaagagguuugccaagccaccgacauuaucaugugucccgugugcgauaaguauuguccuuuuaugagacuuuccgacagcugcguguacgcuaaagucacgcaccuguucgauaacggagccacaguguuuuucgcuguuuuuauggccgugugggccaccgucuuccucgaauuuuggaagcgccggagagcugugauugcguaugacugggaucugaucgacugggaggaagaggaggaagagauucgcccccaguucgaagccaaauacucuaagaaggagcggaugaaucccaucagcggcaaaccugagccguaucaggcuuuuacagacaaguguuccagacuuaucguuucugccagcgggauuuucuucaugaucugcguggucauugccgcuguguuuggaaucgucauuuaccgggugguuaccguguccaccuucgccgcguuuaaaugggcucugauccgcaacaauagccaagucgccacaacgggcaccgccguguguauuaacuucugcaucaucaugcuccugaauguucuguaugaaaagguggcucuccugcuuacaaaccuggagcagcccagaaccgaaucugagugggaaaauuccuuuacacucaaaauguuccuguuucaguucgucaaccugaauagcucuaccuuuuacauugccuucuuucuuggccgguucacggggcacccuggagcuuaccucagacugaucaaccgcuggcggcuggaggagugccaucccuccggcugucucauugaucugugcaugcagauggggaucauuauggugcuuaagcaaacauggaauaacuuuauggaacugggauauccucucauccagaauugguggaccagacgcaaggugagacaggagcacggccccgaacggaaaaucagcuucccgcagugggagaaggacuacaaccugcaaccuaugaacgccuaugggcuguucgaugaauaccuugagaugauucuccaguuuggcuucaccacaaucuuuguugcggccuucccccuggcuccucugcucgcccugcuuaauaacauuaucgagauucgccuggacgcuuauaaauuugucacccaguggagacggccccucgccucccgcgcgaaggauaucggaaucugguacggcauucuggaagggaucggcauucugucugugaucacaaaugccuucgugauugcuaucacgagcgacuuuaucccuagacuugucuaugccuacaaauacggacccugugcugggcagggagaggccggccaaaagugcauggugggguauguuaacgccucccucucuguguuccggauuagcgauuuugaaaaucgcuccgagccggaaagcgacggcucugaguucuccggaaccccucugaaguacuguagauaucgggauuaccgcgacccgccccauagccuggucccuuauggcuacacacuccaguuuuggcacgugcuggcugcgagacuugccuucaucauuguuuucgagcaccugguguuuugcaucaaacaucucauuucuuaucugaucccggaucugcccaaggaccuucgggauagaaugcgccgggaaaaauaccucauucaggagaugauguacgaagcugagcuggagagacugcagaaggaacgcaaagagcggaagaaaaacgggaaggcccaccauaaugaauggccuuga

SEQ ID NO: 65850 - RNA, 2742 nt, Artificial Sequence
  derived and/or modified sequence opt5 from ANO5__Homo_sapiens__NP_998764
augggcgaccccgaucugcucgaggugcuggccgaagagggggaaaaggucaacaaacacaucgacuacagcuuccagauguccgagcaaucucuuagcuccagagaaaccucuuuucugauuaaugaggagacaaugccugcuaagcgguucaaccucuuucugcgcagacggcuuauguuccagaaaaaucagcagagcaaggauuccaucuuuuuccgcgacggaauuagacaaaucgauuuuguucugucuuauguggacgaugugaaaaaggacgccgaacucaaggcggagcggcgcaaagaguucgaaacgaaccugagaaagaccggccuggagcucgaaauugaggauaaacgggacagcgaagaugggcgcacauacuuugucaagauccaugcuccgugggaggugcugguuaccuaugccgaagugcuuggaaucaaaaugcccauuaaggaguccgacaucccuagacccaagcacacaccuauuagcuacguccugggccccgugcggcucccucugucuguuaaauauccgcaucccgaguacuucaccgcccaguuuucccgccacagacaggaacuuuuccugaucgaggaucaggcuacauuuuucccuucuagcucccggaaucgcauuguguauuacauccucagcagaugccccuucgggauugaagacggaaagaaacgguuuggcaucgagagacugcugaacucuaauaccuacuccagcgccuauccucuccaugacggccaauacuggaagcccuccgaaccgccuaaccccacgaaugagcgcuauacccugcaccagaacugggcucgguucucuuacuuuuauaaagagcagccucuugaucugaucaagaauuacuauggggagaaaauuggaaucuacuucgucuuucucggcuucuacacagaaaugcuguuuuucgccgcggugguggggcuugccuguuuuauuuauggacugcucagcauggaacacaacaccuccagcacagagaucugcgaccccgaaauuggcgggcagaugaucauguguccccugugcgaucaagucugugacuacuggagacucaauucuaccugccuggcuuccaaguucagccaucuguuugauaacgagucuacgguuuucuuugccaucuucaugggaauuugggugacacuuuuccuggaguuuuggaagcagcgccaggcucggcucgaauaugagugggaccugguggauuucgaagaggagcaacagcagcuucagcugagaccugaauuugaggccauguguaaacaccgcaagcucaaugcggucaccaaagaaauggagccguacaugccccuguauacacggaucccuugguacuuccugagcggcgccaccgugacccucuggaugucccugguugugacaucuauggucgcugugauuguuuauagacuuagcguguuugccacguucgcuuccuuuauggaaagcgacgccucucugaagcaagucaaauccuuccucacgccccagaucacaaccagccugacaggcucuugccugaacuuuauugugauccuuauccucaacuucuuuuacgagaagauuuccgccuggaucaccaagauggagauuccucgcacguaccaggaauaugagagcucccugacacugaaaauguuccucuuucaguucgucaauuucuacucuagcuguuuuuauguggcuuucuuuaaggggaaauucguuggauaccccggcaaguauaccuaccuguuuaacgaauggcgguccgaggaaugcgaucccgggggaugucuuaucgagcugaccacacaacucaccauuaucaugacaggcaaacagauuuucgggaauaucaaggaggcgaucuauccucuggcccugaacugguggagacgccggaaggcuagaaccaauucugaaaaacuuuacagccggugggagcaggaccaugaucucgaauccuuuggaccccugggccuguucuacgaguaucucgaaaccgugacacaguuuggcuucgucacccuguuuguggccagcuucccucuugcuccccugcucgcccugauuaacaauaucguugagauucgcguggacgccuggaagcugacaacccaauacagacggacggucgcgucuaaagcucacuccaucgggguguggcaggacauucuuuauggaauggccgugcucagcguugccaccaacgcuuucaucgucgccuuuacaucugauaucauuccuagacugguguacuauuacgcuuauuccaccaaugccacacagcccaugaccggcuacgugaacaauagccugucugucuuccucaucgcggacuuuccgaaccacacggccccuagcgagaagcgcgauuucauuacaugccgguacagagacuaucgcuacccgcccgaugacgaaaauaaauauuuucauaacaugcaguucuggcacgugcuggcugccaagaugaccuuuaucauuguuauggagcauguggucuuccuugugaaguuucugcucgcuuggaugaucccugauguuccgaaagacguggucgaaagaaucaagcgggagaaacugaugacaauuaagauccugcacgauuucgagcuuaauaaacucaaggaaaaccuggggauuaacuccaaugaguuugccaaacaugugaugaucgaagagaacaaggcgcaacuggccaagagcacccucuga

SEQ ID NO: 65851 - RNA, 2733 nt, Artificial Sequence
  derived and/or modified sequence opt5 from ANO6__Homo_sapiens__NP_001020527
augaagaaaaugagcagaaacgugcugcuccagauggaggaagaggaagacgaugacgauggcgacaucguccuggagaaucuugggcaaaccauuguucccgaucugggaucccucgaaucucagcacgacuuccggacaccugaguuugaggaauuuaacggcaagccggauagccuguuuuucaaugacgggcagcgcagaaucgauuuugugcuuguguacgaggacgaaucccggaaagagacgaacaagaaaggaaccaaugagaagcagcgcagaaagcggcaagccuaugaaucuaaccugauuugccauggccuccagcuggaggcuacacgcagcguccuggaugacaaacucguguucguuaaggugcacgcccccugggaaguccuguguaccuacgcggagaucaugcauauuaaacuuccucugaagcccaaugaucucaaaaacagauccucugcuuuugggacacugaauugguucaccaaggugcuuagcguugacgaauccaucaucaagccugagcaggaguuuuucacagcccccuuugagaaaaaccggaugaaugacuucuauauuguggaucgcgacgccuuuuucaacccugcuaccagaagccggaucgucuacuucauucugucucgcgugaaguaucaggugaucaauaacgucuccaaauuuggaauuaauagacucguuaacagcggcaucuacaaggccgcuuucccgcugcacgauugcaaauuucggcgccaaucugaggaccccuccuguccuaacgaaagauaucugcucuaccgggagugggcccaucccagaagcauuuacaagaaacagccucuggaucuuauccgcaaguauuacggcgaaaagaucgggauuuauuucgcguggcugggauacuauacgcagaugcuccugcuugccgcuguggugggcgucgccugcuuucuguacggguaucucaaucaggacaacuguaccuggucuaaagaggugugccaccccgauaucggaggcaagauuaucauguguccgcaaugcgaccggcuguguccuuucuggaaacugaauauuacaugcgaguccagcaagaaacucuguaucuuugauuccuucgggacccugguuuuugcuguguucaugggagucugggugacacuuuuucuggaguucuggaagagacgccaggccgaacucgaauacgagugggacaccguugaacugcagcaagaggagcaggcgcggcccgaauacgaggccagaugcacgcacguggucaucaacgaaauuacacaggaggaggaacgcaucccuuuuaccgcuuggggcaagugcauucggaucacacuuugugccucugcuguguucuucuggauucugcucaucaucgccagcgucauuggcaucauuguguauagacuguccguuuuuaucguguucagcgccaaacugcccaagaauauuaacgggaccgaucccauccagaaauaccucaccccucaaacagcuacgucuauuaccgcguccaucaucagcuuuauuaucauuaugauccugaauacaauuuaugagaaggucgccaucaugaucaccaacuucgaacuuccgcgcacacagaccgacuacgaaaauucucugacgaugaaaauguuucucuuccaguuugugaacuauuacagcuccugcuucuauauugcuuucuucaagggaaaguuuguuggcuaccccggggacccuguguacuggcugggaaaauaucggaaugaagagugugaucccggcgggugccugcuugagcucacaacccagcugaccaucauuaugggaggcaaggccaucuggaacaauauucaagaaguccugcucccuuggaucaugaaccugaucggcagauuccaucgcgugucugggagcgagaaaauuacaccccggugggaacaggacuaccaccuucagccgaugggaaagcugggccucuuuuaugaguaccuggaaaugaucauucaguucggguucgugacccuguuuguugccuccuucccucuugcuccccuccuggcccuggucaauaacauccucgagauuagaguggaugcguggaaacugacaacgcaauuucggcgccuugugccugagaaggcucaggacaucggagccuggcagcccaucaugcagggcauugccauccuggcugucgugaccaacgccaugauuaucgcuuucacaagcgauaugauuccuagacucguuuauuacuggucuuuuuccgugcccccguauggggaccauaccagcuacacaauggaaggcuacaucaauaacacccugucuauuuucaaggucgccgauuuuaaaaauaaguccaaaggaaacccuuauagcgaccugggcaaucacacgaccugucgguacagagauuuccgcuauccucccgggcacccccaagaguacaagcauaacaucuauuacuggcacgugaucgcggccaaacuugcuuuuauuaucguuauggaacaugugauuuauuccgucaaguucuuuaucucuuacgccauuccggacgugagcaaacggacaaaguccaagauccagagagagaaauaccucacccagaagcugcugcacgaaaaucaucucaaagauaugacaaagaacaugggaguuaucgcugagcgcaugauugaggccguggacaauaaccugagacccaaaucugaauga

SEQ ID NO: 65852 - RNA, 540 nt, Artificial Sequence
  derived and/or modified sequence opt5 from ANO7__Homo_sapiens__NP_001001666
augagaauggccgcuaccgccugggcgggccugcaggggcccccucucccgacacugugccccgcugugcggacgggacuuuacugucgcgaccaagcccacgccgagagaugggcuaugaccagcgaaacauccucuggcagccauugcgcccggucccgcaugcugagacggcgcgcucaggaggaagauucuaccguccucaucgacguuagcccucccgaggccgaaaagagaggguccuauggaucuacagcgcacgccagcgagccuggcgggcagcaggcugccgcuugucgggccggaucccccgcgaaaccucgcauugauuucgugcuggugugggaggaagaccuuaagcuggauagacaacaggacagcgccgcucgggaucgcaccgacaugcauagaacauggcgggagaccuuucucgauaaccugcgcgccgcuggccugugcgucgaccaggugagaggcgggugucacggacagggcccgcggcccugcauccauucuguuacgcacgaucucgccgccuga

SEQ ID NO: 65853 - RNA, 750 nt, Artificial Sequence
  derived and/or modified sequence opt5 from ANP32A__Homo_sapiens__NP_006296
auggagaugggcagacggauccaccuggaacuccgcaacagaacccccagcgacgugaaggagcugguccuugauaauucccggucuaacgaagggaaacuggagggacucacagacgaguucgaggagcuggaauuucuuagcacgauuaauguuggccugaccuccaucgccaaccucccuaagcugaauaaacugaagaaacucgagcugucugauaaccgcgugagcgggggacuugaagugcuggcugagaagugcccgaaucucacacaucugaaccuuuccggcaauaagauuaaagaccugucuaccaucgagccccucaagaaacuggaaaaccucaagagccuggaucuguucaauugugaggucacaaaccuuaaugacuacagagaaaacguguuuaaacugcucccucagcugaccuaucuugauggguacgaccgggaugacaaggaggcccccgauuccgacgcggaaggauauguugagggccuggaugacgaggaagaggacgaagaugaggaagaguacgacgaggaugcucaaguggucgaagacgaggaagaugaggacgaagaggaggaaggcgaggaagaggaugugagcggggaggaagaggaagacgaggaaggauauaaugauggcgagguugacgaugaggaagacgaggaagaacucggggaagaggagcgcggacagaagagaaaacgggaaccugaggacgaaggcgaggaugacgauuga

SEQ ID NO: 65854 - RNA, 756 nt, Artificial Sequence
  derived and/or modified sequence opt5 from ANP32B__Homo_sapiens__NP_006392
auggacaugaagagacggauccaccuggagcuccgcaacagaacccccgccgcugugcgggaacugguccuugauaauugcaaaagcaacgacggcaagauugaggggcugacagccgaguucguuaaucucgaauuucugucccuuaucaacgugggacugauuucugugagcaaucucccuaaacugccgaagcugaaaaagcucgaacuguccgagaaccgcaucuucggcgggcuugauaugcuggcggagaagcuccccaaucugacgcaucuuaaccugucuggaaauaaacucaaggacauuagcacccuggaaccucugaaaaagcucgagugucugaaaucccuugaucuguuuaacugcgaagucacaaaucucaacgacuacagagagucuguguucaagcugcuuccccagcugaccuaucucgauggcuacgaccgggaggaucaagaagcuccugacagcgaugccgagguugacgggguggaugaagaggaagaggacgaggaaggagaggacgaagaggaugaagacgaugaggacggcgaggaagaggaauuugaugaggaagacgaugaggacgaggaugucgaaggcgacgaggaugacgacgaaguguccgaggaggaagaggaguucgggcuggaugaagaagacgaggaugaggacgaagaugaggaagaggaagagggaggcaagggggagaaacgcaagagagaaacagacgaugagggagaagacgauuga

SEQ ID NO: 65855 - RNA, 396 nt, Artificial Sequence
  derived and/or modified sequence opt5 from ANP32D__Homo_sapiens__NP_036536
auggagaugggcaaguggauccaccuggaacucagaaaccggacccccagcgacgugaaagagcuguuccuugauaauucccagucuaacgaagggaagcuggagggacucacagacgaauuugaggagcuggaacuucugaauacgauuaacaucggccucaccagcauugccaaucugccuaaacugaacaagcucaaaaagcuggagcuuuccucuaaucgcgcuagcgucgggcuggaaguucucgccgagaagugcccgaaccugauccaucuuaaucuguccggaaacaaaauuaaggaucucucuacaaucgagccccugaaaaagcuggaaaaucucgagagccuggaccuuuucaccugugaagugacaaaccugaauaacuacuga

SEQ ID NO: 65856 - RNA, 2904 nt, Artificial Sequence
  derived and/or modified sequence opt5 from ANPEP__Homo_sapiens__NP_001141
auggccaagggcuucuacaucagcaaaucccuggggauucucggaauccugcuuggcguggcugccgucugcaccauuaucgcgcugucuguuguguauagccaggagaagaacaaaaaugcuaacuccucucccguggccagcacaacgccuuccgccucugcuaccacaaauccggccagcgcuaccacacucgaccaauccaaggccuggaacagauaccggcugcccaauacccuuaaaccugauagcuaucgcgucacacugagacccuaccucaccccuaacgaccgggggcuguauguguuuaagggaucuuccacgguucgcuucaccuguaaggaagcgacagaugugauuaucauccacagcaaaaagcugaauuacacccucucucagggccauagagucgugcugcgcgggguuggaggcucccagcccccugacauugauaaaacagagcuuguggaaccgaccgaguaucuggucgugcaccucaagggcagccuggugaaagacucucaguacgaaauggauuccgaguuugagggggaacuugccgacgaucuggcuggauucuaccggagcgaguauauggaaggcaacgucagaaagguuguggccacgacacaaaugcaggcugccgacgcgcggaaguccuuucccugcuucgaugagccugccaugaaagcugaguuuaauaucacccucauucaucccaaggaccugacagcccugucuaacaugcucccuaaagggcccagcaccccgcugccugaagaucccaauuggaacgugaccgaguuccacacaacgccuaagauguccaccuaccuucuggcuuuuaucgucagcgaauuugacuauguggagaaacaggccucuaauggaguucucauucgcaucugggccagacccuccgcuauugcggccggccauggggacuacgcucugaacgugacaggacccauccuuaauuucuucgccggccacuaugauaccccuuacccgcugcccaagagcgaccagaucggccucccugauuuuaacgccggggcuauggaaaacuggggacuggucacauaucgggaaaauucucuucucuucgacccccugagcuccucuagcuccaacaaagagcgcgugguuaccgugauugcccacgaacuugcgcaucaaugguucggcaaucuggucacgaucgagugguggaacgaucucuggcugaaugaaggguuugcuagcuacguggaguaccuuggagccgacuaugccgaaccuacauggaaccugaaggaucucaugguccugaaugacguguacagaguuauggcuguggaugcccuggcuucuucccacccccucagcaccccggccucugagauuaacaccccugcgcagaucuccgagcuguucgacgccauuagcuauuccaagggcgcuucuguccuucggaugcugagcuccuuucucucugaagauguguucaaacaggggcuggccagcuaccugcauacauuugcuuaucagaauaccaucuaccuuaaccucugggaccaucugcaagaggccguuaauaaccgcuccauccagcugcccacaacggugagagacauuaugaaucgguggacccuccagaugggauucccugucaucacaguggauaccagcacaggcacccugucucaagaacacuuucuucuggaccccgauuccaacgugacgagaccuagcgaguucaauuauguuuggauuguccccaucaccucuauucgcgacggccggcagcagcaggauuacuggcucaucgacgugagagcgcaaaacgaucuguuuuccacaagcgggaacgaaugggugcugcuuaaucucaacgucaccggauacuaucgcgugaauuacgacgaggagaacuggcggaagauccagacacagcugcagagagaucacucugccauuccgguuaucaaucgcgcucaaauuaucaacgacgccuucaaucuggcuagcgcccacaaagugccugucacccucgcccugaacaauacgcuuuuucugauugaggagcggcaguauaugcccugggaagcugcgcucuccagccugucuuacuucaagcugauguuugauagauccgagguguauggccccaugaaaaacuaccuuaagaagcagguuacaccucucuucauccauuuccgcaauaacaccaauaacuggcgggagauuccggaaaaucugauggaccaguauagcgaggugaacgccaucuccacagcuuguucuaacgggguccccgaaugcgaggaaauggugagcggacuguuuaaacaauggauggagaauccuaacaauaaccccauccacccuaaucucagauccaccguuuacuguaacgccauugcccagggcggggaggaagagugggauuucgcuugggaacaguuucgcaaugccacccuggugaacgaggcggacaagcugcgggcugcccuggccugcucuaaagaacucuggauccugaauagauaccugagcuauacacuuaaccccgaccucauucggaagcaggaugcuacguccaccaucauuucuaucacaaauaacgucaucggccaaggacuggugugggacuucgugcagagcaauuggaaaaagcuguuuaacgauuacggcgggggauccuucagcuuuucuaaucucauucaggccgucacccgcagauucuccacagaguaugagcugcaacagcuugaacaguuuaagaaagacaacgaggaaaccggcuucgggagcggaacgcgggcgcuggagcaggcucucgaaaagacaaaagccaacaucaaguggguuaaagagaauaaggagguggugcugcaaugguuuaccgaaaacucuaaguga

SEQ ID NO: 65857 - RNA, 1002 nt, Artificial Sequence
  derived and/or modified sequence opt5 from ANTXR1__Homo_sapiens__NP_060623
auggccaccgcugagagacgggcccugggcaucggguuccaguggcucagccuggcgacacuugugcugauuugcgcuggacaaggcgggcgcagagaagacggaggccccgccuguuacgggggauuugaucucuauuucauccuggacaaguccggcucuguccuucaccauuggaacgagauuuacuauuuuguugaacagcuggcccacaaauucaucagcccucagcuccggauguccuuuauuguguucucuacgcgcggcaccacacugaugaagcugaccgaggauagagaacagauccggcaagggcucgaggagcugcagaaagugcuuccgggaggcgacacauacaugcaugaaggguuugagcgcgcuagcgaacagaucuauuacgagaauagacagggauaucggaccgccuccgucauuaucgcucugacagauggcgagcuccacgaagaccuguucuuuuacucugagcgcgaagccaacagaagccgggaucuuggggcgauuguguacugcguuggagugaaggacuucaaugagacccaacuggcccgcaucgcugauuccaaagaccaugucuuucccgugaacgauggcuuccaggcccuccagggcauuauccacagcauucugaagaagucuuguaucgaaauccuggcugccgagccuuccacgauuugcgcgggggagagcuuucagguuguggucagaggaaauggcuuccggcacgcccgcaacguggacagagugcucuguucuuucaaaaucaaugauuccgucacccugaacgaaaagcccuuuagcguugaggacacauaucuucugugcccugcucccauucucaaagaaguggggaugaaggccgcucugcaagugucuaugaaugacggacuuuccuucaucagcuccucugucauuaucaccacaacccauuguagccugcacaaaaucgccuccggcccuacgacagccgcuugcauggaguga

SEQ ID NO: 65858 - RNA, 1470 nt, Artificial Sequence
  derived and/or modified sequence opt5 from ANTXR2__Homo_sapiens__NP_001139266
augguggccgagagaagccccgcucgguccccuggcucuuggcuguucccggggcucuggcugcuuguccugagcggacccggcgggcuccugcgcgcccaggaacaaccuuccugcagacgggcguuugaccuuuacuucguucuggauaagucuggaagcguggcuaacaauuggaucgagauuuauaacuuugugcagcagcucgccgaacgcuucgucucccccgagaugagacugucuuuuaucguguucagcucccaggccaccauuauccugccucucacaggcgaccgggggaaaauuagcaagggacuggaagaucuuaaacgcguuucucccgugggcgagacguacauccacgagggccugaagcucgcuaaugaacaaauccagaaagccgggggacugaagaccuccagcauuaucauugcucuuacagacggcaagcuggaugggcucgucccuucuuaugccgagaaagaagcgaagaucuccagaagccugggagccucuguguacuguguuggcgugcuggacuuugagcaggcucagcucgagcggauugccgauuccaaagaacaagucuucccggugaaagggggauuucaggcucugaaaggcaucauuaacagcauccuugcccaguccugcaccgagauccuggaacuccagcccucuagcgugugugucggcgaggaguuccaaauuguucuguccgggcgcggauuuaugcuuggcagcagaaaugggucugugcugugcacauauaccgugaacgagacauacaccacguccgucaagccugugagcguucagcucaauucuaugcugugucccgcgccuauccugaacaaggccggagagacccucgacgugagcgucuccuucaauggcgggaaaucugugauuagcggaucccugaucguuacagcuaccgaaugcagcaacggcauugccgcuaucaucgugauucuuguccugcuccugcuucugggcaucgggcucauguggugguuuuggccccuguguugcaagguggucauuaaagauccgccucccccucccgcccccgccccuaaggaggaagaggaagaaccgcugcccacaaagaaguggccuaccguggacgcuucuuauuacggaggccgcgggguuggaggcaucaaacggauggaggugagauggggcgauaagggguccacggaagagggagcgcggcucgaaaaggccaaaaaugcugucgugaagauucccgaggaaacagaggagccuauccgccccagaccgccucggcccaaaccuacccaucagcccccucaaacaaagugguacacccccaucaaaggcagacuggacgcccuuugggcccugcuccgccggcaguaugauagaguuagccugaugcgcccgcaggaaggggacgagguguguauuugggaaugcaucgagaaggagcugaccgcuuga

SEQ ID NO: 65859 - RNA, 975 nt, Artificial Sequence
  derived and/or modified sequence opt5 from ANXA10__Homo_sapiens__NP_009124
auguucugcggcgacuacgugcaggggaccaucuuucccgccccuaacuucaauccgauuauggaugcucaaaugcugggaggcgcccuccagggguuugacugugauaaggacaugcugaucaacauucuuacacagagaugcaaugcgcagcggaugaugaucgcugaggccuaucaaagcauguacggacgcgaucugauuggcgacaugagagaacagcucuccgaucacuucaaagacgucauggccgggcugauguaucccccuccccuuuacgaugcucaugagcuguggcacgccaugaagggaguuggcacggacgaaaacugucucaucgagauccuggcuucucggaccaauggcgaaauuuuucagaugcgcgaggccuauugccugcaguacagcaacaaucuccaagaggauaucuauuccgaaacaucugggcauuucagagacacccugaugaaccuugugcagggaacacgggaggaaggcuacaccgauccugcgauggccgcucaggacgccauggugcugugggaggcuugucagcagaaaacaggggagcacaagaccaugcuccaaaugauucugugcaauaaaagcuaccagcaacuucgccuggucuuucaggaguuccagaacaucuccggacaggacaugguggaugccauuaaugaauguuaugacggcuacuuucaagaacuccugguugcgaucgugcugugcgucagagauaagcccgccuauuucgcuuaccggcucuauucugccauucaugacuuuggguuccacaacaagacggugauccgcauccugauugcuagaagcgagaucgaucuucugaccauucggaaacgcuacaaggaaagauauggaaaaucccucuuucacgacauccggaauuucgccagcggccauuacaagaaagcccugcuugcuauuugugcgggcgaugccgaggacuacuga

SEQ ID NO: 65860 - RNA, 1518 nt, Artificial Sequence
  derived and/or modified sequence opt5 from ANXA11__Homo_sapiens__NP_001265336
augagcuaccccggcuauccuccgcccccugggggauaucccccugccgcucccggcgggggaccuuggggcggggccgcguacccgcccccucccuccaugccucccaucggacuggacaacguggcuaccuacgccggccaguucaaucaagauuaucucucuggcauggccgcuaacaugagcgggacauuuggaggcgccaauaugccgaaccuguacccuggggcucccggagccggcuauccucccgucccuccugggggauucggccagccgcccuccgcgcagcagccuguucccccuuacggcauguaucccccgccugggggaaaucccccuucuagaaugcccagcuacccucccuacccgggcgccccugugcccgggcaacccaugccuccgcccggacagcagccucccggcgcuuauccugggcagcccccugugacguaccccggacaaccgccugucccccuuccuggccagcagcagcccgugccguccuauccuggcuaccccgggucuggaaccguuacacccgccgugccucccacccaauuuggcagccgggggacaauuaccgacgcucccggauucgauccgcugcgcgacgccgagguccucagaaaggcgaugaaaggcuuugggacagaugaacaggccaucauugacugccugggcucccggagcaacaagcagcgccaacagauccuucugucuuucaaaaccgcuuauggaaaggaucucauuaaagaccugaaguccgagcugagcggcaauuuugaaaagacgauccucgcccugaugaaaacccccgugcuuuucgauaucuacgagauuaaggaagcuaucaaagggguuggaacagacgaggccugucugauugagauccucgccucuagauccaacgaacacauucgggagcugaaucgcgcuuacaaggcggaauuuaaaaagacccuugaggaggccaucagaagcgauacaucuggccauuuccagcggcugcucauuucccugagccaggggaaccgcgacgaauccaccaauguggauaugucucuggcucaaagagacgcccaggagcucuaugccgcuggagaaaaccggcugggcacggacgagagcaaguuuaaugccguccuuugcucccgcagcagagcgcaccugguggcuguguucaacgaauaccagcggaugacagggcgcgauaucgagaaaucuaucuguagagagauguccggcgaccucgaagagggaaugcuggccgucguuaagugccuuaaaaauaccccugccuuuuucgcugaacggcugaacaaggccaugagaggcgcugggacaaaagaucgcacccucauucggaucauggugagcagaucugagaccgaccugcuggauauucgcagcgaauauaagcggauguacggaaaaucccucuaucaugacaucucuggcgauacaagcggggacuacagaaagauucugcuuaagaucuguggaggcaacgauuga

SEQ ID NO: 65861 - RNA, 1074 nt, Artificial Sequence
  derived and/or modified sequence opt5 from ANXA13__Homo_sapiens__NP_001003954
augggcaacagacacagccaguccuacacccugucugaggggagccaacagcuccccaagggagacucccagccuucuacagugguccagccgcugagccaucccucccggaauggcgaaccugaggcuccccaaccugcuaaagccucuagcccccagggguucgauguugaccgcgaugcgaagaaacuuaacaaggcuugcaaaggaaugggcacgaaugaagccgccaucauugagauccuguccgggagaaccagcgacgaacggcagcagauuaagcaaaaguauaaagcuacauacggaaaggagcucgaggaagugcugaaaucugagcuuuccggcaacuuugaaaagaccgcccuggcucuccuggaucgcccuagcgaguaugccgcgagacagcugcagaaagccaugaagggccucgggacagacgagucugugcugaucgaaguccuuuguacccggacaaauaaggagauuaucgcuaucaaagaagccuaccagcgccuguucgauagaucccucgagagcgacgugaagggagauaccucuggcaaccugaaaaagauucuuguuucccugcuccaagcuaaucggaacgaaggggacgauguggacaaagaucuggccggacaggacgcgaaggaccuguaugaugccggcgaggggcgcuggggaacggacgagcucgcuuuuaaugaaguccuggccaaaagaagcuacaagcagcuucgggcuaccuuccaagccuaucagauccugauuggcaaggauaucgaggaagccauugaggaagagacauccggcgaccuccagaaggcuuaccugacccuugugcgcugcgcgcaggauugugaggacuacuuugccgaaagacuguauaagucuaugaaaggggcuggaacagaugaggaaacccucauccggauuguugugacgcgcgccgaggucgaccugcaaggcaucaaggccaaauuccaggaaaaguaccagaaaagccuguccgauauggugagaagcgacacaucuggggauuuucggaaacuccugguggcccuucugcacuga

SEQ ID NO: 65862 - RNA, 1074 nt, Artificial Sequence
  derived and/or modified sequence opt5 from ANXA1__Homo_sapiens__XP_011516910
augaaccugauccucagauacaccuucagcaagauggccaugguguccgaguuucugaaacaggcuugguucauugaaaaugaggaacaagaguauguccagacaguuaagucuagcaaaggcgggcccggauccgccgugucuccuuacccgacguuuaaccccagcuccgacguggcggcccuucacaaggcuaucauggucaaaggcguggaugaagccaccauuaucgacauucugacaaagcggaauaacgcucagcgccagcaaaucaaggccgcuuaucuccaggagaccgggaaaccucuggaugagacacuuaagaaagcccugaccggacaucucgaagagguugugcuggcgcugcucaagacacccgcccaguucgacgcugaugaacugagagccgcuaugaaaggccuugggaccgacgaggauacgcugaucgagauucucgccucucggaccaauaaggaaauccgcgacauuaacagagucuaccgggaggaacugaagcgcgaucuugcgaaagacaucacaagcgauaccuccggagacuuuagaaaugcccugcucagccuggcuaagggcgaucggucugaggacuucggcgugaacgaagaccuggccgauuccgacgcucgcgcccucuaugaggccggggagagacggaaaggaacagauguuaauguguuuaacaccauucugacgacacgcagcuacccucagcuuagacgggucuuccaaaaguauaccaaauacucuaagcacgacaugaauaaagugcuggaucucgaacugaagggcgacaucgagaagugccuuacagcuauugugaaaugugcgaccuccaagcccgccuuuuucgcugaaaaacugcaucaggccaugaagggggucggaacccgccacaaagcccucaucagaaucaugguuagccggucugagauugauaugaacgacaucaaggcuuuuuaccagaagauguauggcauuucccugugccaggccauccuggaugaaacaaaaggggacuacgagaagauucucguggcgcuguguggaggcaauuga

SEQ ID NO: 65863 - RNA, 1074 nt, Artificial Sequence
  derived and/or modified sequence opt5 from ANXA2__Homo_sapiens__NP_001002858
augggcagacagcuggccgggugcggagacgcuggcaagaaagccagcuucaagauguccaccgugcacgagauccucuguaaacugucucuugaaggggaucauagcacacccccuuccgcguacggaucugucaaggcuuauacgaacuuugacgccgagcgggaugcccugaauauugaaaccgcuaucaaaacaaagggcguugacgaggugaccauugugaacauccucacaaaucgcagcaacgcccaaagacaggauauugcuuucgccuaccagcggcgcaccaagaaagaacuggcguccgcccuuaagucugcucugagcgggcaccucgagacagucauccugggacugcucaaaaccccggcccaguaugacgcuuccgagcugaaggccagcaugaaaggccuuggcacggaugaagacucucugaucgagauuaucugcuccagaaccaaucaagaacuccaggagauuaaccggguguacaaggagauguauaagacagaucuggaaaaagacaucauuagcgauaccucuggggacuuucgcaaacuuaugguugcgcuggccaagggaagacgggcugaggauggcuccgugaucgacuacgaacucauugaccaggaugcccgcgaccuguaugaugcuggggucaagagaaaaggaacagacgugcccaaguggaucagcaucaugaccgagcggucuguuccucaucugcagaaaguguucgaucgcuacaaguccuacagccccuaugacaugcucgaauccauuagaaaggaggucaaaggcgaucuggagaaugccuuucuuaaccuggugcaauguauccagaauaagccucucuacuucgccgaccggcuguaugauucuaugaaagggaagggaacgcgcgacaaagugcuuauuagaaucauggucagccgguccgaaguugauaugcugaagauuagaagcgaguuuaagcgcaaauacggcaagucucucuauuacuauauccagcaggacacaaaaggcgacuaccaaaaggcucugcuguaccucugcgggggagaugacuga

SEQ ID NO: 65864 - RNA, 582 nt, Artificial Sequence
  derived and/or modified sequence opt5 from ANXA2R__Homo_sapiens__NP_001014301
auggagcagcacuuccugggcugcgugaagagagccugggacagcgcugaagucgcccccgagccucaaccgcccccuaucguuuccucugaagaucgggggcccuggccucucccccuguacccugugcuuggagaguauagccuggacuccugugaucucggccugcuuucuagcccgugcuggcgccugcccgggguguacuggcagaacggacucuccccuggcguccagucuacccuggaacccagcacagcgaaaccuacggaguuuuccuggcccgggacccagaagcaacaggaggcuccgguggaagagguuggacaggccgaggaaccugacagacugcggcuccagcaacugcccuggagcucuccucuucaucccugggaucgccagcaggacacagaggugugugauuccggcugccugcucgaaagacggcaucccccugcccugcagccguggcgccaccuucccggcuucagcgacugucuggaguggauucucagagucggguuugcugccuucucugugcugugggcuugcuguucccggaucugcggagccaaacaaccuuga

SEQ ID NO: 65865 - RNA, 972 nt, Artificial Sequence
  derived and/or modified sequence opt5 from ANXA3__Homo_sapiens__NP_005130
auggccagcaucugggugggccacagagggaccguccgggacuaccccgauuucuccccuucuguugacgcugaggccauucagaaggcgauccgcggaauuggcacagaugagaaaaugcugaucagcauucucacggaaagauccaacgcucaacggcagcugaucgugaaggaauaucaggccgccuacgggaaagagcuuaaggacgaucugaaaggagaccucucuggccauuuugaacaccugaugguggcucuugucaccccgcccgccguguucgaugcuaagcagcugaagaaaagcaugaagggggccggaacaaaugaggacgcgcucaucgagauucugaccacacgcaccuccagacaaaugaaagauaucucucaggccuauuacacaguuuauaagaaaagccugggcgacgauauuuccagcgaaaccucuggcgacuuucggaaggcucuccugacgcuugccgaugggcgcagagacgagucccugaagguggacgaacaucucgcuaaacaggaugcccagauccuguacaaggcgggagagaaccgguggggcaccgacgaggauaaauucacagaaauucuuugccugcgcagcuuuccucaacucaagcugaccuucgacgaguauagaaauaucucucagaaagauauugucgacuccaucaagggggaacugagcggacacuuugaggaucuccugcuugccaucgugaacuguguucggaauacacccgcuuuccuggccgaacgccuccauagagcucugaaaggcauugggaccgacgaguuuacgcuuaaccggaucauggugucucgcuccgagauugaucugcucgacaucagaacagaguucaagaagcacuacggauacagccuguauuccgccauuaaaucugauaccagcggcgacuacgaaaucacacugcucaagaucugcggcggggacgauuga

SEQ ID NO: 65866 - RNA, 966 nt, Artificial Sequence
  derived and/or modified sequence opt5 from ANXA4__Homo_sapiens__NP_001307627
auggccauggcuaccaagggcgggacagugaaagccgcgagcggauucaacgcuauggaggacgcccagacgcugagaaaggccaugaaaggccucgggaccgaugaagacgcuaucauuuccguccuggccuaccggaauacagcucaacgccaggagaucagaaccgccuauaagucuacaauuggacgggaucuuaucgacgaucugaaaagcgaacucuccggcaacuuugagcagguuauuguggggaugaugacccccacagugcuguacgacguccaggaacuucgcagagcgaugaagggagccggcaccgaugagggcugccugaucgagauccucgcuucucggacgccugaagagauucgcagaaucagccaaaccuaucagcagcaguacgggcggucccuggaagacgauauucgcucugacaccagcuucauguuucaaagagugcugguuucccucagcgccggaggccgggaugaggggaauuaucuggacgaugcucuugugcgccaggacgcccaggaccuguacgaggcgggagaaaagaaauggggcacagaugaggucaaguuccucacagugcuguguucuagaaaccggaaucaccuucugcauguuuuugacgaauauaaacgcaucucccagaaggauauugagcaaagcaucaaaucugaaaccuccgggagcuucgaggacgcccuccuggcuauugugaagugcaugagaaacaagucugccuacuuugcugagaaacuguacaaguccaugaaaggacucggcacggaugacaauacacugauccgggucauggugagcagagccgaaaucgauaugcuugacauucgcgcccacuucaagcggcuguauggcaaaucccucuacucuuuuaucaagggggauaccagcggagacuauagaaaagugcugcuuguccuguguggcggggaugacuga

SEQ ID NO: 65867 - RNA, 963 nt, Artificial Sequence
  derived and/or modified sequence opt5 from ANXA5__Homo_sapiens__NP_001145
auggcccaggugcugagaggcaccgucacagacuuccccggguuugaugagcgggcugacgccgaaacgcuccgcaaggcgaugaaaggacugggcaccgaugaggaaagcauccuuacacugcucaccuccagaucuaacgcucaacggcaggagauuagcgccgccuucaagacacuguuugggcgcgaccuucuggaugaccucaaauccgaacugaccggaaaguucgagaaacugaucguugcucucaugaagccuucuagacuguacgaugccuaugagcuuaagcacgcucugaaaggcgccgggacaaaugaaaaggugcucaccgagauuaucgcgagccggacgccggaggaacugcgcgccauuaaacagguguacgaggaagaguauggauccucucuugaagacgaugucgugggcgacaccagcggcuacuaucagagaaugcugguugugcuccugcaagcuaaccgggaucccgacgccgggaucgaugaggcucaggucgaacaggacgcccaggcgcuguuucaagccggagagcucaaguggggcacagacgaggaaaaauucaucaccauuuuugggacacgcuccgugagccaucugagaaagguuuucgauaaguacaugaccaucucuggauuucagauugaggaaacgaucgaccgggagacauccggcaaucuugaacagcugcuccuggcuguggucaaaagcauucgcucuaucccugccuaucuugcugagacccuguacuacgccaugaagggggccggaacagaugaccacacccucauuagagugauggugucccggagcgagaucgaucuguucaacauccgcaaagaauuuagaaagaauuucgcuaccucucuguauuccaugauuaaaggcgacacaagcggcgauuacaagaaagcgcuccugcuucugugcggggaggacgauuga

SEQ ID NO: 65868 - RNA, 2022 nt, Artificial Sequence
  derived and/or modified sequence opt5 from ANXA6__Homo_sapiens__NP_001146
auggccaagcccgcucagggcgccaaauacagagggagcauccacgacuucccuggauuugauccgaaccaagacgcggaggcucuguauaccgccaugaagggcuucggguccgauaaagaagccauucucgacaucauuacaucucggagcaaucgccagagacaggaggugugccaguccuacaagucucuguauggaaaagaucuuaucgcugaccugaaguacgaacucacgggcaaguuugagcggcugauugucgggcuuaugagacccccugccuauugugaugcuaaagaaaucaaggacgccaucagcggaauuggcaccgaugagaaaugccugaucgagauucucgcgucccgcacaaacgaacaaaugcaucagcugguugccgcuuacaaggacgccuaugagcgggaucuggaagcugacaucauuggcgauaccucugggcacuuccagaaaaugcucguggugcugcuucagggaacacgcgaggaggacgacgucgugagcgaagaucugguucaacaggacgugcaggaucucuacgaggccggcgaacugaagugggggaccgacgaggcgcaguuuaucuacauucuuggaaauagauccaagcaacaucugcggcucgucuucgaugaauaucugaaaacaaccggcaagcccaucgaggccagcauccgcggggagcugucuggagacuuugaaaaacucaugcuggcugugguuaaguguauuagauccacgccugaguacuucgccgaacggcuuuuuaaagcuaugaagggccugggcacccgcgauaacacacucaucagaauuauggugagccggucugagcuggacaugcuugauauccgcgaaauuuucagaaccaaauaugagaagucccuguacagcaugaucaagaaugacacaucuggggaguauaaaaagacccuccugaaacuguccggaggcgaugacgacgccgccgggcaguuuuuccccgaagcugcgcaggucgccuaccaaaugugggagcucagcgcuguggcccggguggaacugaagggaacggucagaccugccaacgauuuuaauccggacgcugaugccaaagcgcuucgcaaggcuaugaagggccuggggacagacgaggauaccaucauugacaucauuacacaccgguccaacguucagagacagcagauccgccaaaccuucaaaucucauuucggacgggaucucaugaccgaccuuaagagcgaaauuuccggcgaucuugccagacugauccucggccugaugaugcccccugcccacuaugacgcuaaacagcugaagaaagccauggagggggcuggaacagaugagaaggcccucaucgaaauucuggcgacgcgcaccaaugccgagauccgggcuauuaacgaagccuacaaggaggacuaccacaaaagccuugaggaugcucugucuuccgacacaagcggccauuuuagacgcauccucauuucucuggccaccgggcaccgggaagagggaggcgaaaaucuggaccaggcgagagaggaugcccagguggcugccgaaauccuugagauugcugacacacccagcggggauaagaccucccucgagacgcgcuucaugacaauccugugcacccggucuuauccucaucugagacggguguuucaagaguucaucaaaaugaccaacuacgacgucgaacacacaauuaagaaagaaaugagcggcgaugugcgcgacgccuuuguugccaucgugcaguccgucaagaauaagccccucuucuuugcugauaaacuguauaagagcaugaaaggagcgggcaccgacgagaagacacuuacgagaauuauggugucucgguccgaaaucgaucugcucaacauuagacgcgaguucaucgagaaauacgacaagagccugcaccaggccaucgaaggggauaccucuggagacuuucugaaagcucugcucgcccuguguggcggggaggauuga

SEQ ID NO: 65869 - RNA, 1401 nt, Artificial Sequence
  derived and/or modified sequence opt5 from ANXA7__Homo_sapiens__NP_001147
augagcuaccccggcuauccuccgaccggguacccgccuuuccccggauauccucccgccggccaggaguccucuuuuccuccgagcgggcaauaccccuauccuuccggauuucccccuaugggcgggggagcuuacccccaggugccgucuagcggcuauccuggcgccgggggauaccccgcgccuggcggguaccccgcucccggaggcuauccuggggccccgcagcccggaggcgccccuuccuaccccggcgucccucccgggcagggauucggcguuccgccugggggagcuggcuucucuggguauccccaaccucccagccaguccuacggaggcggcccugcccaggugccccugcccgggggauuuccuggcgggcagaugcccagccaauaucccggaggccagccuacauacccgucucagcccgcuacggugacccaggucacacaagggaccaucagaccugccgcgaacuucgacgccauucgggaugcugaaauccuccgcaaggccaugaaaggcuuuggaacagacgagcaggcuauuguggauguuguggccaauagauccaacgaccagcggcaaaagaucaaagcggccuucaagaccagcuauggcaaagaucugauuaaggaccuuaagucugaacuguccgggaauauggaggaacucauccuggcucuuuuuaugcccccuacauacuacgaugccuggagccugcgcaaagcuaugcagggagccggcacccaggagagaguccucaucgagauucugugcacgcggaccaaccaggaaauccgcgagauugugagauguuaucaaucugaguucgggcgggaccuggaaaaggauauccgcuccgacacaagcggacacuuugagagacuccugguuuccaugugccagggcaaucgggaugaaaaccagucuauuaaucaucagauggcccaagaggacgcucagcgccuuuaccaggcgggggaaggcagacugggaaccgaugagagcuguuucaacaugauccucgccacacgguccuuuccccagcugcgcgcuaccauggaagccuauagcagaauggccaaucgggaccuucugucuuccgugagcagagaguucucuggcuacgucgagagcgggcucaaaacgauucugcaaugcgcucugaaccgcccugccuucuuugcggaacggcucuauuacgcuaugaagggagccggcacagacgauuccacccuggugagaaucguggucacacgcucugagaucgaccuuguucagauuaaacagauguucgcccagauguaucaaaagacccuggggaccaugaucgcuggagauacaagcggcgacuaccggagacuccugcuugccauuguggggcaguga

SEQ ID NO: 65870 - RNA, 984 nt, Artificial Sequence
  derived and/or modified sequence opt5 from ANXA8__Homo_sapiens__NP_001035173
auggccugguggaaaagcuggaucgagcaggaaggcgugaccgucaaauccucuagccacuucaaccccgacccugaugcugagacacuguacaaggccaugaaagggauuggaacgaaugaacaagcgaucauugacguucucaccaagagauccaacacacagcggcagcagaucgcuaaaucuuuuaaggcccaauucggcaaggaucugaccgagacacuuaaaagcgaacuguccgggaaguuugagcgccucauuguggcccugauguauccgcccuacagauaugaggcuaaagaacuucaugacgccaugaagggacugggcaccaaagagggggugaucaucgaaauucucgcuucucggacaaagaaucagcugcgcgagaucaugaaggccuacgaggaagauuauggaagcucccuggaggaagacauucaggcggauaccagcggcuaccucgagagaauccuggucugccuucugcagggcucucgggacgauguguccagcuucguugacccugggcucgcccugcaagaugcucaggaccuuuaugccgcuggagaaaagauucgcggcacggaugagaugaaguuuaucaccauucuguguacaagaucugccacccaccuccugcggguguucgaggaauacgagaaaaucgcgaacaaguccaucgaagacagcauuaaaucugagacacaugggucccuggaagaggccaugcucaccgucgugaagugcacgcagaaucugcacagcuacuuugcugagcgccuuuauuacgccaugaaaggagcuggcacaagagacgggacccugauccggaacauuguuucccgcucugaaaucgaucucaaucugauuaagugucauuucaagaaaauguauggaaagacacuuagcuccaugaucauggaggacaccagcggcgauuacaaaaacgcccugcucucucuggugggcuccgaccccuga

SEQ ID NO: 65871 - RNA, 984 nt, Artificial Sequence
  derived and/or modified sequence opt5 from ANXA8L1__Homo_sapiens__NP_001092315
auggccugguggaaggcuuggaucgagcaggaaggcgugaccgucaaaagcuccucucacuucaaccccgacccugaugccgagacacuguacaaggcgaugaaagggauuggaacgaaugaacaagcuaucauugacguucucaccaagagaagcaacacacagcggcagcagaucgccaaauccuuuaaggcccaauucggcaaggaucugaccgagacacuuaaaucugaacugagcgggaaguuugagcgccucauuguggcucugauguauccgcccuacagauaugaggccaaagaacuucaugacgcuaugaagggacugggcaccaaagagggggugaucaucgaaauucucgccucccggacaaagaaucagcugcgcgagaucaugaaggcguacgaggaagauuauggaucuagccuggaggaagacauucaggccgauaccuccggcuaccucgagagaauccuggucugccuucugcagggcagccgggacgaugugucuuccuucguugacccugcucucgcccugcaagaugcucaggaccuuuaugccgcgggggagaaaauucgcggaacggaugaaaugaaguuuaucaccauucuguguacaagaagcgccacccaccuccugcggguguucgaggaauacgagaaaaucgcuaacaagucuaucgaagacuccauuaaaagcgagacacauggcucucuggaagaggccaugcucaccgucgugaagugcacgcagaaucugcacuccuacuuugcugagcgccuuuauuacgccaugaaaggggccggaacaagagacggcacccugauccggaacauuguuagccgcuccgaaaucgaucucaaucugauuaagugucauuucaagaaaauguaugggaagacacuuucuagcaugaucauggaggacaccuccggagauuacaaaaacgcucugcucagccuggugggcucugaccccuga

SEQ ID NO: 65872 - RNA, 2067 nt, Artificial Sequence
  derived and/or modified sequence opt5 from AOAH__Homo_sapiens__NP_001170977
augcagagccccuggaagauccugaccguggccccucucuuccugcuucugucccuccagucuagcgcuuccccggccaacgacgaucagucuagacccagccuguccaauggccacacaugcgucggguguguucuuguggugucugucauugagcagcuggcucaggugcauaacagcacgguucaggcguccauggaacggcucugcagcuaccugccugagaaacuguuucucaagaccacauguuaucuggugaucgacaaauucggaucugauauuaucaaacuucuguccgccgacaugaaugccgaugucgugugccacacccucgaauuuuguaagcaaaacacaggccagccccugugccaucuuuacccucugcccaaggagaccuggaaguucacacuccagaaagcucgccaaauuguuaagaaaagcccuauccugaaguauucuagauccgggagcgacaucuguucucugccggugcucgccaaaauuugccagaagaucaagcuggcuauggaacaguccguccccuuuaaagauguggacagcgauaaguacuccguguucccuacccuucggggauaucacuggcgcggcagagacuguaaugauucugacgagagcgucuaccccgggcggcgcccuaacaauugggauguucaucaggacuccaacugcaauggaauuuggggcguggaccccaaagauggcgugccguaugagaagaaauuuugugaagggagccaaccuagaggaaucauucugcucggcgacucugccggggcgcacuuccacaucucccccgaguggauuacggccagccagaugucucugaacagcuuuaucaaucuuccuaccgcucugacaaacgaacucgauuggccccagcuguccggagccaccggcuuccuggacucuacagucgggaucaaggagaaaagcauuuaccuccggcuguggaagcgcaaucauugcaaccacagagauuaccaaaauaucucccggaacggagcuagcucucgcaaccuuaagaaauuuauugagucccugagcagaaauaaggugcucgacuaucccgccaucguuauuuacgcgaugaucggcaacgaugugugcucuggcaaauccgacccugucccggccaugaccacgcccgaaaagcuguauagcaaugugaugcagacacuuaaacaucugaacucccaccucccuaaugggucucacguuauccuguacggacugcccgauggcaccuuccucugggacaaccugcauaaucgguaucacccucuugggcagcugaacaaggauaugacauacgcucagcucuauagcuuucugaauugucugcaagugucccccugccauggauggaugucuagcaacaagacccuucgcacccucacauccgagagagccgaacagcugagcaauacgcugaaaaagauugcugccucugagaaauucaccaacuucaaucucuuuuacauggacuucgccuuucacgaaaucauucaggaguggcagaagcggggcgggcaaccguggcagcugaucgagccugucgacggauuccaucccaacgaaagaaaauccauucuucugaagggcauccucaugacaagccagacccuggauaaucaggaguggacacaacugaccucuuggaucaagggcaaccuuacgugugacucccgcacacgggaauggcucugcuguugcuggagaauuaucagcgggaaacgcuguucuagcuccggaccuaagagcugggagcggcgcauuagaucuacaccccggcugaacagaugccuggaaaccaaagcuggcaccgagccucuccgcuccaugcaccccuggggagcgcaagggggccgggggcugggcaaacuuaucccgcagacccuguggggacucccuagacaccgccccaagggccuguuuuucagcuccauuuuugccaagugucugucucuuaaugaggaacauaucuggacaacggugcagugcuguguccuccccgggagcgugacccugccucuguuccucaaguga

SEQ ID NO: 65873 - RNA, 2313 nt, Artificial Sequence
  derived and/or modified sequence opt5 from AOC1__Homo_sapiens__XP_011514310
augcccgcccugggcugggcuguggccgcgauccucaugcugcagaccgcuauggccgagccuagcccggggacacuucccagaaaggccggagucuucuccgaccugucuaaccaagaacucaaagcuguucacagcuuucugugguccaagaaagagcuucggcugcagccuucuagcacgaccacaauggccaagaauaccguguuccucauugaaaugcugcugcccaaaaaguaccaugugcuccgcuuucuggauaagggcgagagacacccuguccgggaagcucgcgccgugaucuucuuuggggaccaggagcaucccaacguuacagaguucgcggugggaccucuuccgggccccugcuauaugagagcccuguccccucggcccggguaccagucuagcugggcuucccgcccuauuagcaccgccgaauaugcucuccuguaccacacacuucaagaggccaccaaaccccugcaucaguuuuuccucaauacgaccggauuuucuuuccaggauugucacgacagaugccuggcguuuacagaugucgccccgcggggcguggcuuccggccagcgcagaagcuggcugaucauucaacgguauguugaaggguacuuccuccacccuaccggacuggagcuucugguggaccauggcucuacagaugccgggcacugggcugucgaacaggugugguauaacggaaaguuuuacggcucccccgaggagcucgcccgcaaauacgccgacggggaaguggaugucguugugcuggaggacccucuucccggaggcaagggccaugauagcaccgaggaacccccucuguucucuucccacaaaccgagaggggacuuccccagcccuauccacguguccggaccccggcucguccagccucauggcccccgcuuuagacuggaggggaaugcugugcuguauggaggcuggucuuucgcguuucggcucagaagcuccagcgggcugcagguucuuaacgugcacuucggaggcgaacgcaucgccuacgaggucucugugcaagaagcuguugcccuguauggcgggcauacgccggccggaaugcagacaaaguaccucgaugugggcugggggcugggauccgucacccacgagcuugcuccuggcauugacugucccgaaacagccaccuuucuggacaccuuccauuauuacgaugcggacgauccugugcacuauccccgggcucucugccuguuugagaugccuacaggggucccccugagacgccacuucaauagcaacuuuaagggcggauucaauuuuuacgccggccucaaaggacaggugcugguucuucggacgaccucuacaguguacaacuaugacuacaucugggauuucaucuuuuauccgaauggggucauggaggccaagaugcaugcuaccggcuacgugcacgccacauucuauaccccugaagggcugagacauggaacgcgccuccacacacaccugauuggcaacauucauacccaccugguucauuaccggguggaccuugaugucgcugggaccaaaaauagcuuccaaacacuccagaugaagcuggagaacaucaccaaucccuggucccccagacaccgcguggugcagccuacacuggaacagacgcaauauucuugggagcggcaggccgcguuuagauucaaacgcaagcucccgaaauaccugcuuuuuaccagcccccaggaaaacccuuggggccauaagcggacauacagacugcagauucacuccauggccgaccaaguucugcccccuggauggcaggaggagcaggcuaucaccugggcccggacagaaggcgggcagccccgcgcucucagccaagccgcgucuccuguccccggaagauauccgcuggccgugaccaaguaccgggaguccgaacuuuguucuagcuccaucuaucaccagaacgauccuuggcaucccccuguggucuucgagcaguuucuccacaauaacgagaauauugaaaacgaggaccugguggcuuggguuacggugggcuuccugcauaucccccacagcgaagauauuccgaauaccgccacaccugggaacuccgucggauuucuccugagacccuucaacuuuuucccugaggaccccucucuugcuagccgcgacaccgugaucguuuggccccgggauaauggcccuaauuacgugcagagauggauuccggaagaccgcgauugcuccaugcccccucccuuuucuuauaacgggacauacagaccugucuga

SEQ ID NO: 65874 - RNA, 2190 nt, Artificial Sequence
  derived and/or modified sequence opt5 from AOC2__Homo_sapiens__NP_001149
augcaccugaagaucgugcucgccuuccuggcucuuagccugauuaccaucuuugcccucgcguacguccugcuuacaucccccggcgggucuagccagccuccgcauugccccuccguuucucacagagcucaaccuuggccccauccuggacagagccagcuguucgccgaccucucccgggaggaacugacggccgugaugcgcuuucugacccagagacucggccccgggcugguggaugcugcccaagcucagccuucugacaacuguauuuucagcgucgagcuucagcugccgcccaaagccgcggcccucgcucaccuggaucggggauccccucccccugcccgcgaagcucuugccaucgugcuguuuggcgggcagccccaaccgaauguuagcgagcucguggucggaccucugccccauccuucuuauaugagagacgugacaguugaacggcacggcggcccccugcccuaccaccgcagaccugugcuccgggcggaguucacccagauguggcgccaucugaaggaggucgaacuuccgaaagcccccauuuuucuguccagcacauucaacuauaaugggucuacccucgcugccgugcacgcuacaccuagaggacugcgguccggcgaucgcgccaccuggauggcccuuuaccauaacaucagcggggugggacuguuucuccaccccgucggccuggagcugcuccuggaccacagagcucuugauccugcgcauuggacgguucaacagguguucuaucuggggcacuacuaugccgaccucggacagcuggaacgggaguuuaagucuggccgccuugagguggucagagugccccugccgccucccaauggcgcuuccagccuccgguccagaaacucuccugggccccugccuccccugcaguucagcccgcagggaucccaauacagcguucagggcaaucucguggucucuucccuguggagcuuuaccuucgggcauggaguguucucuggccuucgcaucuuugauguucgguuccagggggaaagaauugccuacgaggugagcguccaggaaugcguguccaucuauggagccgacucuccuaaaacaaugcugacccgcuaccucgauagcuccuuuggccugggccggaacagcagagggcugguccgcggaguggacugucccuaucaagcuacaaugguugauauucacauccuugugggcaagggggccguccagcuccugcccggagcggugugcguuuucgaggaagcucagggccugccucuccggagacaucacaauuaccugcagaaccacuuuuaugggggccuugccucuuccgcccuggugguccgcagcgugucuuccgugggaaauuacgacuauauuugggacuucguucucuacccgaacggcgcucuggaggggcggguccaugccaccggauacaucaauacggcuuuucugaagggcggggaggaaggacuucucuucggcaacagagugggggagcgcgugcugggcacaguccacacccaugccuuucacuucaaacuggaucucgacguggcgggacugaagaauuggguuguggccgaagaugucguguuuaaacccguugcugccccuuggaaccccgagcacuggcuucaacggccucagcugacaagacaggugcucggcaaggaagaccugaccgcuuucagccuggggucuccccuuccucgguaucucuaccuggccuccaaccagaccaaugcguggggacaucaacgcggcuaucagcuggucgugacacagagaaaagaggaggaaagccaguccucuagcauuuaccaccaaaacgauaucuggacgcccaccguuacauuugccgacuucaucaauaacgagacccuccugggggaagaucuuguggcuugggucacagccuccuuccugcauauuccgcacgcugaggacaucccuaauaccgugacgcucggaaaccgggugggcuuucugcugagacccuauaauuucuuugaugaagacccuagcauuuucucucccggguccgucuacuuugagaagggccaggaugccggacuuuguagcaucaacccgguugccugccucccugaccuggcugcgugugugcccgaccugccucccuucucuuaucauggcuuuuga

SEQ ID NO: 65875 - RNA, 2292 nt, Artificial Sequence
  derived and/or modified sequence opt5 from AOC3__Homo_sapiens__NP_003725
augaaccagaagaccauccuggugcuccugauucuugccgucaucacaauuuucgcucugguuugcgugcuccuggugggcagagggggagacggcggggagcccagccaacuuccucacuguccguccgucucucccagcgcccagccuuggacgcaucccggacagucccagcuguuugcggaucucucucgggaagaacugaccgcugugaugcgcuuccugacacaaagacucggcccugggcugguugacgccgcccaggcucggcccagcgauaauugcguguuuuccgucgaacuucagcugccuccgaaagccgcugcccucgcgcaccuggaccgcggaucucccccucccgccagagaggcucuugccaucguguucuuuggccggcagccucaacccaacguuagcgaacugguggucggcccgcucccucaucccuccuacaugcgcgaugugaccguggagagacacgggggaccucugcccuaucaucggcgccccguccuguuccaggaguaccucgacauugaucagaugaucuuuaauagagaacugccucaggcuagcggccuucugcaccacuguugcuucuauaagcaucgggggcgcaaccucguuacaaugaccacagccccgagaggacugcaaucuggcgaccgggcgaccugguuugggcuuuacuauaauaucuccggagccggcuucuuucugcaccaugugggccucgagcugcuggugaaccacaaagcucucgaucccgcccgcuggacgauucagaaggucuucuaccaggggagauauuacgacagccuggcucaacuugaagcccaguuugaggccggacuggugaauguugugcucaucccugauaacggcaccgggggaucuuggucccugaaaagccccgucccucccggcccggcuccuccccuucaguucuacccucaggggccccgguucucugugcaaggauccagaguugcgagcucccuguggacauuuucuuucggccucggcgccuuuagcgggccucgcauuuucgacgugcgguuucagggagagagacuggucuaugaaaucucccugcaggaggcucucgccauuuacggcgggaauagccccgccgcuaugaccacacgcuauguggauggaggcuucgggaugggcaaguacaccacgccgcugacacggggagucgacuguccuuaucuugccaccuacguggacuggcacuuucugcucgaaucucaggcgcccaagacaaucagagaugcuuucugcguuuuugagcaaaaccagggccugccccugcgccggcaucacuccgaccuuuauagccauuacuucgggggacucgccgaaaccgugcuggucgugagaucuaugagcacccugcucaauuacgauuauguuugggacacaguguuucacccuuccggcgccauugagauccgcuucuacgcuacgggguauaucucuagcgccuuucuguucggagcuaccggcaaauacgggaaccaggucuccgagcauacacuuggcaccgugcacacacacagcgcccauuucaagguggaucuggacguugcgggacucgaaaauugggucugggccgaggauaugguguuugugccgauggcuguccccuggucuccugaacaccagcugcaacggcuucaggugaccagaaaacugcucgagauggaggagcaggccgcuuuccugguuggcuccgccacgccccgcuaucuguaccucgcgagcaaccauucuaauaagugggggcacccucggggauaucggauucagaugcuguccuuugccggcgagccccuuccucaaaacagcuccauggcuagaggguucucuugggaacgcuaccagcuggccgugacacagagaaaagaggaggaacccagcuccucuagcgucuuuaaccaaaaugacccgugggcuccuaccguggauuucuccgacuuuaucaacaaugaaaccauugccggaaaggaucucguugccugggugacagcuggcuuccugcacaucccccaugcggaggacauuccuaacaccgucacaguggggaauggcguuggauuuuuccugcggcccuacaacuuuuucgacgaggauccgagcuuuuauucugccgacuccaucuacuucagaggcgaucaggacgcuggggccugugaagugaauccucuugccugccucccccaggcugccgcgugugcuccugaucugcccgccuucagccacggaggcuuuucucauaacuga

SEQ ID NO: 65876 - RNA, 4017 nt, Artificial Sequence
  derived and/or modified sequence opt5 from AOX1__Homo_sapiens__NP_001150
auggacagagccagcgagcuccuguucuacgugaacggccggaaggucaucgaaaagaauguugaucccgagaccaugcugcuuccuuaucugcgcaagaaacucagacugacagggacgaaguacggaugcggcgggggaggcuguggggcuugcaccgugaugauuucccgguauaacccgaucacaaaacgcauuagacaccaucccgccaaugcgugucuuaucccuauuugcucucuguacggagcugccgugaccacagucgaaggcaucggcagcacccacacacggauccaucccgugcaggagcgcauugccaagugucacgggacccaaugcggauuuuguacgccuggcaugguuauguccaucuauacccuccugagaaaccaucccgaaccuacacuggaccagcucaccgaugcucuugggggaaaucugugccgguguacaggcuaccgcccgauuaucgacgccugcaagaccuucuguaaaacgucugggugcugccagagcaaggagaacggaguguguugccuggaucagggcauuaauggccuccccgaguuugaagagggguccaaaacaucuccuaagcuguucgcugaagaggaguuucuuccccuggacccuacccaagaacucaucuuucccccggagcugaugauuauggccgaaaaacagagccagagaacacgggucuucggauccgagcgcaugaugugguucagcccugugacccugaaggaacuccuggaguuuaaguucaaauauccccaggcgccuguuaucaugggcaacaccucuguggggcccgaggucaaguuuaaaggaguguuccaccccgugaucauuuccccugauagaaucgaggaacuuagcgucguuaaucacgccuacaacggccugacacucggggcuggacugucucuugcccaagugaaggacauucuggcugaugugguccagaaacucccggaagagaagacgcagauguaccaugcccugcugaaacaccucggcacccuggcgggcucccagauccggaauauggccagccuugggggacauauuaucucucgccaccccgacuccgaucugaacccuauccucgcugugggcaauuguacacugaaccuucugagcaaggaagggaagagacaaauuccccucaaugagcaguuucuguccaaaugcccuaacgccgaccugaagccccaggagauccucguuucugugaacauuccguauagccggaaaugggaguucgucuccgcuuucagacaagcccagcgccaggaaaaugcccuggcuaucgugaacagcggaaugcggguguuuuucggcgaaggggauggcauuaucagagagcuuuguaucucuuacggaggcguggggccugcgaccauuugcgccaaaaauuccugucagaaacugaucggacgccacuggaacgaacaaaugcucgacauugcuugccggcugauccugaaugaggucagccuucucggcucugcccccgggggaaagguggaguuuaagagaacacugauuaucagcuuccuguuuaaauucuaucucgaagucucccagauucugaagaaaauggacccugugcauuaccccucucuugccgauaaguaugagagcgcucuggaagaccuccacuccaaacaucacuguagcacccugaaguaccagaacaucggcccuaagcagcaucccgaggauccgaucgggcacccuauuaugcaccugucuggcguuaaacaugccacgggagaggcgaucuauugcgacgauaugccccuuguggaccaagaacucuuucugacauucgucaccuccagccgcgcucacgccaagauugugucuaucgaucuguccgaggcccucagcaugcccggcguuguggacauuaugaccgcugaacaucuguccgaugucaauucuuuuuguuucuuuacagaggccgaaaaauuccuugcuaccgacaagguguuuugcguggggcagcugguuugcgccguccucgcggauagcgaggugcaggccaaacgggcugccaagagagugaagaucgucuaccaggaccuggagccucugauccuuacaauugaagaguccauccaacacaacucuagcuucaaaccggaacgcaagcucgaguacggaaauguggacgaggcuuucaaaguuguggaucagauucuggaaggcgagauccacaugggagggcaggaacauuuuuauauggagacgcaguccaugcuggucgugcccaagggcgaagaccaagagauggauguuuacgugagcacccaguucccuaaauauauucaggacaucgucgccucuacacucaagcugcccgcgaacaaagugaugugucacguucggagaguugggggcgccuuuggaggcaagguccuuaagaccgggaucauugcugccgugacagcuuucgccgccaauaaacauggacgcgcugugcggugcguccuggaaagaggcgaggauaugcucaucaccgggggacggcacccuuaccugggcaaguauaaagcgggguuuaugaacgacggccgcauucuggcccuugauauggagcauuacuccaaugcuggagccagccucgacgaaucucuguucguuaucgagaugggccugcucaagauggauaacgccuauaaauuucccaaucugagaugucgggggugggcuugcagaacgaaccuuccuuccaacaccgccuuccgcggauuuggcuucccccaagcggcucugauuacagaaagcuguaucaccgagguggccgccaagugcgggcucucuccggagaaggugcggaucauuaauauguacaaagaaaucgaccagacaccuuacaagcaggagauuaacgcuaaaaaucugauccaguguuggagagaaugcauggccaugagcuccuauagccugcgcaaggucgcgguggagaaauuuaacgcugaaaauuacuggaagaagaaaggacuugccaugguuccccugaaguucccugugggccucggcucuagagccgcugggcaagccgcugcccugguccacauuuaucucgauggauccgugcugguuacccacggcgggaucgagaugggacagggcgugcauacgaaaaugauucaggucgugagccgggagcuucgcaugcccauguccaacguucaccugagagggacaucuaccgaaacagugccgaaugcgaacaucagcggaggcuccgucguggccgaccucaauggccuggcugugaaggaugccugucagacccugcuuaaacggcuggagccuaucauuucuaagaaccccaaggggaccuggaaagacugggcucaaacagccuuugacgaaagcaucaaucucuccgccgucggauacuuccgcggcuaugagucugauaugaacugggaaaagggggagggacagccuuucgaguacuuuguuuauggcgcugcgugcagcgaaguggagauugacugucugacgggggaucauaaaaauaucagaaccgacauugugauggaugucggaugcuccaucaaccccgccaucgacauuggccagaucgaaggcgcuuucauucaggggaugggacucuacacaaucgaggaacugaauuacagcccccaaggcauucuucacacccgggggccugaucaguauaagaucccggccaucugcgacaugcccacagagcugcauauugcccuccugccucccucucagaacuccaacacccuguacagcucuaaaggacuuggcgaguccgggguguuucugggauguagcguuuucuuugcuauccacgaugccgugucugcggcucgccaagaaagaggccuccacggcccucugacgcucaauagcccccugacaccugagaagauucggauggccugcgaagacaaauucaccaagaugaucccgcgcgaugagcccggguccuaugucccuuggaacgugcccauuuga

SEQ ID NO: 65877 - RNA, 810 nt, Artificial Sequence
  derived and/or modified sequence opt5 from AP1AR__Homo_sapiens__NP_001121898
augggcaacugcuguuggacccagugcuucgggcugcucagaaaggaggccggacggcugcaacgcgugggcgggggaggcgggagcaaauacuuuagaacauguucccggggagaacaccuuacgaucgaguucgaaaaucuggucgagucugacgaaggcgagagccccggcuccucucaucgcccucucaccgaggaagagauuguugaucugagagaacggcacuaugacagcaucgcugagaagcagaaagaucuugacaagaaaauucagaaggagcaggaacgccaaagaaucgugcagcaguaccauccguccaacaauggggaguaucagucuagcggacccgaagaugacuuugaguccugccugcggaacaugaagucucaauacgaaguguucagaucuucccgccucagcucugaugccacaguccugaccccuaauacagaguccagcugugaccugaugaccaaaacaaagucuaccuccggcaacgaugacagcacgucccucgaucuggagugggaagacgaggaagggaugaaucggaugcuucccaugcgcgagagaucuaaaaccgaagaggauauucugcgggcggcucucaaguauagcaacaaaaagacaggauccaauccuaccagcgccucugacgacuccaacggccuggagugggaaaaugauuuugugagcgccgagauggacgauaacgggaauagcgaauacagcggauucguuaaccccgugcuugagcuguccgacucuggcauccgccacagcgauacagaccagcagaccagauga

SEQ ID NO: 65878 - RNA, 2760 nt, Artificial Sequence
  derived and/or modified sequence opt5 from AP1B1__Homo_sapiens__NP_001159491
augaccgacagcaaguacuucacaacgaccaaaaagggcgagaucuuugaacugaaagccgagcucaacuccgauaagaaagaaaagaagaaagaggcugugaagaaagucauugccucuaugacaguugggaaggacgugagcgcgcuguuccccgauguggucaauugcaugcagaccgacaaccuugaacugaaaaagcucguguaucuguaccuuaugaauuaugcuaagucccaaccugauauggccaucauggccguuaacacauuugugaaagacugugaggauccgaauccccugauuagagcucucgccguccggaccaugggaugcauccgcguggacaagauuacagaguaccugugugaaccucugagaaaaugccucaaggaugaggaccccuauguucggaaaaccgcugccgugugugucgcgaagcugcacgauaucaacgcccagcuuguggaagaccagggcuuccuggauacgcucaaagaccugaucucugacagcaauccuaugguggucgcuaacgccguugcugcccuuuccgagauugcggagucucaucccagcuccaaucugcucgaucugaacccucagagcaucaauaagcugcucaccgcccugaacgaaugcacagagugggggcaaauuuuuauccuugacugucuggcuaauuacaugccgaaggaugaccgcgaagcccagucuauuugcgagagagugacaccccggcucucccacgcuaacagcgccgugguccugucugccgugaaaguucuuaugaaguucauggaaaugcuguccaaagaucucgacuauuacggaacccugcugaagaaacucgcuccuccccuggugacccuucugagcgcggagccugagcuccaguacgucgcccugcgcaauaucaaccuuauugugcagaagagacccgaaauccugaagcaugagaugaaaguguuuuucguuaaguauaacgauccgaucuacgucaaacucgaaaagcuggacauuaugauccggcuggcuucucaagccaauauugcccaggugcucgcugagcugaaagaauaugccacggaggucgauguggacuuuguucgcaaggcggugagagcuaucggccggugugccauuaaggucgagcaguccgccgaacgcugcgugagcacacuucuggaucucauccagaccaaaguuaacuacgugguccaagaggcuaucguggugauuaaggacaucuucagaaaauauccuaauaaguacgaauccguuauugccacacugugugagaaccuggacucucuugaugaacccgaggcucgggccgcgaugaucuggauugucggggaguaugccgaacgcaucgacaaugcugaugagcuccuggagagcuuucuggagggauuccacgacgaguccacccaggugcagcuccaacugcuuaccgccaucgugaaacuguuucucaagaagccuacagaaacgcaggagcugguccaacaggugcugagccuugcuacccaggauucugacaaccccgaucucagagaccggggcuacauuuacuggagacugcuguccacagaucccguugccgcgaaagaagugguccucgccgagaagccucugaucagcgaagagaccgaccuuauugagccgacacugcucgaugaacugaucugcuauauuggcacccuggcuucuguguaccauaaacccccuagcgccuucguugaagggggacgcggcgugguccacaagucccuucccccucggacggcuucuagcgaauccgccgagagccccgaaacagccccgaccggggcuccucccggagagcagccugacgugauccccgcgcagggcgaucuccugggggaccugcucaaucuggaccuuggaccucccguuucuggcccgccucuggccaccuccagcgugcagaugggcgcugucgaucuccuugggggaggccuggacucucugauugggggaacaaacuucguggccccucccaccgccgcugugcccgccaaucucggcgcgccgaucggguccggacugagcgaucuguuugaccucacauccggcgucggcacgcugucugggagcuauguugcucccaaagccgugggauccaucucuauggaucuucaacugaccaacaaggcccuccaggugaugacagacuucgcuauucaguuuaauagaaacagcuucggccuggccccugcggcuccccugcagguccacgccccucuuucccccaaucaaaccguggagaucagccugccucucucuacaguuggguccgugaugaaaauggaaccccugaacaaucuccaggucgccgugaagaacaacauugauguguuuuacuucagcacccuguauccgcuucauauccuguuuguugaggacggaaagauggaucgccagauguuccucgcuacguggaaagacauuccuaaugaaaacgaggcccaguuucaaauccgggauugcccccugaaugcugaagccgcgucuuccaagcugcagagcucuaacaucuucaccgucgccaaaagaaauguggagggccaggacaugcuuuaccaaagccugaagcucacaaacgggauuuggguucuggcugagcuccgcauccagccuggcaaucccuccuguacccugagccuuaaaugccgggccccggaagugucucagcacgucuaucaggcuuacgagacaauucugaagaacuga

SEQ ID NO: 65879 - RNA, 2478 nt, Artificial Sequence
  derived and/or modified sequence opt5 from AP1G1__Homo_sapiens__NP_001025178
augcccgccccuaucagacugcgggagcucauucgcaccaucagaacagcucggacgcaggccgaagagagagaaaugauucaaaaggagugcgcggcuaucagaagcuccuuccgggaagaggacaacaccuaccgcuguagaaauguggccaaacugcuuuauaugcacaugcugggcuacccggcccauuuugggcagcucgagugccugaaacuuauugcuucucagaaguucacagauaagcggaucggauaucugggcgccaugcuccugcuggacgaacgccaggauguccaccuccugaugaccaacuguaucaaaaaugaccuuaaccauagcacacaauuuguucaggggcuggcucucugcacccugggauguaugggcuccucugagaugugcagagaucuugccggggaaguggagaagcugcucaagacaagcaauuccuaccugcggaaaaaggcggcccugugugcugugcacgucauucgcaaagugcccgagcucauggaaauguuccugccugccaccaagaaccuucugaaugagaaaaaccauggaguucuccacacgucugugguccugcuuaccgaaaugugcgagagaagccccgacaugcuggcucacuuucggaagaaugaaaagcucgugccucagcugguucgcauccugaaaaaccucauuauguccggcuauagccccgagcaugaugugucuggcaucuccgacccuuuccugcagguccgcauucuucggcugcucagaauccuggggcgcaaugaugacgauagcucugaggccaugaacgacauucuugcgcaaguggccacaaauaccgaaacauccaagaacgugggaaaugcuauccuguacgagaccguccucacgaucauggauauuaaaagcgaaucuggccugcggguucuggccaucaacauucucgggagauuucugcuuaacaaugacaagaacauccgcuauguggcucugacaucccuccugaaaaccgugcagacagaccacaaugccguccagcggcauagaagcaccauuguggauugucugaaggaccuugauguuuccaucaaacgccgggccauggagcucucuuucgcucuggugaacggaaauaacaucagaggcaugaugaaggaacugcucuacuuucuggacagcugcgagccggaguucaaggcggauugugccuccgggauuuuucuugcugccgaaaaauacgcccccagcaagcgcuggcacaucgacaccauuaugcggguccugacaacggcuggaucuuaugugagagaugacgccguuccuaaucucauccagcugauuaccaacuccguggagaugcacgcguacacaguccaacgccuguauaaagcuauccuuggcgauuacagccagcagccccucgugcaagucgccgccuggugcaucggcgaauauggggaccugcuggugucuggacagugcgaggaagaggagccuauucagguuaccgaagaugaggugcucgacauccuggaaagcguccuuauuuccaauaugucuacaagcgugacccggggcuacgcucugacggccaucaugaagcucuccacaagauucaccuguaccguuaaccggauuaaaaagguggucagcaucuaugggucuuccauugacguggagcugcagcaacgcgcuguggaguacaaugcccuguuuaagaaauacgaucauaugagaagcgcgcuucucgaacggaugcccguuauggagaaggucacaaccaacggaccgacagaaaucgugcagacgaauggcgagaccgaaccugcuccccuggagacaaaaccuccucccucugggccccagccgaccucccaggccaacgaccugcucgaucugcuuggaggcaaugacaucacacccgugauuccuaccgcccccacgagcaagccuuccucugcuggcggggagcugcucgaucugcugggagacaucaaccuuaccggcgcccccgcggccgcuccggccccugcuagcgucccccaaauuucccagccucccuuccuccuggaugggcugucuagccagccucucuucaacgacaucgccgccggcauucccuccaucacagcuuauagcaaaaauggacugaagaucgaauuuaccuucgagagaucuaacacaaauccguccgugaccguuauuacgauccaggcgagcaacucuacagaacuugauaugaccgacuuuguguuccaagccgcugucccuaagacauuucagcugcagcuccugucccccagcucuagcauugugcccgccuucaauaccgggaccaucacacagguuauuaaagugcugaacccucaaaagcagcagcuucgcaugcggaucaaacugacguacaaucacaagggcuccgccaugcaagaucucgcugaggucaacaauuuuccgccccagagcuggcaguga

SEQ ID NO: 65880 - RNA, 1308 nt, Artificial Sequence
  derived and/or modified sequence opt5 from AP1M1__Homo_sapiens__NP_001123996
augagcgccuccgcuguguacguccuggaccucaagggcaaaguucugaucugcagaaacuaucggggagauguggacaugucugagguggaacacuucaugcccauucuuauggagaaggaagaggaaggaaugcugagcccuauccucgcccauggcgggguccgcuuuauguggauuaaacacaauaaccuguaccuuguggcgaccuccaagaaaaaugcuuguguuucucugguguucagcuuucucuauaaggucgugcagguuuucuccgaguacuuuaaggagcuggaagaggaaucuaucagagauaacuucgugauuaucuaugagcugcucgacgagcugauggauuuuggauacccgcaaacaacggacagcaaaauccuucaggaauauauuacccaggagggccauaagcuggaaacaggggccccgcggccucccgccaccgucacaaaugcuguguccuggcgcagcgagggaaucaaauacagaaagaacgaaguguuccucgaugucauugagucuguuaaucugcuuggcaaauacccuggcgugggguggcugggacacaccguguccgccaacggcaauguccuccggagcgagaucguggggucuauuaagaugcgcguuuuucuguccggaaugcccgaacugagacucggccugaacgacaaggugcuuuucgauaauacagggcggggaaaaagcaagucugucgagcuggaagacgugaaauuucaucagugcguucgccucuccagauucgagaacgaucggaccaucagcuuuauuccuccggacggcgaguucgagcugauguccuaucgccuuaauacgcacgugaagccccugaucuggaucgagucugucauugaaaaacacagccauuccagaaucgaguacaugauuaaggcuaaaagccaauucaagcggcgcucuaccgccaacaauguggaaauccacauuccuguccccaacgaugcggacuccccuaaguuuaaaacaaccgugggcagcguuaagugggugcccgagaacucugaaaucgucuggagcaucaaauccuuccccgggggaaaggaguaucucaugagagcccauuuuggccugccuucuguggaggcugaagacaaagaggggaagcccccuauuagcguuaaguucgaaauccccuacuuuacaaccuccgggauucaggugcgguaucugaaaaucauugaaaagagcggcuaccaggcccuccccugggucagauauaucacgcagaauggggauuaccaacugcgcacacaguga

SEQ ID NO: 65881 - RNA, 1272 nt, Artificial Sequence
  derived and/or modified sequence opt5 from AP1M2__Homo_sapiens__NP_005489
augagcgcuuccgcuguguucauccuggacgucaagggcaaaccccucauuucuagaaacuacaagggggauguugccaugagcaaaaucgagcacuuuaugccucugcuugugcagcgggaagaggaaggagcgcuggcuccgcuccugucccauggccaagugcacuuccuuuggauuaagcauucuaaucuguaucucgucgccaccacaagcaaaaacgccaaugcuucccugguguacucuuuucuguauaagacgaucgagguuuucugcgaauacuuuaaggagcucgaggaagagagcauucgcgacaacuucgugaucgucuaugaacugcuugaugagcugauggacuuuggguucccccagaccacagauuccaaaauccuccaggaguacauuacccagcaaagcaauaagcuggaaacaggaaaaucuagagugccucccaccguuacaaacgccguguccuggcggagcgagggcaucaaguauaaaaagaaugaagucuuuauugacgugaucgagucugugaaccuucuggucaaugcuaacggguccguucuccugagcgaaauugugggaaccaucaagcugaaaguguuccucucuggcaugccugagcugcgccuuggccugaaugauagaguccucuuugagcugacggggcgguccaagaacaaaagcguggaacuugaggacguuaaguuccaccagugugugcgccuguccagauuugauaaugaccggaccauuucuuucauucccccugauggagacuucgaacucaugagcuaccgccuguccacacaggucaaaccgcugaucuggaucgagagcgugaucgaaaaguuuucucauuccagaguugagauuauggugaaagccaagggccaguucaagaaacaaagcgucgcgaacgggguggagaucucuguccccgugccuagcgaugccgacucuccccgguuuaagaccuccguuggaagcgcuaaauacgugccugaacgcaaugucgugauuugguccaucaagagcuuccccggcgggaaagaguaucucaugagagcccacuuuggacugccgucuguugaaaaggaggaaguggagggccggccucccaucggcgucaaguucgagauuccuuacuuuacaguguccgggauccaggugcgcuauaugaaaauuaucgaaaagagcggauaccaggcccuucccuggguuagauauauuacccagucuggcgacuaccaacugcggacguccuga

SEQ ID NO: 65882 - RNA, 477 nt, Artificial Sequence
  derived and/or modified sequence opt5 from AP1S1__Homo_sapiens__NP_001274
augaugagauucaugcugcucuuuagccggcagggcaagcugcgccuucaaaaaugguaccuggccaccuccgacaaggagcggaaaaagauggugagagaacucaugcaggucguucuggcucgcaaacccaagaugugcucuuuccuugaguggagagaucugaaggugguguauaaacgguacgccagccucuauuuuuguugcgcgaucgaagggcaggacaacgagcugauuacacuggaacucauccaccgcuacgucgagcugcuugauaaguauuucggauccgugugugagcuggacauuaucuuuaauuucgaaaaagccuacuuuauucucgaugaguuccugaugggcggggacguucaggauacgucuaagaaaagcgugcuuaaggcuaucgaacaagccgaccugcuccaggaggaggaugaauccccuagaucuguccuggaggaaaugggacuggcuuga

SEQ ID NO: 65883 - RNA, 483 nt, Artificial Sequence
  derived and/or modified sequence opt5 from AP1S2__Homo_sapiens__NP_001259000
augcaguucaugcugcucuuuagcagacaaggcaagcugcggcuucagaaaugguacgugccccuguccgacaaggagaaaaagaaaaucacccgcgaacucguccagacaguucuggccagaaagccuaagaugugcucuuuccuugaguggcgggaucugaaaauuguguauaagcgcuacgcuagccucuauuuuuguugcgccaucgaagaccaggauaacgagcugauuacgcuggaaaucauucacagauacguggagcuccuggacaaauauuucggguccgucugugagcuugauaucaucuuuaauuucgaaaaggcguacuuuauucuggacgaguuccuccugggaggcgaagugcaagagaccucuaaaaagaacguucuuaaggcuaucgagcaggccgaucugcuccaggaagacgccaaagaggcugaaacaccgcggagcgugcuggaggaaauugggcugaccuga

SEQ ID NO: 65884 - RNA, 465 nt, Artificial Sequence
  derived and/or modified sequence opt5 from AP1S3__Homo_sapiens__NP_001034658
augauccacuucauucugcucuuuagcagacagggcaagcugcggcuucaaaaaugguacaucacccugcccgacaaggagcgcaaaaagauuacaagagaaaucgugcagauuauccucucccgggggcaucgcacgucuagcuucgucgauuggaaagagcugaaacuuguuuauaagagauacgccucccuguauuuuugcugugcuaucgaaaaccaggacaaugagcuccugacccuggaaauugugcaccgguacguggagcuccuggauaaguauuucggaaacgucugcgagcuugacaucauuuuuaauuucgaaaaggccuacuuuauccuggaugaguucauuaucggcggggaaauucaggagacaucuaaaaagaucgcggugaaagcuaucgaggacagcgauaugcuccaagaaaccauggaggaauauaugaacaagccuacauuuuga

SEQ ID NO: 65885 - RNA, 2934 nt, Artificial Sequence
  derived and/or modified sequence opt5 from AP2A1__Homo_sapiens__NP_055018
augcccgccgugagcaagggcgacgggaugagaggacuggcugucuucaucuccgauauucggaacugcaaaucuaaggaggccgaaaucaaacgcauuaauaaggagcucgcgaacaucagaagcaaauuuaagggcgacaaggcucuggauggguacuccaaaaagaaauauguuuguaagcugcuguucauuuuucuccugggacacgacaucgauuucggccauauggaagccgugaaucuucugucuagcaacaaauacaccgagaagcagaucggguaucucuuuauuuccgugcuggucaauucuaacagcgaacugauccggcucauuaauaacgccaucaagaaugaccuggcuucccgcaacccuacauucaugugccuugcccugcacuguauugcuaaugugggaagcagagagaugggcgaggccuuugcggccgauaucccgcggauucucguugcuggcgacucuauggauuccgugaaacaaagcgccgcucugugccuucugcgccucuacaaggccucucccgaccuggucccuaugggggaauggacggcgagagugguucaucugcucaacgaucagcacaugggaguggucaccgccgcugugucccugaucacaugucuuugcaaaaagaaucccgacgauuucaaaaccugugugagccuggccgucucucggcucucccgcaucguuagcuccgcuucuacagaccugcaggacuauaccuacuauuuugugccugcccccuggcuuagcgugaagcugcucagacugcugcagugcuacccuccgcccgaggaugccgcugucaaaggccggcucguggaaugucuggagacaguucuuaacaaggcgcaagagccucccaaguccaaaaaggugcagcauagcaaugccaaaaacgcuauucuguucgaaaccaucucucucauuauccacuacgacuccgagccuaaccugcuuguccgcgccugcaaucagcuggggcaguuucuccaacacagagaaacgaaccugcgguaucuggcccucgagagcauguguacccuggcuucuagcgaguucucccaugaagccgugaagacacacauugauaccguuaucaaugcgcuuaaaacagagcgcgacgugucugucagacagcgggcugccgaucugcucuacgccaugugcgacagaagcaacgcuaagcagaucguguccgaaaugcugcgcuaucuggagaccgccgauuacgcuauucgggaagagaucguccuuaagguggccauucucgcggaaaaauaugccguugacuacagcugguauguggauacgauccugaaucugauuagaaucgcuggagacuacgucucugaggaggugugguaccgcguucuccagaucgugacaaaccgggaugacguccaaggcuaugccgcuaagaccguguuugaagcccugcaggcgcccgccugccaugagaauauggugaaaguugggggauacauucuuggcgaguucggcaaccugaucgcuggggacccgagauccagcccucccguccaguucucucuccugcacuccaaguuucaccuguguagcguggccacacgcgcccuucuccuguccaccuauauuaaauucaucaaucuguuuccugaaaccaaggcuacaauucaaggagugcuccgggccggcucucagcugagaaacgcugaugucgaacuucagcagcgcgcgguggaguaccugacgcucagcuccguugccucuaccgacgugcuggcuacaguccuggaggaaaugccucccuuccccgagcgggaaagcuccauccuugccaagcucaaaagaaagaaagggccgggagccggcagcgcucuggaugacgggcgccgggaucccucuuccaaugacauuaacggaggcauggagccuacccccagcacagugucuaccccuucccccagcgccgaucugcucggccugagagcggcuccgccucccgccgccccucccgcuucugccggggcgggaaaucuucugguugacguguuugauggcccugcugcccaacccagccucgggccgacgccugaggaagccuuccuguccgagcuggaaccucccgcucccgagagcccgauggcccuucucgcugaccccgccccugcggccgaucccggaccugaagacaucgggcccccuauccccgaggcugaugagcugcugaacaaguuugucugcaaaaauaacggcguucucuucgaaaaccagcugcuucagauuggcgugaagucugaguuucggcagaaucugggacgcauguaucucuucuacggcaacaagacauccgugcaauuucagaauuucagcccgaccgucgugcauccuggggaccugcagacccagcuggccgugcaaacaaaaagagucgcugcccagguugacggaggcgcccaggugcagcaagugcuuaacaucgaaugucugcgggauuuucucacacccccucugcucuccgucagauuccgcuaugggggagcuccccaggcgcugacccuuaagcugccggugacgauuaauaaauucuuucagccuaccgagauggccgcucaagacuucuuucagcgguggaagcagcucucucugccccagcaagaagcccagaaaaucuucaaggccaaccacccuauggaugcugagguuacaaaagccaagcugcuuggcuuugggagcgcgcugcucgacaauguggaucccaaccccgagaauuucgucggcgcuggaauuauccagaccaaggcccuucaggugggcugccuccugagacuugaaccuaacgcccaagcucagauguaccgccugacacucagaaccuccaaagagccgguuucucggcaucugugugaacugcuugcccagcaguuuuga

SEQ ID NO: 65886 - RNA, 2856 nt, Artificial Sequence
  derived and/or modified sequence opt5 from AP2B1__Homo_sapiens__NP_001025177
augaccgacagcaaguacuucacaacgaacaaaaagggcgagaucuuugaacugaaagccgagcucaauaacgaaaagaaagagaagagaaaggaagcugugaaaaaggucauugccgcgaugaccguugggaaagauguguccucucuguuccccgacguggucaauugcaugcagacagauaaccuugagcugaagaaacucguguaucuguaccuuaugaauuaugcuaagagccaaccugacauggccaucauggccguuaacuccuuugugaaggauugugaggacccgaauccccugauucgggcucucgccguccgcaccaugggaugcaucagaguggauaaaauuacagaauaccugugugagccucugcggaagugccucaaagacgaagaucccuauguucgcaagaccgcugccgugugugucgcgaaacugcacgacaucaacgcccagaugguggaggaucagggcuuccuugacucucugagagaucucaucgcugacagcaauccuaugguggucgccaacgcuguugccgcgcuguccgagauuucugaaagccaucccaauuccaaccuucuggaccucaauccucagaacaucaauaagcugcugacagcccucaacgagugcaccgaaugggggcaaauuuuuauccuggauugucuuagcaacuacaauccgaaagacgaucgggaggcucagucuauuugcgaacgcgugacgcccagacugucccacgccaacagcgcugugguccucucugccgugaagguucugaugaaguuccuugagcugcucccuaaagacuccgauuauuacaauaugcugcugaagaaacucgcucccccucuggugacccuucugagcggagagcccgaaguccaguacguggcccuccggaacaucaaucugauuguucagaagcgcccggagauccuuaaacaagaaaucaagguguuuuucgucaaguauaacgacccuauuuacgugaaacuggagaagcucgauaucaugauuagacuggcgucucaggccaauaucgcucagguccuggccgaacucaaagaguaugccacagagguggacguugauuuugugcggaaggcuguccgcgccauuggcagaugugcgaucaaaguggaacaguccgcugagcggugcguuagcacccugcuugaccugauccaaacaaaggugaacuacgucgugcaggaagccauugugguuauccgcgauauuuucagaaaguaucccaauaaauacgaguccaucauugccacccucugugaaaaccuggacucucuggacgagccugaugcucgggccgcuaugaucuggaucgucggggaguaugccgaaagaauugacaaugcggaugagcuucucgagagcuuucuggaaggauuccaugacgaguccacccaggugcaacugacacuccugaccgccaucgugaaacuuuuucugaagaagcccagcgaaacacaggagcucguccaacaggugcugucucuggcuacccaggauuccgacaaccccgaucuucgcgaccggggcuacauuuacuggagacuccugagcaccgauccuguuacagccaaagaagugguccugucugagaagccgcucaucagcgaagagacggaccugauugagcccacccuucuggaugaacucaucugccacauuggcucccuggcuucuguguaucauaagccucccaaugccuucguugaggggagccacggaauccaccgcaaacaucugccuauccaccauggcuccacagacgcgggggauagccccgugggaaccacaaccgccacgaaccuugaacagccgcaggucauuccuucucagggcgaccuccugggggaccugcucaaucuggaucuuggacccccugugaacguuccccaaguguccagcaugcagaugggcgcugucgaccugcucggcgggggacuggauucucugcuuggcuccgaccucgggggaggcaucgggggaagcccugccgugggccaguccuucauucccucuagcgugccggcuacauuugccccuucccccacccccgccgucguuucuagcggccugaacgaucuguucgagcucuccaccgggaucggaauggcuccuggcggguacguggcgccgaaggccguguggcugcccgcugucaaagccaagggacuugaaauuagcggcacauuuacccaccggcaggggcacaucuauauggagaugaauuucacaaacaaagcccugcaacauaugacggacuuugcuauccaguucaauaagaacucuuuuggcgugauuccuuccacgccccucgccauccacacaccucugaugcccaaucagagcauugauguuucucugccucuuaacacccugggacccgugaugaaaauggagccgcucaauaaccugcaggucgcggugaagaauaacaucgacguuuucuacuuuuccugccucauuccucugaaugugcuuuucgucgaagauggcaagauggagagacaaguguuucuggcuacauggaaagacauccccaacgaaaaugagcuccaguuccagaucaaggaaugucaucugaacgccgauaccguuagcucuaaacugcaaaauaacaacguguauacgauugccaagcgcaaugucgaggggcaggacaugcuuuaccagagccugaaacucaccaacggaaucuggauucuggcugagcuccggauccagccuggcaaucccaacuauacacugucccuuaagugcagagccccggaagugagccaauacauuuaccagguguaugauucuauccugaagaauuga

SEQ ID NO: 65887 - RNA, 1302 nt, Artificial Sequence
  derived and/or modified sequence opt5 from AP2M1__Homo_sapiens__NP_001020376
augaucggcgggcuguucauuuacaaccacaagggagaggugcucaucagcagagucuaucgggacgauauuggccgcaaugccguugacgcuuuuagagugaacgugauccaugcccggcagcaaguccgcucccccgugaccaauauugcgagaacaucuuucuuucacguuaaacggagcaacaucuggcuggcugccgugacgaagcagaaugucaacgccgcuaugguguucgaauuucuuuacaaaaugugcgauguuauggccgcuuauuucgggaagaucuccgaggaaaauauuaaaaacaauuuugugcugaucuacgagcuccuggacgaaauucuugauuucggauauccucagaacucugagaccggcgcccugaagacauuuaucacccagcaagggauuaagagccagacaaaagaggaacagucccagaucaccucucaagucacaggacagauuggcuggcgcagagagggcaucaaguaccggcgcaaugaacucuuccuggacgugcuggagagcgugaaccuccugauguccccgcaggggcagguccuuagcgcgcauguuucuggaagaguggugaugaaauccuaucugagcggcaugcccgaguguaaguuugggaugaaugauaaaaucgucauugaaaagcaaggaaagggcaccgccgacgagacgucuaaauccgggaagcagagcaucgcuauugaugacugcaccuuccaccagugugugcggcucucuaaauuugauuccgaacgcagcaucuccuucauuccucccgacggagaguucgaacugaugagauaccggacaaccaaggauaucauccuuccuuuucgcguuauuccccuggugagagaggucggccggacaaaacucgaggugaagguugugaucaaaucuaacuucaagccuagccugcuggcccaaaagauugaagucagaaucccgacgccccucaauaccuccggcgugcaggucauuugcaugaaagggaaggcuaaauacaaggccagcgagaacgcgaucguguggaaaaucaagcgcauggccggaaugaaggaaucucagauuuccgcugagaucgaacugcuuccuacaaacgacaaaaagaaaugggcccggcccccuauuagcaugaauuuugagguucccuucgcuccgucuggccugaaggugagauaucucaaagucuuugagccuaagcugaacuacagcgaccaugaugugaucaaguggguucgcuauauugggcgguccggaaucuacgaaaccagauguuga

SEQ ID NO: 65888 - RNA, 429 nt, Artificial Sequence
  derived and/or modified sequence opt5 from AP2S1__Homo_sapiens__NP_004060
augaucagauucauucugauccagaaccgggccggcaagacccgccucgcuaaaugguacaugcaauuugacgaugacgagaagcagaaacugauugaagaggugcacgccgucguuacagugagagaugcgaagcauacgaauuucguggaauuucggaacuucaaaaucauuuaucgcagauacgcugggcuuuauuuuugcaucugugucgacgugaaugauaacaaucuggccuaccucgaggccauccacaacuucguugaagugcugaaugaguauuuucauaacgucugcgagcuugaccugguguucaauuuuuacaagguuuauaccguggucgaugaaauguuccucgcuggagagauucgggaaacaagccagaccaaggugcugaaacagcugcucaugcugcaaucccuugaguga

SEQ ID NO: 65889 - RNA, 3138 nt, Artificial Sequence
  derived and/or modified sequence opt5 from AP3B1__Homo_sapiens__NP_001258698
augcuggagagcaacaaggacuccgccaaacucgaugcuaugaagagaaucgugggcaugauugccaaagggaagaaugcgucugaacuguuccccgcugucguuaaaaacguggccagcaagaauaucgagauuaagaaacuuguguacgucuaucuggugcgguacgccgaggaacagcaagaccucgcucugcuuuccaucucuaccuuucagcgcgcccugaaggauccuaaccagcucauuagagcuagcgcccugcggguucuguccucuauccgcgugccgaucauuguccccaucaugaugcucgcgauuaaagaagccagcgcugaccuguccccuuaugugagaaagaaugccgcucacgccauccagaaacuuuacagccuggaucccgagcaaaaggagaugcucauugaaguuaucgagaagcugcuuaaagacaagucuacacugguggcgggauccgucgugauggccuucgaagaggugugcccugaucggauugaccucauccauaaaaacuaucgcaagcuguguaaucugcucgucgauguugaggaauggggccagguggugaucauucacaugcugacgagauacgcucggacccaguuugucagccccuggaaagagggggacgaacuugaggauaacggaaagaauuucuaugaaucugacgaugaccagaaagagaagacagacaagaaaaagaaaccuuacaccauggauccggaccaucgccugcucaucagaaacacaaagccccugcuucaaucccggaaugccgcugugguuauggccguggcccagcuguacuggcacauuagcccuaaaucugaggcuggcaucauuuccaagagccucguccgccugcugagauccaaccgggaagugcaguauaucguucuccagaauaucgcgaccaugucuauucaacgcaaggggauguuugagcccuaccugaaaucuuucuaugugagauccacagauccuaccaugaucaagacgcuuaaacuggaaauucucaccaaccuggccaaugaggcuaacaucagcacacuucugcgggaauuucagaccuacgucaagucucaggacaaacaauucgccgccgcuacaauucagaccaucggaagaugcgccacgaacauccucgaggugacagauaccugucugaauggccuggucugccuccuguccaaccgcgacgagauugugguugcggaaagcguggucgugaucaagaaacuucugcagaugcagcccgcucaacauggcgagauuaucaagcacauggccaagcuccuggauucuauuacaguuccgguggcccgggcuagcauccuguggcuuauuggggaaaauugugagagagucccuaaaaucgcccccgacgugcuccgcaagauggcuaaauccuuuaccucugaagaugaccuggugaagcugcagauccucaaccugggagccaaacuuuaucugaccaauagcaagcagacaaagcuccugacgcaguacauucugaaccuuggcaaauaugaucaaaauuacgacauccgggacagaacccgcuucauucggcagcucaucguuccuaacgucaaguccggggcgcugagcaaauacgccaagaaaauuuuucuggcucagaagcccgccccucuccuggagucuccuuucaaggauagagaccacuuucagcuuggaacacugucccauacccucaauaucaaagcuacaggcuaucuggagcugagcaacuggccggaaguggcccccgauccuucugugcgcaaugucgaggugaucgaacuugcgaaggaguggacccccgccgggaaagcuaagcaagagaacuccgccaaaaaguucuacagcgaauccgaggaagaggaagacucuagcgauuccucuagcgacuccgagagcgagucuggauccgaaagcggcgagcagggcgaaucuggggaggaaggagauuccaaugaggacagcucugaggauagcuccagcgaacaggacucugaguccggccgggaaagcgggcucgagaacaagagaacggcuaaacgcaauuccaaggccaaaggaaagucugauagcgaagacggcgagaaagagaacgaaaaguccaagacaucugauagcuccaacgacgagucuagcuccauugaagacagcagcuccgauagcgagucugaguccgaaccugagagcgaaucugagucccggagaguuaccaaagaaaaggagaaaaagaccaaacaggaccggacaccccugaccaaggaugugagccugcucgaccuggaugacuucaauccggucuccacaccuguggcccuucccacgccugcucugagccccucucucauggcggaucuggaggggcugcaccuuagcaccuccucuagcguuaucuccgugucuacacccgccuuuguccccaccaagacacaugugcuccugcaccgcaugagcggaaaaggccuggcugcccacuauuucuuuccgagacaaccuugcauuuucggcgacaagaugguuuccauccagauuacccucaacaauacgaccgaucggaaaaucgaaaacauccauauuggggagaagaaacugcccaucggaaugaagaugcacguguuuaaucccauugacucucuugaaccugagggcagcaucacagucuccauggggauugauuucugugacagcacccagacagccucuuuucaacugugcaccaaagaugacuguuucaacgugaauauccagccgcccgugggagaacuccugcugccugucgcuauguccgagaaggacuuuaagaaagagcagggcguucuuacggggaugaacgaaacaagcgccgugaucauugcggcuccccagaauuucaccccuucugugaucuuucaaaaggucgugaacguugccaaugugggcgccguccccuccggacaggauaacauucauagauucgcugccaaaacagugcacagcggcucccugaugcucguuaccguggagcugaaggaagggucuaccgcgcagcucaucauuaauacagagaaaacggucaucggaagcgugcugcuucgcgaacugaagccuguucucucccagggcuga

SEQ ID NO: 65890 - RNA, 3648 nt, Artificial Sequence
  derived and/or modified sequence opt5 from AP3D1__Homo_sapiens__NP_001248755
auggcccugaagauggugaaaggcagcaucgacagaauguucgauaagaaccuccaggaccugguccgggggauucgcaaucacaaagaggaugaagcuaaguacaucucccaaugcauugacgagaucaaacaggaacuuaagcaggauaacauugccguuaaggcgaaugcuguguguaaacugaccuaucuccagaugcugggauacgacaucucuugggccgccuuuaacaucauugaggugaugagcgcuuccaaguucacauuuaaaagaaucggcuaucuugccgcuucucaaucuuuccaugaagggacggaugucauuaugcugaccacaaaucagauccggaaggaccucuccucucccagccaguacgauaccggaguggcccugacaggccuguccugcuuuguuaccccugaccucgcgcgcgaucuggccaacgacauuaugacacuuaugagccacaccaaaccguauaucagaaagaaggcugugcugauuauguacaaagucuuccucaaguaucccgagucucugcggccugccuuuccccgccuuaaagagaagcuggaagauccugaccccggggugcaguccgcugccguuaaugugaucugugagcucgcgagacggaacccuaaaaauuaccugagccuggccccgcuguucuuuaagcucaugacgucuuccaccaacaauuggguccuuaucaaaauuaucaagcuguucggagcucucacaccccuggaaccucgccuuggcaagaaacugauugagccccucaccaaccugauccauagcacaucugccaugucccugcucuacgagugcgugaauaccgugauugcuguccugaucagccuuuccucuggcaugccuaaccacagcgccuccauccaacuguguguucagaagcuccggauucugaucgaagacagcgaucagaaucuuaaauaucuggggcuccuggccaugucuaagauucugaaaacgcaucccaaguccgugcagagccacaaggaccucauccugcaaugccuugaugacaaagaugagucuauuagacugcgcgcucucgaccugcuguacggaauggugagcaagaaaaaccuuauggaaaucgucaagaaacucaugacacacguggauaaggcggagggcaccacauauagagacgaacugcugaccaagaucauugauaucuguucccagucuaacuaccaguauauuaccaauuuugagugguacaucagcauucucguugagcugacacggcuugaagggacgcgccauggacaccugaucgccgcucaaaugcucgacguggccauuagagucaaagccauccggaaguucgcugugucccagaugagcgcccugcuggauucugcgcaucuucucgcuuccagcacccagagaaacggcaucugcgagguucuguaugccgccgcuuggauuuguggggaauuuucugagcaucugcaggaaccgcaccacacacucgaggccaugcugcgcccucgggugaccacacuucccggacacauccaagcugucuacgugcagaaugucgugaaacuguacgccuccauucuccagcagaaggagcaagcgggcgaagccgagggcgcucaggccguuacccagcugaugguggacagacugccucaguucguccaaagcgcugaccuugaagugcaggagcgcgccuccugcauccuccagcugguuaaacauauucagaagcugcaagcgaaggaugugcccgucgccgaagaggugucugcucucuucgccggggagcugaaccccguggcuccuaaagcccagaagaaaguuccgguccccgaaggacuugaccuggaugccuggaucaaugagccucucagcgacuccgaaucugaggaugagcggcccagagcuguguuucacgaagaggaacagcgccggccuaagcauagacccagcgaggcggacgaagaggagcuggcccgccggagagaagcucgcaaacaagagcaggccaacaauccguucuauaucaaguccagcccuucuccccagaaacgguaccaggauacgccuggcguggaacacauucccgucgugcaaaucgaccuguccguuccucuuaaggugcccgggcucccgaugagcgaucaguaugucaagcuggaggaagagagacggcaccgccagaaacuggagaaggacaaaagacggaagaaaagaaaggaaaaggagaaaaagggaaaacgccggcauucuucccucccuacagaaagcgaugaggacauugcccccgcucagcaaguggauaucguuaccgaagagaugcccgagaacgcccugccuucugacgaagacgauaaggacccgaaugaucccuacagagcgcuugacauugaucuggacaaaccucucgcugauagcgagaagcugcccauccagaagcaccgcaacaccgaaacauccaaaagcccugagaaggacgugcccauggucgagaaaaagucuaaaaagccuaagaaaaaggaaaagaagcauaaagagaaggaaagagauaaagagaagaagaaagaaaaggagaaaaaggccgaggaccuggauuuuuggcuuuccaccacacccccgccugcccccgcuccugcccccgcgccggugccuagcacgggcgaacuguccguuaauaccgugacaacccccaaagacgagugugaagaugcuaagacagaggcccagggggaagaggacgacgccgagggacaggaucaagacaagaaaucuccuaagcccaaaaagaaaaagcaccggaaggaaaaagaggaacgcaccaagggcaaaaagaaaagcaagaagcagcccccuggcuccgaggaagcugccggggagccgguccagaacggagcucccgaggaggagcaacucccucccgaaucuagcuauucccugcucgccgaaaauucuuacgugaaaaugacgugcgauaucagaggcagccugcaggaggacucccaggugaccgucgcgauuguucuugaaaaccggagcagcuccauccugaaggggauggagcucagcgugcuggauucucugaaugcccgcauggcuagaccucagggauccagcgugcacgacggcguccccgugccuuuccaacuuccgcccgggguuucuaacgaagcccaguauguguuuacaauucaguccaucgucauggcucagaaacugaagggcacccucagcuucauugccaaaaacgaugagggagccacacaugaaaagcuggacuuucggcuccacuucuccugcagcucuuaccugaucaccacgccuuguuacagcgaugcuuuugcgaaacuucuggaguccggcgaccucucuaugagcuccaucaaaguggaugggauucgcaugucuuuccaaaaucugcuggccaagaucugcuuucaucaccauuucagcguuguggagagagucgacuccugugcuucuauguauagccgguccauucagggacaccacgugugccuucugguuaaaaagggcgaaaacagcgugucugucgacgggaaauguuccgauagcacacuccugucuaaucuccuggaggaaaugaaggccacccuugccaaaugcuga

SEQ ID NO: 65891 - RNA, 1257 nt, Artificial Sequence
  derived and/or modified sequence opt5 from AP3M2__Homo_sapiens__NP_006794
augauccacagccuguuccucauuaacuccucuggcgacaucuuucuggagaagcauuggaaaagcguggucuccagaucuguuugcgauuacuucuuugaagcccaggagcgggcuaccgaagccgagaaugugcccccugugauuccgacaccccaccauuaucuucugagcgucuaccgccacaagaucuucuuuguggcgguuauucaaacggaagugccuccccucuucgucaucgaguuucugcauagagugguugacaccuuccaggauuauuuugggguguguuccgagccugucaucaaagacaacgugguggucguuuacgaagugcuugaggaaaugcuggauaauggauucccccucgcuacagagucuaacauucugaaggagcugaucaaaccuccgaccauucuccggacaguggucaauaccaucacaggcagcaccaacgugggggaccagcugcccacgggacagcuuuccguugugccuuggcgcagaaccggcgucaaguauacaaauaacgaagccuacuuugaugugauugaggaaaucgacgccauuaucgauaagagcgggucuaccaucacagcugagauucaaggaguuaucgacgccugcgugaaacugaccggcaugcccgaucucacgcuguccuucaugaauccucggcuucuggacgaugucagcuuucaccccugugugcgcuucaagagaugggaaucugagcggauucucuccuucaucccgccugacggcaacuuucgccugcugagcuaucacgucucugcucagaaucucguggccauucccguuuacgugaaacauaacaucuccuucagagacagcuccucucuggggcgguuugagaucacagucggaccuaagcagaccaugggcaaaacaauugaaggggugaccguuaccagccagaugcccaagggagugcuuaauaugucccugacacccagccaaggcacgcacaccuucgauccugucacaaagaugcucucuugggacguggggaaaaucaacccgcagaagcugcccucccuuaaaggaaccaugagccugcaggcgggcgccucuaagccugaugagaaucccacaauuaaccuccaguuuaaaauccaacagcuggcuauuagcggccugaaggugaaccgccucgacauguacggggaaaaauauaagccuuucaagggaaucaaauacaugaccaaggccggcaaauuucagguuagaacguga

SEQ ID NO: 65892 - RNA, 582 nt, Artificial Sequence
  derived and/or modified sequence opt5 from AP3S1__Homo_sapiens__NP_001275
augaucaaggccauucugaucuucaacaaucacggcaaacccagacucagcaaguuuuaccagccuuauuccgaggacacccaacagcagauuauccgggaaacauuccaucuggugucuaaacgcgaugagaacgucugcaauuuucuugaagggggacugcucauuggcgggagcgacaacaagcugaucuacagacacuaugcuacgcuuuacuucguguuuuguguugauuccucugagagcgaacugggaauccucgaccugauucagguguucgucgagacccuggauaaaugcuuugagaaugugugugaacucgaccugaucuuccauguugauaaggugcacaacauucuugccgagauggucaugggcgggauggugcuggaaacaaauaugaacgagaucguuacccaaauugacgcgcagaauaagcucgagaaauccgaagcuggacuggccggcgccccggcucgggccgugucugcugucaagaacaugaaucuucccgagaucccucgcaacauuaauaucggcgauaucagcauuaaagugcccaaccugccuuccuuuaaguga

SEQ ID NO: 65893 - RNA, 582 nt, Artificial Sequence
  derived and/or modified sequence opt5 from AP3S2__Homo_sapiens__NP_005820
augauccaggccauucugguguucaacaaucacggcaagcccagacucguccgguuuuaccaacgcuucccugaggaaauccagcagcagauuguuagagagaccuuucaucuggugcuuaaacgggacgauaacaucugcaauuuccuggaagggggaagccucauuggcggguccgacuauaagcugaucuaccgccacuaugcuacacuuuacuuuguguucugugucgauucuagcgaguccgaacugggaauccucgaccugauucaaguguuuguugagacgcuggauaaaugcuucgagaacgugugugaacucgaccugaucuuucauauggauaagguccacuauauucuucaggaggugguuaugggcgggauggugcuggaaaccaauaugaacgagaucgucgcccagauugaggcgcagaauagacucgaaaaaucugagggaggccugagcgcugccccggcccgggcuguguccgccgugaagaacaucaaucuucccgaaauuccucgcaacaucaauaucggcgaccugaacauuaagguccccaaucucucucaauucguuuga

SEQ ID NO: 65894 - RNA, 1995 nt, Artificial Sequence
  derived and/or modified sequence opt5 from AP4B1__Homo_sapiens__XP_011538826
augcccuaccugggcagcgaggacguggucaaggaacucaaaaaggcccugugcaacccucacauccaggcugauagacuucgguaucgcaauguuauucaaagagugauccggaugccgggggugcaggaguacauucagcagcccauccugaacggacuccgcgacaaagccuccuaugucagacggguggcgguucugggcugugcuaagaugcauaaucuucacggggauucugaaguggacggagcccuggucaacgagcucuacagccugcugcgcgaucaagacccuauugugguugugaauugccucagaucccuggaagagauccuuaaacaggagggcggggucgugaucaacaagcccauugcccaucaccuucucaaucggaugucuaagcuggaucaguggggacaggcugaagugcuuaacuuccugcuccgcuaucaaccuagaagcgaggaggaacuguuugacauccugaaucuccuggauuccuuccuuaaaucuagcucccccggcgucguuaugggcgccaccaagcuguuucucauucuggcuaaaauguucccucaugugcagacagacgugcuuguccgggugaaggggccgcugcucgccgcguguagcucugagucccgcgaacugugcuuuguugcccugugucacgugagacagauccuccacagccugcccggacauuucucuucccacuacaaaaaguuuuucugcagcuauucugagccucauuacauuaagcugcagaaagucgaagugcugugugagcucguuaacgaugaaaaugugcaacagguccuggaggagcuucggggcuacugcacggacguguccgcugauuuugcccaggcugccaucuucgcgauugggggaaucgcccgcaccuauacagaccaauguguccagauccugaccgaacuccugggccugagacaggagcacauuacaaccgugguugugcagacauuucgggaccucgucuggcugugcccccaauguaccgaagcugugugccaggcccuuccugggugcgaggaaaacauccaggauagcgagggaaagcaggcucugauuuggcuccugggcguucacggcgagagaauccccaaugccccguacgugcuggaagacuucgucgagaacgugaaauccgaaacguuuccugccgugaagauggagcuucucaccgcucugcugcgccucuuccugucucggcccgcggaaugucaagauaugcuugggagacugcucuauuacugcauugaggaggaaaaagacauggccguucgcgaucggggacuguucuauuacagacugcuucucgucggcaucgacgaggugaagcgcauccuguguagcccuaaauccgaucccacacuggggcuccuggaagaccccgcugagcggccugugaauagcugggccucugauuuuaacacccuugucccgguguauggaaaggcccauugggcuacaauuuccaagugccagggcgccgagagaugugaccccgaacugccuaaaaccagcucuuucgcggcuagcgggccccucaucccugaggaaaacaaggagcgcguucaggaacugcccgauuccggagcccugaugcuugugccgaaucggcagcucacggccgacuacuuugagaaaacauggcugucucugaaggucgcucaccaacaggugcucccuuggagaggcgaguuccaucccgacacccugcagauggcccuucagguugugaacauucaaacaaucgcuaugagccgcgccggcucccggccuuggaaagcguaccugagcgcccaggaugacaccgggugccucuuucugaccgaacugcuucucgagcccggaaauucugaaaugcagauuuccgucaagcaaaacgaggcuagaacagaaacgcugaauagcuucaucucugugcuggagaccguuaucggcacaauugaggaaaucaaguccuga

SEQ ID NO: 65895 - RNA, 3414 nt, Artificial Sequence
  derived and/or modified sequence opt5 from AP4E1__Homo_sapiens__NP_031373
augagcgacaucguggagaagacccugacagcccuccccggccuguuccuucagaaccaaccugggggaggcccggcugccgcgaaggcuuccuuuucuagcagacuggggucccucguccggggaauuacggcccugaccucuaaacacgaagaggaaaaacuuauccagcaggagcugagcucccucaaggccacaguuucugcucccaccacaacccugaaaaugaugaaggaaugcauggugcgccugauuuacugugagaugcucggcuaugaugccagcuucggguacauccaugcuauuaagcuggcccagcaaggaaaucuucuggagaaaagagugggcuaucucgcggucucccuguuucuucacgaaagccaugagcugcuccugcugcucgugaacacaguugugaaggaccugcagucuaccaaucuugucgaagugugcauggcccugacgguugugucccagaucuucccuugugagaugauccccgcuguccucccucugauugaggauaaacuucagcacagcaaggaaaucgugcggcgcaaagccgugcuggcucucuacaaguuucaucugauugcccccaaccaaguccagcacauccacauuaaguucagaaaagcgcugugcgaccgggauguuggcgugauggccgcuucucuccauaucuaucugcgcaugauuaaggaaaauuccagcggguacaaagaccuuaccggaucuuuugugacaauccugaagcaggucgugggcgggaaacucccuguugaguucaacuaucacuccgugccggcccccuggcugcagauccaacuucugcggauucucggacugcugggcaaggaugaccagagaaccagcgagcucauguacgauguccuggacgaaucccuucgcagagcugagcugaaucauaacgugacauacgccauccucuuugaguguguucacaccguguauucuauuuacccuaaaagcgaacugcuggagaaggccgcuaagugcaucgggaaauucguccuuucccccaagauuaaucucaaauaucugggacugaaggcgcucacguacgugauccagcaagauccuacacuggcccuucagcaccagaugaccaucauugaaugucuggaccaucccgauccgaucauuaaacgggagacacucgaacugcuguaucgcaucaccaacgcucagaauauuaccgucaucgugcaaaagaugcuugaguaccuccaccagagcaaggaggaauauguuaucgugaaccuggucggcaaaauugccgagcuggccgaaaaguacgcuccugacaaugccugguuuauccagacaaugaacgcgguguucucuguuggcggggacgugaugcaucccgauauuccuaauaacuuucucagacugcuugcugagggauucgacgaugaaacggaggaccagcaacugcggcucuacgccguccaguccuaucugacccugcuugauauggagaacguguucuacccccagcgcuuucuccaggugaugagcuggguucugggcgaauauucuuaccugcucgacaaagagacacccgaagaggucaucgccaagcuguauaaacuucugaugaaugauagcguguccucugagaccaaggcuuggcucauugccgcugugacaaagcugaccagccaagcccacuccagcaacacggucgaaagacugauccaugaguucacaauuucucuugauaccugcaugcggcagcacgcguuugaacucaaacaccuucaugagaauguggaacugaugaagucccuccugccuguugacagaagcugugaggaccuuguggucgaugccucucuguccuuccucgacggguuuguggcugagggacugagccagggcgccgcuccguacaaacccccucaccagcgccaagaagagaagcugucccaggaaaaaguucuuaacuucgagcccuaugggcugucuuuuagcuccucuggauucaccggccggcagagcccugccggcaucucccucgggagcgacgugucuggaaauuccgcggaaacaggccugaaggagaccaacagccucaagcuggaggggaucaaaaagcuguggggaaaagaaggcuaccugcccaagaaagagucuaagacaggggaugaauccggcgcccucccggucccucaagagagcauuauggaaaauguggaccaggcuaucacgaaaaaggaucagucucagguucugacccaaagcaaggaggagaaagaaaagcagcugcuugccuccagccuguuugugggacucggcucugaguccacaauuaaccugcucgggaaagcugacaccgucagccauaaguucagacgcaaauccaaggugaaggaagccaaaucuggagagacaaccagcacgcacaauaugaccugcuccucuuuuagcucccugucuaacguggccuacgaggaugacuauuacagcaauacacuucacgauaccggcgacaaggaacugaaaaaguucucccucacaagcgagcugcuggauucugaaucccuuaccgagcugccccucgucgaaaaauuuagcuauuguucucuguccacgccuagccucuucgcuaacaauaacauggagaucuuccaucccccucagucuacagcggccuccguugcuaaggagagcucccuggccagcucuuuucuugaagagaccacagaauacauucacagcaaugccauggaggugugcaacaacgaaaccaucuccgugucuagcuauaagaucuggaaagacgauugccugcugauggucugguccgugaccaauaagucugggcucgagcugaaaagcgcugaccuugagauuuuccccgccgaaaacuuuaagguuacagagcagccgggauguugccugccugugauggaagcggaguccacgaaaucuuuccaauacagcguccagaucgaaaagcccuuuaccgagggcaaucucacaggguucauuuccuaucauaugauggauacccacagcgcucagcuggaguuuucugugaaccucucccugcuugacuucauccggccccugaagauuagcucugacgauuuuggcaaacuguggcucuccuucgccaaugacguuaagcagaacgugaaaaugagcgaaucccaagccgcucugccuucugcccuuaagacacugcagcagaaacucagacugcauaucaucgagauuaucggaaaugaaggccuccuggcgugucaacuucugccgagcauucccugccugcuccacugucgcguccacgcugaugugcuggcccuuugguuucgguccagcugcucuacccugccugacuaccuccuguaccagugucagaagguuauggagggguccuga

SEQ ID NO: 65896 - RNA, 1362 nt, Artificial Sequence
  derived and/or modified sequence opt5 from AP4M1__Homo_sapiens__NP_004713
augaucagccaguucuuuauucuguccucuaagggcgacccccucaucuacaaagauuucagaggggacagcggaggccgggauguggccgagcuguuuuaucgcaagcugaccgggcugccuggagacgaauccccggucguuaugcaccaucacggcagacauuucauucacauccggcauucugggcucuaccugguggugacaacgagcgagaacgucucccccuuuucucuucuggaacuccugagccgccuggcuacccuccugggagauuauugcggcucccuuggcgaggggacaauuagcagaaauguggcccugguuuacgaacuccuggacgaggugcuugauuauggauacguccaaaccacaucuaccgagaugcugcggaacuucauccagacagaagcggugguuuccaaaccuuuuagccucuucgaccugucuuccgugggccuguuuggggcugagacccagcagagcaaggucgcccccucuuccgccgcuagccgcccugugcucuccucuagaagcgaucaaucccagaaaaaugaaguguuccuggacgucguugagcggcuuagcgugcugaucgccucuaacggaucccuccugaagguggauguccagggcgagauucgccuuaagagcuuucugcccucugggagcgaaaugagaaucggacucacggaggaguucugugugggcaaauccgaacugcggggcuaugggccuggcauucgcguugacgaagugucuuuucacagcuccgucaaucuggaugaguucgagagccacagaauccuccggcugcagccgccccaaggagaacuuaccgugaugcgcuaccagcugucugacgaccucccuagcccccugccuuucagacuuuuucccuccguucagugggaucgggggucuggaagacuucagguguaccucaagcugcgcugcgaccugcucuccaaaagccaagcucugaacguccggcuucaucugccgcucccuagaggcguggucucccugucucaggagcugagcucccccgaacagaaggccgagcuugcggaaggggcccuccgcugggaucugccucgggugcaaggaggcucucagcugagcggccucuuccagauggacguucccgggcccccuggaccgcccucccacggccugagcacaucugcuuccccucuugggcugggacccgccagccucucuuuugagcugccuagacauaccuguuccggccuucaggugcgcuuccugcggcucgcuuuuagacccugcgggaaugccaacccgcacaaauggguccgccaccugagccauucugaugcguaugugauucggaucuga

SEQ ID NO: 65897 - RNA, 435 nt, Artificial Sequence
  derived and/or modified sequence opt5 from AP4S1__Homo_sapiens__NP_001121598
augaucaaguucuuucugauggugaacaaacagggccaaaccagacucagcaaguacuaugagcacgucgacauuaauaaaagaacacugcuugaaacggagguuaucaaguccugccugucucgcagcaacgaacaguguuccuucauugaguacaaagauuuuaagcucaucuauagacaguacgccgcucuguucauuguggugggggucaaugacaccgaaaacgagauggccaucuaugaguuuauccauaauuucguggaaguucuugaugaguacuuuucucgggugagcgaacuggacauuauguucaaccucgauaagguccacaucauucuggacgagauggugcugaauggaugcaucguugagacaaaccgcgcgcggauucucgcuccccugcuuauccuggauaaaauguccgaaucuuga

SEQ ID NO: 65898 - RNA, 1473 nt, Artificial Sequence
  derived and/or modified sequence opt5 from AP5M1__Homo_sapiens__NP_060699
auggcccagagagcuguguggcugaucagccacgagcccggcaccccucucugcgggacaguccgguucucccgcagauacccgacgguugaaaagcgggcccgcguguuuaacggagcgucuuaugugcccgucccugaggacggccccuuccugaaagcccuucuguuugaacucagacugcuugaugacgauaaggacuucguggagagccgggauuccuguucucgcauuaauaaaaccagcaucuacgggcugcucauuggaggcgaggagcuguggccuguuguggcuuuucugaagaacgacaugaucuaugccugcgucccccucguggagcaaacacuguccccuagaccgccccuuauuucuguuagcggggugucccagggauucgaauuucuguucggcauccaggauuuucucuacagcggccagaaaaaugacucugagcugaacaccaaacuuucccaacugccugaucuccugcugcaggcuugucccuucgggacacuccuggacgccaaucuucagaacagccuggauaauaccaacuuugcuucugucacacagccucaaaagcagcccgccuggaagaccggaacguauaagggcaaaccucagguguccaucagcauuaccgaaaaggugaaaucuaugcaguacgacaagcaagggaucgcggauacauggcaggucguuggaaccgugacaugcaagugugaccucgagggcauuaugccgaaugugaccaucucccugagccuucccacgaacggguccccucugcaggacauucucguccaucccugcgugacaucucuggauagcgccauccugaccuccagcucuauugacgcuauggaugacuccgccuucagcggacccuauaaauuuccuuucacaccgccccucgagucuuucaaucuguguuuuuacaccagccaaguuccugugcccccuauccuuggcuucuaccagaugaaggaagaggaaguccagcugcggaucaccauuaaccucaaacugcacgaguccgugaagaauaacuuugaguucugcgaagcucauauccccuuuuauaaucgcggcccgauuacacaccuugaguacaaaacgucuuucgggcagcuggaaguuuuuagagaaaagagccuccugaucuggauuaucggacaaaaauucccuaaguccauggaaaucagccugucuggcaccgugacauuuggggccaagucccaugagaaacagcccuucgauccuauuuguaccggagaaacagcguaucucaagcugcacuuucggauccuugacuacacccugacgggcugcuaugccgaucagcacagcguccagguguucgcuucugggaaacccaagauuuccgcccaucgcaaacucaucagcuccgacuacuauauuuggaacucuaaggcuccugcccccgucacauacggaagccugcugcuuuga

SEQ ID NO: 65899 - RNA, 2424 nt, Artificial Sequence
  derived and/or modified sequence opt5 from AP5Z1__Homo_sapiens__NP_055670
auguucagcgccggcgcugagucccugcuccaccaggccagagaaauccaagacgaggaacugaagaaauuuugcucucggauuuguaagcuccugcaggcggaggaucucgggcccgacacccuggauagccuucagcgccuguuccucaucauuuccgcuacaaaauacucuagacggcuggaaaagacgugcguggaccugcuccaggccacccugggacuuccugccuguccggagcaacugcagguccucugcgcugccauccugcgcgagaugagccccuccgauucucuuagccuggcuugggaccauacacagaacuccagacagcucagccugguugccucugugcugcucgcgcaaggcgaucggaaugaagaggugcgcgccgucgggcagggagugcugagagcucuugaaucccggcagccugagggccccagccugcgccaccuccugccuguuauggccaaaguggucgugcuuucucccgggacccugcaggaggaccaagcuacacuccuguccaagagacugguugauuggcuccgguaugccagccugcagcagggacuuccucauucuggcggcuuuuucuccaccccgcgcgcgagacaacccgggccugugacagaagucgacggagccguggcuaccgacuuuuucacggugcugagcuccggccaccgguuuaccgaugaucaguggcucaacguccaggccuucucuaugcugcgcgcuuggcuucugcauagcgggcccgagggaccuggcacacucgacaccgacgauagauccgaacaggaggggagcacacugucuguuauuuccgccaccagcucugccggacggcugcuucccccgagagaacgccugcgggagguggcuuuugaguacugucaaagacuuaucgaacagagcaaucgccgggcgcugagaaagggcgacuccgaucuccagaaagccugccugguggaggcuguccuggugcuugacguucucugucgccaggauccuucuuuccuguaucggagccuguccugccucaaggcccugcacggcagagugcgcggggaccccgccagcguccgggugcuucugccucucgcucacuuuuuccugucucauggagaagccgcggcuguugauuccgaggccguguaccaacaccuguuuacgagaauccccgucgaacaguuccauagccccaugcuugccuucgaguuuauucaguucugucgcgacaaccuccaccuguuuucuggccaccuguccacacuccggcugagcuucccuaaucuuuuuaaauuccuggcuuggaacuccccgccccucaccucugaguuuguggcccugcugccugcucuugucgaugccgggacagcgcucgaaaugcugcaugcccugcucgaccugcccugccuuaccgcugugcuggaucuccagcugagaagcgccccugcugccuccgagcggccccugugggacaccucucuucgcgcgccgagcugucucgaagccuucagagacccucaauuucagggacuguuccaguaucugcuccggcccaaggcuuccggcgccacagagagacuggcuccucuucaccagcugcuccaacccauggccgggugcgcccgcguugcucagugcgcgcaggccgugccuacgcugcugcaagccuuuuucagcgcugucacccagguggccgauggaucucuuaucaaucagcuggcucuccugcuccugggccgguccgacagccuuuaccccgccccgggcuaugcggcugggguucauucugugcuguccagccaguuucucgcccuguguacacugaaaccuucucuugucguggaacuggccagagaucuccuggaguuccucggaagcgugaacggccugugcucccgcgcuagccuuguuaccucugucgugugggccauuggggaguaccuguccgugacauacgacagacgguguaccgucgaacaaaucaauaaguucuuugaggcgcucgaagcucugcuguucgaggugacgcagugccgccccagcgccgcccuucccagauguccuccgcagguugugacaguccugaugaccacccucacaaagcuggcuucccggucucaggaucucauuccccgcgccagccugcuucuguccaaaaugagaacccuggcucacucuccugccacaagcuccacgcauucugaggaaggagcggaggccauccggacccgcgcuacagaacuccugacccuucugaagaugcccagcguggcccaauuuguucucacaccuuccaccgaggugugcagccccagauaucaccgggacgcuaacacggcccugccucucgcccugcgcaccgucucuagacuuguggaacgggaggcuggccugaugcccggguga

SEQ ID NO: 65900 - RNA, 3585 nt, Artificial Sequence
  derived and/or modified sequence opt5 from APAF1__Homo_sapiens__NP_001151
auggacgccaaggcuagaaacugccugcuccagcaccgggaggcccuggaaaaagauaucaagaccagcuacauuauggaccauaugaucuccgauggcuuccuuacaauuucugaggaagagaaagugcgcaaugaacccacgcaacagcagagagcggcuaugcugaucaagaugauucucaaaaaggacaacgauagcuaugucuccuuuuacaaugcccugcuucacgagggguauaaggaccuggccgcucuccugcaugauggaaucccuguugugucuagcuccucugugcggaccguccugugugagggcggggugccgcagcgccccguuguguucgucacaagaaagaagcucgugaacgccauccaacagaaacugagcaaacuuaaaggagaaccuggcuggguuaccauucacgggauggcuggaugcggcaaguccgugcuggccgcggaggccguccgggaccauagccuccuggaaggcuguuuucccgggggagugcacugggugucugucggcaagcaggauaaauccgggcuucugaugaagcuccagaaucugugcacacgccuggaccaagaugagagcuucucucagagacucccucugaacaucgaggaagcuaaagaccggcuucgcauucugaugcucagaaagcacccccggucccugcuuauccuggaugacguuugggacagcugggugcucaaagccuuugauucucagugucagauucugcugaccacacgcgacaaguccgugaccgauagcgucaugggaccuaaauacgugguuccgguggaguccucucucggcaaggaaaaggggcuggagauccuuagccuguucgucaauaugaaaaaggcugaccuccccgaacaagcccauuccauuaucaaagagugcaagggaagcccucuggugguuucucuuaucggcgcgcugcucagagauuuucccaaccggugggaguauuaccugaaacagcugcagaauaagcaauucaagcgcauuagaaaauccagcucuuaugacuacgaagcccucgaugaggcuaugagcaucuccguggaaaugcugcgggaggacauuaaggauuacuauacggaccuuucuauccugcagaaagaugucaaggugccuaccaaaguccucuguauucugugggacauggaaacagaggagguggaagacauccugcaggaguuuguuaacaagagccuucucuucugcgauagaaauggcaaguccuuucgcuacuaucugcacgaccuccagguggauuuccugaccgagaaaaacuguagccaacugcaggaccuucauaagaaaaucauuacacaguuucagcgguaccaccaaccccacacccugucuccggaucaggaagacugcauguauugguacaauuuccucgccuaucauauggcuuccgccaagaugcacaaagaacugugugcccugauguucagccuugauuggaucaaggcuaagacggagcucgucgggccugcgcaucugauucacgaguuuguggaauacagacauauccuggacgagaaagauugcgccguuucugaaaacuuccaggaguuucucucccugaauggacaccuucugggccgccagcccuucccuaacauugugcaacucgggcugugcgagcccgaaacaagcgaggucuaccagcaggcuaagcugcaggccaaacaagaaguggacaacggaaugcuuuaucucgaguggaucaauaagaaaaacaucaccaaucugucccggcuggugguuagaccccacacagaugccgucuaccaugcuuguuuuucugaagacggccagcgcauugccagcugcggggcggauaagacccuccagguguucaaagcugagaccggagagaagcugcuugaaaucaaggcccacgaggacgaagugcuguguugcgccuuuuccacagacgaucgguucauugcuacguguucugucgacaaaaaggugaaaaucuggaacagcaugaccggcgagcucguucauacauaugaugaacacuccgagcaagugaauugcugucacuuuaccaacagcucucaucaucugcugcuugccacaggcuccagcgacugcuuccucaagcugugggaucugaaucagaaagaguguagaaacaccauguuugggcacacgaauagcgucaaccacugccgcuucuccccugacgauaagcuccuggcuagcuguucugccgacggaacacuuaagcugugggaugcgaccagcgccaaugaacggaaauccauuaacgugaagcaguuuuuccucaaucuggaggacccgcaggaagauauggagguuaucgugaaaugcugcagcuggucugcugacggcgccagaauuauggucgcugccaagaacaaaaucuuccuguggaauaccgauucccgcagcaagguggcggacugucgggggcaucuuuccuggguucacggagugauguuuucucccgacggcagcuccuuccugacaucuagcgaugaccaaaccaucagacucugggaaacaaagaaagucugcaagaacuccgccgugaugcugaaacaggagguggaugucguuuuucaggagaacgaagugauggugcucgcugucgaccacauucggcgccugcagcuuaucaaugggagaacgggccaaauugauuaccugaccgaggcccaggugucuuguugcugucucagcccucaucugcaguauaucgcuuucggagacgaaaacggcgccauugagauccuggagcuuguuaauaaccggaucuuucaguccagauuccaacacaagaaaacaguguggcauauucaguuuaccgccgaugaaaagacacugaucucuucuuccgacgaugcugagauucaggucuggaauuggcaacucgacaagugcaucuuccugcgcgggcaccaggaaaccgugaaagauuuucggcuccugaagaacagcagacuucugucuugguccuucgacggaacgguuaaaguguggaauauuaucaccggcaacaaggagaaagacuuugucugucaucaggggacagugcucagcugcgauaucucucacgacgcgaccaaguucuccagcacauccgccgauaaaaccgcuaagauuuggagcuuugaccugcugcuuccccugcacgaacuccgcggacauaauggcuguguuagaugcucugccuucagcguggauuccacgcugcucgccacaggggacgauaacggcgagauccggauuuggaaugucucuaacggagagcugcuucaccugugugcuccucugagcgaagagggcgccgcgacccaugggggaugggugacagaccucugcuucucccccgauggcaagaugcugaucucugcugggggauacauuaaaugguggaauguggucaccggcgaaagcucccagaccuuuuauacaaacgggacgaaucuuaagaaaauccacguuucuccggacuucaagaccuacgugacaguggauaaccugggcauccucuacauucugcaaacccucgaguga

SEQ ID NO: 65901 - RNA, 2514 nt, Artificial Sequence
  derived and/or modified sequence opt5 from APBA1__Homo_sapiens__XP_011516919
augaaccaccuggagggcagcgccgaaguggaggucaccgacgaagcugccgggggagagguuaaugaauccguggaggcggaucucgagcaucccgaaguggaggaagaacagcaacagccuccgcagcagcaacacuacgucggcagacaucagcgggggcgcgcucuggaggaccuuagagcccagcugggacaggaagaggaggagcggggcgaaugccucgcccgcucugcuagcacagaguccggguuccacaaccauacggauaccgccgagggagacgugaucgcugccgcgagagauggcuaugacgccgaacgggcucaagaucccgaggacgaaucugccuacgcuguucaguaucgcccugaggccgaagaguacacagagcaggcggaagccgagcacgcugaagccacccacagacgggcucugcccaaucaucuucacuuucauagccuggagcacgaagaggccaugaacgccgcuuauuccggcuacguguauacacaccgccucuuccauagaggggaggaugaaccuuacucugagcccuacgcggacuauggaggccugcaggaacacgucuacgaggagauuggggaugccccugaacuggacgcucgggauggacuccgccuguaugagcaagaaagagacgaggccgccgcuuaccggcaggaagcccuuggcgcgcgccugcaucacuaugacgagagaagcgauggggaguccgacagcccggaaaaggaggcugaauuugcccccuacccucggauggauucuuaugagcaggaagaggacaucgaucaaauuguggccgagguuaaacaguccaugagcucucagucccucgacaaggcugccgaagauaugcccgaggcugaacaggaccuggagagaccucccaccccggccggaggccgcccugauagccccggccuucaagcgccugccgggcagcagcgggcugugggacccgccggcgggggagaagcuggccagagauacucuaaagagaagcgcgacgccaucucccuggcgauuaaagauaucaaggaggccaucgaagaggucaagacacggaccauuagaagccccuacacgccugacgaaccgaaagagcccaucugggugaugcgccaagacauuuccccuacccgggauugugacgaucagagacccauggacggggauucuccuagccccggauccagcucuccgcucggcgcugaguccagcucuacaagccugcauccuuccgaccccguggaagccucuaccaauaaggagagccgcaaaucccuggcuagcuucccuacauaugucgaaguucccggcccuugcgaucccgaggaccucaucgaugggauuaucuuugccgccaacuaccugggaucuacccagcuucuguccgacaagacgccgagcaaaaaugugcggaugaugcaggcucaagaagcggugucuagaauuaagauggcccagaagcucgcuaaaucccgcaagaaagccccugagggcgagagccagcccaugacagaagucgaucuguucaucuccacccagcggaucaaggugcuuaacgccgacacacaagagaccaugauggaucacccccugagaaccauuucuuauaucgcugacauugggaauaucguugugcucauggcccggcgcagaaugccucggagcaacucccaggaaaaugucgaggcgucucacccgagccaggacggaaaaagacaauacaagaugauuugucauguguuugaauccgaggaugcucagcugaucgcccagagcaucggccaggccuucucuguugcuuaucaagaguuucugcgcgccaacgggauuaaucccgaagaccucucccagaaagaguacagcgaucugcuuaacacacaggacauguauaaugaugaccugauccacuucucuaaguccgaaaacugcaaggauguguuuauugagaaacagaagggcgaaauccucggagucgugauugucgagagcggcugggggucuauccugccuacggugaucauugcgaacaugaugcauggaggccccgcugagaaaagcgggaaacuuaauaucggagaccaaauuauguccaucaacggcaccagccugguugggcucccucugucuacaugucaguccauuaucaaaggccugaagaaucagagccgggugaagcucaacauugucagaugucccccugugaccacaguucugauccgcagacccgaucuucgguaccagcugggauucuccgugcaaaauggcaucauuugcucucucaugcgcgggggaaucgccgaaagaggcgggguccgggugggacaccgcauuaucgagauuaacggccagagcgugguugccaccccgcacgaaaagaucguccauauccuguccaaugcugugggggagauucacaugaagacgaugccugccgcuauguacagacugcuuacagcccaggagcaacccguguauaucuga

SEQ ID NO: 65902 - RNA, 2214 nt, Artificial Sequence
  derived and/or modified sequence opt5 from APBA2__Homo_sapiens__XP_006725606
auggcccacagaaagcuggagagcgugggcuccgggaugcucgaccaucggguccgccccggaccuguuccgcacucucaggaacccgagagcgaagauauggagcugccucuugaaggcuacgugcccgaggggcuggagcucgcugcccugagaccugaaucccccgcgccugaggaacaagagugccauaaccacucuccggacggagauagcuccucugacuaugugaauaacaccagcgaggaagaggauuacgacgaaggccuucccgaggaagaggaggggaucacauauuacauucgguauuguccugaagaugacuccuaccuggagggaauggauugcaauggcgaagaguaucucgcucauagcgcccaccccgucgacacggaugaaugucaggaggccguggaggaauggaccgacucugcuggcccucacccccaugggcacgaggccgaaggaucccaggauuacccggacggccagcugccuauccccgaggacgaaccuagcguucuggaggcucaugaucaagaggaagacgggcacuacugcgccucuaaagagggauaucaggauuacuaucccgaagaggcgaacggcaauacaggggccucccccuaccgccucagacggggagacggcgaucuggaggaccaggaagaggauauugaccagaucguggcugaaauuaagaugagccuuucuaugaccuccaucacaagcgccuccgaggcuucuccugaacacggcccggagcccgggccugaggauagcgucgaagccugucccccuaucaaagcguccugcagccccucucgccaugaggccagaccgaagucccugaaccuccugccugaagcuaaacaccccggagacccucaacggggcuucaagcccaagacccgcacaccugaggaaagacuuaaauggccccaugaacagguguguaaugggcuggagcagccgcggaagcagcaacgcagcgaucucaacggaccuguugacaauaacaauauucccgaaaccaaaaagguggccucuuuucccagcuucgucgcugugccuggcccgugcgagcccgaagaccugaucgaugggauuaucuuugccgccaacuaucugggauccacgcagcuccugucugagagaaauccuagcaaaaacauucggaugaugcaggcucaagaagcggugucccgcgucaagaauagcgagggcgacgcccagacccuuacagagguugaucuguucaucucuacccagagaauuaaggugcucaacgcugacacacaggaaaccaugauggaucacgcccugcggacgaucuccuacaucgccgacauuggcaacaucgugguccuuauggcuagacgccggaugcccagaagcgccucucaagauuguauugagacaaccccuggggcgcaggaagggaaaaagcaguauaaaaugaucugccauguguuugaguccgaggacgcucagcugauugcccaaagcaucggccaggccuucuccguugcuuaccaggaauuucuccgcgccaaugggaucaaccccgaggaucugucucagaaggaauacagcgacauuaucaauacacaagagauguauaacgaugaccugauucacuucuccaauucugaaaacuguaaagagcuccagcuggagaagcacaaaggagaaauccuuggcguggucgugguugagagcggguggggcuccauucugccuaccgugauccucgcuaauaugaugaacggaggccccgccgcgcggagcgggaagcugucuaucggagaucagauuauguccaucaauggcaccagccuugucgggcugccgcucgccacaugccagggaauuaucaagggccugaaaaaccaaacccaggugaagcugaauauugucucuugcccucccgugacgacaguucucaucaaaagaccugaccugaaguaccagcuuggguuuuccgugcaaaacggcauuaucuguagccugaugcgcggaggcaucgcugaacggggaggagucagagugggccaucgcauuaucgagauuaaugggcagucuguuguggccaccgcucacgagaaaaucguccaggcccucagcaacuccgugggagagauucauaugaagacaaugcccgcggccauguuccggcugcugaccggccaggagacgccgcuuuauaucuga

SEQ ID NO: 65903 - RNA, 1728 nt, Artificial Sequence
  derived and/or modified sequence opt5 from APBA3__Homo_sapiens__NP_004877
auggacuuccccaccaucagcagauccccuucuggcccgcccgccauggaucuggaggggccucgggacauucucgugcccagcgaagaucugacaccugacucccagugggaucccaugccuggaggcccggggucucuuagccgcauggagcuggacgaauccucucuccaagagcugguccagcaguuugaagcccuucccggagaucugguuggcccuagccccgggggagcuccuugcccccuccacaucgcgacgggccauggccuggcuucccaggagauugccgacgcccacgggcugcucagcgcugaggccggaagagaugaccugcuuggccugcuccauugugaagagugcccgccuucucaaaccgggcccgaggaaccucuggagcccgcuccccggcuucugcagccuccggaagaucccgacgaggauuccgacagcccugaauggguggagggagccucugcggaacaggagggcucccgcucuagcuccagcucccccgagccuuggcucgaaacagugccccuggucaccccggaggaaccucccgccggggcucagucuccugagacacuggccagcuaccccgcuccucaagaagugcccggaccgugugaccacgaggaucuccuggacggcguuaucuucggcgccagauaucuuggguccacccagcuggugagcgagcggaacccucccacaucuacccgcauggcgcaggccagagaagcuauggaucgggucaaggcccccgacggagagacgcagccuaugaccgaaguggaucucuuuguuuccacaaaacgcauuaaggugcugaccgcugacagccaagaggccaugauggaucaugcccuucacacaaucucuuacaccgcugacaucggcugcguccuggugcucauggcgagacggcgccuggccagacggccggcuccccaggaucacgggcgcagacuguauaaaaugcucugucauguguucuacgccgaagacgcccagcugauugcucaagccaucggacaggcguuugcugccgccuauagccaguuccuucgggaguccggcauugauccuucucaggucgggguucaccccagcccuggagcuugccaucugcacaauggcgaccucgaccacuuuuccaacagcgauaauuguagagaggugcaucuggaaaagcgccggggcgaggggcuuggaguggcccuggucgaaucuggcugggggucccuccugcccacggcugugaucgccaaccugcuccacggaggcccugcggagagaagcggggcccugucuauuggcgaccgccuuacagcuaucaauggaaccucccugguuggccucccccuggccgcuugccaagccgcggugcgggagacaaaaagccagaccuccgucacccugucuauugugcauuguccgccuguuacaacggccaucauccacagaccccaugcucgcgaacagcuuggguucugcguggaggauggaauuaucuguagccuccugcggggcgggauugccgaaagaggaggcauccgcgucgggcaccggauuaucgagaucaacggccaguccguggucgcuaccccucacgccagaauuaucgaacugcucacagaggccuacggagaggugcauauuaagaccaugcccgcugcgacauaucgccugcuuaccggccaagaacagccgguuuaccuguga

SEQ ID NO: 65904 - RNA, 1473 nt, Artificial Sequence
  derived and/or modified sequence opt5 from APBB1__Homo_sapiens__NP_001244248
augagcgccauguucucccaggacuuuuuccuggcuaucauucuccaagauucuagcgccgacuccuuuuggaaccccaaugcguucgagaccgauucugaccugccugcuggcuggaugagagugcaggauacaagcgggacguacuauuggcacaucccgaccggaacaacccagugggaacccccuggccgggccucccccucucaggggagcuccccucaagaggaaagccagcuuacauggaccggauuugcccauggcgagggguucgaagacggagaguuuuggaaggaugagcccucugacgaagcuccuauggagcugggccucaaagaaccggaggagggcacacugaccuuccccgcccagucccuuagcccugaaccccugccucaggaggaagagaagcugcccccgcgcaacacgaauccugggauuaaaugcuuugcugucagaucucucggauggguugaaaugaccgaggaggaacuggcccccggccgguccagcguggcggugaacaauuguauccgccaacucucuuaccacaagaacaaucugcaugauccuauguccgggggauggggcgaggggaaagaccuucugcuccagcuggaagaugagacacuuaagcuggucgaaccccagagccaggcccuccugcacgcucaacccauuaucuccaucagaguguggggaguuggccgggacucuggccgcgagagagauuucgccuauguggcucgggacaagcugacccagaugcucaaaugccaugucuuucgcugugaggccccugcgaagaacauugccacaagccugcacgaaaucugcuccaaaauuauggcugagagacggaaugcccgcugucuugugaacgggcugagccucgaccacucuaagcugguugaugugccguuccaggucgaauuucccgcuccuaaaaaugagcuugugcaaaaguuccagguguacuaucugggaaacguccccguugccaagccugugggcguggacgucaucaauggggcccucgaauccgugcugagcucuagcuccagagagcaguggacccccucucauguuagcguggcuccggcgacgcugacaauucuccaccagcaaaccgaggccguccugggagaaugccgggugcgcuuccuuuccuuucuggcuguuggcagagaugugcauacauucgccuuuaucauggccgcugggccugccagcuucuguugccacauguuuuggugugagcccaacgcggcuucucucuccgaagccguccaggccgcuugcaugcugcgguaccagaaaugucuugacgccagaagccaggcuucuaccuccugccugccugcgcccccugccgagagcguggcccgccgggucggauggaccgugagacgcggcguucaaucccucuggggcucucugaagcccaaacggcugggggcucacacaccguga

SEQ ID NO: 65905 - RNA, 2001 nt, Artificial Sequence
  derived and/or modified sequence opt5 from APBB1IP__Homo_sapiens__XP_006717514
augggcgagagcuccgaagacaucgaucagauguucucuacccugcucggggagauggaccugcuuacacaaagccugggaguggauacgcugcccccuccggaccccaacccucccagagccgaauuuaauuacuccgucggcuucaaggaucucaacgagucucuuaaugcucuggaagaccaggaucucgacgcccugauggcggaucugguugcugacauuagcgaggccgagcagcggaccauccaggcccaaaaagaaucccuccagaaccagcaccauucugcuagccugcaggccuccauuuuuagcggggcugccucucuuggauauggcacaaauguggcggccaccgggaucucccaauacgaggaugaccugccucccccuccggcugaucccgugcucgaccugccucuucccccucccccgccugaaccccugagccaggaggaggaagaggcccaggcuaaggccgacaaaauuaagcucgcgcuggaaaaacugaaggaggccaaggucaaaaagcucgugguuaaagugcacaugaacgauaauucuacaaagucccugauggucgacgaacgccagcuugcuagagaugugcuggacaaccucuucgagaaaacccauugcgauuguaauguugacuggugccuguaugagaucuacccugaacuucaaaucgagcgguuuuucgaagaucacgagaacguggucgaagugcugagcgacuggacacgcgauaccgagaauaagauucucuuucuggagaaggaagagaaauaugccguguucaagaacccccagaauuuuuaccuggacaacagaggcaaaaaggaaucuaaagagacgaaugaaaagaugaacgcuaaaaacaaggagucccuccuggaggagagcuucuguggaaccuccaucauuguccccgaacuugaaggcgcccuguaucucaaggaggaugggaaaaagucuuggaaacggcgcuacuuucugcuuagagccagcggaaucuacuauguuccuaagggcaaaacaaagaccucccgggaccuggcuugcuucauucaguuugagaaugugaacaucuacuaugggacacaacauaagaugaaauacaaggcgccgaccgacuauuguuucgugcucaaacacccccagauucagaaggaaagccaguacaucaaauaucugugcugugaugacacgcgcacacugaaucaaugggucaugggaaucagaauugccaaguacggcaagacccucuacgauaacuaucagcgggcuguggccaaagccgggcuggcuucucgcuggacaaaucuuggaaccguuaacgccgcggcuccugcccagcccuccaccggcccuaagacaggcacgacccagcccaaugggcaaaucccgcaggccacacacagcgugucugcuguccugcaggaggcccagagacaugcugaaaccagcaaagacaagaaaccugcccucggaaaccaccaugaucccgcggugccucgggcgccccacgcuccuaaguccucucugcccccgccuccucccguucgcagaagcuccgacacaagcggcucucccgccaccccgcugaaggcuaaagggacgggaggcgggggacuucccgccccucccgaugacuuccucccucccccucccccgccucccccucuggaugaccccgagcugccgccucccccucccgauuuuauggaacccccuccggacuucgugcccccucccccucccuccuacgcgggcauugccggcagcgagcucccuccgcccccucccccucccccggcuccugcccccgcucccgucccugauucugcccggcccccuccggccguggcuaagagacccccugugcccccuaaacgccaagagaaucccgggcacccgggaggcgccgggggaggcgaacaggacuuuauguccgaccugaugaaggcccuucagaaaaagcgggggaacgucagcuga

SEQ ID NO: 65906 - RNA, 2277 nt, Artificial Sequence
  derived and/or modified sequence opt5 from APBB2__Homo_sapiens__NP_001159522
augagcgaggugcugcccgccgacuccggcgucgauacccucgcuguuuucauggccucuagcgggacaacggacgugaccaacagaaauuccccugcgacaccgcccaacacccugaaucuucggucuagccacaacgaacugcucaaugcugagaucaagcauacagaaaccaaaaacuccacaccucccaagugccgcaaaaaguacgcccugaccaauauucaggccgcuaugggacuuucugauccugccgcucaaccccugcucggcaacgggagcgccaauaucaaacuggugaagaacggagagaaucagcugagaaaggcggccgaacagggccagcaagacccuaacaaaaaucucuccccgacggcugucauuaacaucaccagcgagaagcuggaggggaaagaaccccacccucaggauucuuccagcugugagauucuucccucucagccucggcgcacaaaguccuuucugaauuauuacgccgaccucgaaaccagcgcuagagagcuggagcagaaccggggaaaccaucacggcacagccgaagagaaaucucaacccgugcagggccaggcguccaccaucaucgggaauggagaucuucugcuccagaagccgaaccgcccucaaagcucccccgaagacggccagguugccacggugucuagcuccccugagacaaagaaagaucaucccaagaccggggcuaaaacagacugcgcccugcaccggauucagaaucuggcucccagcgaugaagagucuuccuggaccacccucagccaagacucugccagcccuuccucuccggaugagacagacaucuggagcgaccacuccuuccagacggaucccgaccugccucccggauggaagagagucagcgauauugccggcaccuauuacuggcauaucccuacagggaccacacagugggaacgccccgugucuauuccggcugaccuucagggauccagaaaaggcagccugucuuccguuaccccuagccccacgccugagaacgaaaagcaacccugguccgauuuugcggugcucaauggcgggaaaaucaacucugacauuuggaaggaucugcacgccgcuacagucaauccugaccccagccuuaaggaguucgaaggagccacccugcgguaugccucccucaaacugcgcaacgcuccgcauccugaugacgaugacucuuguagcaucaauuccgaccccgaggccaagugcuuugcggugagaagccugggcuggguggagauggcugaagaggaucucgcccccgggaaaucuuccgucgccguuaacaauuguauccggcagcugagcuacugcaagaacgacauucgcgauaccgugggaaucuggggcgaagggaaagacauguaucuuauucuggagaaugauaugcucucucugguggacccuauggauagauccguccuucacagccagccgaucgugucuauucggguuuggggagugggcagagacaacggccgcgauuucgcuuacgucgcccgggacaaggauacaagaauccugaagugucacguguuucgcugcgacacccccgcuaaagccaucgcgacaagccuccaugaaauuuguuccaagaucauggccgagcggaaaaaugcuaaggcccuggcuugcagcucucugcaggagagagccaacguuaaccucgaugugccucugcaagucgacuuccccacgccuaaaaccgaacuugugcagaaguuucacguccaguaccuggggaugcuccccguggacaagccuguuggaauggauauucuuaauuccgcgaucgagaaccugaugacaagcuccaauaaagaagacuggcugucugugaacaugaaugucgccgaugcuaccgugacaguuauuagcgagaagaacgaggaagaggugcucgucgaaugucgcgugcgguuccuguccuuuaugggcguggggaaagacguucauaccuucgccuuuaucauggauacgggaaaucagagauucgagugccacgucuucuggugcgaacccaacgcuggcaaugugucugaggccgugcaagccgcuuguaugcugcgcuaucagaagugccucgucgcgcggccgccuagccagaaagugagacccccucccccgccugccgacuccguuacccgccgggugacaaccaacgucaagagaggggugcugucucuuaucgauacacugaagcagaaacggcccguuaccgagaugccuuga

SEQ ID NO: 65907 - RNA, 1482 nt, Artificial Sequence
  derived and/or modified sequence opt5 from APBB3__Homo_sapiens__NP_006042
augcugggcaaggacuacaugcucgccaucauucuggugaacugcgaugacgaucuuuggggagaccacagccuggaggucgaagcugggcucccgccuggcuggagaaaaauccaugaugccgcggggaccuauuacuggcacguuccguccggaucuacacaguggcaacggcccacgugggagcugggcgacgcugaagauccugggaccggaacagagggcauuuggggccuuagacccccuaaggggcgcagcuucuccucucuggaaagcucccucgaccggucuaauagccuguccugguauggaggcgagagcuacauccagucuauggagcccggggccaaauguuuugccgugcgcucccugggauggguggaagucccugaggaagaucucgcuccgggcaagagcucuauugccgugaacaauugcauccagcagcuggcucaaaccagaucccggagccagcccccugacggggccuggggagagggccagaacaugcuuaugauccugaaaaaggaugcgaugucucucguuaauccccuggaccauucccuuauucacugucagccucuggugcauauccgcgucuggggcguggggagcuccaagggaagagauucucccauuagcgccccggcucgggacuucgccuuuguugcuuccgacaaagauagcugcaugcucaagugucacguguucugcugugacgucccugccaaagcgaucgccucugcucugcacggccugugcgcccaaauucucuccgagcgcguggaagugagcggggaugcuucuuguugcagccccgacccuaucucccccgaggaucugcccagacaggucgaacuucuggacgccguuucucaggccgcucagaaguaugaggcgcucuacaugggaacacugccugugaccaaagccaugggcauggaugugcuuaacgaagcuauugggacacugaccgcccggggagaccgcaaugccugggucccgacgaugcucagcguguccgauagccugaugaccgcucaucccauccaagccgaggcgucuacagaggaggaaccucuguggcagugucccguuagacucgugaccuuuaucggcgucggccgggacccucacacauucgggcugauugcugaucuuggacgccaguccuuucaaugcgccgccuucuggugccagccccaugcuggcgggcugagcgaagccgugcaggcugccuguaugguucaguaucaaaagugccucguggcgucugccgcuagaggaaaggccuggggcgcucaggcccgggcgagacugcgccuuaaacggaccuccagcauggacucccccgggggcccucugccccucccucugcugaagggaggcgucgggggagccggcgcuacgcccagaaaacgcgggguguuuucuuuccucgacgccuuucggcugaagccuagccuucugcacaugcccuga

SEQ ID NO: 65908 - RNA, 6984 nt, Artificial Sequence
  derived and/or modified sequence opt5 from APC2__Homo_sapiens__XP_005259532
augggccugcucgggcugcuuagccugcuccacuccgccuucuuuggagaccagacccugcaagagcuuaagauggcuucuagcguggcccccuacgaacagcuggugcgccagguugaggcccucaaggcugaaaacucccaucugcggcaggagcugcgcgauaauucuagccaccucuccaagcuggaaacagagacgucuggcaugaaagaggugcuuaagcaucugcaagggaaacucgaacaggaggccagagugcuggucagcuccggacagaccgaagugcuugagcagcugaaggcccuccaaauggacaucacaagccuguauaaccugaaguuccagccuccgacccucggccccgagccugcugcccggacacccgaagggucuccuguucacggauccggccccagcaaagauucuuuuggcgagcugucccgcgcuaccauuagacuucuggaggaacucgaccgggaacgcugcuuccugcuuaaugagaucgagaaggaagagaaagaaaagcugugguacuauagccagcuccaggggcugucuaaaagacuggaugagcucccucauguggaaacacaauuuuccaugcagauggaccugauucggcagcaacuugaguucgaggcccagcacauccgcagccugauggaagagagauuuggaaccuccgaugaaaugguccagcgggcccagauucgcgccucuagacucgagcaaaucgacaaggaacugcuugaggcucaggaucgggugcagcagacggagccgcaagcccugcucgcuguuaagagcgugcccgucgacgaagauccugagaccgaagugcccacacacccugaggacggcacaccccaaccggggaacuccaaaguggaggucguuuucuggcugcugagcaugcucgccacccgcgaucaggaagacaccgccagaacgcugcuugccaugucuuccagcccugagucuuguguggcuaugcggagaagcggaugccugccccuccugcugcagauccuucauggcacagaagccgcugccgggggacgcgccggcgcuccuggcgcccccggggccaaggacgcucggaugagagccaaugccgcucuccacaacauuguguuuucccaacccgaucagggacuggcccgcaaagagaugcggguccugcaugugcucgaacagaucagagcguacugugagaccugcugggacuggcugcaggcucgcgauggcgggccugagggaggcggggccggaucugccccgauucccaucgaaccucaaauuugucaggcuacaugcgccguuaugaaacuuagcuucgacgaggaauaucggagagcuaugaaugagcugggcggccuccaggccguggcggaacugcugcaagucgauuacgagaugcacaaaaugacccgcgacccccuuaaccucgcccugcggagauaugcugggaugacccugacaaaucucacguuuggagauguggccaacaaggcuacccugugugcccgccggggcugcauggaggcgaucguugcccagcuugcuuccgacagcgaggaacugcaccagguggucucuuccauucucagaaaucugagcuggcgggccgauaucaacucuaaaaaggugcugcgcgaagcuggguccgucacagcccuugugcaguguguucucagagccaccaaggagagcacacugaaauccgugcugucugcucucuggaaucugagcgcgcauuccaccgaaaacaaggccgcuaucugccaagucgacggagcccuuggcuuccuggugucuacgcucacauacaaaugucagagcaauucccuggccauuaucgagagcgggggcggcauucugcggaacguuucuucccuuguggcuaccagagaggauuaccgccagguccuccgggaccacaacugccugcagacccugcuccaacaucugacaagccacucucuuaccaucguguccaaugccugcggcacacuguggaaccucagcgcgagaucugcucgcgaccaggaacugcugugggaucuuggggccgugggaaugcugagaaaucucguucauagcaagcacaaaaugauugccaugggcuccgcugccgcgcugcggaaccuccuggcucaccgcccugccaagcaucaggccgcugccacggcugucagccccgggucuugugugccgucccuuuaugugagaaagcagcgggcccuggaggcggaacucgacgcccgccaccuggcucaagcccuggagcaucuugagaaacagggaccucccgcugccgaagccgcuaccaagaaaccucugcccccucucagacaccuggauggccucgcgcaggacuacgccagcgauuccgggugcuuugacgaugacgaugcucccucuagccuggccgccgcugccgcgacaggcgagccggcuuccccugccgcccuuucucuguuccucggaagccccuuccugcaaggccaggcucuggcccggacacccccuacacgcagagggggaaaggaagcggagaaagacaccuccggcgaagcugccgucgccgcuaaggccaaggcuaaacuugcccuggcgguggcccggaucgaucagcucguugaggacaucucugcucugcacacgagcuccgaugacagcuuuucucucuccagcggggacccgggacaggaggcgccccgcgaaggcagagcucaaucuuguuccccuugccgggggcccgagggcggaagacgcgaagccggcagccgggcccauccucugcuuagacugaaggcugcgcacgccucucuguccaaugauagccucaacuccgggagcgcuucugacggauauuguccccgcgagcauaugcugccuugcccccuugccgcccuggcuagccggagagaagauccgcgcuguggccagccucggcccuccagacucgaccuggaucucccugggugccaggccgagcccccggcgcgcgaggcuaccucugccgacgcccgggugagaacaauuaaacugagcccuaccuaccagcacgucccccuucuggaaggagcuucccgggccggcgcggagccucuggccgggcccggcaucucucccggagcucgcaagcaagccuggcucccugcugaucaucugagcaaagugccggaaaaacuugccgcugcgccccuguccguugcgucuaaggcccuccagaaacuggcugcccaggagggcccucucagccuguccagauguagcucucuuuccagccugucuuccgcugggcggcccggaccuagcgaaggcggggaccuggaugacuccgauucuagccucgagggacuggaggaagccggccccuccgaggccgaacuugacagcacauggcgcgcuccuggcgcgaccucucugccgguggccauucccgcuccuagacggaauagagggcgcggacucggcgucgaggaugccacgcccuccagcucuagcgagaacuaugugcaggaaacaccucugguucucucccggugcucuagcguguccucucuggggagcuucgagucccccagcaucgccucuuccauuccgagcgaaccuuguuccggacaaggcucugggaccaucagccccuccgagcuucccgacucuccuggacagacaaugcccccuagcagauccaagaccccgccccuggcuccugcgccccagggcccucccgaagcgacccaguuuagccugcaaugggagucuuacgucaaacgcuuccucgacaucgccgauugccgggagagaugccgccugccguccgaacuugacgcuggcagcgugcgguuuacaguggagaagccugaugaaaauuucucuugugccuccagccugucugcucucgcccugcacgagcacuauguccagcaggacguugaacugagacuccuucccagcgcgugcccugagcgcgggggaggcgccgggggagcuggccugcauuuugccgggcacagacggcgcgaggaaggacccgcuccuacgggcuccagaccccggggcgccgcugaucaagagcuggaacuccugcgcgagugucuuggggccgcggugccggccagacugcggaaaguggcuucugcccucgucccuggaagacgcgcucugcccgugcccguuuacaugcuggugccugccccggcccccgcgcaggaagacgauagcugcaccgacuccgcugagggcacaccugucaacuucagcuccgccgcuucucucagcgaugagacccuucaggggcccccucgggaccagcccggaggcccugccgggagacaacgcccgacaggacggcccaccuccgccagacaggcuaugggccaucggcacaaggccggcggggcgggacgcucugccgaacagagcagaggcgcugggaaaaaucgggccggacuggagcugccucucggcagacccccuuccgcucccgccgauaaggacgggucuaagccgggaagaacgcggggcgacggcgcgcugcagagccuuugucugacaaccccuaccgaagaggccguguacugcuuuuaugggaacgauuccgacgaggaaccgcccgcugccgcuccuacacccacccaucgcagaacaagcgccauuccucgggcuuucacgcgcgagagaccgcaaggacggaaagaagcccccgcgccuucuaaggccgcucccgccgcuccucccccggccagaacccagccuucccucaucgccgaugagacacccccuuguuacagccugucuuccagcgcgucuucccugagcgaacccgagccuuccgagcccccggcuguucacccucgcggccgggaacccgccgugaccaaagaccccgggccuggaggcgggagagauagcucuccgagcccccgcgccgcugaggaacuccuucagcggugcauuuccucugcccugccuagacgccggcccccugucagcggacugagacgccggaagcccagagcuacacgccucgacgagcggccugccgaaggcuccagagagcgcggcgaggaagcggccgggucugauagagcuagcgaccuggauuccguggaguggcgggccauccaggaaggagcuaauucuauuguuaccuggcuucaccaagccgcggccgcuacgcgcgaggccagcuccgaaagcgacucuauccuguccuuugugagcggccucucugucggguccacccugcagcccccgaaacauagaaagggacggcaggcugagggcgagauggggagcgccagacggccugaaaagcgcggagcugccuccgugaaaacaucuggcagccccagauccccugcgggccccgagaagccgcgggggacccagaagaccaccccuggagugcccgccguccugcgcggcagaacaguuauuuaugugcccagcccugcuccccgggcccagccuaaggggaccccgggaccccgcgccacgccuagaaaaguggcucccccuugucucgcccagcccgcggcuccugccaaggucccgucucccggccagcaacggucccgcagccuucacagaccugccaagacaucugaacuggcuacccugagccagcccccucgguccgccacaccucccgcucgccucgccaaaacacccucuagcuccucuagccagaccucccccgcgagccagccccugccuagaaagcggcccccugugacgcaagccgcuggggcccuuccgggccccggagcuucuccuguucccaaaaccccugcccgcacccugcucgcgaagcagcauaaaacacagagaucccccgugcggaucccguucaugcagagaccugcccgccggggacccccuccccuggcuagagccgucccggagccugggccccgcggacgggcuggcaccgaggccgggcccggagccagaggcgggcgccugggccucgugcggguugcuagcgcgcuuuccucuggaagcgaauccucugauagaagcggcuuucgccggcaacugacauucaucaaggaguccccugggcugagacgccggagaagcgaacucucuuccgccgagagcgcugccucugcgccccagggagcuuccccucggagaggccgcccggcccugcccgcgguguuccuuugcagcucucggugugaggaacugagagcugccccucgccaggggcccgccccugcuagacagcggcccccugccgcucgcccgucccccggagagagaccugcccggcgcaccacgagcgaaucucccagcagacucccuguccgggcgcccgccgcucgcccggagaccgugaagagauacgccucccugccucacauuagcgucgcucggcgccccgacggcgccgugcccgcggccccugcuuccgccgaugcugccagacggucuagcgacggggaaccccgcccucugccgagaguugccgcucccggcacaaccuggcggagaauccgcgacgaggaugugccucacauucuccgguccacacuucccgcgaccgcccugccucugagaggaucuacgcccgaagacgcuccggccggcccucccccucgcaaaacaagcgaugccgucgugcaaaccgaggagguugcugcccccaagacaaacuccucuaccagcccuucccucgaaacccgggagcccccgggggcgcccgcuggaggccagcugagccuucuggggucugacguggauggaccuucccucgccaaagcccccaucagcgcuccuuuuguccaugaaggccugggcguggccgucgggggauucccggcuucuagacacggcucccccagccgcucugcccggguuccucccuuuaauuaugucccuucccccauggugguggcggccacaacggacagcgcugccgagaaggcuccugccaccgcgucugccacacugcucgaauga

SEQ ID NO: 65909 - RNA, 1545 nt, Artificial Sequence
  derived and/or modified sequence opt5 from APCDD1__Homo_sapiens__NP_694545
augagcuggcccagacggcugcuccugcgcuaccuuuucccugcccugcuccugcacggccuuggggagggauccgcucugcuccauccggacucuagaagccacccccggucccuggaaaagucugccuggcgcgcguuuaaagagagccagugccaucacaugcugaagcaucuccacaacggcgcuagaaucaccgugcaaaugccucccacaauugaagggcacugggucuccacgggaugugagguucggucuggcccugaguucaucacccgcagcuauagauuuuaccauaauaacacauucaaagccuaucaguuuuacuauggguccaaucggugcaccaaccccacauacacccugauuauccgcggaaagauuagacuucggcaggccagcuggaucauccgcggcggcacagaagcugauuaucagcugcacaaugugcaagugauuugucauaccgaggccgucgcugaaaaacucgggcaacaggugaacagaacgugcccuggauuccuggccgacggcgggccguggguucaggauguggcguacgaccuuuggcgggaggaaaauggaugugagugcaccaaggccgucaacuuugcuaugcacgagcugcagcucauccgcguggaaaagcaguaccugcaccauaaucuggaucaccucguugaggaacuguuccuuggcgacauucauacagaugccacccagagaauguuuuaucggcccucuuccuaccagccuccccugcaaaacgcuaaaaaucacgaccaugccuguaucgcgugcagaauuaucuaucgcagcgaugagcaccacccucccauucucccgccuaaggccgaccugacaaucgggcuucauggagaaugggugucucagcggugugaggucagacccgaggugcuguuccucacccgccacuuuaucuuccaugauaacaauaacacgugggaaggccacuacuaucacuacuccgacccugugugcaaacaucccacauuuagcauuuaugcucggggcagauacucucgcgggguccuguccagccggguuaugggaggcaccgaguucguguucaaggugaaucacaugaaagucacacccauggaugccgcuaccgccucccugcucaacguguuuaacgggaaugaauguggagccgagggcucuuggcagguugggauccaacaggacgugacccauacaaacggaugcgucgcucugggcauuaaacuuccucacacggaauacgagaucuucaagauggagcaggacgcgagaggccgcuaucugcucuuuaaugggcagcggccgagcgauggauccagccccgacagaccugaaaagcgcgccaccucuuaccaaaugccccuggugcagugcgcuuccagcucuccucgggccgaggaucuugccgaagacagcggcuccucucuguaugggagagcucccggacggcauacauggagccuccugcuggccgcgcucgcuugucugguuccgcuucugcacuggaacauucgcagauga

SEQ ID NO: 65910 - RNA, 1539 nt, Artificial Sequence
  derived and/or modified sequence opt5 from APCDD1L__Homo_sapiens__NP_001291716
auggccgagaacagcggccccggggugagaccuccgggaugggaagcucagaucaauauuaucuccacccggcuggcccucgcgcacacagcucccgccgccggcgaggcugggggaucuugccugcgcugggaaccucauugucaacagccccuuccugacagaguccccagcacggccauucugccuccgcggcucaacggccccuggaucuccaccgggugcgagguucgcccuggacccgaguuccugacaagagcuuacaccuuuuauccuucucggcuuuuccgcgcccaccaguuuuacuaugaagaucccuucuguggcgagccggcgcauagccugcucgugaagggcaaagugagacugcggcgcgccuccugggucacaagaggggcuaccgaagccgacuaccaucugcacaaggugggaauuguuuuucacucucggcgcgcucucguggaugucacaggcagacugaaucagacccgggccgggcgcgacugcgcgagacggcuuccucccgccagagcuuggcugccuggagcccucuaugagcugcgcagcgcucgggcccaaggcgauugucuugaagcccuggggcucacgaugcacgagcugucccuggugagaguucagcgccggcuccagccccagcccagagcuagcccucgccugguggaggaacuuuaccugggagacauccauaccgauccggcggagcggagacacuaucgccccacaggcuaccaacggccucuccagucugcccugcaucacguccagcccugcccugcuuguggccuuaucgccagauccgacgugcaccaucccccggugcugccucccccucucgcccugccccugcaccucgggggauggugggucagcucuggcugcgaaguucgcccugcugugcuguuccuuacccggcuguuuacauuccaugggcacuccagaagcugggagggauacuaucaucacuuuucugaucccgccugucggcagccgaccuucacgguguacgcggcuggccgcuauacaagagggaccccuuccacacgggucagaggaggcaccgaacucguguuugagguuacccgcgcccacgugacacccauggaccaagucacgaccgccaugcugaacuucagcgagcccuccucuugcggcggggcuggagccuggagcaugggcacagaacgggaugugaccgcuacaaaugggugucuuccucugggaauuagacucccgcauguugaguacgaacuguuuaaaauggagcaggacccccugggccagucccuccuguucaucgggcaacgcccuaccgauggcagcucucccgacacgccugaaaagagacccacauccuaucaggccccucuugugcugugccacggagaggcgcccgacuucagccggccgccucagcaucgccccucucuccagaaacacccuagcaccggcgggcugcacauugcccccuuuccgcugcuuccucucguccugggacuggcuuuccuccauuggcuguga

SEQ ID NO: 65911 - RNA, 8532 nt, Artificial Sequence
  derived and/or modified sequence opt5 from APC__Homo_sapiens__NP_001120982
auggccgcugccagcuacgaccagcugcucaagcaaguggaggcgcugaaaauggaaaacuccaaucuuagacaggagcuggaagauaacucuaaucaccucaccaagcuggagacagaagcuagcaacaugaaagagguccuuaagcagcugcagggcuccaucgaggacgaagccauggccucuagcgggcaaauugaucuccuggagcggcugaaagaacucaaucuggacuccucuaacuuccccggaguuaagcuucgcagcaagaugucccugagaagcuauggcucucgggagggguccgugagcucucgcuccggagagugcagcccugugccgaugggcucuuuucccagacggggguucgucaauggaucccgcgaaagcacgggcuaccucgaggaacuggagaaagaaagaucccuucugcucgcugaucuggacaaggaggagaaagaaaaggauugguauuacgcccagcugcagaaccucaccaaacggaucgacucucugccucuuacagagaauuuuagccugcagaccgauaugacacgcagacaacucgaauaugaggcucggcagauucgcguggccauggaagagcagcugggcaccugucaggacauggagaagagagcgcaacggcgcaucgccagaauucagcagaucgaaaaggauauccuucggauuagacaacugcuccagucccaggcuacagaggccgaacgcagcucucagaacaaacaugagaccgggucccacgacgcugaacggcaaaaugagggacagggcguuggggagaucaacauggccacgagcggaaauggccaggggucuaccacaagaauggaucaugaaaccgcgagcgugcuguccucuagcuccacacacagcgccccccgccggcugaccucucaucucggaacgaaggucgagaugguguacucccugcuuagcaugcugggcacacacgacaaagacgauaugucuagaacccuccuggcuauguccagcucccaggacucuugcauuagcaugcgccaauccggcugucuuccucugcucauccagcugcugcacgggaacgauaaggacucuguucuccugggaaauagccggggcuccaaagaagccagagcucgcgccagcgccgcucuucauaacauuauccacucucagcccgaugacaagcgggggagacgcgagauucgggugcugcaucuccuggagcagaucagagcguauugcgaaacauguugggaguggcaagaagcccacgagccuggaauggaucaggacaaaaacccgaugcccgcuccugucgaacaccagaucugccccgccgugugugugcugaugaagcuuuccuucgaugaggagcaucggcacgccaugaaugaacucggcgggcugcaggcuauugccgagcugcuccaagucgacugcgaaauguacggacugaccaacgaucauuacagcaucacccuucgcagauaugcgggcauggcucugacaaaucucacguuuggcgacguugccaacaaggccacccuguguucuaugaaagggugcaugcgggcucugguggcccagcuuaaguccgagagcgaagaccuccagcaagugauugcuucuguccugagaaaucugagcuggcgcgccgaugugaacuccaaaaagacacuccgggagguuggaagcgugaaagcgcugauggagugugcccuugaagucaagaaggagucuacccugaaauccgugcucagcgcucuguggaaucuguccgcccacugcacagaaaacaaggcugacaucugcgccguugauggcgcgcuugccuuccucguggggacccugacguacagaucucagacaaauacccuggcuauuaucgagagcggaggcgggauccuccgcaacgucuccucucugauugccaccaaugaagaccauagacagauccuucgggagaacaauugucugcagacacuccugcaacaccugaaaagccacucccuuaccauugugucuaacgcuugcggcacacucuggaaucugagcgcccgcaacccuaaggaucaggaggcccugugggacaugggagcugucuccaugcucaaaaaccugauccauagcaagcacaagaugauugcgaugggcucugccgcugcccuuagaaaucugauggccaaccggcccgcuaaauauaaggaugccaauaucauguccccggggagcucucucccuucccugcaugugcgcaaacagaaggcgcuggaagcugagcuugacgcccagcaccugagcgaaacguuugauaacaucgacaaucucucucccaaagccucccacagaagcaagcaacggcauaagcagucccuguacggagauuauguuuucgacaccaaccgccacgaugacaauagaagcgacaacuuuaauacaggcaacaugaccgugcucucuccuuaccugaauacaaccguccuucccagcuccucuagcucccgggggucucuggauagcucccgcucugagaaagacagaagccucgagcgggaaagaggaauuggccuggggaacuaucaucccgcuacggagaauccuggcaccuccagcaagcgcggacugcagaucucuacaaccgccgcgcagauugcuaaagugauggaagagguuuccgccauccacacaagccaagaagaucggucuuccggcagcaccacggagcuucauugugugacagacgagagaaacgcccugcgccgguccucugcugcccacacccacagcaauacauacaacuucaccaaguccgaaaacagcaauagaaccugcucuaugccguacgcuaaacucgaguauaagcgcuccagcaacgauucucugaauagcgucuccucuagcgacggguacggaaaacggggccagaugaagcccuccauugaaucuuauagcgaggaugacgaauccaaguuuuguagcuacgggcaguauccugccgaucucgcgcauaaaauccacucugccaaccauauggacgauaaugacggagagcuggauacacccauuaacuacucccuuaaguauagcgacgagcaacugaauuccggcagacagucuccuagccagaacgaacgcugggcucggcccaaacacaucaucgaggacgaaauuaagcaguccgagcaaagacagucucggaaucagagcacgaccuacccgguguacacagaauccaccgaugacaaacaucucaaguuccagccucacuuugggcaacaggagugcgugagccccuaucgcucuagaggcgccaacggauccgagacaaaucggguuggcagcaaccacgggaucaaucagaacgucucucagucccugugucaagaagaugacuacgaggaugacaagccuaccaauuauagcgaacgcuacucugaggaggaacagcaugaggaagaggaaagacccacgaacuauagcauuaaauacaacgaggagaagcggcacguggaucagccuaucgacuauucccugaaauacgcuacagauauucccucuagccagaagcaauccuucagcuucuccaaaucuagcuccggacagucuagcaagaccgaacauauguccucuagcuccgagaauaccagcacaccgucuuccaacgccaagagacagaaucaacuucacccuagcucugcccagucccgcagcggccagccccagaaagcugcgaccugcaaggugucuuccaucaaccaagaaacaauccagacguacugugucgaggacacccccauuugcuuuagccgguguuccagccugucuagccucuccucugccgaagaugagaucgggugcaaucagacaacccaggaggcugacagcgccaacacacugcaaauugccgaaaucaaagagaagauuggaaccagauccgcugaagacccugugucugagguuccggccgugagccagcacccccgcacgaaauccucucggcuccagggcagcucccugagcucugaauccgcgagacauaaggcugucgaguucagcucuggggccaaguccccuagcaaauccggcgcccagacccccaagucuccucccgagcacuaugugcaagaaacaccucuuauguuuagccgcugcaccuccguuagcucucuggauuccuucgagagccggucuaucgcuagcuccgugcagucugaacccuguagcggaauggucuccggcaucauuucuccgagcgaccugccugauucccccgggcagacaaugccucccagcagaucuaaaaccccgccucccccuccccaaacagcccagaccaagcgcgaggugcccaaaaauaaggcgccuacggcugagaaaagagaauccggaccgaagcaggccgccguuaacgcugccgugcagcggguccaagugcuccccgacgcugauacacugcuucauuuugccaccgagagcaccccugacggcuucuccugcucuagcucccugucugcgcucagccuggaugaacccuuuauccagaaggacguggagcuccgcauuaugccucccguccaggaaaaugauaacgggaaugagacagaguccgaacagccuaaagagagcaacgaaaaucaagagaaggaagccgagaaaaccaucgacucugagaaggaucugcuugacgauuccgacgacgaugacauugaaauccuggaggaauguaucauuagcgcuaugccgacgaaaucuuccagaaaggccaagaaacccgcucagacagccagcaagcugccucccccuguugcccggaaacccucucagcucccgguguacaagcugcuuccuucccagaaccgccugcaaccccagaaacacgugagcuucacccccggagaugacaugccuagagucuauugcguggagggcacacccaucaauuuuucuaccgcuacaagccucuccgaucugaccauugaaagcccuccgaacgagcucgcggccggcgaggggguucggggaggcgcucaguccggggaauucgagaagagagacacgauccccaccgaaggacgcucuacagaugaggcccagggcgggaagaccagcuccgugacaauuccugagcuggacgauaauaaagccgaagagggagacauccuugcugaauguauuaacucugccaugcccaagggcaaaagccauaagccuuuucgggucaaaaagaucauggaucaagugcagcaggcguccgcuucuagcuccgcccccaacaagaaucaacuggacggcaaaaagaaaaagccgaccagcccuguuaaacccaucccucagaacacggaguacagaacacgcgugcggaagaaugccgauucuaagaacaaucugaacgcugaaagagucuucuccgacaauaaagacagcaagaaacagaaccucaagaauaacucuaaaguguuuaaugauaagcugcccaacaaugaggaccggguucgcggguccuucgccuucgauagcccucaccacuauacccccauugagggaacaccguacugcuuuucuagaaacgacucccuuagcucucuggauuucgacgaugacgauguggaccucucccgggaaaaagcggagcugcgcaaggccaaggaaaauaaagagagcgaagcuaaggucaccagccauaccgagcucacauccaaccagcaaucugccaacaaaacgcaggcuaucgccaagcagccuauuaauagaggccagcccaaacccauccugcaaaagcagagcaccuuuccucaguccucuaaggauauuccggaccggggggcugccacagacgagaaacuucagaacuucgcgaucgaaaauacccccguguguuuuagccacaacuccucucugagcucccugagcgauaucgaccaagagaauaacaauaaggaaaacgagccuauuaaagaaacagagcccccugauucucagggagagcccuccaagccucaggccagcggcuaugcuccgaaaucuuuccauguggaagacacccccgucugcuuuucccgcaauagcucccucucuagccuguccaucgauucugaggacgaucuucugcaagaauguauuagcuccgccaugccuaagaagaaaaagcccagcagacucaaaggggacaacgagaagcacucuccucggaauaugggaggcauccugggcgaggaucugacgcucgaccuuaaagauauucagcgccccgacuccgaacacgggcugagcccggauucugagaacuucgacuggaaggcuauccaggaaggagccaauagcaucguuuccucucugcaucaggccgcugcggccgcuugccucagcagacaagccuccagcgacucugauuccauucugagccuuaaguccggcaucucucuggggagcccuuuucaccucacacccgaccaggaggaaaaacccuucaccuccaacaagggaccucggauucugaaacccggcgagaagucuacccuggagacaaaaaagaucgaaagcgaguccaaagggauuaagggaggcaagaaaguguacaagucucucaucaccggcaaagugagaagcaauuccgaaauuagcgggcagaugaagcagccucuucaagccaacaugccgucuaucucccgcggacggacaaugauccauauucccggcgucagaaacagcucuuccagcacgucuccugugagcaaaaaggggcccccucugaagacccccgcuuccaaaagcccguccgagggacagacagccaccacaucuccucgcggcgcgaagcccagcguuaaauccgaacugucuccuguggcccggcagaccagccagaucgggggauccucuaaggcucccagcagauccggcagccgcgauucuacgccuucccggcccgcccaacagccgcucagcagaccuauucagucucccggccgcaauuccaucagccccgggcggaacggaauuucuccuccgaauaaacugucccaacuucccagaaccagcucuccuuccacagcuagcaccaaguccagcggcucugggaagaugagcuacacaucccccggacgccagaugucucagcagaaccugaccaaacaaacaggccucagcaagaaugccuccucuaucccucggagcgaguccgcgagcaaagggcugaaccagaugaauaacggaaauggcgccaacaagaaagucgagcugucuagaauguccagcacgaagucuuccggcagcgaaucugaccgcuccgagagacccgugcucguucggcagagcaccuuuaucaaggaagcuccuucccccacacuucgcagaaaacuggaggaaucugccagcuucgagucccugagcccgucuucccggccugcuagccccaccagaucucaggcccaaaccccugugcucagccccucccugccggauaugucucuuagcacacacuccagcguccaggcugggggauggcggaagcugccucccaaucucucucccacgauugaguauaacgacggccgcccugccaaaagacaugauaucgcgcggucccacagcgaaucucccucccgccugccuauuaauagaagcgggaccuggaagcgggagcacuccaaacauucuagcucccugccgcgcgugucuacauggagacggaccggaagcuccagcucuauccucuccgccagcucugaauccagcgagaaggcuaaaucugaggacgaaaagcacgucaacuccauuagcggcacaaagcagagcaaagagaaucagguguccgccaaggggaccuggcgcaaaaucaaggaaaacgaguuuucucccacgaacagcacaucccaaaccguuucuagcggagcuaccaauggcgccgaauccaaaacacuuaucuaccagauggccccugcggugucuaagaccgaggaugucugggugagaauugaggacugucccaucaacaauccucggagcggccgcucccccacagggaacaccccuccgguuauugauucugugagcgaaaaggcuaaucccaacaucaaagacuccaaggacaaucaggccaaacagaacgucggaaauggcagcgugccuaugagaacgguggggcuggagaaccggcugaauucuuucauucaaguugaugcucccgaccagaagggaacagaaaucaaaccuggccagaacaaucccgucccgguguccgagaccaacgaaagcucuauuguggagcgcacaccuuucuccagcucuuccagcuccaagcauagcucucccagcgggaccgucgccgccagagugacgcccuuuaauuauaacccuuccccccggaagucuagcgcugauuccaccucugccagaccuagccaaaucccgacacccguuaacaauaacaccaaaaagcgcgacuccaaaacagauucuaccgagagcuccggcacacagagcccuaagcggcacucuggauccuaccucgugaccagcgucuga

SEQ ID NO: 65912 - RNA, 672 nt, Artificial Sequence
  derived and/or modified sequence opt5 from APCS__Homo_sapiens__NP_001630
augaacaagccccugcucuggaucagcgugcugaccucccuucuggaggccuucgcucacacagaccucucuggcaaagucuuuguuuucccuagagaaagcgugacggaucaugugaaucugauuaccccgcuugagaagccccugcagaacuuuacacucugcuuccgggccuacuccgaccugucucgcgcguauagccuguuuuccuacaauacccaagggagagauaacgaacuccuggucuauaaagagcgggugggagaauacucucuuuauaucggccgccacaagguuacaagcaaagugauugagaaguucccugcucccguccauaucuguguguccugggagucuagcuccgggauugccgaauuuuggaucaauggaaccccucugguuaagaaaggccucagacagggguacuucguggaggcccagcccaagaucguccugggacaggaacaagacagcuauggcggcaaauuugaucggucucaguccuucgugggggagauuggagaccuuuacaugugggauagcgugcugccuccggagaacauccucucugcuuaccagggcacaccccugccugccaauauucuggacuggcaggcucucaacuaugaaauccgcggguacgucauuaucaagccccugguuuggguguga

SEQ ID NO: 65913 - RNA, 2199 nt, Artificial Sequence
  derived and/or modified sequence opt5 from APEH__Homo_sapiens__NP_001631
auggagagacaggugcugcucagcgaacccgaggaagccgcugcccuguaccggggccuuucccgccaaccugcgcugucugcugccugccucgggccggaggucaccacacaguauggaggccaguacagaacgguucacaccgaauggacacagcgggaccuggagcgcauggagaacaucagauucugucggcaauaucuuguguuucaugauggggacagcguggucuucgccggacccgcuggcaauuccguggaaacccgcggggagcugcucucuagagaaagcccuuccggaacaaugaaggccguucugcggaaagcuggcggcaccgggcccggagaggagaagcaguuucuggaagugugggagaaaaaccgcaagcucaaaucuuucaaucugagcgcccuugaaaagcacggcccugucuacgaggaugacugcuuugggugucuguccuggagccauucugaaacacaccuccuguauguggcggagaagaaaagacccaaggccgaguccuucuuucagaccaaagcucuugauguuagcgccucugacgaugaaauugcucggcugaagaaaccugaccaggccaucaagggagaucaauucguguuuuacgaggacuggggcgaaaacauggucuccaagagcauuccggugcucugcgugcuggaugucgagucugggaauaucuccguucuggaaggagugcccgagaacgugagcccuggccaggcguucugggcccccggcgacgcuggggucguguuuguuggaugguggcaugagccuuuccgccucggcauuagauuuuguacgaaucggcgcuccgcccuguauuacguggaucuuaucgggggaaaaugcgaacugcucucugacgacagccuggcugucuccagccccagacuuucuccggaucagugucggaucguguaccugcaguauccuucccucauuccccaccaccaaugcagccagcugugucuguacgacugguauaccaagguuacaucuguggucguggaugucgugccuagacagcucggcgagaacuucagcgggaucuacugcucccugcuuccccugggauguuggucugccgacagccaacgcguuguguucgauuccgcccagcggagcagacaggaccucuuugcugucgauacccaggugggcacaguuaccucucugacggcgggcggguccggaggcagcuggaaacuucugacaauugaccaagaucucaugguggcccaguucucuacccccucccugccuccgacacugaaggucggguuucuccccagcgcuggaaaagaacaguccgugcugugggugucucuugaggaagccgagccuauccccgacauucauuggggcauccgcguucugcagccucccccggagcaagaaaauguccaguaugccgggcucgauuucgaggcuauucugcugcagccuggcagcccucccgacaagacccaggugcccaugguggucaugccucacggaggcccccauuccucuuuugugaccgccuggaugcuuuucccggcgaugcucugcaaaaugggguuugcuguucugcuggugaacuaccggggaagcacaggcuucgggcaagacuccauccucagccugccuggaaaugucggccaccaggaugugaaggacguucaguuugccguggaacagguccuucaagaggagcacuucgaugccucucauguggcucugaugggcgggucccacggaggcuuuaucagcugccaucucauugggcaguaucccgaaacguacagagccuguguugcucgcaaccccgugaucaauauugccucuaugcugggauccaccgacaucccugauuggugcgucguggaggcgggcuucccguuuagcucugacugucugcccgaucuuagcgugugggccgaaaugcucgacaaguccccuauucgguacaucccccaggucaaaacaccucugcugcucaugcuggggcaagaggauagacgcguucccuucaagcagggaauggaauauuaccgggcucuuaaaaccagaaacgugccugugcgccugcuccuguaucccaagagcacacacgcccugucugaggucgagguggaauccgacagcuucaugaaugcuguucuuuggcuccggacccaucugggcuccuga

SEQ ID NO: 65914 - RNA, 957 nt, Artificial Sequence
  derived and/or modified sequence opt5 from APEX1__Homo_sapiens__XP_005267638
augcccaagagaggcaaaaagggggccguggcugaggacggagaugaacugcggaccgagccugaagccaaaaagagcaaaacagcggcuaagaagaacgacaaagaggccgccggcgaagggccggcucucuacgaggaucccccugaccagaagacgucccccucuggaaaaccugccacccugaagaucugcagcuggaaugucgauggccuucgcgcuuggauuaaaaagaaggggcuggacuggguuaaagaggaagcccccgauauccucugucugcaagagacaaagugcuccgaaaacaaacuuccugcggagcugcaggagcucccgggacugucucaccaguauuggagcgcccccuccgacaaggaaggcuacucuggcguggggcugcucagcagacaguguccucugaaaguguccuauggaauuggcgaugaggaacaugaccaagaggggcgggucaucguggcugaguucgauagcuuuguucuugugaccgccuacguccccaaugcuggacgcggccuggugagacucgaauaucggcagcgcugggacgaggccuucagaaaguuucugaaagggcuugcgucucggaagccucugguucucugcggagaucugaacguggcccacgaagagauugaccugcgcaaucccaagggcaacaaaaagaaugcuggcuucacaccgcaggaaagacagggguuuggagagcuccugcaagccgucccucuugcugacuccuuccggcaucuguaccccaacaccccuuaugccuacacauuuuggaccuacaugaugaaugcccgcagcaaaaacgugggcuggagacucgauuauuuccugcuuucucacucccugcuccccgcucugugugacagcaagauccggucuaaagcgcugggguccgaucauugccccaucacgcucuaccuggcccuuuga

SEQ ID NO: 65915 - RNA, 1557 nt, Artificial Sequence
  derived and/or modified sequence opt5 from APEX2__Homo_sapiens__NP_055296
augcugagaguggucagcuggaacaucaauggcauucggcgcccccuccaggggguugccaaccaagagccuuccaauugcgcugccguggcggugggaagaauccuggacgaacuugaugcugacauugucugucugcaggagaccaaggugacacgggaugcccucacggaaccgcuggccaucguugagggcuacaacucuuauuucagcuuuucccgcaauagaucuggguacagcggaguggcuaccuucugcaaagacaacgccacacccgucgcugccgaagagggccuuuccgggcuguuugcgacccagaauggagaugugggcuguuauggcaacauggacgaguucacacaggaagaacuccgggcccuggauucugaagggcgcgcucugcucacccaacacaagauuagaacaugggagggaaaagagaagacccugacgcuuaucaauguuuacugcccucaugccgaccccggccggccugaacgccugguguuuaaaaugagauucuaucggcuccugcagauccgcgcugaggcccuucuggcggccgggagccacgucauuauccucggagaucugaacaccgcucauagacccauugaccacugggaugccgugaaucuggaauguuuugaggaagacccuggccggaaguggauggauucccuccugagcaaccuugggugccagucugcuucccaugugggaccguucaucgacagcuaccgcuguuuucagcccaagcaagagggcgccuucacaugcuggucugccgucaccggcgcuagacaccugaauuaugggucccggcucgacuacguucugggagauagaacacuugugauugacaccuuucaggcgagcuuccugcucccugaggugaugggcucugaucacugucccgucggggccgugcuguccguuagcuccgugccugcuaaacagugucccccgcugugcacgcgcuuucucccugaguucgccggaacacagcugaagauccuucgguuccuggucccccucgagcaaucuccugugcuggaacagagcacccuucagcauaacaaucaaacaagaguucagaccugccagaacaaagcccaggugcgcuccacccggccccaacccagccaggucgggucuuccagaggccagaagaaccugaaaagcuacuuucagccuucuccgagcugcccccaggcuuccccugacauugagcuccccucucugccucugaugagcgcccucaugacacccaagacgccggaagagaaggcgguggcuaaagucgugaagggacaagccaaaaccuccgaggccaaggaugaaaaagagcugcgcaccagcuucuggaagucuguucuugcuggcccucugcggacaccccucuguggcgggcacagagaaccuugcgugaugcgcacagucaaaaagcccggaccuaaucugggccggagauuuuauaugugugcccgcccccgggggccgccuaccgaccccuccagcagaugcaacuucuuucuguggucucggcccuccuga

SEQ ID NO: 65916 - RNA, 651 nt, Artificial Sequence
  derived and/or modified sequence opt5 from APH1B__Homo_sapiens__NP_001139118
augaccgccgcuguguucuuuggcugcgccuucaucgcguuugggcccgcucuggcccucuacgucuucacaauugccacggagccucugagaaucauuuuucuuaucgcuggagccuucuuuuggcugguuagccuccugauuuccucucuugugugguucauggcucgggugaucaucgacaacaaggauggcccgacccagaaauaucugcucauuuuuggggccuucgucagcguguacauccaagaaauguuucgcuucgcguauuacaagcugcugaaaaaggccuccgagggacucaaaucuauuaaucccggcgaaacagcuccuagcaugagacugcuugccuaugcuuuuaugacccugguuaucauucuccugcacguguucugggggaucgucuucuuugacggaugugagaagaagaaauggggcauucuucugaucgugcuccugacacaucugcucguuuccgcccagaccuucaucucuagcuacuauggcauuaaccuggcguccgccuuuaucauucuugugcugauggggacaugggcuuuccucgccgcuggaggcagcugccggucucugaaacuuugucugcucugccaggauaagaauuuucugcuguacaaccagcgcuccagauga

SEQ ID NO: 65917 - RNA, 1575 nt, Artificial Sequence
  derived and/or modified sequence opt5 from API5__Homo_sapiens__NP_001136402
augcccaccguggaggaacuguacagaaacuauggcauccucgccgacgcuacagagcaggucgggcaacacaaggaugccuaccagguuauucuggacggagugaaaggcgggacgaaggaaaaacggcuugcggcucaguucaucccuaaguuuuucaaacauuuuccggagcuggccgauagcgccauuaaugcucagcucgaccugugcgaagaugaggacguguccauccgcagacaagccauuaaggagcuuccccaguucgcuaccggagaaaaccugccucgggucgccgauauccucacacagcugcugcagaccgacgauucugcggaguuuaaucucgugaacaaugcccugcuuagcaucuucaagauggacgcuaaaggcacacucgggggacuguuuucccaaauucugcagggcgaagauaucguucgcgagagagccauuaaguuccuuucuaccaaacugaagacacuccccgacgaggugcugaccaaagaagucgaggaacugauccucacggagagcaagaaggugcuggaagauguuaccggcgaggaguuugugcuuuucaugaaaauucuguccgggcucaagucucugcagacagucagcggacggcagcaacuuguggaacugguggcugagcaggccgaccucgaacagaccuuuaacccuuccgaccccgauugugucgaccgccugcugcaaugcacaagacaggcgguuccucucuucagcaaaaaugugcacucuacccgguuugugacguauuucugugagcagguccugccgaaccuuggcacacugaccacacccguggaagggcucgauauccagcuggagguucuuaagcugcucgccgagauguccagcuucugcggagacauggaaaaacuggagaccaaucugcgcaagcucuuugauaaacugcuugaauacaugccucugcccccugaggaagcugagaacggcgagaaugccgggaacgaggaacccaagcuccaauucucuuauguggaaugucugcuguacuccuuucaucagcuuggaagaaagcucccggacuuccugaccgcuaaacugaaugccgagaagcucaaagauuuuaagauucggcugcaguauuucgcccgcggccuucaggucuacaucagacaacugcggcucgcucugcagggcaaaacaggggaggcgcugaagacggaagagaacaagaucaaagugguugcccuuaagauuaccaauaacaucaacgugcucauuaaagaccuguuucacaucccucccagcuacaagucuacagucacccuguccuggaaaccugugcagaaggucgaaauuggacagaagcgcgcuagcgaggauacaaccuccggcucuccucccaaaaagagcuccgccgggcccaaaagagacgcccggcaaaucuauaauccgcccagcggaaaguacucuuccaaccucggcaauuucaacuaugaacagagaggggcuuuucgcggaagccggggcggcagaggguggggaacgcgcggcaaucggucuagagggcgccuguacuga

SEQ ID NO: 65918 - RNA, 729 nt, Artificial Sequence
  derived and/or modified sequence opt5 from APIP__Homo_sapiens__NP_057041
augagcggcugcgacgccagagagggggauuguugcucccggcgcuguggagcucaggacaaggaacaccccagauaccugaucccugagcucugcaaacaauucuaucaucugggcugggugaccgggacaggaggcgggauuucucuuaagcacggagaugaaaucuacauugccccgagcggcguccagaaagagcggauccagcccgaagacauguuuguuugugauauuaacgagaaggacaucuccggcccuucucccagcaaaaagcugaagaaaucccagugcacgccucucuucaugaaugcguauaccaugcgcggggcuggagccgugauccauacacacucuaaggccgcugugauggccacccugcuuuuucccggcagagaguucaaaauuacacaucaagaaaugaucaaggggauuaaaaaguguaccagcggaggcuacuaucgguacgaugacaugcuggucgugccuaucauugagaacacaccggaagagaaggaucucaaagaccgcauggcucacgccaugaaugaguaucccgauuccugcgcgguucuggugagacggcacggggucuacguguggggagaaaccugggagaaggccaaaacgaugugugaaugcuacgacuaucuguuugauaucgcuguuagcaugaagaaagugggccucgacccuucucagcugcccgucggcgagaacgggauuguguga

SEQ ID NO: 65919 - RNA, 234 nt, Artificial Sequence
  derived and/or modified sequence opt5 from APLN__Homo_sapiens__NP_059109
augaaccugagacucugcgugcaggcccugcuucugcucuggcugagccuuaccgcugucuguggcgggucccugaugccccucccugacggaaauggccuggaggaugggaacguucggcaccuggugcaaccgcgcggaucuagaaauggccccgggccuuggcagggaggccggcgcaaguucagacggcagcgccccagacucagccauaaaggcccuaugcccuuuuga

SEQ ID NO: 65920 - RNA, 1143 nt, Artificial Sequence
  derived and/or modified sequence opt5 from APLNR__Homo_sapiens__NP_005152
auggaggaaggcggggacuucgauaacuacuauggagccgacaaucagagcgagugcgaauacaccgauuggaaguccucuggcgcucugauccccgccauuuauaugcucguguuucugcuugggacaacgggaaacggccugguccucuggaccguuuucagaagcucccgggagaaacgcagaucugcggacaucuuuauugcuagccuggccguggccgaucuuacauucguggucacccugccucucugggcuacauacaccuaucgggacuacgauuggccguuugggacauucuuuuguaagcuguccucuuaucugaucuucgugaauauguacgccagcguguuuugccucaccggacuguccuucgaccgcuaccuugcuauuguuagacccgucgccaacgcgcggcugcgccucagagugagcggcgccguugcuacggccgugcuguggguccuugcugcccugcucgcgaugccugugauggugcugcggaccacaggcgaucuggaaaauaccacaaaaguccaauguuauauggacuacucuaugguugccaccguguccagcgagugggcuugggagguggggcucggagucucuuccacgacagugggcuuuguugugcccuucaccaucaugcugacaugcuacuuuuucaucgcccagaccauugcugggcacuuccgcaaggaaagaaucgagggacuucggaaacgcagacggcugcucagcauuaucgucgugcugguugugaccuuugcccuuuguuggaugccuuaucaucuggucaagacacucuauaugcugggcucucugcuccacuggcccugcgauuucgaccuguuucuuaugaacauuuucccuuacuguacgugcaucuccuaugugaauagcugucugaacccguuucucuacgccuucuuugauccccgcuucagacaggcuugcaccuccaugcuguguugcgggcagucucggugcgcgggaacaagccauuccagcucuggcgaaaaguccgccagcuacucuagcggccacucccaagggccuggacccaauaugggcaaagggggagagcagaugcaugagaagucuauuccuuauagccaggaaacccuugucguggacuga

SEQ ID NO: 65921 - RNA, 1956 nt, Artificial Sequence
  derived and/or modified sequence opt5 from APLP1__Homo_sapiens__NP_001019978
augggccccgccagcccugcugccagagggcugucccggcgcccgggacagcccccucucccccugcuucugccucuccugcuucugcuccugagagcgcaacccgcuaucggcucucuggccgggggaagcccuggcgccgcugaggccccgggguccgcucagguggccggacucugcggccggcugacccuucaccgcgaccugagaacaggccggugggaacccgauccucagcgcucuagacggugucuccgcgacccccagagaguccuggaguacugccggcaaauguauccugaacuucagauugcgcgcguugagcaggccacgcaggcuauccccauggaaagauggugugggggaagccgguccggcucuugcgcccauccgcaccaucaaguggugccuuuccgcugucugcccggggaguuugucagcgaggcucuccuggugccugaaggaugcagauuccugcaccaggagcggauggaucagugugaauccagcaccagacgccaucaggaggcccaagaggcgugcagcucccagggccucauucugcacgggagcggaaugcuucugcccuguggcucugaccgguuuagaggcguugaauacgugugcugucccccuccggggacacccgauccuuccggaaccgccgucggcgaccccagcacacgcucuuggccucccgggucccggguggagggagcugaagaugaggaagaggaggaaucuuucccgcagccuguugacgauuauuuuguggagcccccucaagccgaagaggaagaggagaccgugcccccucccuccucucacacacucgcugucgugggcaaggucaccccgacgccuagacccaccgacgggguugauaucuacuucggaaugcccggcgaaauuagcgagcaugaaggcuuucugcgcgccaaaauggaccuugaggaacggagaaugcgccagaucaacgaggugaugcgggagugggccauggcugauaaucaguccaagaaccugccuaaagcggacagacaggcccucaaugaacacuuccaaagcauccugcagacacuggaggaacaggugucuggggagcgccagcggcucgucgagacccaugcuacaagagugauugcccugaucaacgaccaacggcgcgccgcucuugaaggauuucuggccgcgcuccaggcugauccgccccaggccgagagaguucugcuugcccugcggagauaucuccgcgcugaacagaaggagcaacggcacacccugagacacuaccagcauguggccgcugucgacccugaaaaagcccagcagaugcgcuuccaagugcacacgcaucugcagguuauugaggagagagugaaucagucccucggccugcuugaucaaaacccccaccuggcgcaggaacuccggccucagauccaggagcugcugcauagcgaacaccuugggcccucugagcucgaagccccugcucccggaggcagcuccgaggacaaagggggccugcaaccgccugauucuaaggacgccgauacacccaugacccugccuaagggaagcacagagcaggacgcugccucccccgaaaaggagaaaaugaauccgcucgaacaguaugagcgcaaggucaacgcgagcgugccuagaggcuuucccuuccacucuuccgaaauucagcgggaugagcuggccccugcugggaccggagucagccgcgaggccgugucuggccuucugaucaugggggcuggaggcgggucccucauuguucugagcaugcugcuucucagacggaaaaagcccuacggcgccaucucccauggaguggucgaaguggaccccaugcugacccuggaggaacaacagcuccgcgagcugcagagacacggcuacgagaauccuacauaucgguuucuugaggaacgcccguga

SEQ ID NO: 65922 - RNA, 2256 nt, Artificial Sequence
  derived and/or modified sequence opt5 from APLP2__Homo_sapiens__NP_001135748
auggccgcuaccggcacagccgcggcugccgccacggggagacugcuccugcuucugcucgugggacugaccgcucccgcccuugcucuggccggcuacaucgaggcgcucgccgcuaacgccgggacaggauucgcugucgccgaaccucagauugcgauguuuugcggcaagcugaauaugcacguuaacauccaaaccgggaaaugggagccggaccccacaggaaccaagagcuguuucgaaacaaaagaggaagugcugcaguauugccaggagauguacccugagcuccagauuaccaaugugauggaagccaaccaacgggucuccaucgauaauuggugucgcagagacaagaaacagugcaagucucgguuugugacgcccuucaagugucugguuggcgaguuugugagcgauguccuucuggugccugaaaaaugccaguucuuucauaaggagcgcauggagguuugugaaaaccaccagcauuggcacaccguggucaaagaggcuugccucacacaaggcaugacccuguauuccuacgggaugcuucugcccuguggaguggaccaguuccauggcacagaauaugugugcuguccucagaccaagauuaucgggucugucagcaaagaggaagaggaggaagaugaggaagaggaagaggaggaagacgaggaagaggauuacgacguuuauaaguccgaauuuccgacggaggccgaucucgaggacuucacagaagcugccguggaugaggacgaugaagacgaggaggaaggagaggaaguggucgaggacagagauuacuacuaugacaccuuuaagggcgaugacuacaaugaagagaaccccacagagccugggucugauggaaccaugagcgacaaagaaaucacccacgaugugaaggccguuugcucccaggaggcuaugacaggccccugccgggcggugaugccucgcugguauuucgaccugagcaaaggcaagugugucagauuuauuuacgggggaugcggcgggaaucggaacaauuucgaaucugaggauuauuguauggccgugugcaaagcuaugauucccccgacgccucugcccaccaacgacguugauguguacuucgaaacauccgccgacgacaaugagcacgcccgcuuucaaaaggcuaaagagcagcucgaaaucagacaucggaaccgcauggauagagucaagaaggagugggaagaggccgaacugcaggcgaaaaaucuuccuaaggcugagcggcaaacccugauccagcacuuccaggccauggugaaagcccucgagaaggaagcugccagcgagaaacagcaacuggucgaaacacaucuugcucgcguggaggccaugcugaacgacagacggagaauggcgcucgagaacuaucuggccgcucugcagucugauccuccccgcccccaccggauucuccaggcccugagacgcuacguucgggcugaaaauaaggacagacuucacaccauccgccauuaccagcacgugcuggccgucgauccggagaaggcggcccaaaugaaaucccaggugaugacgcaucuccacguuauugaggaacggagaaaccagagccugucucuucuguauaaggugcccuacgucgcucaggaaauccaagaggagaucgacgaacuccugcaggagcagcgcgccgauauggaccaguuuacagcuuccauuagcgaaaccccuguggaugugcggguuuccucugaggaaagcgaggagauucccccuuuccaucccuuucacccguucccugcccugcccgaaaaugagggauccggcgucggggaacaagacggaggccucaucggcgccgaggaaaaagugaucaacagcaagaauaaaguggaugagaacauggucauugacgagacccuggaugugaaggaaaugaucuuuaaugcugagagaguugggggacuugaagaggagcgcgaaucugugggcccucugcgggaggacuucucccucagcucuagcgcgcugaucgggcugcuugucauugccguggcuaucgccacaguuauugugaucucccucgucaugcugagaaagcggcaguauggaaccauuucucacggcaucguggaaguugaccccaugcugacaccugaggaacgccaucucaacaaaaugcagaaucacggguacgagaaccccacguauaaguaccuggagcaaaugcagaucuga

SEQ ID NO: 65923 - RNA, 867 nt, Artificial Sequence
  derived and/or modified sequence opt5 from APOA1BP__Homo_sapiens__NP_658985
augagcagacugcgggcccuccugggccuugggcugcucguggcuggaucccgcguccccagaaucaagucucagaccauugccugccggagcggcccuacauggugggggccgcaacgccugaacuccggaggcagaugggacucugagguuauggcgagcacgguggugaaauaccuuucccaggaagaggcucaggccgucgaucaggaacuguucaaugaguaucaauuuucuguggaccagcucauggaacuggccgggcugagcugugcuaccgccaucgcuaaggccuaucccccuacauccaugagccggucucccccuaccguucucgugauuugcggacccggcaacaauggcggggauggacuggucugugcgcgccaccuuaaacuguucggcuacgagccuacaaucuacuauccgaagagacccaacaaaccucucuuuaccgcccuggugacacagugccagaagauggacauucccuuccuuggggagaugccugcugaacccaugaccaucgaugagcuguacgaacucguuguggacgccaucuuuggauucuccuuuaagggcgauguccgggagccguuccauagcauucugucugugcugaaagggcucacggugccuaucgcuuccauugacauccccagcggaugggaugucgagaagggcaaugccggcgggauucaaccugaccugcuuaucucucugaccgcgcccaaaaaguccgccacacaguuuaccggacgcuaucacuaccucggcgggagauucguucccccugcucuggagaaaaaguaccagcuuaaccugccgcccuauccugauacagaauguguguaccggcuccaguga

SEQ ID NO: 65924 - RNA, 303 nt, Artificial Sequence
  derived and/or modified sequence opt5 from APOA2__Homo_sapiens__NP_001634
augaagcugcucgccgcuaccgugcugcuucugacaaucugcagccucgagggcgcccuggucagacggcaggcgaaagaacccuguguugagucccuugugucucaauacuuccagacggugaccgacuaugggaaggaucugauggaaaaagucaagagcccugagcuccaggcugaagccaaauccuacuuugagaagucuaaggagcagcugacaccgcugauuaaaaaggccggaaccgaacucgugaacuuccugagcuauuuuguugagcuuggcacacaacccgcuacccaguga

SEQ ID NO: 65925 - RNA, 1191 nt, Artificial Sequence
  derived and/or modified sequence opt5 from APOA4__Homo_sapiens__NP_000473
auguuccugaaggccgugguccucacccuggcucuuguugccguggcgggcgcuagagccgaggugagcgccgaccaggucgcuacagugaugugggauuacuuuucccaacugucuaacaaugccaaagaagcuguugagcaccuccaaaagagcgaacugacgcagcagcuuaacgcccuguuccaggacaaacucggggaggugaauaccuaugcgggagaucugcagaagaaacugguccccuuugccacagaacuccaugagcggcuggcuaaggacuccgagaaacuuaaggaagagaucggcaaggaacuggaggagcuccgcgccagacugcuuccucacgcuaacgaagugucucagaaaauuggggauaaucugcgggagcuccagcaacgccuggaaccguacgccgaccagcugagaacccagguuagcacacaggcggagcaacuccggcgccagcugacccccuaugcccagagaauggaacgggugcuucgcgagaacgcugauucccugcaagccucucucagaccucaugcugacgagcugaaggccaaaaucgaucagaaugucgaagaacuuaagggacggcugacacccuacgccgacgaguucaaggugaaaauugaucagaccguggaggaacuccgcagaagccuggcuccuuaugcgcaggacacgcaagagaagcugaaccaccagcucgagggccugaccuuucagaugaaaaagaaugccgaagaacuuaaagcucggaucuccgccagcgccgaggagcugcgccagagacucgcuccccuggccgaagauguccgggggaaccuuagaggaaauacagagggccugcaaaagucucucgcggagcugggcgggcaucuggaccagcagguugaagaguuccgccggagaguggaaccuuacggagagaacuuuaauaaagcucucgugcagcaaauggagcagcugcgccagaaacuuggcccgcacgccggggacgucgaaggacaccuguccuuccucgagaaggaucugcgggacaaggugaacagcuuuuucucuaccuuuaaggaaaaagagucccaggauaagacacugagccuucccgaacucgagcaacagcaggagcaacagcaggaacagcaacaggagcagguucagaugcuggccccucuggaaucuuga

SEQ ID NO: 65926 - RNA, 1101 nt, Artificial Sequence
  derived and/or modified sequence opt5 from APOA5__Homo_sapiens__NP_001160070
auggccagcauggcugccgugcugaccugggcgcucgcucugcuuuccgccuucucugccacacaggcuagaaagggcuuuugggacuacuucagccaaacguccggggauaaaggacgggucgagcagauccaccagcagaagauggcccgcgaacccgcuacccugaaagacucucucgagcaagaucugaacaauaugaacaaguuucuugaaaaacugagaccucucagcggcuccgaggccccgcggcugccccaggacccuguugggaugcgcagacagcugcaggaagaacucgaggaagugaaggcgcggcugcaacccuauauggccgaggcucaugaacuugugggauggaaucuggagggccuccgccagcagcugaagccuuacacaauggaucuuauggagcaggucgcccugagagugcaagaacuccaggagcagcugcggguugugggggaagacaccaaagcucaacugcucggaggcgucgaugaggccugggcgcugcuucagggccugcagucucgcgugguucaccauacagggagauucaaggaacucuuucaccccuaugccgagagccugguguccggaauuggccggcauguccaggagcuucaccgcagcguggcuccucacgccccggcuucucccgccagacugucccggugcgugcaaguccucagccgcaaacugacccugaaggccaaagcucuccaugcgagaauccagcagaaccuggaccagcuucgggaggagcugucuagagccuucgcugggacaggaaccgaagagggcgccgggccugauccccaaaugcucuccgaagagguucgccagcggcugcaggccuuuagacaggacacguaccuucaaauugcugccuucacccgcgcgaucgaucaggagacagaagaggugcagcagcaacuggcuccucccccgccuggacacagcgccuuugcccccgaguuccagcagaccgacucuggcaaggugcucuccaagcugcaagcucggcuggaugaccucugggaagacauuacacauagccugcacgaucagggccacucccaucuuggggacccuuga

SEQ ID NO: 65927 - RNA, 711 nt, Artificial Sequence
  derived and/or modified sequence opt5 from APOBEC1__Homo_sapiens__NP_001291495
augaccagcgagaagggccccuccacaggggacccuacgcugagacggcgcaucgaaccgugggaguucgauguguuuuacgaccccagagaacuccggaaagaggccugccugcuuuaugaaauuaaguggggaaugucucgcaaaaucuggagaagcuccggcaagaacaccacaaaucacgucgagguuaacuucauuaaaaaguuuaccucugagcgggauuuccauccuagcauguccuguucuaucacaugguuucugagcuggucccccugcugggaauguagccaggcuauucgcgaguuccucucuagacacccuggggugacccuggugaucuacgucgcccggcuguuuuggcauauggaccaacagaaucgccagggacuuagagaucucgugaacuccggcguuacaauccagauuaugcgggcgagcgaauauuaccacugcuggcgcaauuucgugaacuaucccccuggggacgaggcucauuggccgcaauaucccccucuguggaugaugcuguacgcccucgagcugcacuguaucauucuuucucugcccccuugccucaagaucuccagacgguggcagaaucaccugaccuuuuuccgccuucaucugcagaacugucacuaccagacgauucccccgcauauccuccuggccaccggacugauucacccuagcgucgcuuggagauga

SEQ ID NO: 65928 - RNA, 675 nt, Artificial Sequence
  derived and/or modified sequence opt5 from APOBEC2__Homo_sapiens__NP_006780
auggcccagaaggaggaagcugccguggcgacagaggcugccagccaaaacggcgaagaccuggagaaucucgaugaccccgaaaaacugaaggagcuuaucgagcugccuccguucgaaauugucacaggggagagacuccccgccaacuuuuucaaauuucaguuccggaauguugaauacuccucuggacgcaacaagacguuucugugcuaugugguggaggcucagggcaaagggggacagguccaagccagcagaggcuaccuugaggaugaacacgcugccgcgcaugccgaggaggcuuucuuuaauaccauccugccugccuucgaccccgcucuccgguauaacgugacaugguacguuuccucuagcccuugugccgcgugcgccgaucgcauuaucaagacccuguccaagaccaaaaaucugagacuccugauucuuguggggcggcuguuuaugugggaagaacccgagauccaggcugcccucaagaaacugaaggaggcuggauguaaacuucgcaucaugaagccucaggacuucgaauaugucuggcagaacuuuguggagcaagaagagggcgaaucuaaggccuuccagccgugggaggauauucaggagaauuuucuguacuaugaagagaaacucgccgacauccugaaguga

SEQ ID NO: 65929 - RNA, 600 nt, Artificial Sequence
  derived and/or modified sequence opt5 from APOBEC3A_B__Homo_sapiens__XP_011545347
auggaggccagccccgcuuccggcccuagacaccugauggacccgcauaucuucaccucuaacuuuaauaacgggauuggacggcacaagacauaccucugcuaugaaguggagcgccuggauaauggcacgagcgucaaaauggaccagcauagaggguuccuucacaaccaagccaagaaucugcucuguggauuuuacggccggcaugcggaacugcgcuuccuugaucugguucccucccuccagcuggacccugcucagaucuauagagugaccugguuuauuucuuggagccccugcuucuccugggggugugccggagaggugcgggccuuucugcaggaaaacacacacguccgccucagaaucuucgcugcccggauuuacgauuaugacccucuguacaaagaggcgcuucaaaugcugcgcgaugccggcgcucaggugucuaucaugaccuaugacgaguuuaagcacugcugggauacauucguugaccaucagggcugucccuuucagccuugggaugggcucgacgaacacagccaagcccuguccggaagacuucgggcuauccugcagaaucagggcaacuga

SEQ ID NO: 65930 - RNA, 1074 nt, Artificial Sequence
  derived and/or modified sequence opt5 from APOBEC3B__Homo_sapiens__NP_001257340
augaacccccagaucagaaauccuauggagcggauguaccgcgacaccuucuaugauaacuuugaaaaugagccgauucuguacggcagaagcuauacauggcucugcuacgaagugaagaucaaacgggggcgcuccaaccugcuuugggacacgggagucuucagaggccaaguuuauuuuaagccccaguaccacgccgagauguguuuccugucuugguuuugcgggaaucagcucccugcuuauaaauguuuccagauuaccugguuugugagcuggacacccugcccugauuguguggccaagcuggcggaguuccuuuccgagcaucccaacgucacccugacaaucucugcugcccggcucuacuacuauugggagcgcgacuacagacgggcccugugccgccugagccaagcuggagccagagugaaaauuauggauuaugaagaguuugcuuacuguugggaaaauuucguuuauaacgagggccagcaguuuaugccuugguacaaguucgacgagaauuaugccuuucuccaccggacccugaaggaaauccuucgcuaccugauggauccggacacauucaccuucaacuuuaauaacgauccccucgugcugagacggcgccagacguaccuuugcuaugaggucgaaagacuggacaaugggaccugggugcucauggaucaacauaugggauuccuguguaacgagcuggacccugcgcagaucuaccggguuacaugguuuauuuccuggucucccugcuucagcuggggcugugccggcgaagugagagcuuuucuccaggagaauacccacguccgccugcggaucuucgccgcuagaauuuaugauuacgacccucuuuauaaagaggcccugcagaugcuccgcgacgcgggggcccaaguguccaucaugacauacgaugaauuugaguauugcugggacaccuucguguaccggcagggaugccccuuucagccgugggauggccuggaagaacauagccaagcucuuucugggagacugcgcgccauucuccagaaccagggaaacuga

SEQ ID NO: 65931 - RNA, 573 nt, Artificial Sequence
  derived and/or modified sequence opt5 from APOBEC3C__Homo_sapiens__NP_055323
augaacccccagaucagaaauccuaugaaggccauguacccgggcaccuucuauuuucaauucaaaaaccugugggaggcuaaugaccggaacgaaacauggcucugcuuuacgguggaggggauuaagcgcagaagcgucguuuccuggaaaaccggaguguuccggaaucagguggauucugaaacacacugucaugccgagcgcugcuuucugagcugguucugugacgauauccuuucccccaacaccaaguaccaggucacaugguauaccucuuggagcccuugccccgacugugcgggcgaaguggcugaguuucuggccagacacuccaauguuaaccucacaauuuucaccgcccggcuguacuauuuucaguacccuugcuaucaagaggggcuucgcucucugagccaggaaggaguggcugucgagaucauggauuacgaagacuucaaauacuguugggagaauuuuguguauaacgauaaugagcccuucaagccuuggaagggccucaaaacgaacuuuagacugcugaagcggcgccucagagaaucccugcaguga

SEQ ID NO: 65932 - RNA, 306 nt, Artificial Sequence
  derived and/or modified sequence opt5 from APOBEC3F__Homo_sapiens__NP_001006667
augaagccccacuucagaaacaccguggagcggauguaccgcgacacauuuagcuauaauuucuacaacagaccuauccugucccggcgcaauacggucuggcucugcuaugaaguuaaaaccaagggcccgucuagaccccggcuggaugccaaaauuuuucgcggacaggugccucggagcuucaucagagcucccuuucaagugcuuuccucuccuuucgggcagugugcgcccccucauggcacagcccagguccaguggccgccccaacugaccgcugggcgcgagcagggaagaccuuga

SEQ ID NO: 65933 - RNA, 1155 nt, Artificial Sequence
  derived and/or modified sequence opt5 from APOBEC3G__Homo_sapiens__NP_068594
augaagccccacuucagaaacaccguggagcggauguaccgcgacacauuuagcuauaauuucuacaacagaccuauccugucccggcgcaauacggucuggcucugcuaugaaguuaaaaccaagggcccgucuagacccccucuggaugccaaaauuuuucggggacagguguacagcgagcuuaaguaucaucccgaaaugcgcuucuuucacugguucuccaaauggagaaagcugcaucgggaccaagaguacgaagugacaugguauaucucuuggagcccuuguaccaagugcacacgcgauauggcuaccuuucucgccgaggaccccaaagucacacugaccauuuucguggcgagacuuuacuacuuuugggauccugacuaucaggaggcucugcggucccucugucagaagcgcgaugggccgagagccacgaugaaaaucaugaacuacgacgaguuccagcacugcuggucuaaguuuguuuauagccaacgggaacuguucgaacccuggaauaaccugccuaaauacuauauucuccugcauaucaugcuuggcgagauccugcgccacuccauggaucccccuaccuuuacauucaauuucaacaaugagcccugggugagagggcggcacgaaaccuaccucuguuaugaggucgaaagaaugcauaacgacacaugggugcugcuuaaucagcgccggggauuucugugcaaccaggccccgcacaagcauggcuuccucgaggggagacacgcugaacuguguuuucuggauguuauuccuuucuggaagcucgaccuggaucaggacuaccgcgugaccugcuuuacgagcuggucucccuguuucuccugcgcccaagagauggcuaaauuuaucagcaagaauaaacacgucucucuuuguauuuucacagcccggaucuacgacgaucagggaagaugccaggagggccugcgcacccucgcggaagccggcgcuaagauuuccaucaugacauauagcgaguuuaaacauugcugggacaccuucguggaucaccagggguguccuuuucaacccugggacggacuggaugaacauucucaggaccuuuccggccggcugagagccauucuccagaaccaagagaauuga

SEQ ID NO: 65934 - RNA, 549 nt, Artificial Sequence
  derived and/or modified sequence opt5 from APOBEC3H__Homo_sapiens__NP_001159474
auggcccugcucaccgcugagacauucagacugcaguuuaacaauaagcggcgccuuagacggcccuacuauccucgcaaagcccugcucugcuaccaacugacgccgcagaacggcagcacccccacaagaggguauuucgaaaauaagaaaaagugucacgcggagaucugcuuuauuaacgaaaucaaauccaugggacuugacgagacccaguguuaccaggugacaugcuaucugaccuggucuccuuguagcuccugcgcuugggaacucgucgauuucauuaaggcccaugaccaccugaaucugggcaucuuugccucucggcucuacuaucauugguguaagccccaacagaaagggcugcgccuucugugcggaagccagguuccuguggaggugaugggcuuccccgaguuugcugauuguugggaaaacuucgucgaccacgagaagccucucuccuuuaauccguacaaaaugcuggaggaacuugauaagaacucuagagccauuaaacggcgccuggagagaaucaagagcuga

SEQ ID NO: 65935 - RNA, 13692 nt, Artificial Sequence
  derived and/or modified sequence opt5 from APOB__Homo_sapiens__NP_000375
auggaucccccuagaccggcccugcucgcucugcuugcucugcccgcgcugcugcuucugcuccuggcuggcgcccgggccgaggaagagaugcuggaaaacgugucccucgucugcccuaaggacgcuacacgcuucaagcaccugagaaaguacacauauaauuacgaggccgaauccucuuccgggguucccgggacggcugauucccggucugccacacgcaucaacuguaagguggagcuugaggugccucagcugugcagcuuuauucucaagacaucccaauguacccugaaggaagucuauggcuucaaucccgaggggaaggcgcuucugaagaagacaaagaacucugaagaguuugccgcugccaugagcagauacgagcucaagcuggcuaucccugaagggaagcaaguguuccuguauccggagaaagaugaacccaccuacauucucaauaucaagcggggcauuaucuccgcccugcuuguuccucccgagacagaagaggcgaaacaggugcuguuucucgacaccgucuaugggaacugcagcacgcacuucaccgugaaaacacgcaagggaaauguugccaccgagaucucuacagaaagagaucugggccagugugaccgguuuaaaccuauucgcaccggcaucagcccccuugcucugauuaaggggaugacgagaccgcucagcacacugaucucuuccagccaaucuugccaguacacccuggaugccaaacggaagcacguggcugaggccauuuguaaagaacagcaccucuuccugccuuuuuccuacaagaacaaguauggaauggucgcccaggugacacaaacccuuaaacuggaggacacccccaagaucaauagccgcuucuuuggcgaagggaccaagaagaugggacucgcuuucgaguccacgaaaucuaccagcccucccaagcaggcggaggccgugcugaagacacuucaggaacugaaaaagcucaccauuuccgagcagaacauccaaagagcuaaucuguuuaacaaacuggucacagaacuccggggccugagcgaugaggccguuaccucucuucugccccagcucaucgaaguguccagcccuauuacgcugcaggcccuggugcaaugcgggcagccgcaguguucuacacacauccuucaguggcucaagcgcguccaugcuaauccccugcugauugacgugguuaccuaccucguggcccugaucccugagcccagcgcgcaacagcuuagagagauuuucaacauggcucgggaucagagaucccgcgccacccuguaugcccucucucacgcugucaauaacuaccacaaaacaaacccuaccggaacacaggaacugcuggacaucgccaauuaucuuauggagcaaauccaggaugacugcacgggcgacgaagauuacaccuaucucauucugcgggugaucggcaacauggggcagacaauggagcagcugacccccgagcucaagagcuccauucugaaguguguucaaagcacaaaaccgucucuuaugauccagaaggcugccauucaggcgcugagaaaaauggaaccuaaggacaaagaucaggaggugcuccugcaaaccuuccuggacgaugccucccccggagacaagcgccuugcugccuaccucaugcugaugcggagcccuucucaggcugauaucaauaagaucguccagauucugcccugggaacaaaacgaacaggugaaaaauuuugucgccucccauaucgcgaacauucucaauagcgaagaacuggacauccaggaucuuaagaaacuggugaaggaggcccucaaagaaucccagcugccuacgguuauggacuucagaaaguuuucucgcaacuaccaacuguauaaaagcgugucccuucccucucucgauccggcuagcgccaagauugagggcaaucugaucuucgacccuaacaauuaccugcccaaggaauccaugcucaaaaccacacugaccgcuuuuggguucgccagcgccgaccuuauugagaucggacuggaaggcaagggguuugagcccacacucgaggcucuguucggaaaacagggcuuuuucccugauucugucaacaaggcgcuguauugggugaauggccagguuccggacgggguguccaaaguccuuguggaucacuuuggauacaccaaggacgauaagcaugaacaggacauggugaacggcaucaugcugagcguugagaaacucauuaaggaucugaaaucuaaggaaguccccgaggcccgggcuuaucucagaauccugggggaagaacuuggauucgccucccugcacgaccuccaacugcugggcaaacuucugcucaugggggcccgcacgcugcagggcauuccucagaugaucggagaggugauucggaagggcagcaagaaugacuuuuuccuccacuacaucuucauggaaaacgcuuuugagcugcccacaggggccggacuucagcugcaaaucucuagcuccggcgugauugcgccuggggcuaaagccggagucaagcucgaaguggccaacaugcaggcugagcugguugccaaacccagcgugucugucgaguucgugaccaauaugggcaucauuaucccugacuuugcgagauccgggguucagaugaacacaaauuucuuucaugaaagcggccuggaggcucacguggcccuuaaggccggaaaacugaaguucauuauccccuccccgaagcgcccugucaaacuccugucuggcgggaacacccuccaucuggugagcaccacaaagacggaaguuauucccccucuuauugagaaucggcaauccuggucugugugcaaacaggucuuucccggacugaacuauugcaccagcggcgcuuacuccaaugccucuagcacagauuccgcuagcuacuauccgcugaccggggacacaagacucgaacuggagcuucggccuaccggagagaucgaacaguacucuguguccgccacguaugagcugcagcgcgaagauagagcgcucguggacacacugaaguucgucacccaagccgagggcgcuaaacagaccgaagccacaaugaccuuuaaguacaaccggcagagcaugacacucucuuccgagguucagauucccgacuucgauguggaccuggggacgauccuuagagugaaugaugagagcaccgaaggcaaaacaucuuaucgccugacccuggacauucaaaacaagaagaucacagaggucgcucucaugggacaccuguccugugauaccaaagaggaacggaagaucaaaggcgugauuagcaucccuagacuucaggccgaagcccgcuccgagauucuggcucauuggagccccgcgaagcuccugcuccagauggacucuagcgccacggcuuacggguccaccguuucuaaaagaguggccuggcacuaugaugaggaaaagaucgaguuugaauggaauacaggaaccaacgucgacacaaagaaaaugaccagcaauuuccccguggaucuguccgacuacccuaagucucuucacauguacgccaaccggcugcuggaucaucgcguuccgcagacagacaugaccuuuagacacgugggcagcaaacucauugucgcuauguccucuuggcugcaaaaggccagcgggucccuucccuauacgcagacacugcaggaucaucucaauagccugaaagaguucaaccuccagaacaugggacugccugacuuccacauccccgagaaucuuuuucugaagucugacggccgggugaaguacacccugaacaaaaauucccucaagauugaaaucccucugcccuucgggggcaaaagcucucgcgaucuuaagaugcuggagaccguuagaaccccugcgcuccacuuuaaauccgugggauuccaucugccgagccgggaauuucaaguccccaccuucacgaucccuaagcuguaucagcuccaggugccccuucugggcgugcuggaccucuccacaaacgucuacucuaaucuguauaacuggagcgcuuccuacagcgggggaaauaccucuacagaucacuuuucccuucgcgccagauaucauaugaaggccgacagcguuguggaucugcucucuuacaacgugcaaggcagcggggagaccacauacgaccacaaaaauaccuucacgcuguccugcgauggaucucugcggcauaaguuucucgacagcaacauuaaauucucccacgucgaaaaacuuggcaauaacccugugucuaaaggccugcugaucuuugaugcuagcuccagcugggggccccagaugucugccuccguucaccucgacagcaagaagaaacagcaucuguucgugaaggaggucaaaauugauggacaguuccgcguguccucuuuuuaugcgaagggcaccuacgggcuuagcugucaaagagacccgaauacaggacggcugaacggcgaguccaaucucagauucaacucuagcuaucugcaggggaccaaccagaucacaggacgcuacgaagacggcacccugucccucacgagcacaucugaucuucaguccggcauuaucaaaaauaccgcuagccugaaguaugagaacuacgaacugacacucaaaucugacaccaaugggaaguauaagaacuuugccaccuccaauaaaauggauaugacauucagcaagcaaaacgcccugcuucggucugaguaccaggcugacuacgaaagccugagauuuuucucccuccugucuggaagccucaauucccacggccucgagcuuaacgccgauauccuggggacggacaaaauuaauagcggagcucauaaggccacccugcgcaucggccaggaugggauuuccacaucugcgaccacaaaccucaaaugcagccugcuuguucuggagaaugaacucaacgccgagcugggacuguccggcgcuucuaugaagcucaccacgaauggccgguuuagagaacacaacgccaaguucagccuugacgggaaagcugcccugacagagcugucccucggaucugccuaucaggcuaugauccugggcguggauagcaagaauauuuuuaacuucaaagucucccaagaagggcuuaagcugagcaaugacaugaugggaucuuacgcggagaugaaauuugaucauaccaacucccucaacaucgccggccugagccuggacuucucuuccaagcucgauaauaucuauagcucugacaaguuuuacaaacagaccgugaaccuucagcugcaaccuuauucccuggucacaacccucaauagcgaccugaaguacaacgcucuugaucugacaaauaacgggaaacuccgccuggagccccugaagcuccacguggccggaaaucuuaaaggcgccuaucagaacaaugaaauuaagcacaucuacgcuauuuccagcgccgcgcugucugcuagcuacaaggccgacacgguugccaaagugcagggcgucgaguucucccaucggcugaacaccgauaucgcugggcucgccucugcgauugacaugagcacaaauuauaacuccgauucucugcacuucagcaauguguuuagauccguuauggcccccuucaccaugacaaucgacgcucauaccaacggaaauggcaaacuugcccuguggggagaacacacgggacagcucuacucuaaauuucugcugaaggcugagccucucgccuucaccuuuagccacgauuauaaaggcuccacaagccaucaccuugugucucgcaaguccauuagcgcugcccuggagcauaaagucucugcgcugcucacccccgccgaacaaacagggaccuggaagcugaagacacaguucaacaacaaugaguacucccaggaccuugaugcuuauaacacgaaagacaagaucggaguggaacugaccggccggacacucgccgaucugacccugcucgacagcccuaucaaagugccgcuucugcuguccgagcccauuaauaucauugaugcucucgaaaugagagacgccguugagaagccucaggaguuuaccaucgucgccuucgugaaauacgacaagaaccaagaugugcacucuauuaaucugcccuuuuucgaaacacuucaggaguauuuugaacggaaccgccagacgaucaucgucgugcuggagaauguucagagaaaccucaagcauauuaauaucgaccaauucgugcggaaauaccgcgcugcgcugggcaagcugccucagcaggccaacgauuaccucaauagcuuuaacugggaaagacaggucucccacgcuaaagagaagcugaccgcccuuaccaagaaguaucggauuaccgagaaugacauccaaauugcccuggaugacgcuaagaucaacuucaaugaaaaacucagccagcugcagacauacaugauccaauucgaucaguauauuaaggacucuuacgaucuucacgaccugaaaaucgccauugcgaacaucauugaugagaucauugaaaagcucaaaucccuggacgagcauuaucacaucagagugaaccugguuaagaccauccaugaccuccaccuguuuauugaaaauaucgauuucaacaagagcgggucuagcacggccuccuggauucagaauguggacacaaaauaccagauccgcauucaaauccaggagaaacuucagcagcugaaacggcacauccaaaacauugauauccagcaucucgcuggaaagcugaaacagcacauugaggccaucgacgucagagugcuucuggaucagcucggcaccaccauuucuuuugaacgcaucaaugacguucuggagcaugugaagcacuucgucaucaaccugauuggggauuuugaaguggcugagaaaaucaaugccuuccgggcgaaggugcaugagcucauugaaagauaugaggucgaccaacagauccagguucugauggauaaacuuguggaacuggcccaccaauacaaacucaaggagacaauucagaaacugagcaacgugcuucagcaggucaagaucaaagacuacuuugaaaagcuggugggauucauugaugacgcuguuaagaaacucaaugagcuguccuuuaagaccuucaucgaggaugugaacaaauuucuggacaugcucaucaagaaacugaagucuuucgacuaucaccaauuugucgaugaaacaaaugacaagauucgcgaggugacccagcggcuuaacggcgaaauccaggcccuggagcucccccagaaagcugaagcccugaaacuuuuccuggaggagacgaaagcuacaguugccguguaccucgaaagccugcaagauaccaagauuacacugaucauuaauuggcuccaggaggcgcuguccagcgccucucuugcucauaugaaagccaaguucagagaaacccuggaggacacgcgcgauagaauguaucagauggacauccagcaagaacuccagcgguaccugucccuugucggacagguguauagcacccuggucacauacaucuccgauugguggacccucgcugccaagaaccugacagacuuugccgagcaauauucuauucaggauugggcgaaacgcaugaaggcucugguggagcagggauucaccguuccggaaaucaaaacaauucucggcaccaugccugccuuugaggugagccugcaggcccuucagaaggccacguuccagacacccgacuuuaucgugccucugaccgaucucagaauccccuccguccagaucaauuucaaagaccugaagaacaucaagauuccuucucgguuuagcacccccgaguucacaauccuuaacaccuuucacauuccguccuucacaaucgacuuuguugagaugaaagugaagauuauccgcacgauugaucagaugcugaauagcgagcuccaauggccugugcccgacaucuaccugagagaucugaaagucgaagacaucccccucgcccggauuacccugccugauuucagacuuccggagaucgcuauucccgaauuuaucauuccuacacugaaccucaaugacuuccaggugcccgaucugcauaucccugaguuccagcuuccccacaucucucacaccauugaaguuccuacauuuggcaagcuguacuccauccucaaaauucagagcccgcuguucacccuggacgccaacgcggauaucgggaauggaacgaccucugccaacgaggcuggcauugccgcuuccaucacagccaagggggagagcaaacuugaagugcugaauuuugacuuccaagcgaacgcccagcucucuaaucccaagaucaacccucuggcucucaaggaguccgucaaauuuagcucuaaguaucugcgcaccgaacauggaagcgagaugcuuuucuuuggcaaugccauugaagggaaauccaacacaguggcuagccugcacaccgagaagaauacgcuggagcucuccaacggagucaucgugaaaauuaauaaccagcugacacuugauucuaacaccaaguacuuccauaagcugaauauccccaaacucgacuuuagcucccaggccgaucugcggaacgaaauuaagacacuccugaaagcuggccacaucgccuggaccucuagcggcaagggguccuggaaaugggcguguccuagauucucugacgagggaacccaugaaagccaaaucuccuuuacaauugagggcccccugacgagcuucgggcuuucuaauaagaucaacuccaagcaucugcgcguuaaucagaaccucguguaugaaagcggaucucugaauuuuuccaaacuugagauucagagccaagucgacucucagcacgugggccauuccguucugaccgccaaggggauggcucucuucggcgagggaaaagccgaguucacaggccggcacgaugcucaucugaacgggaaggugaucggaacccucaaaaauagccuguuuuucucugcccagccguuugagauuacagccuccaccaacaaugaaggcaaccugaaggucagauucccucuucggcugacggggaagaucgacuuucucaauaacuacgcgcuguuccuuagccccagcgcucagcaagccuccuggcaagugucugcccgcuuuaaucaguauaaauacaaccagaacuucagcgcuggaaauaacgagaauauuauggaggcccacgugggcaucaacggggaagcuaaucuggauuuucucaacaucccccugacaauuccugagaugagacugcccuauaccaucauuaccacaccuccgcucaaggacuucucccugugggaaaagacaggccuuaaggaguuucugaaaacaacgaagcaaucuuucgaucucagcguuaaagcccaguacaagaagaauaaacaucggcacuccaucaccaacccccuggcgguccuuugcgaauuuauuucucagagcaucaaguccuucgaccgccacuucgagaaaaauagaaacaaugcccuggauuuugugacaaagagcuacaacgagaccaaaaucaaguucgacaaguauaaagcugaaaagucucaugaugagcucccucggacauuucagauucccggauacaccgugccugucguuaauguggaagugucccccuucacgaucgagaugagcgccuuuggcuaugucuucccgaaagcugugucuaugccuuccuuuagcauucugggguccgacguucgcgugcccucuuacacccugauccucccuagccuggaacuucccguccugcacgugccuagaaaccucaagcugucccuucccgauuucaaagagcuguguacaauuucucauaucuuuaucccggccaugggaaauauuaccuaugacuucagcuuuaaguccagcguuaucacacucaacaccaacgcggagcuguucaaucaaucugauauuguggcccaucugcuguccagcucuagcuccgucaucgacgcucugcaguacaaacuugaaggcacaacccggcugacgcgcaaaagagggcucaagcuggccacagcucuuucucugagcaacaaauucguggagggaucccacaauagcaccgugucucucaccacaaagaacauggaagucuccguugccacgaccacaaaagcucagauuccuauccugcggaugaauuuuaagcaagagcugaacggcaauaccaagagcaaacccacaguguccucuagcauggaguucaaguaugacuuuaacuccucuaugcucuacagcaccgccaaaggggcgguggaucacaagcugucccuugagucucugacaagcuacuucuccauugagagcucuaccaaaggcgacgucaagggauccgugcucagcagagaauauucuggcacgaucgccuccgaggcuaauaccuaccugaacagcaaaucuacacgcagcuccguuaaacuucaggggaccagcaagaucgaugacauuuggaaucuggaagugaaagagaacuuugccggagaggccacacuccagcggaucuauucccugugggaacacucuaccaagaaucaucugcagcucgagggccuguucuuuacgaacggggaacacacaagcaaagcuacccuugagcugucccccuggcaaaugucugcccucguccaggugcaugcgagccagccuuccucuuuccacgauuuuccggaccugggacaggaaguugcucuuaaugccaacacaaagaaccagaagauuagauggaagaaugaggugcgcauccacagcggcuccuuccagagccaggucgagcugucuaacgaucaggaaaaggcccaucucgacauugcuggcucccuggaggggcaucugcgguuucucaaaaauaucauccugcccguguacgauaagagccuuugggacuuccugaaacucgauguuaccacgucuauuggaagacgccaacaucugcggguguccaccgccuuugucuauacaaagaacccuaauggcuacagcuucucuauccccgugaaaguccuggcugacaaguucauuaucccugggcucaaacuuaacgaccucaauuccgugcugguuaugcccaccuuucacgugccuuucacagaucuccagguccccagcugcaaacuggacuuuagagaaauucagaucuauaagaaacuucgcaccucuuccuucgcccugaaccucccgacacugccugaggugaaguuucccgaaguggauguucugaccaaauacagccagccugaggacucccuuauccccuucuuugagauuacggugccggaaagccaacucacagucucucaguucacccugccuaagagcguguccgauggaaucgcggcccuggaccucaaugcuguugccaacaagauugcugauuuugagcugcccaccaucauugugcccgaacagacaaucgagauuccuucuaucaaauucagcguccccgccggcaucgugauuccuuccuuucaagcgcuuaccgcccgguucgaagucgacucuccgguguacaaugcuacauggagcgccucccugaagaacaaagcugauuauguugagacggugcucgacagcaccuguucuuccacaguccaguuucuggaguacgaacugaaugugcuugggacccacaagaucgaggauggaacacucgccagcaaaaccaagggcacguucgcccauagagacuucucugcugaauaugaggaggauggcaaguacgaagggcugcaggagugggaaggaaaagcgcaccugaacauuaagucccccgccuuuaccgaccuccaucugcgcuaucagaaagacaagaaaggcaucagcacaucugcugccuccccugccguugggaccgugggaauggauauggacgaggaugacgauuucagcaaguggaauuuuuacuauagcccccaaucuagcccugacaagaaacuuacaauuuucaagaccgaacugcgggucagagaguccgaugaggaaacgcagaucaaagugaacugggaggaagaggcugccagcggccuccugacaucucugaaggacaaugugcccaaagcgaccgggguucuuuacgauuacgucaacaaguaucacugggaacauacaggacucacccugcgcgagguguccagcaaacugagacggaaccuccagaauaacgcugaguggguguaccagggcgccauccgccaaauugacgauaucgacgucagauuucagaaggccgcuucuggcaccacagggacguaucaggaauggaaggauaaagcccagaaucuguaccaagagcuucugacccaggaaggacaggcuagcuuccaaggccucaaggacaacguguuugacgggcugguucgggugacacaggaguuccacaugaaagucaagcaccugauugauucccuuaucgacuuucucaauuucccuagauuucaguucccgggaaaacccggcauuuauacccgggaggaacugugcacaauguuuauccgcgagguggggaccguucugucucagguguacagcaagguccauaacggauccgaaauccucuucagcuacuuccaagaucuggugauuacgcuuccuuuugagcugagaaagcacaaacucaucgacguuauuucuauguaucgggaacugcugaaggaucuuuccaaagaggcccaggagguguucaaggcgauccagagccucaaaacaaccgaaguccugcgcaaucugcaggaccuccugcaauuuauuuuccagcuuaucgaggauaacauuaagcagcugaaggaaaugaaauuuaccuaccucaucaauuauauccaggacgagauuaacacaaucuucucugauuacauucccuauguguuuaagcugcugaaagaaaaucuuugucucaaccugcauaaguucaaugaguuuauccaaaacgagcugcaggaagccucccaggagcuccaacagauucaccaguacaucauggcucugagagaagaguauuucgacccuagcaucgugggcuggaccgucaaauacuacgaacuugaggagaagauuguuucccugaucaaaaaucuccugguggcccugaaggauuuucauucugaauauauugugagcgcuuccaacuucacaucucagcuuagcucccaagucgagcaguuucuccaccggaacauccaggaauaccugagcauucugacggaccccgacggcaaggggaaagagaagaucgccgaacucucugcgaccgcccaggagaucauuaaaucccaagcuaucgccacaaagaaaauuaucagcgauuaucaccagcaguuccgcuacaagcugcaggacuucucugaucaacuuuccgacuauuacgagaaguuuauugcugaaagcaaaagacugaucgaucucucuauucagaauuaucauaccuuccugaucuacaucacagagcugcuuaagaaacuccaguccaccacggugaugaacccguacaugaagcuggccccuggagaacugaccauuauccucuga

SEQ ID NO: 65936 - RNA, 3294 nt, Artificial Sequence
  derived and/or modified sequence opt5 from APOBR__Homo_sapiens__NP_061160
auggacuuccugagacucuaccugcccggccuucaccaggcccugcgcggggcucucgauagccugggaaccuuuguguccuaucuucugggcgacgccgucccuacaguugagcgggaagcgcaagcugccgaggaacucggggugguggccgucggaaagacgggcaaaaucguggaggaagaggcucaggaggaucuggaagggcugagaggaucucagaacgagggcgccggccggcuccgcgggccgggagacgauagacggcaugaaguuggcagcuccgcuguggagcagaccuggggguggggagacggcucuagccacgggucccaagccgagcgccaggauucuggagcgggcgaaacagccaaggcugccagaugccaggagcccagcgcucaucuggaagcccggaaaaaguccaaagcgggcagcggggccugucaggaccgcucuggacaagcucaggagagacaggaaucccacgagcaggaggucaaucgggaagaacgccuuagaagcugggaacaagaggaagaggaggaagaggugcgggcccgcgaaccuggcauggcuagaggggccgagucugaauggaccuggcauggagagacagagggcaaggccggggcuguuggacccaaggcggccggcgauaaccgggaaauggagcagggcgugagagaagcugacgccggggagaccgaggaaccuggagccgagggcgcugggaaaggagaagaggucgugguggucgaaaaggccugcgaguccacacgcgcguggggcaccugggggcccggcgcugagccugaagauugggggauucugggccgggaggaagccagaacgaccccggggcgcgaggaagcccgggcuauccucgacggagaggaggccagaacaauuagcggcggggaagaggcugaaaccgccucuggaggcgaggaagcggagacagccuccgggggcgaggaagcuggaaccgccagcggcggggaggaagcuggaaucgccuccggcggggaggcgggaacggccucuggcggggaggaagcuggcacagccagcggaggcgaggaagcugggaccgccuccggaggcgaugaggccuggacaaccagcgggaaagaagaggcugaccugcuuggaguucgccagaccgaguacggcgcggugcccggggaacggcugcucgaggccacaggcaagguguggguccuggaagaggaaggagacgaggagagagaagcugaggugucuccuuuccccaaacaaccucagguucugggcacggaacgcaccgaggaagccgccgagucccagacagcugggcgggaggccgugggaggccaggaagcgggggagagcuuugaaggacaagucgaucucagaggcaaggaggcugagaugcgccaggaccugggcauucgggccgauagagcccggauggaggagcuugugcaggcugaagaggcccaggaggaacgcgggucuagcagagaccccguugcggagcugccguccgauggagaagcugagggcaccgccgaccucgaagccacaccugaggcucggcccgaagaggagcugaccggggaagagucugaagccgcucaaacgagcuguggacuucugggcguggaguggggaggacucacacacuccgucaccaagggccagggcccugaacugaugggaggggcccagacccccacaaaacagcccgaggagagagaagcgggcgagguggaacugauggggguccucgcccugagcaaggaggagcaagaacgcucucuugaggcuggaccucggcacgccggcuccgugaaaccggaagcuagcgaggccuuccccggggccugggaaaauagaacccgcaaggauauggagagaggaaacacacaggaggacgcugcggauggcgaacagcgggaggaagaggaaacggccggcgggcagacccuggcugccgaggccgagggagaccgcgaaucugagcucuccgaaguuccugaggcuggcggggaaggacugacaacccaagaugccggcugcgggacagaggagggagaagcgagcguguccgagaaucaggaacuugacggcucuaccggcgcugacgccgggcccuguccuagccugggagaggccuaugcuagagagacggaagaugaggaagccgaggcggaccggaccucccgcagaggcuggcggcuccaggcugucgccguggggcugcccgaucgcgaagacgcccaaacaggaucuguugcugccggcaucaugggaggggauguggucccgcauaucagcgcugccggcgcgggcgaggcccuggagggggugcucggacagggcugggacuccaaagaaaaggaggaagcugccgcuggggagcacgccggaggccaggaauuugggcuggagggaagcgccgaggaagaggugaccggcagaggcucucagguugaagccuucgagucccgggaagggggaccuuggggcgggcgcgucgaggcggaggaaagcgccggagcugaggauucuugcggccuugaccccgccgggucccaaacagccagagcugaaggaaugggcgccaugguggaggcgggcgggcugcucgagaaauggacccugcuggaagaggaagcugugggauggcaggagcgggaacagagagaggauagcgagggccgcuguggggacuaccauccugaaggagaggcuccccggcuucucgaugccgaaggccugauggucacagggggcagacgcgcugaggccaaggaaacggagccugagucucuggaacacgugcggggacaggaggaacaacccacccaccaggcgccggccgaggcugccccugaaagcguuggcgaggcugagacagccgaagcuaugggguccgccagaggaggcgcggccaacagcuggucugaggcuccccuccccgggucccugcuugacgugagcgucccucgcucccgggugcaucugucuagaagcuccucucagcgccggagcagaccguccuuucggcgcacccccgccugggaacagcaagaggagccucccgcuccuaaucccccugaagaggaacucucugcccccgagcagagaccgcugcagcuggaggaaccucuugagcccagcccucuccggcacgauggaacccccguuccggcccgcagacggccucugggccauggguucggccuggcucaccccggaaugaugcaagaacuccaggcgagacugggccgcccuaagccccaguga

SEQ ID NO: 65937 - RNA, 252 nt, Artificial Sequence
  derived and/or modified sequence opt5 from APOC1__Homo_sapiens__NP_001636
augagacuguuccucagccugcccgugcuugucguugugcuguccaucgugcucgagggcccugccccggcucaggggacccccgacgucucuagcgcccuggauaaacuuaaggaauuuggaaacacacuggaggacaaggcgcgggaacucauuucccgcaucaaacaaucugagcugagcgcuaagaugagagaaugguucuccgagacguuucagaaagugaaggagaagcugaaaauugauucuuga

SEQ ID NO: 65938 - RNA, 306 nt, Artificial Sequence
  derived and/or modified sequence opt5 from APOC2__Homo_sapiens__NP_000474
augggcaccagacugcuccccgcccuguuccuugugcugcucguccugggguuugagguucagggaacacaacagccucagcaggacgaaaugccgagccccacguuccuuacccaagugaaggagucccugucuagcuacugggaauccgcuaaaacagccgcgcagaaccucuaugagaagaccuaccugccugcuguggaugaaaaacugcgggaccucuauucuaagagcacagccgccauguccaccuacacaggcaucuuuaccgaucagguccugucugugcuuaaaggggaggaguga

SEQ ID NO: 65939 - RNA, 300 nt, Artificial Sequence
  derived and/or modified sequence opt5 from APOC3__Homo_sapiens__NP_000031
augcagcccagagugcugcucgucguugcccugcuugcucugcucgccagcgcgcgggcuuccgaggccgaagacgccucucugcuuagcuucaugcaaggcuacaugaagcacgcuaccaaaacagccaaggaugcucuguccucugugcaggagagccagguggcccagcaagcgcgcgggugggucacggacggauuuuccucucucaaagauuauuggagcaccgugaaggacaaauucuccgaauuuugggaucuggacccugagguuagaccgacaagcgccguggcugccuga

SEQ ID NO: 65940 - RNA, 384 nt, Artificial Sequence
  derived and/or modified sequence opt5 from APOC4__Homo_sapiens__NP_001637
augagccugcucagaaaccggcugcaggcccuucccgcucugugccucugugugcugguccuugccugcaucggcgcgugucaaccugaggcucaggaagggacccuguccccgcccccuaagcucaaaaugucucgcuggagccugguuagaggacggaugaaggagcugcucgaaacaguggugaaucgcacgagagacggcuggcagugguucuggucccccucuaccuuucggggguucaugcagacauacuaugaugaccaucugcgcgaucuuggaccucugaccaaagccugguuucucgagagcaaggacucccugcuuaaaaagacacacucucugugccccagacucgucuguggcgauaaggaccaaggguga

SEQ ID NO: 65941 - RNA, 570 nt, Artificial Sequence
  derived and/or modified sequence opt5 from APOD__Homo_sapiens__NP_001638
auggugaugcugcuccugcuucugagcgcccucgcuggccuguucggggccgcggagggacaggcuuuucaccuuggcaagugccccaacccuccgguccaagaaaauuucgacguuaacaaauaccuggggagaugguaugagaucgaaaagauucccaccacauuugagaauggacgguguauccaggccaacuacucccucauggaaaauggcaaaauuaaggugcugaaccaggagcugcgcgccgaugggacggugaaucagaucgagggagaagcuaccccugucaaccucacagagcccgccaaacuggaagugaaguucucuugguuuaugccuagcgcucccuauuggauucuugccaccgacuacgagaauuaugcgcugguuuacuccugcacauguaucauccaacucuuccauguggauuuugccuggauucuggcuagaaacccuaaucuuccgcccgagaccgucgacucucugaagaacauccucacaagcaauaacauugaugugaaaaagaugaccguuacggaccaggugaauugcccuaaacuguccuga

SEQ ID NO: 65942 - RNA, 1032 nt, Artificial Sequence
  derived and/or modified sequence opt5 from APOE__Homo_sapiens__NP_001289617
augagcuccggcgccucuagaaagagcugggaccccgggaacccuuggccgcccgauuggccuaucaccggacggaaaaugaaggugcugugggcugcccuccuggucacauuccuugcgggcugccaggcuaaaguugagcaagccguggaaacggagcccgaaccugagcugcgccagcagaccgaauggcaguccgggcaaagaugggagcucgcccugggacgguuuugggacuaccuucgcugggugcagacacugucugagcagguccaggaagaacuccugagcucccaagugacccaggaacugagagcucucauggaugagacaaugaaggagcugaaagccuauaagucugaacuugaggaacagcugacccccguugcugaggaaacacgggcccgccucagcaaggagcugcaggcggcccaagcuagacuuggcgccgacauggaggaugugugugggcggcugguccaguaccgcggagaagugcaggcuaugcucggccaauccaccgaggaacugagaguucggcuggccagccaccuccgcaaacugagaaagcggcuucugcgcgacgcggaugaccuccagaaaagacuggccguguaucaggcuggcgcccgggagggggcugaaagaggacuuucugccauucgcgagcggcugggcccucucgucgagcaggggagagugcgcgccgcuacggugggaucccuggcgggccaaccgcugcaggaacgggcccaggcuuggggagagagacuccgcgcccggauggaagagauggggagcagaacccgcgaucggcuggacgaagucaaggagcagguugccgaggugagagcuaaacuugaggagcaagcccagcagauccgccugcaggcggaggcuuuccaagcccggcucaagucuugguuugaaccccugguggaggauaugcagagacagugggccggccuugucgaaaaggugcaggcugccguuggcacauccgcugccccugugcccagcgacaaucauuga

SEQ ID NO: 65943 - RNA, 981 nt, Artificial Sequence
  derived and/or modified sequence opt5 from APOF__Homo_sapiens__NP_001629
augaccggccugugcggguacagcgcccccgacaugagaggacuccggcugaucaugauuccuguggagcuucugcucuguuaucugcuucugcacccggucgaugcuacauccuacggcaagcagacgaacguucucaugcauuucccccugucucuggaaagccaaaccccuuccucugacccccucagcugccaguuucugcacccuaaaucccuucccggguucucucauauggccccucugccgaaguuucucgugagccuggcgcuucgcaaugcucuggaggaagccggaugucaggccgaugugugggcucuccagcugcaacuguauagacagggcggggucaacgccacacaggugcucauccagcaucugcggggacuucaaaaaggccgcuccaccgagagaaauguuagcguggaagcucuggccucugcgcuccagcugcuugcccgggagcagcaguccacaggccgcgucgggagaagccugcccaccgaggacugcgaaaacgagaaggaacaagcugugcacaauguugugcagcuccugccuggagucggcacauucuacaaccuggggaccgcccucuauuacgcuacgcagaauugucugggaaaagcccgggagcgcggcagagauggggcgauugaccuuggauaugaucugcucaugaccauggccggcaugucuggcgggcccaugggacuggcuaucuccgccgcucuuaagccugcccugcggagcggcgugcaacagcucauucaguacuaccaggaccaaaaggaugccaacaucucucagcccgagacaaccaaagaagggcugcgcgcuaucuccgacgugagcgaucuggaggaaacaaccacgcucgcguccuuuauuucugaggucguuagcuccgccccguauuggggaugggcuaucauuaagagcuacgaccuggauccuggcgccgggucucuugaaaucuga

SEQ ID NO: 65944 - RNA, 1038 nt, Artificial Sequence
  derived and/or modified sequence opt5 from APOH__Homo_sapiens__NP_000033
augaucagccccgugcugauucucuucuccucuuuucugugccacgucgccaucgcuggcagaaccuguccuaagccggacgaucuucccuucagcacaguugugccucugaaaacguuuuacgagcccggggaagagauuaccuauuccugcaagccuggauacgugucucggggcgggaugcgcaaauucaucuguccccucacaggacuguggccuauuaacacccuuaagugcacaccgagagucugucccuuugccggcauccuggaaaauggggcggugcgguauaccacauucgaguacccuaacaccaucagcuuuuccugcaauacgggauucuaucucaacggcgcugacucugccaaauguaccgaagagggcaaguggagccccgagcugccuguuugcgcccccauuaucuguccgccucccuccauuccuacauuugcuacccugcgcguguacaagcccagcgccgggaauaacucucucuauagagauacagcugucuucgaaugccugccccagcaugccauguuuggaaaugacaccaucacguguacaacccacggcaacuggacaaaacuuccugagugccgggaagugaagugcccguuccccucccgcccugauaauggguuuguuaacuaccccgcgaaaccuacccuguacuauaaggacaaagccaccuucggaugucaugauggcuacagccucgacgggcccgaggagauugaaugcacaaagcugggaaauuggucugcuaugccguccuguaaggccagcugcaaagugccugucaagaaagcuacggugguguaucaaggcgagagagucaagauccaggaaaaauucaagaacggcaugcuucacggggauaaaguuuccuuuuucuguaagaauaaggagaaaaagugcucuuacaccgaagacgcccaguguauugauggaacaaucgaggugcccaaaugcuuuaaggagcauagcucccuggcguucuggaaaaccgacgccucugaugugaagccuuguuga

SEQ ID NO: 65945 - RNA, 1143 nt, Artificial Sequence
  derived and/or modified sequence opt5 from APOL1__Homo_sapiens__NP_001130013
auggagggcgccgcucugcucagagugagcguccugugcaucuggguucagcaaaacgugcccuccgggaccgacacaggagauccucagucuaagccgcuuggcgacugggccgcggggacgauggaucccgaaagcuccauuuucaucgaggacgcuauuaaauacuuuaaggaaaaagugucuacccagaaucugcuccugcuucugacagauaacgaggccuggaauggauucgucgccgcugccgaacucccucggaacgaggcugacgagcugcgcaaggcccuggauaaucucgcgagacagaugaucaugaaagacaagaacuggcacgauaagggccaacaguaucggaauugguuucugaaagaguucccccgccuuaagagcgaacuggaagacaacauuagacggcuccgcgcccuggcugauggggugcagaaaguucauaagggaaccacaaucgccaauguggucuccggcucucuuagcaucuccagcggcauucugacccucguggggaugggacuggcuccuuuuacagagggcgggucucugguucuccuggagcccggaauggaacuuggcaucaccgccgcgcugacggggauuaccuccagcacaauggacuacggcaaaaagugguggacccaggcccaagcucacgaucucgugaucaagucucuggacaaacuuaaggaggucagagaguuccugggagaaaacauuuccaauuuucucagccuggccggcaacacauaucagcugacccgggggaucggaaaagacauucgcgcucucagacgggcccgcgccaaucugcagucugugccucaugcuuccgcgagcagaccgcgggugacggaacccaucuccgccgagucuggcgagcaggucgaacgcguuaacgagccuagcauccuugaaauguccagaggggugaagcugacagauguggcucccgucagcuucuuucucgugcuggacguuguguaccuugucuaugagucuaaacaucugcacgaaggagccaaguccgagaccgccgaggaacucaaaaagguggcucaagagcuggaagagaagcugaauauucucaacaacaauuacaaaauccugcaggccgaucaggaacuuuga

SEQ ID NO: 65946 - RNA, 1014 nt, Artificial Sequence
  derived and/or modified sequence opt5 from APOL2__Homo_sapiens__NP_663612
augaaccccgagagcuccaucuucauugaagacuaccugaaguauuuucaggaucaagugucuagagagaaucuccugcagcuucugaccgacgaugaagccuggaacggcuucgucgcugccgcggagcucccucgggacgaagcugaugagcugcgcaaagcccuuaauaagcuggccagccacaugguuaugaaagacaagaacagacacgauaaagaccagcagcaccggcaaugguuucucaaggaguucccgcgccugaagagagaacuggaggaucauauccggaaacuccgcgcucuggccgaagagguggaacaggugcacagagggacaacgauugcuaaugucguguccaacucuguuggaaccacaagcggcauccuuacccugcucgggcugggacuugcccccuuuacagagggcauuuccuucgugcugcucgacaccgggaugggacugggcgcggccgcugccgucgcuggcaucacaugcucugugguugagcuggugaauaagcuccgggcccgcgcgcaggccagaaaccuggaucagagcgggaccaaugucgcuaaagugaugaaggaauuugugggaggcaacacgccuaauguccuuacccugguugacaacugguaccaagugacacaggggaucggacggaauauucgcgccaucagacgggcucgcgccaacccccagcucggcgccuaugcuccucccccucaugugauugggagaaucuccgcggagggaggcgaacaggucgagcgggugguugagggcccggcccaagcuaugagcagagggaccaugauugugggagccgccacaggcgggauccugcuucugcucgaugucgugucucuggcuuacgaauccaaacaucugcucgagggagccaagagcgaaucugcggaggaacugaagaaacgcgcucaggagcuugagggcaagcugaauuuccucaccaaaauucacgaaaugcugcagcccgggcaagaccaguga

SEQ ID NO: 65947 - RNA, 1209 nt, Artificial Sequence
  derived and/or modified sequence opt5 from APOL3__Homo_sapiens__NP_663615
augggccuggggcagggauggggcugggaggccagcugcuucgcuugucucaucagauccugcugucaaguggucaccuuuacauuccccuuuggguuccagggaauuucucagagccuggaaaacguuuccggcuacuaugccgacgcgcggcuugagguggggucuacgcagcugcgcaccgcuggaagcugcucccacucuuuuaagcggagcuuccucgaaaagaagcgguuuacagaggaagccaccaaauacuuccgcgagagaguguccccuguccaucugcaaauccuucugacaaauaacgaggccuggaagcgguuugugaccgcugccgaacucccgcgcgaugaggcugacgcccuguaugaagcgcugaaaaagcucagaacauacgccgcuauugaggaugaguauguucagcagaaggacgaacaguuccgggagugguuucugaaagaguucccccaagugaagcgcaaaauccaggagagcauugaaaaacuuagagcccuggcuaauggcaucgaggagguccaccggggcuguaccaucucuaacgugguuuccagcucuacgggggccgcguccggaauuaugagccucgccggccuggugcuugcuccuuuuaccgccgggacaucucuggcucucaccgccgccggagucggccugggggcugcguccgccgugacaggaaucaccacgagcauuguggaacauuccuacacaucuagcgcugaggccgaagccucccgccugaccgcuacaagcaucgauagacucaaagucuucaaggagguuaugcgggacauuacccccaaucugcuuucucugcucaacaauuauuacgaagccacccagacaaucggcuccgagauucgcgcgaucagacaggcucgggccagagcccgccugccugugacgaccuggcggaucagcgcuggcucugggggacaagccgagagaacaauugcuggcaccacacgcgccgugagcagaggggcgagaauccuuuccgccaccacgucuggaauuuuccuggcucucgaugucgugaaccugguuuacgaaagcaagcaucugcacgagggcgccaaauccgcuagcgccgaagaacuccgccggcaggcgcaggaacuggaggagaaucuuauggaacugacacaaaucuaucagagacucaaccccugccacacccacuga

SEQ ID NO: 65948 - RNA, 1047 nt, Artificial Sequence
  derived and/or modified sequence opt5 from APOL4__Homo_sapiens__NP_085146
augggcagcugggugcagcugaucaccuccgucgggguucaacagaaccaccccggauggacaguggccggccaguuccaggagaagaaaagauuuacggaagaggugauugaauacuuccaaaagaaagucucuccugugcaucucaagauccugcuuaccagcgacgaggcuuggaaacgguuuguucgcguggccgaacugccgagagaggaggcggaugcucucuaugaagcccugaagaaucuuacacccuacgucgccauugaggacaaggauaugcagcagaaagaacagcaauuccgggagugguuucugaaggaguucccucagauccgcuggaaaauucaggaauccaucgagagacuccgggugaucgcuaacgaaauugagaagguucaccgcgggugcgugaucgccaaugucgugucuggaagcaccggcauucuguccgugaucggggucaugcuggcucccuuuacagccggacucucucugagcauuaccgcggccggcguuggccuugggaucgcuuccgccacagcuggaauugccagcucuaucguggaaaacaccuauacgagauccgcggagcugaccgccagccggcucacagcuaccucuacagaccagcuggaggcccuucgcgauauccugagagacauuaccccuaaugugcucuccuucgcucuggauuuugacgaagccacgaaaaugaucgccaacgauguccauacacugcggcgcagcaaggcuaccgugggcagaccccucauugcguggcgguacguuccuaucaauguggucgagacacugcgcaccagaggggccccgacccggauugugagaaagguugcucgcaaccuuggaaaagccacaucuggcgugcuggucgugcucgacgucgugaaucugguucaagauucccuugaccugcacaagggggccaaaagcgaauccgcugagucucuccggcagugggcccaggaacuggaggagaaccugaaugaacucacgcauauccaccaaagccugaaggcgggauga

SEQ ID NO: 65949 - RNA, 1032 nt, Artificial Sequence
  derived and/or modified sequence opt5 from APOL6__Homo_sapiens__NP_085144
auggacaaccaggccgagagagaaagcgaggcuggcguggggcugcaacgggaugaagacgaugcgccccucugcgaggacgucgaacugcaggauggagaccuuuccccugaggagaagaucuuccugcgcgaauuuccgagacucaaagaggaucugaagggcaauauugacaaacuucgggcccuggcugaugacaucgauaagacccacaaaaaguucacaaaggccaacaugguugccacgucuaccgcugugauuagcggggugaugucccuccugggacuggcccucgcucccgccacaggcgggggaucucugcuucugagcaccgcgggccagggccucgccacagcugccggggucaccuccaucgugucuggaacacuggaacgcagcaaaaauaaggaggcucaggccagagcggaggacauucuuccuaccuacgaucaagaagaccgggaggacgaagaggaaaaagccgauuauguuacggcugccggcaagaucaucuacaaccugcgcaauacccucaaauaugcuaagaagaacgugagagccuuuuggaaacugcgggccaauccccgccuggcuaacgcgacaaagagacuccugaccacagggcaggucuccagccggucucgcgugcagguucagaaagccuucgcuggaaccacgcuugccaugacaaagaaugccagagugcugggcggggucauguccgcuuuuagccucggauacgaccuggccacccuuucuaaagaguggaagcaucugaaagagggcgcgcggacaaaguucgcugaggaacuccgcgccaaggcccuggaacuggagagaaaacucaccgaacugacccaacuuuauaagucccugcagcagaaagugcggagcagagcucgcggcguggggaaggaucucacaggaacgugugagaccgaggccuacuggaaagaacugcgggagcacgucuggauguggcuuuggcugugcguuugucucugcguguguguguauguccaguuuacauga

SEQ ID NO: 65950 - RNA, 840 nt, Artificial Sequence
  derived and/or modified sequence opt5 from APOLD1__Homo_sapiens__NP_001123887
auguucagagcccccugccaccggcugcgcgcuagaggcacccggaaggcccgcgcgggggcuuggagaggauguacauuuccuugccucggcaaagggauggagcggccggccgcccgcgaaccccauggaccugacgcucugagacgguuccagggccuucugcucgaucgcagagggcggcugcacggacaagugcuucgccugagagaggucgcccggcgccucgaaagacugcggagacgcagccugguugcuaacguggccggcuccucucucagcgcgacgggcgcccuggcugccaucguggggcuuucccugucucccgucacccucggaacaagccugcuuguguccgcuguuggccuggggguggccaccgcgggaggcgccgucacaauuaccucugaccucagccugaucuuuuguaauucccgggagcugagacgcgugcaggaaauugcugccacaugccaggaucagaugcgggagauccucagcugucuggaguucuuuugcagauggcaaggguguggagaccgccagcuucugcagugcggccggaacgcuucuauugcccucuacaauuccguuuauuucaucguguuuuucggcagcagaggguuucugaucccucgccgggccgaaggagauaccaaggucucucaggcugugcuuaaagcgaagauucaaaaacuggccgagucccucgaaagcuguacgggcgcucuggacgagcugucugagcagcucgaauccagagugcagcugugcaccaagagcucccgcgggcaugaucuuaagaucucugccgaccagcgggccggacuguucuuuuga

SEQ ID NO: 65951 - RNA, 351 nt, Artificial Sequence
  derived and/or modified sequence opt5 from APOM__Homo_sapiens__NP_001243098
auggccgcuggcagcgcccccaugcagcugcaccucagagcgaccauccggaugaaagacgggcugugcgugccucgcaaauggauuuaccaccuuaccgagggauccacggaucugagaaccgaaggccggccggacaugaagacagaacucuucucuagcuccugucccgggggaaucaugcugaacgagaccggccaaggguaucagcgcuuucuucuguacaauagaucuccucaucccccugagaaaugcgucgaagaguucaagagccucacauccugucuggauucuaaggcuuuucugcucacaccccggaaccaggaggccugcgaacugagcaauaacuga

SEQ ID NO: 65952 - RNA, 597 nt, Artificial Sequence
  derived and/or modified sequence opt5 from APOO__Homo_sapiens__NP_077027
auguucaaggugauccagagaagcgucggccccgccucccugucucuccugaccuuuaaaguuuacgcugccccuaagaaagacagcccgcccaagaacuccgugaaaguggaugagcuuucucuguauagcgucccugaagggcaauccaaguacguggaggaagcgcggucucagcucgaggaaagcauuucccagcugcgccacuauugcgagcccuacacaacguggugucaggagaccuauagccaaacaaagccuaaaaugcagucucuuguucaguggggacuggacuccuacgauuaucuccagaaugcucccccuggcuucuuuccgagacugggggugaucggauucgccggccugauugggcuccugcuugcccggggaagcaagaucaaaaagcuggucuaucccccuggcuuuaugggccucgcugccucucuguacuacccccaacaggcuauuguguucgcccagguuuccggggaacgccuuuacgacuggggacugagaggcuauaucgugaucgaggaucucuggaaagaaaacuuucagaagccugggaaugucaagaacagccccggaaccaaauga

SEQ ID NO: 65953 - RNA, 621 nt, Artificial Sequence
  derived and/or modified sequence opt5 from APOPT1__Homo_sapiens__NP_115750
augcugcccugcgccgcuggcgccagagggcggggagcgauggugguccuccgcgcuggcaagaaaaccuuccugccuccgcuuuguagagccuuugccugccgggggugucagcuggcucccgagcgcggagccgaaagacgggacacagcuccuagcggcguuucccgcuucugucccccuagaaagucuugccacgauuggaucgggcccccugacaaauacagcaaccuccggccggugcauuuuuauauucccgagaaugaauccccucuggagcaaaaacuucgcaagcugagacaggaaacgcaggaguggaaccagcaauucugggccaaucagaaccucaccuuuucuaaggagaaggaagaguucauccacagccggcugaaaacaaagggacugggccuccgcaccgaauccggccagaaagcgacacugaaugccgaggagauggcugauuuuuacaaggaguuccuuucuaaaaacuuucagaagcauauguauuacaauagagacugguauaagcggaacuucgccauuaccuuuuucauggggaaaguggcucuggaacgcaucuggaauaagcucaaacaaaagcagaaaaagagaagcaacuga

SEQ ID NO: 65954 - RNA, 1758 nt, Artificial Sequence
  derived and/or modified sequence opt5 from APPBP2__Homo_sapiens__NP_006371
auggccgcuguggagcuggaauggauccccgagacccucuacaacacagccauuagcgcggucguugacaauuauaucagaucccggcgcgauauuagaucucugccugaaaacauccaguucgacguguacuauaagcuguaccaacagggccggcugugccagcucgggagcgaguuuugugaacuggagguguucgcuaaaguccuucgcgcccuggauaagagacaccuccugcaucacugcuuucaggcccugauggaccauggagugaaaguugcuuccgugcucgccuauucuuucagccggcgcuguuccuacauugcugagucugaugccgcggucaaggaaaaagccauccaagugggcuuuguucuugggggauuccuuagcgacgcuggcugguauuccgaugccgagaagguguuucugagcugccuccagcuguguacgcuucacgacgaaaugcugcauugguucagagcugucgagugcugugugcggcuccugcacgugcgcaaugggaacugcaaguaccaccugggagaggaaaccuuuaaacucgcccagacauacauggauaagcugucuaaacauggccagcaagcgaauaaggccgcucuuuauggcgagcugugugcccuccuguucgcuaaaucccacuacgacgaagccuauaaguggugcaucgaggccaugaaggaaauuaccgcugggcuuccggucaaaguugugguggauguccugagacaggcgagcaaggccugugugguuaaacgggaguuuaagaaagcugagcagcucaucaagcaugccguguaccuggcccgcgaccacuucggaucuaaacaccccaaguauuccgauacacugcucgacuacggcuuuuaucugcuuaacgucgacaauauuugccagagcguggcuaucuaccaagccgcgcuggauauuagacagucuguuuucgggggaaagaacauccauguggcuaccgcccacgaagaccucgccuacuccagcuauguccaucaguacuccucuggcaaauucgauaaugcucuguuucacgccgagcgggcuauugggaucaucacacauauucuuccugaagaccaucugcuccuggccagcuccaagcgcgugaaagcgcugauccucgaggaaauugccaucgauugccacaacaaggagaccgagcaaagacugcuucaggaagcucacgaccugcaccucagcucucugcagcuggccaaaaaggcuuucggagaguuuaauguccagacggccaagcauuauggcaaccuuggccggcucuaccaauccaugagaaaauucaaggaagcggaggaaaugcacauuaaagccauccagaucaaggagcagcugcuggggcaggaggauuaugaaguggcucucagcguuggacaccuggccucucuuuacaauuaugacaugaaccaauacgagaaugcugaaaaacuguaccuccgcagcauugccaucggcaagaagcuguuuggggagggauauuccggccuggaguacgauuaucgggggcuuauuaaacucuacaacucuaucggaaacuaugaaaagguguucgaguaccauaauguccugagcaacuggaauagacugcgcgaccggcaguauuccgugaccgaugcccucgaagacguuagcacaucuccccaguccaccgaggaagugguccagagcuuucugauuucucaaaacguggagggcccuuccuguuga

SEQ ID NO: 65955 - RNA, 2313 nt, Artificial Sequence
  derived and/or modified sequence opt5 from APP__Homo_sapiens__NP_000475
augcugcccggccucgcccugcuucugcucgcugccuggaccgcgagagcucuggaggugccuacagacgggaacgccggacuucuggccgaaccgcagaucgcuauguucugcggccggcucaauaugcacaugaacguccaaaaugggaagugggauagcgaccccuccggaacgaaaaccuguauugauacaaaggagggcauccugcaguacugccaggaaguuuauccugagcugcagauuaccaacgugguggaagccaaucaacccgucacaauccagaacugguguaaacgcgggagaaagcagugcaaaacccauccucacuuugugauucccuaccggugucucguuggagaguucgugucugacgcucugcuugucccugauaagugcaaguuucugcaucaggagcgcauggacgugugugaaacacaccuccauuggcacaccguugccaaagagacgugcagcgaaaaguccaccaaucugcacgauuauggcaugcuucugccguguggcaucgacaaauucagagggguggaguuugucugcuguccccucgcggaggaaucugauaacguggacagcgccgaugcugaggaagacgauuccgacgugugguggggaggcgccgacacagauuacgcugacgggucugaggauaaggucguugaaguggccgaggaggaagagguggcggaagucgaggaagaggaggccgacgaugacgaagaugacgaggauggagacgaaguggaggaagaggcugaggaaccuuaugaggaagccaccgagcggacaaccagcaucgcuacgacaaccacaaccaccacagaguccguugaagaggugguccgcgaagugugcagcgagcaagccgaaacgggccccugcagagccaugauuucucggugguacuucgauguuaccgaggggaaaugugcucccuuuuucuauggaggcugcggcgggaaucgcaacaauuuugacacagaggaauacuguauggcggugugcggauccgccaugagccagucucugcugaagaccacacaggagccucucgcuagagacccggucaagcugccuaccacggccgccuccacacccgaugcuguggacaaauaccuugaaaccccuggcgaugagaacgaacaugcccacuuccagaaggcgaaagagcggcuggaggcuaagcaucgcgaaagaaugagccaagucaugcgggagugggaagaggccgaacgccaggccaaaaaucuccccaaggcugacaaaaaggccgugauccagcacuuucaagagaagguugagucucuggaacaggaggcugccaacgaaagacagcagcuuguggagacccacauggcgcgggucgaggccaugcugaaugauagacgccggcucgcucuggaaaacuauauuacagcccugcaagcugugcccccuagaccgcgccauguuuucaacaugcucaaaaaguacgugcgggccgagcagaaagacagacagcacacccugaagcauuuugaacacguccgcaugguggaucccaaaaaggcggcccagauccggucccaagugaugacacaucuuagaguuauuuaugagcgcaugaaucagagccugucccuccuguacaacgucccugcuguggccgaagagauccaggacgagguggaugaacuucugcagaaggagcaaaauuauucugacgauguccucgcuaacaugauuagcgaaccccggaucuccuacgggaaugacgcccugaugccuagccugacggagaccaaaacaaccguggaacuccugcccguuaacggagaguucucucuugaugaccugcagccguggcacuccuucggcgccgacagcgugccugcuaauacagagaacgaagucgagcccguggaugcgagaccugccgcugaccgcgggcucaccacgcggcccggaucuggccugaccaauaucaagacagaagagauuagcgaaguuaaaauggaugccgaguuuagacacgacuccggcuaugaggugcaucaccagaagcuggucuucuuugccgaagauguggggucuaacaaaggagcuaucauuggccuuaugguugggggaguggucaucgccaccgugauugugaucacacucgucaugcugaagaagaaacaguacaccagcauccaucacggcguuguggagguggacgcggcugucacgccugaggaacggcaccuguccaagaugcaacagaauggguacgagaaccccacauauaaauucuuugaacagaugcaaaauuga

SEQ ID NO: 65956 - RNA, 2130 nt, Artificial Sequence
  derived and/or modified sequence opt5 from APPL1__Homo_sapiens__NP_036228
augcccggcaucgacaagcugccuauugaggaaacccucgaggauagcccgcagacaagaucccugcuugggguguucgaagaggacgccacggcuaucucuaacuacaugaaucaacuguaucaggccaugcaccggauuuacgaugcgcagaacgaacucagcgcugccacccaucugacauccaaacuucugaaggaguaugagaaacagcgcuuuccccucggaggcgacgaugaagucaugucuagcacccugcaacaguucuccaagguuaucgacgagcugucuagcugccacgccgugcucuccacacagcuggcugaugccaugauguuuccuauuacccaguucaaagaaagagaccuuaaggagauccugacacucaaggagguguuucaaaucgcuagcaaugaucaugacgccgcgauuaaccgguacucucgccuguccaaaaagagagaaaaugauaaagucaaguaugaggugaccgaagacguuuacacgagccggaaaaagcagcaccagaccaugaugcauuauuucugugcccuuaacacacugcaguacaagaaaaagaucgcucuccuggagccccugcucggguacaugcaagcccagauuagcuuuuucaaaaugggauccgaaaaucugaacgagcagcuugaggaauuucuggcuaauaucggcaccagcgugcaaaacguccgcagagagauggauucugacauugaaacaaugcagcagaccaucgaggaccucgaaguggccuccgauccucuguauguucccgacccugauccgacgaaguuccccgugaaucggaaccuuacacgcaaagcgggguaccugaaugccagaaacaagaccggacucgucagcuccacaugggaccggcaguuuuauuucacccaaggcggcaaucugaugucucaggcucgcggggauguggccggaggccuggcuauggacauugauaacugcagcgugauggccgucgacugugaggauagacgguacugcuuucagaucaccuccuucgacgggaaaaagagcucuauccuccaggccgaguccaagaaagaucacgaagaguggauuuguacaaucaacaauauuagcaagcaaaucuaucugucugaaaacccugaggaaacggcugcgcgcguuaaucagagcgcccuugaggcugugacccccuccccuucuuuccagcagagacacgagagccugcggcccgccgccggacaauccagaccgccuacagcucgcaccucuucuuccggcagccucgggucugaauccacaaaccuggccgcgcuuagccuggacucccucguggcucccgacaccccuauucaguuugauaucaucucucccgucugcgaggaccagcccggacaggccaaagccuucggccaaggcgggcggagaacgaauccuuuuggagaaagcggcggguccacaaagucugagaccgaggauagcauucugcaucagcuguucaucgugcgcuuucucggauccauggaaguuaaaagcgacgaucacccggacguggucuacgagaccaugcggcagauucuggcugccagagcuauccauaacauuuuccgcaugacagaaucucaccuucuggugaccugugauugccucaagcugaucgacccccaaacacagguuacgcggcugaccuuuccucuucccugugugguccucuaugccacacaccaggagaauaagagacuguucggcuuugugcugcgcaccuccagcgggcggucugaauccaaccucagcucugucugcuacaucuucgagagcaauaacgagggagagaaaauuugugauuccgugggccuggcgaagcagaucgcccuucaugcugaacuggacagacgcgccagcgaaaaacaaaaggagauugaacggguuaaagagaagcagcagaaggagcucaauaaacagaagcaaaucgaaaaagaucuggaggaacagucuagacugauugcugccuccagccggccuaaccaggcguccucugagggccaguuugugguccuuagcuccucucaaagcgaagaguccgaccucggggagggaggcaagaaacgcgaaucugaggccuga

SEQ ID NO: 65957 - RNA, 2013 nt, Artificial Sequence
  derived and/or modified sequence opt5 from APPL2__Homo_sapiens__NP_001238833
augcccgccguggacaagcugcuccuggaggaagcccuucaggauagcccucaaaccagaucccugcucucugucuucgaggaagacgcuggcacacugacggauuacaccaaccagcuucugcaggcgaugcagcggguuuauggggcucaaaaugagaugugccucgccacacagcagcugagcaaacagcugcucgccuacgaaaagcaaaacuuugcucugggaaaaggcgacgaggaggugaucuccacccuucacuauuucucuaagguggucgaugaacugaaucuccugcauacagagcuugccaaacagcuggcugacaccauggugcucccgauuauccaguuucgcgaaaaggaucugacagagguuagcacccugaaggaccucuucgggcuggccuccaacgaugugugucuuuuucuggagcacgaccucucuauggcgaaauacagcagacugcccaagaaaaaggaaaaugagaaagucaagacggaagugggaaaggagguugccgcugcccggcgcaaacagcaucuuuccagccugcaauauuacugcgcucucaacgcccugcaguauagaaagcagauggcgaugauggaaccuaugauuggcuucgcccacgggcaaaucaacuuuuucaaaaagggagcugagauguuuucuaaacggauggauuccuuccugagcucuguggccgacaugguccaguccauucagguggagcucgaagcugaggccgaaaagaugcgcgugagccagcaagagcugcuuucugucgaugaauccguuuacacccccgacagcgacguggccgcuccucagaucaauagaaaucugauccagaaagcgggcuaccucaaccugcggaauaagacaggccuugugaccacaaccugggagcgccuguacuuuuucacgcagggaggaaaccucaugugucaacccagaggcgccgucgcugggggacugauucaggaucuggacaauugcuccgugauggccguugauugugaggaccggcgcuauugcuuucagaucacaaccccuaacggcaagucugggauuauccuccaggccgaaagcagaaaagagaaugaagaguggauuugugcuaucaacaacauuucccggcaaaucuaucugacagauaauccggaagccguggcgaucaaacuuaaccagaccgcucugcaggccgucacccccauuacgagcuucgggaaaaagcaggagucuuccugcccuagccaaaaucucaaaaacucugagauggaaaaugagaacgacaagaucgugcccaaggccacagcuagccugccugaagccgaggagcugauugcucccggcaccccgauccaguucgauauuguucuuccugccacagaauuucucgaccagaaucgcggcuccagacggaccaaccccuucggggagacagaagaugagucuuuuccugaagcggaggacagccugcugcaacagauguucaucgugagauuucucggauccauggccgucaaaaccgauagcacgacagaggugaucuacgaagcuaugcgccagguccuggccgcucgggccauucauaauaucuucagaaugaccgagucucaccuuauggugaccucccagagccugcgccucauugacccccaaacacagguuucucgggcgaacuuugaacugaccuccgugacacaguucgccgcucaccaggagaauaagagacuggucggcuuugugauccgcguucccgaaagcacgggggaggagucccuuucuaccuauauuuucgaaagcaacuccgagggagaaaagaucuguuacgccaucaaucucggcaaggagauuaucgaagugcaaaaagacccugaggcucuggcccagcugaugcucucuauuccgcugacaaacgaugggaaguauguccuucugaaugaccagcccgaugacgaugacggaaacccuaacgagcaucggggcgccgaaagcgaggcuuga

SEQ ID NO: 65958 - RNA, 543 nt, Artificial Sequence
  derived and/or modified sequence opt5 from APRT__Homo_sapiens__NP_000476
auggccgacagcgagcugcagcucguggaacaaagaauccgguccuuccccgauuuuccuaccccgggcgucguuuuccgcgacauuucucccgugcugaaggauccugcuagcuuuagagccgcgaucgggcuucuggcucggcaccucaaagccacacauggaggccgcauugacuacaucgccgggcuggauuccagaggauuccuuuuuggccccucucuggcucaggagcucgggcugggaugcgugcugauucggaagcgcggcaaacucccuggccccacgcugugggccagcuauucccuugaauacgggaaggcugagcuggaaauccagaaagacgcccucgagccuggacagagagucgugguuguggaugaccugcuugcgaccggcgggacaaugaacgccgcuugugagcugcucggacggcugcaagccgaaguccuggagugcgugucucucguugaacugaccagccuuaagggccgcgagaagcuggcuccggugcccuucuuuucccuccugcaguaugaguga

SEQ ID NO: 65959 - RNA, 1071 nt, Artificial Sequence
  derived and/or modified sequence opt5 from APTX__Homo_sapiens__NP_001182177
augagcaacgugaaucuguccgucucugacuucuggagaguuaugaugcgggugugcuggcucgugcgccaggauagcagacaccaacggauccgccugccccaucuugaggccgucgugauuggcagagggccugaaaccaagaucacagacaaaaaguguucccggcagcagguucagcugaaagcugagugcaacaagggauacgugaaagucaagcaagugggcguuaauccgacgucuauugauagcguggucaucgggaaggaccaggaagugaaacuccagcccggacaggugcugcacauggucaacgagcuuuauccuuacauuguugaauuugaggaggaagccaagaaucccggccuggagacccaucgcaaaagaaagcgguccgggaacucugauagcaucgaacgcgacgcggcucaagaggccgaggccggaacaggccucgaaccuggcuccaauagcgggcaguguucugugccccugaaaaagggaaaggaugcuccuaucaaaaaggagucccugggccacuggagccaggggcucaaaauuucuaugcaggacccgaagaugcaaguguauaaagaugaacaggucgugguuaucaaggacaaauaccccaaggccagauaucauuggcuggugcuuccuuggaccuccauuagcucucugaaggcugucgcccgggagcaccucgaacugcuuaaacacaugcauacagugggagagaagguuaucguggauuucgcgggcuccagcaaacugcgcuuuagacucggguaccacgccauucccuccaugucucauguccaucugcacgugaucagccaggacuucgauuccccuugccugaagaacaaaaagcacuggaauagcuuuaacaccgaguauuuccucgaaucucaagcugucauugagauggugcaggaagccggacggguuacagugcgcgacggcaugcccgagcugcuuaagcugccgcucagaugucacgaaugccagcagcugcuuccuuccaucccccaacugaaagagcaucuccggaagcacuggacccaguga

SEQ ID NO: 65960 - RNA, 906 nt, Artificial Sequence
  derived and/or modified sequence opt5 from AQP10__Homo_sapiens__NP_536354
augguguucacacaggcccccgcugagaucaugggccaccugagaauccggagccuccuggcccgccaaugccuugcggaauuucugggggucuucguucucaugcugcuuacacagggagcuguggcccaggccgugacguccggcgagaccaaggggaacuuuuucacaauguuucuggcuggaucucucgccgucaccauugcuauuuacgugggcgggaauguuagcggagcccaucugaacccugcguucucccuggccauguguaucgugggcagacucccgugggucaaacugcccauuuauauccuugugcagcugcucucugcuuuuugcgccagcggcgcuacauacguucuguaucacgacgcccuucaaaauuacaccgggggaaaccugacagugaccggcccuaaggaaacggcguccaucuucgccaccuaucccgcuccuuaccucucucugaauaacggguuucuggaucagguccucggaacaggcaugcugauuguggggcuucuggccauccucgaccggcgcaauaaaggagugcccgcuggccuggagccugucguugugggcaugcuuauucuggcccucgggcugagcaugggagccaacuguggcaucccgcugaaucccgcuagagaucucgggccucggcuguucaccuauguggcgggauggggccccgaagucuuuuccgccgggaacggaugguggugggugccuguuguggcuccccuugucggcgccacagugggcaccgccacguaccagcugcucguugcucugcaucacccggaggggccugagcccgcccaggaccuugugagcgcgcaacauaaggcuucugaacuggagaccccugccuccgcccagaugcucgaaugcaaacuguga

SEQ ID NO: 65961 - RNA, 561 nt, Artificial Sequence
  derived and/or modified sequence opt5 from AQP1__Homo_sapiens__NP_001171989
augcccggcgccagaccucugccgcucgugcuggucccccagaacacccuugcuuggaugcaacuggacgccaaggcgccugcucacccccggccucuccagcugcuugggcgcguuggacccggcagcagacagcuggccgauggggucaauuccggacagggccucgggaucgagauuaucggaacacugcaacuggugcucugcgugcuggccacgaccgaccggcgcagacgggaucuuggcggcucugcuccucuggccauugggcucagcguggcucugggacaucuucuggccaucgacuacacaggcugugggauuaacccggcgcgcuccuucggaucugccguuaucacccacaauuuuagcaaccauuggaucuucugggugggccccuuuauugggggagcucucgccguccugaucuaugauuucauucuggcuccuagauccucugaccucacagaucgggugaaaguuuggaccagcggccagguggaagaguacgaccuggaugccgacgauaucaauucccgcgucgaaaugaagcccaaauga

SEQ ID NO: 65962 - RNA, 816 nt, Artificial Sequence
  derived and/or modified sequence opt5 from AQP2__Homo_sapiens__NP_000477
augugggagcugagaagcaucgccuucucccgggcuguguuugccgaguuccucgcgacccugcuuuuugucuucuuuggccuggggucugcucucaacuggccccaggcccugccuagcguucuucaaauugccauggcuuucggacugggcaucgggacacucgugcaggcccugggacacauuuccggcgcucauaucaauccggccgugacggucgcgugccugguggggugucacguuucugugcuccgcgccgcuuuuuacgucgccgcucagcugcuuggagccguggcgggcgccgcucugcuccaugagauuacccccgccgacaucagaggcgaucuggcuguuaacgcccuuagcaauuccacaaccgccgggcaggcugugacagucgaacuguuccucacccugcaacuggugcucugcaucuuugcgucuacagacgagcggcgcggagaaaacccuggcacccccgcccugagcauuggguucuccguggcucuuggacaucugcucggcauccacuauacgggguguagcaugaauccugccagaucucuggcccccgcugucguuaccggaaaguuugaugaccacuggguguucuggauuggcccucuugugggcgccauccuggggucccuccuguacaacuauguccuguuuccgcccgcgaaaagccucucugagcggcuggcugugcuuaagggacuggagccugauacagacugggaagaacgcgaaguuagacggcgccaguccguggagcuccacagcccccagucucugccuagaggcaccaaagccuga

SEQ ID NO: 65963 - RNA, 879 nt, Artificial Sequence
  derived and/or modified sequence opt5 from AQP3__Homo_sapiens__NP_004916
augggcagacagaaggagcuggugagccggugcggggaaaugcuccacauccgcuacagacugcuucggcaagcccuggcugagugucucggaacccugauucuugucauguucggcugcggguccguugcccagguggugcugucucgcggaacacauggcggguuucucacgaucaaccuggcguucggauuugcugucacccugggcauucucaucgccggccaggugagcggggcccaccugaaucccgcuguuacauucgccauguguuuucuugcuagagaaccuuggauuaaacugccgaucuauacccucgcccagacacugggagcguuccuuggcgccgggaucguguuuggacuguacuaugacgcuauuuggcauuucgccgauaaccaacucuuugucuccggccccaaugggaccgcuggaaucuucgccacauacccuucuggccaccuggacaugauuaacggcuuuuucgaucaguuuaucgggaccgcgagccugauugugugcguucucgccaucguggaccccuauaauaacccugucccccggggacuggaggcuuucacggugggccuugugguccugguuauugggaccuccaugggauucaauucuggcuacgccgugaacccugcucgcgauuuugggccgagacucuucacagcccuggccggauggggcagcgcuguguuuaccacaggccagcauuggugguggguccccaucguguccccucuucuggggagcaucgcgggaguuuucguguaucagcucaugauuggcugucaccuggaacaacccccucccucuaaugaggaggaaaacgucaagcuggcccacgugaaacauaaggagcagaucuga

SEQ ID NO: 65964 - RNA, 972 nt, Artificial Sequence
  derived and/or modified sequence opt5 from AQP4__Homo_sapiens__NP_001641
augagcgacagacccaccgcccggcgcuggggcaagugcgggccucuguguacaagagagaacaucaugguggcuuucaaaggagucuggacgcaggccuuuuggaaggcgguuaccgcugaguuccucgccaugcugauuuuugugcuucugucccucggcucuacaaucaauuggggaggaaccgaaaaaccgcugcccguggauaugguccuuauuagccugugcuucggccucuccaucgccacaauggugcaauguuuugggcacauuucuggaggccauaucaacccugcuguuaccguggccauggucugcacacggaagaucagcauugcuaaauccguguucuacaucgccgcgcagugucugggcgccauuaucggggcugggauucuguaucucguuacgcccccuucuguggucggcgggcugggagugaccauggugcacggcaaucuuaccgccgggcauggacugcucgucgaacugaucauuacauuucagcuuguuuucaccaucuuugcuagcugcgacuccaagcgcacagaugugaccggcagcaucgcccuggcgauuggcuucucuguggccaucgggcaccucuuugcuauuaacuacacgggagccuccaugaaucccgcucggagcuucggcccugccgucaucauggggaacugggagaaucauuggauuuauugggugggaccgaucaucggcgccguucuggcugggggacuguacgaauauguguuuugucccgacgucgaguucaagcggcgcuucaaagaggcguuuucuaaggccgcucagcaaacaaaaggcuccuacauggaaguggaggauaacagaagccagguugaaaccgacgaucucauucugaagccuggcgugguccacgugaucgacgucgauagaggggaggagaaaaagggaaaggaccagucuggcgaagugcuuuccagcguuuga

SEQ ID NO: 65965 - RNA, 798 nt, Artificial Sequence
  derived and/or modified sequence opt5 from AQP5__Homo_sapiens__NP_001642
augaagaaagaggugugcagcgucgccuuccugaaggcuguuuuugccgaauuucucgcgacccugaucuuuguguucuuuggccuuggguccgcucugaaauggcccucugcccucccuacaauucugcagaucgcccuugcuuucggacuggccauuggcacgcucgcucaagcccuggggccggugagcggaggccacaucaaccccgcgauuacccuggcccuccuggucgggaaucagaucucccuucugagagcuuucuucuacguggccgcucagcucguuggagccaucgcgggcgccggcauucuguaugggguggcuccucuuaacgcccggggaaaucuggcugucaacgcccucaauaacaauacaacccagggccaagccauggugguugagcugauccugacauuucagcucgcucuguguauuuucgcgucuaccgacagccgcagaacaucccccguggggucuccugcccuuagcaucggacuguccgucacccucggccaucugguggggauuuacuuuacgggaugcagcaugaaccccgcucggucuuucggcccugccguggucaugaaucgcuuuuccccggcccacuggguuuucugggugggccccaucgugggggcuguccuugccgcgauucuguauuucuaccuccuguuuccuaacagccugucucucuccgaaagaguggcuaucaucaagggaaccuaugagcccgaugaagacugggaggagcagcgggaggaacgcaaaaagacaauggaacugaccacaagauga

SEQ ID NO: 65966 - RNA, 849 nt, Artificial Sequence
  derived and/or modified sequence opt5 from AQP6__Homo_sapiens__NP_001643
auggacgccguggagcccggcgggagaggaugggcuagcaugcuggccugccggcucuggaaggcgaucucccgcgcucuguucgccgaauuucuugccaccggccuguacgucuucuuugggguuggaucugugaugagauggccuacagcucucccgagcgugcugcagauugccaucacguucaaccuugucaccgcuauggccgugcaaguuacauggaaagcguccggcgcccacgcuaaucccgccgugacccuggcuuuucucgucgggucucauauuagccugccucgggccguggcguauguugccgcucagcuggugggagccacagucggcgcugcccuccuguacggcgugaugcccggggauauccgcgagacccuuggaauuaacguggucagaaauuccguuucuacaggccaggccguggcuguggaacugcuccugacccuucagcugguccucuguguguucgcgagcacggacucccggcaaaccagcgggucuccugccacaaugaucggaaucuccguugcucugggccaccugauugggauccauuuuaccggaugcagcaugaaccccgcccgcucuuucggcccugccauuaucauuggcaaguuuacagugcacugggucuucuggguggggccgcucaugggagcucugcuugccucccugaucuauaauuuuguucucuuccccgauaccaaaacgcuggcgcagagacuugcuauucugacaggcaccguggaggucgggacaggagccggcgccggggcugaaccucucaagaaagagagccagcccggaucuggcgccguggagauggaauccgucuga

SEQ ID NO: 65967 - RNA, 1029 nt, Artificial Sequence
  derived and/or modified sequence opt5 from AQP7__Homo_sapiens__NP_001161
auggugcaggccagcggccacagacgguccacccgcgggucuaagauggucagcugguccguuaucgcuaaaauucaagagauccugcagagaaagauggugcgggaguuccucgccgaauuuaugucuacauacgugaugauggucuucggacugggcagcguggcgcauaugguucuuaacaaaaaguauggguccuaccugggagugaaucucggcuuuggguucggagucacgaugggcgugcacguugcuggccgcauuucuggggcccauaugaacgccgcugugaccuuugccaauugcgcucugggaagaguccccuggcggaaauuccccguguaugugcuuggccaguuucuggggagcuuccucgccgcggccacaaucuacucccuguuuuauaccgcuauucugcacuucagcggaggccagcucauggucacagggccgguugccaccgcuggaaucuuugccacauaccugcccgaccauaugacccuuuggcgcggcuuccugaacgaagcguggcucacgggcaugcugcaacuuugucuguuugccaucaccgaucaggagaauaacccugcucuccccgggacagaagcccuggugauuggaauccugguggucauuaucggcgugucucucgggaugaauaccggauaugcuauuaacccuuccagagaccugcccccucggaucuucacauucauugccggcugggggaagcagguuuuuagcaauggagagaacugguggugggugccggucguggcuccccuucugggcgccuaccucggcgggaucaucuaccugguuuucauuggaucuaccaucccucgcgagccccuuaagcuggaagauuccguggcguaugaggaccacggcauuacgguccucccuaaaauggggagccacgaacccacaaucucuccgcugaccccuguguccgucagccccgccaauagauccucugugcauccugcuccuccccugcacgagagcauggcccucgagcauuuuuga

SEQ ID NO: 65968 - RNA, 786 nt, Artificial Sequence
  derived and/or modified sequence opt5 from AQP8__Homo_sapiens__NP_001160
augagcggcgagaucgccaugugcgaacccgaguucgggaacgacaaggcuagagaaccuuccgugggaggccgguggcgcgucucuugguacgagagauuuguucagccgugucugguggaacuccuggggagcgcccuuuucauuuuuaucggaugccuguccgugauugagaauggcaccgauacagggcuccugcaacccgcgcuugcucacggacuggcccucggccuggucaucgccacgcugggcaacauuucugggggacauuucaauccugcugugagccucgccgcuaugcugaucggcgggcuuaaccugguuaugcuccugcccuauugggugucccagcuucugggaggcaugcucggggccgcgcuggccaaagcugucucuccugaggaacgguuuuggaaugccagcggagcugccuucgugaccguucaggagcagggccaaguggcgggcgcccuggucgcugaaaucauucucacaacccugcuugcccuggcuguguguaugggggccaucaacgagaagacaaaaggaccccucgccccuuuuuccauuggcuucgcugugaccgucgacauccuggccgggggaccgguuagcggcgggugcaugaaucccgcgcgcgcuuuuggaccugccgugguggccaaccacuggaauuuccauuggauuuacuggcuuggcccccugcucgcuggccugcuggucgggcuccugaucagauguuuuauuggagauggcaagacacggcuuauccugaaagcccgcuga

SEQ ID NO: 65969 - RNA, 888 nt, Artificial Sequence
  derived and/or modified sequence opt5 from AQP9__Homo_sapiens__NP_066190
augcagcccgagggcgccgaaaaggggaaauccuucaagcaaagacuggugcucaaauccucucuggcuaaggagacccuuagcgaauuucugggaacauucauccucauuguccugggcugcggguguguugcccaggcgauccuuucccggggacgcuuuggcggggugauuacgaucaacgugggauucucuauggcugucgccauggccauuuacguggcuggcggcguuagcgggggacacaucaauccugccgugucccuggcuaugugccucuuuggcagaaugaaaugguucaagcugccguuuuaugucggggcccaguuccugggagcguuugugggcgccgcuaccguuuucgggaucuacuaugacggacucaugucuuuugccggcggcaagcugcuuauugugggggagaacgcuacagcccauaucuucgcgaccuaccccgccccuuaucugagccucgcuaaugccuuugcugaucaggucguggccacaaugauucugcuuaucauuguguucgccaucuucgacucccggaaccugggagcuccccgcggccucgaaccuauugcgaucgggcugcugaucauugucaucgccagcucucucggacugaauagcggcugugcuaugaaccccgccagagaucuuagcccucggcuguuuaccgcccucgcuggguggggauucgagguuuuucgcgccggcaauaacuucugguggauuccgguggugggcccccuggucggggcggugaucggaggccuuauuuacguucuggugaucgagauccaccauccugaacccgacucugucuuuaaaacagagcaauccgaagauaagccugagaaauaugagcucagcgugauuauguga

SEQ ID NO: 65970 - RNA, 561 nt, Artificial Sequence
  derived and/or modified sequence opt5 from ARAF__Homo_sapiens__NP_001243126
auggagcccccuagaggcccgcccgccaacggggcugaaccuagccgggccgugggaaccgucaagguuuaccugcccaauaaacagcgcacaguggugacggucagagacggcauguccguguaugauucucucgacaaggcgcugaaaguucgggggcuuaaccaagauugcuguguggucuaccgccugaucaagggaagaaaaaccgugacagcuugggacaccgccauugccccucucgauggcgaggaacugaucguugaggugcuugaagacgucccccugacaaugcacaauuucgugcggaagaccuuuuucagccucgcuuuuugcgauuucugucugaaguuucuguuccauggguuucgcugccagacauguggauauaaauuccaccagcauugcuccucuaaggugccuaccgucuguguugacaugagcacgaacagacagcaauuuuaccacuccgugcaggaucucucuggcggcagccggcagcaugaggccccguccaaucgcccccugaacgagcuucugaccccucaggggcccagauga

SEQ ID NO: 65971 - RNA, 4353 nt, Artificial Sequence
  derived and/or modified sequence opt5 from ARAP1__Homo_sapiens__NP_001035207
auggccgaggcuggcgacgccgcgcugagcguggcugaauggcucagagcccugcaccuugagcaguacaccgggcuguucgaacaacauggacucgucugggccacagagugccagggccuguccgauacgcggcuuauggacauggggaugcugcuccccggacaccgcagacggauccuggcuggccugcuccgcgcccauaccucuccugcuccggcccccagaccuacaccccggccuguucccaugaagcgccacauuuuuagaagcccuccggugcccgcgaccccucccgaaccucugcccacaaccacagaggaugaggggcuuccggccgcuccucccaucccuccccggcgcuccugucugcccccuaccugcuucacgaccccgucuacagccgcucccgacccugugcugcccccucuccccgccaaaagacaucuugcggaacugagcgucccgccugugcccccucggaccggacccccucgccuccugguuucccugcccacaaaggaggaagagucucuccugccgagccuuuccagcccuccccagccccagucugaggaaccucuguccacccucccgcaagggcccccucagcccccuucucccccucccuguccgccugagauucccccuaaacccgugagacuguuuccggaguucgaugacagcgauuaugacgaagucccugaagagggccccggcgccccugcucgggugaugacgaagaaagaggaacccccucccucccgcguuccgagagccgugcgggucgcuagccuucugucugagggagaggaacucuccggcgaugaccagggggaugaagaggaggacgaucacgccuacgaaggagugcccaacggcggguggcacacaagcucccugucucugagccucccuuccaccaucgccgcuccccauccuauggacggacccccuggcggcagcacaccggugacccccgucauuaaggcgggguggcuggacaagaauccuccccagggaucuuauaucuaccagaaaagauggguucgccuugauaccgaccaucugcgguauuuugauuccaacaaggacgccuacagcaaaagauucaucucuguggcuugcauuagccacguggccgccaucggcgaucaaaaguuugaggucauuacaaauaaccgcacguucgcuuuucgggccgaauccgacguggagagaaaagaauggaugcaggcgcuccagcaagcuauggccgagcagcgcgcccgggcuagacugucuagcgccuaucuucuggggguuccuggauccgagcagcccgaucgcgcuggcagccucgaacugcggggguucaagaauaagcuguacguggccgucgugggagacaaaguucaacucuacaagaaccuggaggaauaucaccuuggcaucggcauuaccuuuaucgauaugucuguggggaaugucaaagagguggacagacgcuccuucgaucugacaaccccguaccggauuuuuagcuucucugcggacuccgagcucgaaaaggagcaguggcuggaagccaugcagggagcuaucgccgaggcucugagcacauccgaagucgccgagagaaucugggcggccgcuccuaaccgguucugugccgacugcggcgcuccccagcccgauugggccucuauuaaucuuugugugguuaucugcaaacgcugugccggggagcacagaggacucggcgcuggggugagcaagguccggucccugaaaauggacagaaagguguggaccgaaacgcugauugagcucuuucugcaacuuggcaacggagcgggcaaucgcuucugggccgcuaacguuccucccucugaagcccugcagccuagcuccagcccgucuacacggagaugccaucucgaggccaaguaucgcgaagggaaauacagacgguaucacccccuguuuggaaaucaggaggagcuggauaaggcucuuugugccgcggugaccaccacagaccucgcugaaacccaggcccugcugggcugcggggccggaaucaacugcuucuccggcgauccugaggcucccacaccucucgcccuggcggaacaagcugggcagacgcuucagauggaguuucugcgcaauaacagaaccacagaagucccccggcucgacagcaugaaaccgcuggagaagcauuacucuguggugcugccuaccguuucccacagcggcuuccuuuauaaaacagccucugccggaaagcuccugcaggaucgcagagcucgggaggaauuuagccgcagaugguguguccugggcgacggggugcucuccuacuucgagaacgaacgggccgugacccccaauggagagauucgcgcuagcgagaucgucugccuggccgugccucccccugauacgcauggcuuugaacacaccuucgagguuuacacagaaggggagagacuuuaucuguuuggacucgaaucugcggagcaagcccacgagugggugaaguguaucgcuaaagccuucgugcccccgcuggcugaagaccugcuugcccgggauuuugagagacucggccgccugccuuacaaggccgggcugucccuccagcgggcucaggaaggcugguucagccuguccggaucugagcuuagagcggucuuccccgaaggccccugcgaggagccucugcagcuccgcaaacugcaagaacugagcauucagggggacuccgagaaccagguucuugugcuggucgaacggagacgcacccucuauauccaaggagagcggagacuggauuuuaugggcuggcucggggccauucagaaggcugccgccucuaugggagacacacugagcgaacagcagcuuggcgacuccgauaucccggugauuguuuaccgcuguguggacuauaucacccaaugcgggcugacgucugagggcaucuaccggaaauguggacagacaagcaagacccagagacuccuggagucccugcggcaggaugcucgcagcguccaucuuaaggaaggcgagcaacacguggacgaugugucuuccgcccugaaaagauuccuccgggaccugcccgaugggcucuuuacacgcgcgcagagacugaccuggcuugaagcuagcgagauugaggacgaagaggaaaaggucucucgguauagagagcugcucguucgccugccucccgugaaucgggccaccgugaaagcccugaucucccaucuuuacugcguccaguguuucagcgauacaaaccagaugaaugugcacaaccuggcuauuguuuuuggaccuacccucuuccaaacggacggccaggauuacaaggccgggagaguggucgaagaccugaucaaucacuaugugguuguguuuucugucgaugaggaggaacuccgcaaacagcgggaggaaauuacagcgaucgugaagaugagaguugcuggaaccgccuccggcacacaacaugccggcgacuucauuugcaccguguaccuggaggaaaagaaagcugagacggagcagcacaucaagguccccgccagcaugacagcugaggaacuuacccuggaaauccuggaccgccggaacguggggauuagagagaaagauuauuggaccuguuuugaagugaaugagcgcgaggaagccgagagaccucuccauuucgcggaaaagguccugccgauccuucacggacugggcacagacucccaucucguugugaaaaagcaccaggccauggaggcuaugcugcucuaccuggccagccgggugggggauaccaaacacggaaugaugaaguuucgcgaggacagaucucuucugggccuggggcuccccagcggaggcuuccaugaucgguauuuuauucugaacuccucuugccuucgccuguacaaggaagucagaagccagcggccuugguccggcgcucccgagacaucucacagaccugaaaaagaguggcccaucaagagccucaaaguguaucuggggguuaagaaaaagcuccgcccgccuacgugcuggggauucaccgugguccaugaaacagagaagcacgagaaacaacagugguaccuguguugcgacacccagauggaacuucgggagugguucgccacauuucuguucgugcagcaugauggccugguuuggcccuccgaacccucuagagugagccgcgccgucccugaggugcggcucggguccgucagccugauuccccuuagaggaucugaaaaugagaugcggcgcuccguggcugcguuuaccgccgacccucugagccuccugagaaacguuuga

SEQ ID NO: 65972 - RNA, 4635 nt, Artificial Sequence
  derived and/or modified sequence opt5 from ARAP3__Homo_sapiens__NP_071926
auggccgcuccccaggaccuggauaucgccguguggcucgcgaccguccaccuggagcaauacgcugacacauucagacggcauggccuugccacggccggggcugcccgcggacugggccacgaggagcucaagcagcuggggauuagcgcuaccggacauagaaaacggauccuucgccugcuccagacaggcaccgaagaggggucccuggauccuaagucugacagcgccauggaaccgucccccucuccugcgccccaggcccaaccucccaaaccuguuccgaagcccagaacaguguuuggaggccugagcggcccugcuaccacacagcggcccgggcucuccccugcccugggaggccccggggugucucgcagcccggagccuucccccagaccuccgccccuuccuaccucuagcuccgagcagagcucugcucugaacacggucgaaaugaugcccaauuccauuuauuucggacucgauagccggggccgcgcccaggcggcccaagacaaagcucccgauucuucccagaucagcgccccuacccccgcucugagaccuacaaccgggacagugcacauuauggaccccggaugccuuuacuauggcguucagccggugggcaccccuggggcccccgaucggcgcgaguccagaggagucugucagggccgggccgaacaucgccugucuagacaagaccucgaggcucgggaggaugcgggguacgccagccuggaacugccuggagacuccacgcuccugagccccacacuugagaccgaagagacaucugaugaccugaucuccccuuaugcuagcuuuucuuucaccgccgacagacucacaccccugcuuagcggcuggcuggauaagcucuccccgcaggggaacuacguguuucagcgccgguucguucaauuuaauggaagaucucugauguauuucggcagcgacaaggauccuuuucccaaaggcgugaucccccugaccgccauugaaaugacgcgcuccagcaaggacaacaaauuccaggucaucaccgggcagcggguguuuguguucagaacagagucugaggcucagcgcgauauguggugcuccacccuccaaagcugucugaaggaacagcggcuucugggacacccuagaccgccccagccuccccgcccucuccggacaggcaugcuggagcuuagagggcacaaagccaaggucuuugcggcucugucucccggagaacucgcccuguacaaguccgagcaggccuucagccugggcauugggaucugcuucauugaacuccaaggcuguuccguucgcgagaccaaaucucggagcuuugaccugcuuacgccucauagaugcuucuccuuuacagcugagucuggaggcgcccggcagagcugggcugccgcgcugcaggaagccgugaccgagacccucuccgauuacgaaguggcugagaagaucuggagcaaucgcgccaacagacagugugcugacugcgggucuucccggcccgauugggccgcggucaaucugggagugguuauuuguaaacaaugcgccggccagcacagagcucuggggagcggaaucucuaaggugcagucccuuaaacucgacacaagcgucuggucuaacgaaaucgugcagcuguucauuguucugggcaaugaucgcgccaaccgguuuugggcugggacccucccgccuggcgagggacugcaucccgacgccacaccuggccccagaggggaguucaucagccgcaaguauagacuuggacuguuucggaaaccgcacccucaauaccccgaccacucccagcuccugcaggcccugugugcugcgguggcccgcccuaaucuucucaagaacaugacgcaacugcugugcgucgaggcuuucgaaggcgaggaacccugguuucccccugccccggaugggagcugccccggacuccugccuucugaccccuccccuggcguguauaaugaggucgugguuagagccaccuacagcggguuccuuuauuguucccccgugucuaacaaggcuggcccuagcccgccccggcgcggaagagaugccccuccccggcuguggugcguccucggcgcggcucuggaaauguuugccuccgaaaauucuccugaaccccugagccuuauucagccgcaggacaucgugugucucgggguuuccccuccucccacagaucccggagaccgcuuccccuuuucuuucgagcugauucuggccggcgggagaauccagcauuucggaaccgauggcgcugacagccucgaagccuggacauccgcgguggggaaaugguuuagcccucugucuugccaccaacuucugggcccgggacuccugcggcugggccgccuuuggcucagaucccccagccauaccgcuccugcccccgggcuguggcugucuggauucggccuccugagaggggaucaccuuuuucuguguuccgccccuggacccggcccgccugcucccgaggacaugguccaucuccggcgccugcaggagaucagcguggugucugccgcugauacgccugacaagaaagaacaccugguucuugucgagaccggccggacacuguaccuccagggggaaggaagacuggauuucaccgccuggaacgcggccauuggcggggcugccggaggcgggggaacaggccuccaggagcaacagaugucccgcggcgacauccccauuaucguggacgcuugcauuagcuuugugacccagcacgggcugcggcuugaaggagucuauagaaagggcggggcccgcgcccggucccugagacuccuggcugaguuccgccgggaugcgagaagcgugaaacugcggccuggagagcauuuuguugaagacgugacggauacacuuaagcgcuucuuuagagagcuggacgaucccgucaccucugcccggcuccugccgcgcuggagagaagcugccgagcucccucagaagaaccaacggcuggaaaaauacaaggacgugaucggcugucuucccagaguuaaucgccggacacuggccacccucaucgggcaccuguacagagugcagaaaugcgcugcccugaaccagauguguacccgcaaucuugcgcuccuguucgcucccagcgucuuucaaacagauggacggggcgagcaugaggugagaguucugcaggaacucauugacggcuauaucuccguguucgauauugacucugaucaggucgcccagaucgaccuggaggugagccuuauuacgaccuggaaggaugugcaacugucccaggccggggaccugaucauggaagucuacauugagcagcagcucccugacaacugcguuacacugaaagugucuccgacccuuacagcugaggaacugaccaaucaagugcucgagaugcgcggaacggccgcgggcauggaucugugggucacauuugaaauccgggagcacggggaacucgagagaccccugcacccuaaggagaaggugcuugaacaggcucugcaguggugucagcugcccgagccuugcagcgccucccuccugcuuaaaaagguuccccuggcccaagcuggaugccucuucaccggcauccgcagagaaucuccucggguggggcugcuccgcuguagagaggaaccgccccggcugcuuggaagccgcuuccaggagagauuuuuccugcugcggggcagaugccuccugcuucugaaagagaagaaauccagcaagccugaacgcgaguggccccucgaaggcgccaaggucuaucuggggauucggaaaaagcucaaaccucccaccccguggggauuuacacugauccuugagaagaugcaucuguaccugucuuguaccgacgaagaugagaugugggacuggacaacguccauucucaaagcucagcacgaugaccagcaaccugugguucugagacgccauucuagcuccgaucuugcccggcagaaguucggcaccaugccccugcuccccaucagaggggacgauagcggagcgacacugcuguccgccaaccagacccuccggcgccuucacaauagacggacacugucuauguuuuucccuaugaaaagcucccaaggcagcguggaggaacaggaggaacuggaggagcccgucuaugaggaaccuguguacgaagagguuggggcuuuuccggaacucauucaggacaccucuacguccuucagcaccacacgcgaguggaccgugaagcccgagaacccucugacaucucaaaagagccuugaucagcccuuucuguccaaaucuagcacccucggacaggaagagagaccucccgaaccgccucccggcccucccuccaagucuagcccucaggcccggggcucccuggaggaacagcugcuccaagagcuuagcucucugauccugcgcaaaggggagacaaccgcuggacucggcucccccagccagccguccucuccucagagccccucccccacggggcugccuacacagaccccgggauuccccacccaaccucccugcacaucuagcccucccuccagccagccucuuaccuga

SEQ ID NO: 65973 - RNA, 1191 nt, Artificial Sequence
  derived and/or modified sequence opt5 from ARC__Homo_sapiens__NP_056008
auggagcuggaccacagaaccagcggcgggcuccaugccuaccccggaccucggggcggacagguggcuaagccgaacgucauccugcaaauugggaaaugccgcgccgaaaugcuugagcacguuagacggacacaucgccaucugcucgcggaaguguccaaacagguggagagagaacugaagggccuucaccggucugucgggaagcuggagagcaaucucgauggauaugugcccacguccgacucucagcgcuggaaaaagagcaucaaggcuugucugugcagaugucaggagaccauugccaaccuggaacgguggguuaaacgcgagaugcacguguggagagaagucuucuaccggcucgagcgcugggccgauagacuggaguccacaggcggcaaguauccuguggggucugaaagcgcucggcacaccguuuccgugggagucggcgggcccgagagcuacugccaugaagccgacggauaugauuacacagugucuccuuaugcuaucacacccccuccggccgcgggcgagcuucccgggcaagaaccugccgaggcucagcaguaccagcccugggugccuggagaggacggccaacccuccccgggcgucgauacacagauuuuugaagacccucgcgaguuccugagccaccucgaagaguaccugagacagguugggggaucugaagaguauuggcuuucccagauccaaaaucauaugaacggccccgccaaaaaguggugggaguuuaaacaggggagcgugaagaauuggguggaguucaagaaagaauuucugcaguacucugaaggaacccucucccgggaggcuauccaaagagaacuggaucugccucagaagcagggcgagccccucgaccaguuccuguggcgcaaacgggaucuuuaucaaacgcuguacgucgacgccgaugaggaagagauuauccaguaugugguugggacccuccagcccaagcugaaaagauuucuucgccacccucugccgaagacacucgaacagcugauucaacggggaauggaggugcaggacgaccuggagcaggcggccgaacccgcuggcccucaccuccccgucgaggaugaagccgagacccugaccccugcucccaacagcgaauccguggccucugacagaacccagccggaguga

SEQ ID NO: 65974 - RNA, 1272 nt, Artificial Sequence
  derived and/or modified sequence opt5 from ARCN1__Homo_sapiens__NP_001135753
augauccccgaguacugcagagcccuggaagagaacgaaauuagcgagcacuguuucgaccucaucuuugcuuucgaugaaauuguggcccugggcuaucgggagaaugucaaccuugcgcagauccgcaccuuuacagagauggacucccaugaagagaagguuuucagagcugugcgggaaacgcaagagcgcgaggccaaagccgaaaugagacggaaggcuaaagagcugcagcaggcccgcagagaugcugaacggcaggggaagaaagccccuggauuuggcggguucggaucuagcgcgguguccggcgggucuaccgccgcuaugauuacagagaccaucaucgaaacagacaagccgaaggucgcccccgcuccugcccgccccagcggaccuuccaaagcgcucaagcugggcgccaaaggcaaggagguggauaauuuuguugacaaacuuaagucugagggggaaaccauuaugagcuccagcaugggaaagagaacaucugaggcuaccaaaaugcacgcucccccuaucaacauggaauccgugcauaugaagauugaggagaaaaucacgcugaccugcggccgggaugggggacuccaaaauauggaacugcacggcaugauuaugcugcgcaucagcgacgauaaguacgggcggauuagacuccaugucgagaacgaagacaaaaagggagugcagcugcagacacacccgaauguugauaaaaagcuguucaccgccgagucucuuaucggccucaagaaccccgaaaaauccuuuccugugaauagcgacgucggcgugcugaaguggcgccuucagacaaccgaggaaucuuucaucccccugacgauuaacuguuggccuuccgagagcgggaauggaugcgaugugaacaucgaguaugaacuccaagaggacaaucuggaacugaacgacgucguuauuacaaucccccucccguccggcgugggggccccugugauuggagagaucgauggcgaguacagacacgacucucggagaaauacccuggaauggugucuucccgucaucgaugccaaaaacaagagcgggucccuggaguuuagcauugcuggacagccuaacgacuucuuucccgugcagguuucuuucguguccaaaaagaauuauugcaacauccaggucacaaaggugacccaaguugauggcaauagccccgugcgcuucucuaccgaaacaacguuucucgucgacaaauacgagauucuguga

SEQ ID NO: 65975 - RNA, 759 nt, Artificial Sequence
  derived and/or modified sequence opt5 from AREG__Homo_sapiens__NP_001648
augagagcuccccugcucccuccggcccccgugguccugagccuucugauccucggcuccgggcacuacgccgcgggacuggaccuuaacgauaccuauucuggcaagcgggagccuuucagcggggaccauuccgcugauggauuugaaguuacaucucgcagcgagauguccucuggcagcgaaauuucccccgugagcgagaugccuucuuccagcgaacccucuuccggggccgacuacgauuauagcgaggaguacgacaaugaaccucagaucccgggauauauuguggaugacucugucagaguggagcaaguugugaaacccccucagaacaagacggaauccgagaauaccagcgauaaacccaagcggaaaaagaagggcggcaaaaacgggaagaaucgcagaaaccggaaaaagaaaaauccuugcaacgccgaguuccagaauuuuuguauccacggagaaugcaaguacauugagcaucuggaagcugucacauguaagugccagcaagaguauuucggcgaacgcuguggggagaaauccaugaagacccacucuaugaucgacagcucccucagcaaaaucgcccuggcugccauugcggccuuuaugucugcugugauccugacagccguugcugugauuaccguccagcucagacggcaguacgugcgcaaguacgagggagaagccgaggaacggaaaaagcugagacaggagaacggcaaugugcaugcgaucgccuga

SEQ ID NO: 65976 - RNA, 546 nt, Artificial Sequence
  derived and/or modified sequence opt5 from ARF1__Homo_sapiens__NP_001019398
augggcaacaucuucgccaaucuguuuaagggacucuucgggaaaaaggagaugcggauucugauggugggccuugacgcugccgggaaaaccacaauccuguacaagcucaaacugggagaaauugucacgaccauccccacaauuggcuuuaacguugagaccguggaauauaagaauaucagcuucacagugugggaugucgggggacaggacaagaucagaccucuuuggcgccacuacuuucaaaacacccagggccugauuuucgugguugauuccaaugacagagagcgggugaacgaagcgcgcgaggagcucaugagaaugcuggcugaagaugagcugcgggacgccguccuccugguguuugccaauaaacaggaucuuccgaacgcuaugaaugccgcugaaaucacagacaagcugggccuccauucucugcgccacagaaacugguauauucaggcgaccugcgccacgagcggggauggacuuuacgagggccuggacuggcucuccaaucaacugcggaaccagaaauga

SEQ ID NO: 65977 - RNA, 546 nt, Artificial Sequence
  derived and/or modified sequence opt5 from ARF3__Homo_sapiens__NP_001650
augggcaacaucuucgggaaucugcucaagagccugauuggcaaaaaggagaugagaauccuuauggugggacuggacgccgcugggaaaaccacaauucucuacaagcugaaacuuggagaaaucgucacgaccauucccacaaucggcuuuaacguugagaccguggaauauaagaauaucuccuucacagugugggaugucgggggacaggacaagauucggccucuguggcgccacuacuuucaaaacacccagggccucaucuucgugguugauucuaaugacagagagcgggugaacgaagcccgcgaggagcugaugagaaugcuggcggaagaugagcuccgggacgcuguccugcuuguguuugccaauaaacaggaucugccgaacgccaugaaugcugccgaaauuacagacaagcucggccugcauagccuucgccacagaaacugguauauccaggcuaccugcgccacguccggggauggacuguacgagggccucgacuggcuggcgaaucaacugaaaaacaagaaauga

SEQ ID NO: 65978 - RNA, 543 nt, Artificial Sequence
  derived and/or modified sequence opt5 from ARF4__Homo_sapiens__NP_001651
augggccugaccaucagcucccucuucucuagacuguuugggaagaaacagaugcggauucuuauggugggacuggacgccgcuggcaagacaacgauccucuacaaacugaagcugggggagauugucaccacaauccccaccauuggauucaacguugaaacaguggaguauaaaaauaucugcuuuaccgugugggaugucggcgggcaagaccgcaucagaccucuguggaagcacuacuuccagaacacacagggacucauuuuugugguugauagcaaugaccgggaacgcauccaggagguggccgaugaacugcaaaagaugcugcucgucgacgagcugagagaugcggugcuucuucucuucgcuaacaaacaggaccugccgaaugccauggccauuuccgagaugaccgauaaacuuggccugcagucucuccggaaccgcacgugguauguucaggcuaccugugccacacaaggcaccgggcuguacgaaggacuggacuggcucagcaaugagcuguccaagagauga

SEQ ID NO: 65979 - RNA, 528 nt, Artificial Sequence
  derived and/or modified sequence opt5 from ARF6__Homo_sapiens__NP_001654
augggcaaggugcugagcaaaaucuucgggaacaaggagaugcggauucucaugcugggacuugacgccgcuggcaaaaccacaauccuguacaagcucaaacuggggcaguccgucacgaccauucccacaguuggauuuaauguggaaaccgugacauauaagaacgucaaguucaaugugugggauguuggcgggcaagacaaaaucagaccucuuuggcgccacuacuauaccggaacacagggccugauuuuuguggucgauugcgccgacagagaucggaucgacgaggcgcgccaggaacuccauagaaucauuaacgaucgggagaugcgcgacgcuaucauucugaucuucgccaauaagcaggaucugccggacgccaugaaaccccacgaaauucaagagaagcucggccugaccagaauccgggaucgcaacugguacgugcagccuucuugugcuacgagcggggacggacuuuaugagggccugaccuggcucacauccaauuacaaaucuuga

SEQ ID NO: 65980 - RNA, 1212 nt, Artificial Sequence
  derived and/or modified sequence opt5 from ARFGAP1__Homo_sapiens__NP_001268411
auggccagccccagaacccggaaggugcugaaagagguccgcguucaggacgaaaacaaugugugcuucgaguguggcgcuuuuaacccucaauggguguccgucacauacgggaucuggauuugccucgaauguucuggaagacaccggggccugggggugcaucuuagcuucguucgcuccgugacgauggauaaguggaaagacaucgagcuggaaaagaugaaagccggaggcaaugcgaaguuuagagaguuccucgagucucaggaagauuaugacccgugcuggagccugcaggagaaguacaacucccgggcugccgcccuuuuucgcgauaaagucguggcucuggccgaagggagagaguggucucucgagagcucccccgcucagaauuggaccccuccccaaccucggacacugcccagcaugguucaccgcgugucuggacagccucaguccgucaccgccagcucugacaaggcguucgaagauuggcugaacgacgaucucggcuccuaucagggcgcccaagggaauagauacgugggauuuggcaacacaccgcccccucagaaaaaggaggacgauuuccugaauaacgcuaugagcucucuuuauuccggguggagcuccuuuaccacaggagccucucgguucgcuagcgccgcgaaagaaggcgccaccaaguuugggucccaggcuagccagaaggccucugagcugggacauucccucaaugaaaacgugcugaaacccgcucaagagaaggucaaagagggcaagauuuucgacgauguuagcucuggcgugagccagcuugccuccaaaugucagcgcagacugugcugucaccaaucucauugcagcgccgggcaccucggacgggcuuuuuguccuguguccuggcacgaagcgcugugcggccagacggggcgcgaggaacaggccagccugcugcccccgaagcaugucgugggagcucucgagguuugugccagaggcugcccucggugccacgugccccauaccccugggacagccgcugaauggcccggaagacuuugucugucucgcgaguccgucgugcgggacggcggcaccucucccccuuucuucagagggaaacagcgcgccccguggacagcgccccggagagcuaccguuauccgcacggccguguggacaaccagcaagacagccaccuga

SEQ ID NO: 65981 - RNA, 1482 nt, Artificial Sequence
  derived and/or modified sequence opt5 from ARFGAP2__Homo_sapiens__NP_001229761
auggccgcugagcccaacaagaccgaaauccagacacuguucaaaagacuccgggccgugccuacgaauaaggcgugcuuugacuguggcgcuaaaaacccgagcugggccuccauuaccuacggggucuuccugugcaucgauuguucuggaguucaccgcagccuuggcgugcaucuguccuuuauuagaucuacagagcucgacagcaauuggaacugguuccaacugcggugcaugcaggucgggggaaaugccaacgcuaccgccuuuuuccgccagcacggcuguacagcuaaugaugccaacaccaaguauaauuccagagcggcccagauguaccgggagaaaauccgccaacuugggucugcugcccuggcuagacauggaacagaucccccugccugggacgcgcccgccaccgaaccuagcggcacgcagcagcccgcuccuuccaccgaaagcucuggccucgcccagccggagcacgggcccaacacagaccugcugggaaccuccccuaaggcuagccucgagcugaagucuuccauuaucggcaaaaagaaacccgccgccgcuaagaaagggcuuggagcgaagaagggccugggggcccaaaaagugagcucucaguccuuuagcgaaaucgagcggcaggcucagguggccgaaaagcuccgcgagcaacaggccgcugaugccaaaaagcaggcggaggaauccaugguugcuucuaugagacuggccuaucaagagcuucagauugaccggaaaaaggaagagaaaaagcugcagaaucucgaaggaaagaaacgcgagcaggccgagagacugggcaugggccuggugagccgguccagcgucucucauuccgugcucagcgaaaugcaaguuaucgagcaggaaacaccugugucugcuaagagcucccgcucucagcuggaucuuuucgacgaugucgggaccuuugccagcggacccccgaaauacaaggacaacccuuucucccugggcgagagcuuugggucuagaugggauacggacgcugccuggggaauggaccggguggaagagaaagagcccgaagugacaauuuccagcaucagaccuauuucugagcgcgcgaccaaucggagagaagucgagucccgcagcuccggccucgaaucuagcgaggcccggcagaaguucgcuggggccaaggcuaucuccucugauauguuuuucggaagagagguugacgccgaauaugaggcgcgcagccggcugcaacagcuuuccggcagcucugccauuuccagcucugaucuguucggcgacauggauggggcucacggagccggcuccgugagccucgggaacgugcugcccacagcugacaucgcccaguuuaaacagggagucaagucuguggccggcaaaauggcuguucuggcgaauggggugaugaacagccuccaagauagauacggcuccuauuga

SEQ ID NO: 65982 - RNA, 1419 nt, Artificial Sequence
  derived and/or modified sequence opt5 from ARFGAP3__Homo_sapiens__NP_001135765
augggcgaccccagcaagcaggauauccugaccauuuucaaaagacuccgguccgugccuacaaacaaggucugcuuugacuguggggccaaaaauccgucuugggcuagcaucacguacggaguuuuccugugcauugauuguuccggcucucaccgcagccuuggggugcaucuguccuuuaucagaucuaccgagcucgacagcaacugguccugguuccaacugcggugcaugcaagugggaggcaaugccagcgcgcuuuggcuggauucuugugucgugcccccucucucucccccucccaaggaagaggacuuuuucgcuagccacguuucuccugaaguguccgauacagccugggccagcgcuauugccgagccgucuucccugaccagccgccccgucgaaacaacccuggagaacaaugaagggggacaggagcagggcccuuccguggagggccucaacguucccacaaaagcuacccuggaagugucuagcaucaucaagaagaaaccuaaucaagccaagaaagggcuuggagcgaagaaaggcucccugggggcccagaagcucgcuaacacgugcuuuaaugagauugagaagcaggcccaggcugccgacaaaaugaaggaacaagaggaucuggcgaaagucgugagcaaggaagagucuaucguguccagccuuagacuggccuauaaagaccucgaaauucagaugaagaaagaugagaagaugaacaucucuggaaagaaaaaugucgacagcgaucggcugggcaugggguucggaaacugucgcuccguuauuucucauagcgugaccuccgacaugcagacaaucgagcaggaaagccccauuauggcuaagccgcggaaaaaguacaaugacgauucugacgauuccuauuuuaccagcuccuccagcuacuucgacgagccuguggaacugagauccucuagcuuuuccucuugggaugacagcuccgauagcuauuggaaaaaggagacaucuaaggacaccgaaacgguccucaaaacaaccggcuacuccgaucgccccacagccagacggaagccugacuaugagcccguggagaacaccgaugaagcucagaaaaaguucggcaauguuaaagccaucagcucugacauguacuuugggcgccagucccaggccgacuacgagaccagagcucggcuggaacgccuuagcgcgucuagcuccaucagcucugccgaucuguucgaggaacccagaaagcaaccugcuggaaacuauucccucagcuccgugcugccgaacgcccccgacauggcccaguucaagcagggcguccggucuguggcugggaaacuuagcguuuuugccaauggaguggucacauccauucaggauagauacggcucuuga

SEQ ID NO: 65983 - RNA, 5550 nt, Artificial Sequence
  derived and/or modified sequence opt5 from ARFGEF1__Homo_sapiens__NP_006412
auguacgaaggcaagaaaaccaagaacauguuccugacaagagcccucgagaaaauccuggcugacaaggaagugaaaaaggcccaccacagccaacuucggaaggcgugcgaaguggcucuggaggaaauuaaagccgagacggagaagcaaucucccccucacggggaagccaaagcuggauccagcacccucccgcccguuaaguccaaaacaaauuuuaucgaggccgauaaguauuuccugccuuuugaacuugcuugucagucuaagugcccccgcauugugagcaccucccuggacugucuccagaaacugaucgccuacggccaucugacagggaacgccccugauucuaccacacccggaaagaaacucauugacagaaucaucgagaccauuugcggcuguuuccaggggccucaaacggaugagggagugcagcugcagaucauuaaggcccuucugaccgcugucacaagccagcacaucgaaauucaugagggcaccgugcuccaagccguucggacaugcuauaauaucuaccuggcuuccaaaaaccuuauuaaucagaccacggccaaggcgacacugacccagaugcucaacgugaucuuugcccgcauggaaaaucaggcucugcaagaggccaaacagauggaaaaggagagacaccggcagcaccaucaucugcuccaaagcccggucucucaucacgagcccgaauccccucagcugcgcuaucuucccccucagacaguggaccacaucagccaggagcaugaaggcgaucuggaccuccacaccaacgauguugacaagucucugcaagaugacaccgagcccgaaaauggguccgauauuagcucugcugagaacgagcagacagaagccgaccaggccacggcugcggagacccuuuccaaaaaugaagugcuguacgacggagagaaccaugauugugaagagaagccgcaggacaucguccaaaauauuguggaggaaauggugaacaucgucguuggcgauaugggggagggaacaaccauuaaugccagcgcugacggcaacaucgggacaaucgaagauggauccgacucugagaacauucaggccaauggcaucccuggcacccccauuagcguggccuauacgccuucccuccccgaugacagacugagcgugucuuccaacgauacacaggagagcggaaauucuagcggacccuccccuggcgcuaaauucucucacauccugcagaaggacgccuuucucgucuuccggagccugugcaaacuuuccaugaagccgcugagcgaugggcccccugaccccaagucucaugaacuccgcuccaaaauucugagccuucaacugcuccugucuauccugcagaacgcgggaccuaucuuuagaaccaaugagauguucauuaacgcuaucaagcaguaccucuguguggcccuguccaaaaauggcguuagcuccgugcccgaagucuuugagcuuucucugagcauuuuccucacccugcuguccaacuuuaagacacaccuuaaaaugcagaucgaaguguucuucaaggagauuuuucucuacauccuggagaccucuacaagcuccuucgaccacaaguggaugguuauucaaacgcugacccggaucugcgccgaugcucagagcguggucgacaucuaugugaauuacgauugugaccucaacgccgcuaauauuuuugaacgccuggucaacgaucuuucuaaaaucgcccaggggagaggaucccaagagcugggcaugagcaaugugcaggaacucucucugcggaagaaaggccuggagugccuuguuuccauucucaagugcaugguggaauggagcaaagaccaguaugucaaccccaauucucagacaacccuggggcaagagaagccuagcgagcaggaaauguccgagaucaagcaucccgaaacaauuaaccgcuacggaagccugaacucucucgaguccaccagcuccucuggcaucgggagcuauuccacgcagaugucuggaaccgauaauccugaacaguucgaggugcugaaacaacagaaggagaucauugaacagggcaucgaccuuuuuaacaaaaagcccaaaagagggauucaguaccugcaagagcagggcaugcucggaacaaccccugaagauaucgcgcaguuccugcaccaagaggagcggcuggacagcacacagguuggcgaauuucuuggggauaaugacaaguucaacaaagaggugauguaugccuacgucgaucagcaugacuuuuccggaaaggacuucgugucugcucucagaauguuucuggaaggcuuccgccugcccggggaggcccagaagauugaucggcucauggaaaaauuugcugccagauaccuggaguguaaucaaggacagacccuuuucgcgagcgccgacacggcuuaugugcuggccuacuccaucaucaugcucacaaccgaucugcacagcccgcagguuaagaacaaaaugacaaaggagcaguauauuaaaaugaaucgcggcaucaacgacucuaaggaucugccugaagaguaccuuuccgcuauuuauaaugaaaucgccgggaagaaaauuagcaugaaggagaccaaagaacucaccauccccacaaagucuuccaaacaaaacgucgccagcgagaagcagcggagacugcuguacaaucucgagauggaacagauggcuaagacggcgaaagcccugauggaggcugugucucacgugcaggcccccuucaccuccgccacacaucuugaacacguccgcccuauguuuaagcuggcuuggaccccguuccucgccgcguuuagcgugggccugcaagacugcgaugacacagagguugcuucccugugucuugaaggaauccggugcgccauuagaaucgccuguauuuucagcauccagcuggagcgcgaugcuuaugugcaggcccucgcgcgguuuacccugcucacggucucuagcggcauuacagagaugaaacagaagaacaucgacaccauuaaaacccugaucacaguggcucauaccgaugggaauuaccuuggaaacuccuggcacgaaauccugaagugcauuucucaacucgagcuggcccagcugaucggcacagggguuaagcccagauacauuagcggaacggugcgcggccgggaagggucccuuaccggcacaaaagaccaggccccugaugaguucgucggacugggccucgucggcgggaauguugacuggaagcaaaucgcuucuauucaggagagcaucggggaaaccuccucucagagcguggucguggccguggacagaaucuuuacaggguccacccggcuggauggaaacgcuauugucgacuucguucgcuggcucugugccgugagcauggaugagcugcuuucuacgacccaucccagaauguuuucccugcagaaaaucguggaaauuagcuauuacaacaugggccggaucagacuccaauggucucgcauuugggaggucaucggggaccacuucaauaaggugggcugcaacccuaaugaagauguugcgaucuuugccguggacucccugcggcagcugagcaugaaauuccuugagaagggagagcuggcuaacuuuagauuccagaaagauuuccuccgccccuuugaacacauuaugaagagaaaucgguccccuacaauccgcgacauggucgugagauguauugcccagaugguuaacucucaagcugccaauauccggagcggcuggaagaacauuuucuccguguuucaucuggccgcuagcgaucaggacgagucuaucgucgaacucgcguuccagaccacagggcacauugugacccugguuuuugagaaacauuuccccgccacaaucgauuccuuucaggacgcugugaagugccuuagcgaguucgccuguaaugccgcuuuuccggacaccucuauggaggccauccgccugauuagacacugcgcgaaauaugucagcgaucggccucaggcuuucaaggaguacacguccgacgauaugaacguggcccccgaagaccgcgugugggucagaggaugguuuccuauccuguucgagcucucuugcauuaucaaucgguguaaacuggauguucgcacaagaggccuuaccgugauguucgaaauuaugaagaccuaugggcauacauacgagaagcacugguggcaggaccuguuucggaucguguucagaaucuuugauaacaugaaacuccccgaacagcaaaccgagaaggccgaguggaugacgacaaccugcaaucacgcucuguaugccauuugugacgucuucacacaguaccucgaagugcugagcgauguucuucuggacgauaucuuugcgcagcuguacuggugcgugcagcaagacaacgagcagcucgcucgcuccggaaccaauugucuggaaaacgucgugauucuuaacggcgagaaauucacacuggagaucugggauaagaccugcaauuguacgcucgacauuuuuaaaaccacaaucccgcaugcccugcucaccuggcggccuaacucuggcgaaacagcgcccccuccgcccagcccuguuuccgagaagccgcuggacaccaucagccagaagucuguggauauucacgacuccauccagcccagaagcgucgauaaucgcccucaagcuccccuuguguccgccucugcugucaacgaagaggugagcaaaauuaaguccacggccaaauucccugaacagaagcuguuugcggcccugcucaucaaaugcguugugcagcuggagcuuauucagacaaucgacaauauugucuucuuucccgcuaccucuaagaaggaggaugccgaaaaccuggcugccgcccaacgggacgcuguggauuucgacguuagaguggauacacaggaccaggggauguaucgcuuucucaccagccagcaacuguucaaacuccuggauugucuucuggagucccaucgguucgcgaaggccuuuaauagcaacaaugaacagagaaccgcucuguggaaagccggauucaagggcaaaucuaagccuaaccuccugaagcaggagacauccagccuugccugcgggcugcgcauccucuuucggauguacauggacgaaucuagagucuccgcuugggaggaggugcaacagcggcugcugaauguguguagcgaagcccucucuuauuuccuuacgcugaccagcgagucccaccgcgaagcguggacaaaccugcuccugcuuuuucugaccaaaguucucaagaucucugauaauagauucaaagcucacgccagcuuuuacuauccgcugcugugcgagauuaugcaguucgaccucauccccgaacuucgggccguccugcgcagauuuuuccugcggauuggagugguguuucagaucucccaaccucccgagcaggagcucggcauuaacaagcaguga

SEQ ID NO: 65984 - RNA, 5358 nt, Artificial Sequence
  derived and/or modified sequence opt5 from ARFGEF2__Homo_sapiens__NP_006411
augcaggaaagccaaaccaaguccauguucgugucuagagcccuggagaaaauccucgcugacaaggaagucaaacggccccagcacagccagcugcgcagagccugccagguugcgcuugaugaaauuaaggcugagaucgaaaaacaacggcugggcaccgccgccccuccgaaggcuaacuuuauugaagccgacaaguacuuccuccccuuugagcuggcuugucaguccaaaucuccucgcguggugagcacgucccuugauugccugcagaagcucaucgccuaugggcauauuaccggaaaugcgcccgacucuggcgccccugggaaaagacugaucgaucggaucgucgaaacaauuuguagcugcuuccagggaccccaaaccgacgagggcgugcagcugcagaucauuaaggcucuccugacagccguuaccuccccucacaucgaaauucaugaggggacaauccuucagaccgugcgcacguguuacaacauuuaucuggcuagcaaaaaucucaucaaccaaaccacagccaaggcgacccugacacagaugcuuaaugucaucuuuaccagaauggagaaccaggugcugcaagaagcccgggagcucgaaaagccgauucagucuaaaccccaguccccuguuauccaggcugccgcugugagccccaaguucguccgccugaaacacucucaagcccaguccaagccuacgacacccgagaaaaccgaucugacaaauggagaacaugccagaagcgacucuggcaagguguccaccgagaacggcgaugcuccgcgggagcgcgggagcucccucucuggaaccgacgauggcgcgcaggaaguggucaaagacauucuggaggauguugugacaagcgccaucaaggaagcugccgagaagcacgggcuuacggaaccugagagagugcugggagagcucgaaugccaggagugugccauucccccuggcgucgacgaaaauucccaaaccaacgggaucgcugacgaucggcagagccugucuuccgccgacaaucuugagagcgaugcgcagggacaccagguggcugcccgcuuuucucauguucugcaaaaagacgccuuccucguguuuagaagccugugcaagcuguccaugaaaccccucggcgaaggacccccugauccgaagucucacgagcugcggagcaaagucgugucccuucagcugcuccugagcguucuucagaacgcugggcccguguucagaacacaugagauguuuaucaaugccauuaagcaguaccugugugucgcucucucuaagaacggaguguccagcgucccugacguguucgaacugucucuggccaucuuucucacccugcuuuccaauuucaaaaugcaccugaagaugcaaauugagguuuucuuuaaagaaaucuuccucaacauucuggagacaagcaccuccucuuuugagcaccgcuggauggugauccagacgcugacacggaucugcgcggaugcccagugugucguggacauuuauguuaacuacgauugcgaccuuaaugcugccaacaucuucgaaagacucgugaaugaucugagcaagauugcucaaggccgcuccgggcaugagcugggaaugacaccccuccaggaacugucucuucggaaaaagggccuggagugccucgucagcauccugaaguguaugguggaaugguccaaagaccuguaugugaacccuaaucaccagaccagccuugggcaggagagacucacagaccaagagauuggagauggcaagggccuggacauggcccgccggugcucuguuaccuccauggaaagcacagucucuuccgggacgcagaccacagugcaggaugaccccgagcaguuugaagugaucaaacaacagaaggagauuaucgaacauggaaucgagcuguucaacaaaaagccgaagagaggcauucaguuucuccaggagcaagggaugcugggaaccagcgucgaagauaucgcgcaguuccuucaccaggaggaacgccuggacucuacacaagugggcgauuuucucggggacagcgcccgguucaauaaagagguuauguacgcuuacguggaucagcuggacuuuugugaaaaggaguucgucuccgcccugagaaccuuucuugagggcuuccgccucccuggagaagcucagaaaauugaucggcugauggagaaguucgccgccagauauaucgaaugcaaccagggccaaacgcuguuugcuagcgcggacaccgccuacgugcucgcuuauucuauuaucaugcugacaaccgaucuucauagcccccaaguuaaaaauaagaugacaaaagagcaguacaucaagaugaaccgggggauuaaugacuccaaggaccugccugaggaauaucucuccucuaucuacgaggaaauugagggcaaaaagaucgccaugaaagaaaccaaggagcugacgauugccacaaaaagcaccaagcagaacguggcuuccgagaagcaacgcagacugcuuuauaaucucgaaauggagcagauggccaaaacagcgaaggcucugauggaagccgucucucacgccaaagcucccuucaccagcgccacccaccuggaucaugugcggccuauguuuaagcucguuuggacaccccugcuugcggcuuacuccaucggccugcagaacugugacgauacggagguggccucucucugccuggaagggaucagaugugccauucgcaucgcuugcauuuucggaaugcagcuggagcgggacgccuacguccaagcucuugccagauuuagccugcucaccgcguccagcucuaucacagagaugaaacagaagaauauugauaccaucaagacacugaucaccguggcccacacggacggcaacuaucucgggaacuccuggcaugaaauucugaaauguaucagccagcuugagcuggcucagcucauuggcacaggagugaagacccgcuaccugucuggcuccgggagagaacgggagggaagccugaaaggccacacccuugccggggaagaguucaugggacugggccucgggaaucuggucucuggcggaguugauaagcgccaaauggcuuccuuucaggagagcgugggcgaaacauccagccagucuguggucguggccguugacagaaucuucaccgggagcacacggcucgauggaaacgccauuguggacuuuguccgcuggcugugcgcuguguccauggaugagcuugcgucuccgcaccauccuagaauguucagccugcagaaaaucguugaaauuuccuauuacaauaugaaccggauccgccuccaguggucuagaaucuggcacgugauuggcgaccauuuuaauaaggucggguguaaccccaaugaggauguggccaucuucgcuguugacagccugcggcagcuguccaugaaguuucuugagaaaggagaacuggccaacuuccgcuuccagaaggacuuucucagacccuucgagcacauuaugaaaaagaaucggucuccuacgaucagagauauggccauucgcugcaucgcucaaauggugaacagccaggccgcgaauauccgguccggcuggaaaaacauuuuugcugucuuccaucaggccgccagcgaccacgaugggaauaucguggaacuggcuuuucagaccacaugccacauugugaccacaaucuuccaacaucacuuuccggccgcgauugacucuuuccaggaugcugucaagugucucuccgaguuugccugcaacgccgcuuuccccgacaccagcauggaagccaucagacugauccgcuuuuguggcaaauauguuucugagcggccuagagugcuucaggaguacacguccgaugacaugaauguggcucccggagaucgcgucugggugcggggcugguucccuauucuguucgaacugagcugcaucauuaacagauguaagcucgacguucgcacccgggggcugacagugauguuugagaucaugaaguccuauggacauaccuucgaaaaacacugguggcaggaucuuuuuagaauugucuuccggaucuuugacaacaugaagcugcccgagcaacucucugagaaaagcgaguggaugacaaccacaugcaaucaugcccuguacgcgauuugugacguguucacccaguuuuacgaggcccucaacgaaguucugcuuuccgauguguucgcucagcugcaauggugcgucaagcaggacaaugagcagcuggcccgcagcggcacgaacugucucgaaaaucuggugaucucuaacggggagaaauuuuccccugaagucugggaugagacaugcaauuguaugcuugacaucuucaagaccaccauuccccacgugcugcucacauggagaccgguuggaauggaggaagauagcucugagaagcaccuggacguggaucucgaccggcagagccuguccucuaucgauaaaaacccuagcgaacgcggccaaucccagcuuucuaaucccaccgacgauagcuggaagggcagaccuuaugcuaaccagaaacuguuugccucccugcucauuaagugcgucgugcagcuggagcuuauccaaacgauugacaauaucguuuucuaccccgccacaagcaaaaaggaggaugcugaacauaugguggcggcccagcaggacacccuggacgcugauauccacauugagacagaagaccaggggauguauaaguacaugucuucccaacaucucuuuaaacugcucgauugccugcaggagagccacuccuucucuaaggccuucaacagcaauuaugaacagcggaccguccuuuggagagccggauuuaaaggcaaguccaaaccgaaccugcugaagcaggagacaucuagccucgcuuguugccugcgcauccuuuuccggauguacguggacgagaauagacgcgauuccugggaagagauucaacagcggcugcucaccguguguagcgaagcccuggcguauuuuaucacgguuaacucugagucccacagagaggcuuggaccagccugcuccuucugcugcucacaaagacccugaaaauuaacgacgagaaguucaaagcccaugccucuauguacuacccuuaucuuugcgagaucaugcaguuugaucugauccccgaacuccgcgcuguccugcggaaguucuuucugagaauuggggugguguacaaaaucuggauuccugaggaacccucccaaguccccgccgcgcucagcccugugugguga

SEQ ID NO: 65985 - RNA, 6534 nt, Artificial Sequence
  derived and/or modified sequence opt5 from ARFGEF3__Homo_sapiens__NP_065073
auggaggaaauccugagaaagcugcagaaggaggccagcggcuccaaguacaaggcuauuaaggaaucuugcaccugggcccuggagacacuugggggacuggacacgaucgugaagauucccccucacguccuccgggaaaagugucugcuuccgcugcaacucgcgcuggagagcaagaacguuaagcuggcucagcaugcccucgccggcaugcagaagcugcuuuccgaggaaagauucgugucuauggagaccgauagcgacgaaaaacagcugcucaaucaaauccugaacgcugugaaggucacacccucccuuaaugaggaucuccagguggagguuaugaaagugcuccugugcauuaccuauacaccuaccuuugaccugaacgggucugccguccucaagaucgcugaaguguguaucgagacauacauuagcuccugccaccagagaagcaucaauaccgccguucgggcgacgcugucucagaugcuuuccgaucugacccuccaacugcgccagagacaggaaaacacaauuaucgagaaucccgacgugccucaggauuucggaaaccaaggcagcaccgucgaaucucuuugugacgaugugguguccguccugacaguucucugcgagaagcugcaggccgcuauuaaugacagccagcaacugcagcuccuguaucuugaguguauccugucugugcucuccagcuccucuagcuccaugcaucugcaccggcgcuuuaccgaucuuauuuggaaaaaccugugccccgcccucaucgugauccuggggaauccuauucaugacaagacgaucacaagcgcucacaccucuuccacaagcaccucucuggaaagcgauuccgccucucccggagucagcgaccacggcagaggcuccggguguagcugcaccgcgcccgcccucucuggaccuguggcucggacaauuuacuauaucgccgcugagcugguucgccuugugggcuccgucgacagcaugaaacccgugcugcagucucucuaccauagaguucugcuguauccucccccgcagcaccggguggaagccauuaagaucaugaaagagauccuuggguccccucaacgccucugugaucuggccggacccagcuccacggaaucugagagcagaaagcgguccauuucuaaacgcaagagccaucuggaccuccugaaacuuaucauggauggcaugaccgaggcuugcauuaaagggggaaucgaagcgugcuacgccgcugucuccugugugugcacacugcucggcgcccuggacgagcugagccagggcaaggggcuuucugaaggacagguccagcuccugcugcucagacuggaggaacuuaaagauggcgccgaguggucccgggacagcauggagauuaacgaagcugauuucagauggcaacgccgggugcugucuuccgagcacaccccuugggaaagcgggaaugagagaucucucgacaucagcaucuccguuacaaccgauacgggacagacaacccuggagggcgaacuggggcagaccacacccgaggaccacagcggaaaccauaaaaauucucuuaaaucccccgccauuccugaaggcaaggagacccucagcaaggugcuggaaacagaggcggucgaucagccggacgugguucaacgcucccacacggugcccuacccugacaucaccaacuuucugucugucgauugucggacaagaagcuauggcucccgcuacucugagagcaacuucuccguggacgaucaggaccucucucggaccgaauuugauagcugcgaccaguauuccauggcugccgagaaagauagcgggagaucugacguguccgauauuggaagcgacaauuguucucuggccgaugaagaacagacaccccgcgacugccuuggccaucggucccugagaaccgcugcccucagccugaagcugcuuaaaaaccaagaagcugaucagcacucugcccgccucuucauccagucccuggaggggcugcucccucggcugcuuagccuguccaauguugaggaagucgacacggcgcuccaaaacuuugccagcaccuucuguucuggaaugaugcauagccccggcuuugacgggaauagcucucugagcuuccagaugcugaugaacgcugauucccuuuacacagccgcucacugcgcccugcuccugaaucucaagcugucucacggcgacuauuacagaaaacggccgacccuugcgccuggagugaugaaggauuuuaugaaacaggugcagacaagcggcguccugaugguguucucccaagccuggauugaggaacucuaucaucagguucuggaccgcaacaugcugggggaggcuggauacuggggcucucccgaagauaauagccuuccucugaucaccaugcucacggacauugaugggcuggaguccagcgccaucggaggccagcucauggcuucugccgccacagagucccccuucgcucagagcagacggaucgacgauucuaccguggcgggggucgccuuugcuagauacauucuggugggcuguuggaaaaaccuuaucgacacacuguccaccccucucaccggacgcauggccggcagcuccaaggggcuggccuucauucugggagcugaaggcaucaaagagcaaaaucagaaggaacgggaugccauuugcaugucucuugacgggcugagaaaagcggcucgccucagcugugcccugggaguugccgcuaacugcgccuccgcgcucgcucagauggccgccgcuagcugcgugcaggaggagaaggaagagagagaagcccaagagcccucugaugcuaucacacaggucaagcugaaaguggaacagaaacuugagcaaaucggcaaaguucaggggguguggcugcacacggcccauguccuguguauggaggcgauucucuccgugggccuggaaaugggaagccacaauccggacugcuggccucacguguuucgggucugugaguauguuggcacccuugaacauaaccacuucucugacggggccagccagccgccucugacaaucucccagccucaaaaggcuaccggaucugccggccuccugggggauccggagugcgaaggauccccucccgagcauucccccgagcagggccgcucucucagcacagcuccuguggugcagccccuguccauucaggaccuugucagagaagggagccggggccgcgccucugauuuuagaggaggcucccugaugagcggguccucugccgcuaaagugguucugacccucagcacgcaagcggaccggcuguucgaggaugccacagacaaacuuaaucugauggcucucggaggcuuucuguaccagcucaaaaaggccucccagucucagcuguuccacagcgugaccgauaccgucgacuauucccuugccaugccuggggaaguuaagagcacacaagaucgcaaaucugcucugcaucuguuuagacucggaaacgccaugcugcggaucgugcgcuccaaggcgagaccccuucugcacgugaugcgguguuggagccucgucgcuccgcaccugguggaggccgccugccauaaagaaagacacguuucucagaaggcuguguccuucauucaugacauccucaccgagguccugacagauuggaacgagccuccccacuuucauuucaaugaagcccuuuuucgcccuuucgagcggaucaugcagcuggaacugugugacgaggacgugcaggaucaaguggucacgagcauuggcgagcucguugaagugugcucuacccagauccagagcggcuggagaccccuguucuccgcgcuugagacagugcacgggggaaacaaaucugaaaugaaggaguaccuggucggcgacuauagcauggggaagggacaagcuccgguguuugauguuuucgaagccuuucucaauaccgacaacauucagguguucgccaaugcugccacauccuacaucaugugucugaugaaauuugucaagggccugggggagguggauugcaaagagauuggagacugugcuccugcccccggcgcgccuagcaccgaucucugccuucccgcccuggacuaucugcgccggugcucccagcuccuggcuaagaucuacaaaaugccccuuaagccuaucuuccugucuggcagacucgccgggcugccgcgccggcugcaggaacaaagcgcuuccucugaggauggaauugaaagcguucucuccgacuuugaugacgauacgggccuuaucgagguguggauuauccugcuggaacagcucaccgccgccgucucuaacugucccagacagcaccagccucccacacuggaccuucuguucgagcuccugcgcgacgugaccaagacaccugggcccggauuuggcauuuacgcugucgugcaucugcuccuuccuguuaugagcguguggcugcggagaucccacaaagaucauagcuauugggacauggcgucugccaauuucaagcacgcuaucgggcuguccugcgagcucgucguggaacacauucaauccuuucugcauucugauauccgguacgaguccaugaucaacaccaugcuuaaagaccuguucgaacuccugguugccuguguggccaagccgacagagaccauuagccgcgucggaugcucuuguaucagauaugugcuggugacggcuggccccguuuuuacagaagagauguggcggcucgccugcugugcgcuucaggaugcuuucuccgccacccugaaaccugucaaggaccugcucggcugcuuccacagcgggaccgaguccuuuagcggagaaggcugucaggugcgcguggccgcucccucuagcuccccuucugccgaggcggaauacuggcgcauucgggccauggcucagcaagucuucaugcuggauacacagugcagccccaagaccccgaauaacuuugaccaugcccaguccugucaacuuaucauugagcugccucccgaugagaaacccaaugggcacacgaagaaaucugugagcuucagagaaaucguugugucccuccugucucaucagguccugcuccagaaccuuuaugacauccugcuggaggaauuugugaagggaccuagccccggcgaggagaagacaauucagguuccugaggcuaagcucgccggguuccugcgcuacaucuccaugcaaaaucuugcugugauuuuugaucugcuccuggacagcuaucggaccgccagagaguucgauacaucuccgggacugaaaugccuccuuaagaaggucuccggcaucggcggggcggccaaccuguaccgccagagcgcuaugucuuuuaauauuuacuuccacgcccuggugugcgcuguucucaccaaccaggaaacaaucaccgccgaacaggugaaaaagguccuguuugaagacgacgagcgguccacggauagcucccaacaguguucuagcgaagacgaggauaucuucgaggaaaccgcccaggugucucccccuagaggaaaagagaagcgccaguggcgggcuagaaugccccuucugagcgugcaaccugucagcaacgcggacuggguuuggcucgugaaacgccugcacaagcugugcauggaacucuguaauaacuauauucagaugcaucuugaucuggagaauugcauggaggagcccccgaucuucaagggcgaccccuuuuucauucugcccuccuuucagagcgagucuagcacaccuuccaccgggggauucucuggcaaagaaacacccagcgaggaugacagaucccagucucgggaacacaugggggagagccucucccugaaggccggaggcggcgaucuucugcucccucccagcccgaaaguggagaagaaagacccuucucgcaagaaggaauggugggagaacgcugggaauaaaaucuacaccauggccgccgauaagacgauuuccaaacugaugacagaauauaagaaaagaaagcaacagcauaaccugagcgcuuuucccaaggaggucaaaguggaaaagaaaggagagccccucggcccucgggggcaggacuccccgcuucugcaacgcccccagcaccugauggaccagggacagaugagacacucuuucagcgccggcccugagcuccugcggcaagauaagagaccccgcuccgggucuaccggaagcucccuuagcguuucugugcgggacgcggaagcccagauccaggcuuggacaaauaugguccugaccgugcucaaccagauucaaauccugccugaucagaccuuuacagcccugcagcccgcuguuuucccuuguaucucccagcucacgugccaugugaccgacauuagaguccgccaagccgugcgggaguggcuuggcagagucggccggguguacgauaucauuguuuga

SEQ ID NO: 65986 - RNA, 1122 nt, Artificial Sequence
  derived and/or modified sequence opt5 from ARFIP1__Homo_sapiens__NP_001020766
auggcccaggagagccccaagaacuccgcugccgaaaucccugugaccucuaauggcgaggucgacgauagcagagaacacuccuucaaccgggaccugaaacauucucucccgagcgggcugggacuuuccgagacacaaauuacgucucacggcuuugauaauaccaaggaagggguuaucgaggcgggagcuuuccagggcagccccgccccuccccugccuuccgugaugagccccucucgcguggccgcuuccagacucgcccagcaggggagcgaccugauugucccugcuggaggccaacggacacagaccaaaucuggcccggugauccuugccgaugagauuaagaaccccgcgauggaaaaacuggagcucguucgcaaguggucccugaauacauacaagugcaccagacagaucaucagcgaaaaacuggggcggggaucucgcacaguggaccucgagcuggaggcccagauugauauccuuagagacaacaagaaaaaguaugaaaauauucugaaacucgcucaaacccuguccacgcagcuuuuucagaugguccauacccagcggcaacugggcgaugccuucgcugaccucagccugaagucccuggagcuccacgaagaguuuggguacaacgccgauacacagaagcugcuugcgaaaaauggagaaacccugcucggcgccaucaacuucuuuauugcuucugugaauacacugguuaacaagaccaucgaggacacgcuuaugacagugaaacaguaugagagcgcccgcauugaauacgaugcuuauagaaccgaccuggaggaacucaaucuggggccucgggacgccaacacacugcccaagaucgagcaaucccagcaucucuuccaggcccacaaagaaaaguacgauaaaaugcgcaaugacgucagcgugaagcugaaguuucuugaggagaacaaagugaagguccugcacaaccagcucguucuguuccauaaugcuaucgcggccuauuuugcuggaaaccaaaaacagcuugaacagacccugaagcaguuccacauuaaacucaagaccccuggcguggaugcccccucuuggcuggaggaacaauga

SEQ ID NO: 65987 - RNA, 522 nt, Artificial Sequence
  derived and/or modified sequence opt5 from ARFRP1__Homo_sapiens__NP_001128230
auguacacccugcucagcggccuguauaaguacauguuccagaaagacgaguauugcauccuuauucuggggcucgauaacgccggaaagacaacguuucuggaacaauccaaaaccagauucaauaagaacuacaaaggcaugucucuuagcaagaucacaaccacaguggggcugaauauuggaaccgucgacguuggcaaggcucggcucauguuuugggaucucgggggacaggaggaacugcagucccugugggacaaauauuacgccgagugucacggcgugaucuaugugauugauucuacagacgaggaacgccuggcggagagcaagcaggcuuucgaaaaagucgugaccuccgaggcccuuugcggcguucccgugcugguccucgccaacaagcaagauguggaaacgugucugucuaucccugacaucaaaaccgcuuuuagcgauugcacauccaagauugggagacgggacugucuuacccaggccugcagcgcucugacaggauga

SEQ ID NO: 65988 - RNA, 969 nt, Artificial Sequence
  derived and/or modified sequence opt5 from ARG1__Homo_sapiens__NP_000036
augagcgccaaguccagaaccaucggcauuaucggggcucccuucucuaaaggacagccucggggcgggguggaggaaggaccgacaguccugcgcaaggccggccuccuggagaaacuuaaggaacaagagugcgacguuaaagauuacggggaccugcccuuugcggauauuccuaacgacagccccuuccagaucgugaagaauccuagauccgugggaaaggcuucugaacagcucgccggcaaagucgccgaggugaagaaaaacggccggauuagccugguucuugggggagaucacucccuggcuaucggcucuaucagcgggcaugcccgcgugcaccccgaccucggagucauuuggguggaugcucauacggacaucaauaccccucugacaaccacauccggcaaccugcacgggcagccgguuagcuuucuccugaaggagcuuaaaggaaagauucccgaugugccuggcuucucuugggucacccccuguaucuccgccaaggacauuguguauaucggccugagagauguggacccuggggaacauuacauucucaaaacacugggaaucaaguauuuuagcaugaccgaggucgaucggcuuggcaucgggaaaguuauggaagagacgcugucuuaccuccugggacgcaagaaaagacccauucaccuguccuucgacguggacggccucgauccgagcuuuaccccugcgacagggacccccguggucggaggccugacauaucgggagggccuuuacaucaccgaagagauuuauaagacggggcugcucucuggacuggacaucauggaagugaauccuucccuuggcaaaacacccgaggaaguuacccgcacagugaacaccgccgucgcuauuacccuggccugcuucgggcucgcuagagagggaaaucacaagcccaucgauuaccugaacccuccgaaguga

SEQ ID NO: 65989 - RNA, 822 nt, Artificial Sequence
  derived and/or modified sequence opt5 from ARGLU1__Homo_sapiens__NP_060481
augggcagaagccggucccgcucuagcuccagaucuaagcacaccaaaagcuccaagcauaacaaaaagcggucucgcagcagaucccggagccgcgacaaagagagagugcggaagcgcucuaaguccagagaaagcaaacggaaucgcagacgggagucucgcuccagaagccggucuacaaacacggccgucuccagacgcgaacgggauagagagcgcgcuagcucucccccugaccggaucgauauuuucgggagaaccguuuccaagcgcagcucccuggacgaaaaacagaagcgggaggaggaagagaaaaaggccgaauuugagagacaacgcaagauccggcagcaggagauugaagagaaacucaucgaagaggaaacagcgagacgcguggaggagcugguggcuaagcgggucgaagaggaacuugagaaaagaaaggaugaaauugagcgggaggugcugcgcagaguugaagaggccaaacggaucauggaaaagcagcuccuggaggaacuugagagacaacgccaggccgagcuggcugcccagaaagcucgggaagaggaagagagagccaagcgcgaggaacucgagagaauccuggaagagaauaaccggaagauugcggaagcccaggcuaaacuggccgaggagcaacuccgcaucguggaagaacagagaaagauucacgaggagcggaugaaacuggaacaggagcgccagagacaacagaaggaggaacagaaaaucauucuuggaaagggcaagagccggccgaaacugucuuucucccucaagacccaagacuga

SEQ ID NO: 65990 - RNA, 2361 nt, Artificial Sequence
  derived and/or modified sequence opt5 from ARHGAP10__Homo_sapiens__NP_078881
augggccugcagccccucgaguucagcgacugcuaccuggauuccccuugguuuagagaacggauccgcgcccacgaggcugaacuugagagaaccaacaaguucauuaaagaacugaucaaggacgggaaaaaucucauugccgcgacaaagucucugagcguggcucaacggaaauuugcccauucccuucgcgauuucaaguuugaguucaucggagacgccgucacggaugacgagagauguauugaugcuucucugcgggaauuuagcaacuuccucaagaaucuggaggaacagcgcgagaucauggcccuguccguuaccgagacacucaucaaaccgcuggaaaaguuuagaaaagagcagcuuggcgcugugaaggaagagaaaaagaaguucgacaaagaaaccgagaagaacuauucucugauugauaaacaccucaaucugagcgccaagaaaaaggacucccaucuucaggaggcggauauccaaguggaacagaaccggcagcacuuuuacgagcugagccucgaauaugucugcaaacugcaggagauucaagaacgcaagaaguucgaguuuguggagcccaugcugucuuucuuccaggggauguuuacauucuaccaucagggacacgaacucgccaaagacuuuaaucacuauaagauggagcugcagaucaacauucaaaauaccagaaaccgguucgaaggcacacgcuccgagguugaggagcuuaugaauaaaaucagacagaacccuaaggaucauaaacgggcuagccaguuuaccgccgagggguaccuguaugugcaagaaaagcgccccgcuccuuucggaucuuccugggucaagcacuacuguauguacagaaaagccgcgaagaaauuuaauaugauucccuucgagcaucggagcggcggcaagcucggggacggagaaguguuuuuccugaaagagugcacgaagagacacaccgacucuaucgaucgccgguuuuguuucgacaucgaggccgcugauagaccuggcguuucccuuacaaugcaggccuuuagcgaagaggaacgcaagcaguggcuggaggcucucgggggaaaagaagcccugucccacucuuucaacaccgccauuaucccgcggcccgagggcaaugcucagcuggacaagaugggguucacaauuaucagaaaaugcauuagcgcgguggagacccgcggaaucaacgaucaaggccucuaucgggucgugggcguguccagcaagguccagagacugcuuucuaugcugauggacguuaaaacguguaacgaaguggaucucgaaaauuccgccgacugggaagugaagacaaucaccagcgcucugaagcaguaccuucgcucucugccugagccccucaugacauaugaacugcauggggauuuuauugucccugccaaaagcggaucccccgagucucgggugaacgccauccacuuccugguucauaagcucccggagaaaaauaaggaaaugcuggacauucuugugaaacaccugaccaacgucagcaaucauuccaagcagaaccucaugaccguggcuaaucugggcguuguguuugggccuacacugaugagaccccaagaggaaacggucgccgcgcuuauggaucucaaauuccagaacaucguggucgagauucugaucgaaaaucacgagaagaucuuucgcaccccucccgacacaaccuuccccgagccuacaugccugagcgcuucuccgcccaacgccccuccccggcaguccaagagacagggacaacggaccaaacgcccuguggccguuuacaaucucugucuggaacuugaggacggcgauaaccccuauccgagcaaggaagacacgccuacaucuucccuggauagccucuccucucccagcccugugaccaccgcuguccccgggccucccggaccggacaaaaaucaccuucuggccgauggcggcuccuuuggggacugggcuucuacaauuccuggacagaccagaagcuccauggugcaguggcuuaacccccagagccccacaacgaccucuuccaauagcgccguuacaccucucucuccgggcuccagccccuucccuuuuucucccccugcgaccguggccgauaagcccccugagagcauccgguccagaaaagcucgcgccgucuaccccugcgaggcugaacauagcucugagcuguccuucgaaauuggggccaucuuugaggacgugcaaacaagccgggaaccgggauggcuggagggcacccucaacgggaagagaggccugauuccucagaacuaugugaagcugcuguga

SEQ ID NO: 65991 - RNA, 2505 nt, Artificial Sequence
  derived and/or modified sequence opt5 from ARHGAP11A__Homo_sapiens__NP_001273408
auggacagcuccaaccuggccgugaucuucgcucccaaucuccugcagaccucugagggccacgaaaagaugagcuccaacacagagaaaaagcugagacuucaagccgcggucguucagacgcucauugauuacgcuucugacaucgggcgggugccugauuuuauucuggagaaaaucccggccaugcuuggaauugacggccugugcgccacccccagccucgaaggguucgaagagggagaguaugaaacaccuggcgaguacaagcgcaaaagacggcaguccgugggggauuuugucucuggagcucugaauaaguucaagcccaaccgcaccccuagcaucacaccccaggaagagagaaucgcccaacuguccgagagcccugugauucucaccccgaaugcuaaacggacacugcccguugacucuucccauggcuuuagcucuaagaaacgcaaguccaucaaacacaacuucaauuuugaacuucugccuagcaaccucuucaauucuuccagcacccccguguccguccauauugauacgucuagcgagggcuccagccagucuucccugagcccugugcuuaucgggggaaaccaccugauuaccgccggcguucccagacggucuaagcgcaucgcggggaagaaaguguguagagucgaaagcggaaaggccggcugcuuuuccccgaaaauuucucauaaggagaaagugcggcgcagccucagacugaaguucaaucuggggaaaaacggacgggaagugaauggcuguuccggcgucaaccgcuaugagagcguuggguggagacucgcuaaucagcagucucugaagaaccggaucgaguccgugaagacaggacuucuguuuagcccugacguggaugaaaaacuccccaagaaaggcucugagaagaucuccaaaagcgaagagacccugcuuacaccugaaagacuggucgggaccaacuaccgcauguccuggacgggacccaauaacucuagcuuccaagagguggacgccaaugaggcuuccucuaugguugaaaaccucgagguggaaaauagccuggagcccgauauuauggucgaaaaguccccugccacaagcugcgagcugaccccgucuaaccucaauaacaagcacaauuccaacaucacaagcucuccccuguccggcgacgagaauaacaugaccaaagaaacccuugugaagguucagaaagcguuuagcgagucugggagcaaucugcacgcccucaugaaccagcggcaguccagcgugacaaaugucggaaaggugaaacugacggaaccuucuuaucuugaggauucccccgaggaaaaccuguucgagaccaacgaccucacaauugucgaaagcaaggagaaguacgaacaucacaccggcaaaggcgagaaguguuucuccgagagagacuuuucuccucugcaaacacagaccuucaaucgcgaaacgacaaucaaaugcuauagcacccagaugaagauggagcaugaaaaagauauucacuccaacaugcccaaggacuaccugucuaagcaagaguuuagcuccgaugaagagaucaaaaagcagcagucuccgaaagacaagcucaauaacaaacugaaggagaaugaaaacaugauggaggggaaucuuccuaaaugugcugcccacagcaaggaugaagcucgguccagcuucucucagcaauccacaugcgugguuaccaaccugagcaagcccagaccuaugcgcaucgccaaacagcagucucucgagaccugugaaaagacaguguccgagagcucucagaugacggagcaucggaaagucuccgaccacauucaaugguuuaauaagcugagccugaacgaacccaauagaaucaaagugaaguccccucuuaaguuccagcgcacccccguucggcagagcgugagacgcauuaacucucuccuggaguacagccggcagccgacaggacauaaacuggccucccucggcgauaccgcuucuccucuggucaagagcguguccugcgacggggcgcuuucuagcuguaucgaauccgccucuaaagauagcuccgugagcugcauuaagucuggacccaaagagcaaaaguccaugagcugcgaggaaucuaauaucggcgcuaucuccaagagcuccauggagcugcccucuaagagcuuucucaaaaugagaaaacacccugacuccguuaacgccagccugcggucuacaaccgucuauaagcagaaaauucuguccgauggccaggugaaggugccgcuugacgaccucacgaaucaugauaucgucaagcccgugguuaacaacaauauggggauuagcucuggaaucaacaaucgcgugcugagacggccuagcgaaagaggccgcgccugguacaaagggucccccaagcacccuauuggaaaaacccagcugcuccccacaucuaagccugucgaccuguga

SEQ ID NO: 65992 - RNA, 804 nt, Artificial Sequence
  derived and/or modified sequence opt5 from ARHGAP11B__Homo_sapiens__NP_001034930
augugggaccagagacuggugaagcucgcccugcuucaacaccuucgggcuuucuacggcaucaaagucaaggggguucgcggacagugcgauagacggcgccaugagaccgccgcgacagaaauuggcgggaaaaucuuuggagugcccuucaacgcucucccucacagcgccgugccggaguauggccauauucccuccuuucuggucgacgccuguacgucucuugaggaacacauccauaccgaagggcuguucagaaagagcggauccgugauucggcucaaagcucugaagaauaagguugaucacggcgagggcugccugucuagcgccccucccugugacaucgcugggcuccugaaacaguuuuuccgcgagcuuccugaacccauccugccugccgaucuccacgaggcgcugcuuaaggcccagcaacugggaacagaagagaaaaacaaggcuauucuccugcuguccugccuccuggccgaccauaccgugcacguccuuagauacuuuuucaauuuucugcggaacgugucucuccgcagcuccgagaauaaaauggauagcucuaaccuggcuguuaucuucgccccgaaucuucugcagacauccgaaggccaugagaagaugagcucuaacgcggaaaagaaagggguguaucagacccucuccuggaagagauaccagcccuguuggguccugauggugagcgugcugcuccaccacuggaaagcccugaagaaagucaauaugaagcugcugguuaacauucgggagcgcgaagacaauguguga

SEQ ID NO: 65993 - RNA, 1428 nt, Artificial Sequence
  derived and/or modified sequence opt5 from ARHGAP15__Homo_sapiens__NP_060930
augcagaaaagcaccaacuccgacacaucuguggagacgcugaauagcaccagacaaggcacaggggccguccagaugcggaucaaaaacgcuaauucccaccaugaucgccucucucagagcaaguccaugauucugaccgacguuggaaaagugacagaacccaucucuagacaccggcgcaaccauagccagcacauucuuaaggaugugaucccuccgcuggagcaacucauggucgaaaaagagggcuaccugcagaaggccaagauugcggacgggggaaagaaacuuagaaagaauugguccaccagcuggaucgugcugucuucccggcgcaucgaguucuauaaggagagcaaacagcaggcucucucuaacaugaagacaggccauaagcccgaguccguugaucugugcggggcccacauugaaugggccaaagaaaagagcucucggaaaaauguguuucaaaucaccacggucuccggaaacgaguuccugcuccagagcgacauugauuuuaucauucuggacugguuccacgcuaucaagaaugccauugauagacuuccuaaagacuccucuugucccagccgcaaccuggaacucuuuaagauccagagauccagcucuaccgagcugcuuucccauuacgauagcgacaucaaagaacagaagccugagcaccggaagucucugauguuccgccuccaucacagcgcuuccgauacaucugacaaaaauagaguuaagagccggcugaaaaaguuuauuacccgcagacccucccugaaaacacuccaagaaaagggccugaucaaggaccagauuuucggcagccaccuucauaaagugugcgagcgggaaaacucuaccgugccuugguuugucaagcaguguaucgaggccguggagaaaagagggcuggauguggacggaauuuaucgcgucuccggcaaucucgcgacgauccaaaagcugcgguucaucguuaaccaggaagagaaacuuaaucuggaugacagccagugggaagauauucacguggugacaggggcccucaagauguuuuucagagagcugccggaaccccuguuuccuuacucuuucuucgagcaguuugucgaggcuaucaagaaacaagacaacaacacccgcauugaagccgugaagucccucguucagaaacugcccccucccaaucgggauacaaugaaggugcuuuucggacaucugaccaaaaucgucgcuaaggccagcaagaaccucauguccacccagucucugggcauuguguuugggccgacacuucugagagcggagaaugaaacgggaaacauggccauccacaugguuuaucagaaucaaaucgcugagcucaugcugagcgaauacuccaaaauuuucggcucugaggaggacuga

SEQ ID NO: 65994 - RNA, 1992 nt, Artificial Sequence
  derived and/or modified sequence opt5 from ARHGAP18__Homo_sapiens__NP_277050
augagcuggcuguccucuagccagggcgugguccucaccgccuaccaccccuccgggaaggaccaaacaguuggaaacucucaugcuaaagccggcgaggaagcgacgagcuccagacgguaugggcaguacaccaugaaucaggagucuacaaccaucaaggugauggaaaaaccuccguucgaucgcagcauuucccaggacagccuggaugagcuuucuauggaagacuauuggaucgagcuggagaacauuaagaaauccagcgaaaauucucaagaggaucaggaaguggucgugguuaaggagcccgacgagggagaacucgaggaagaguggcugaaggaagcuggccuuuccaaccuguuuggggagagcgccggagauccucaggagucuaucguguuccucuccacacugaccagaacacaggccgcugccguccaaaaacggguggaaaccguuagccagacgcugcgcaagaaaaauaagcaguaccagauucccgacgugagagauaucuuugcucaacagcgggaguccaaagaaaccgccccuggcggcacagagucucagagccuccgcaccaacgaaaauaaguaucaagggagagacgaugaggcguccaaccuggucggagaggaaaaacuuauucccccugaggaaacaccggcccccgagaccgacaucaaucuggaagugagcuucgcugagcaggcccucaaccagaaagagucuuccaaggaaaagauccagaaaagcaaaggcgaugacgcuacgcugccuucuuuucggcuucccaaggacaaaacagggaccacacgcauuggagaucuggccccucaagacaugaagaaggugugccaccucgcgcugaucgagcugaccgcccucuacgauguccugggcauugaacuuaaacagcagaaggcuguuaaaaucaagaccaaagacagcgggcuguucugugugccccucacagcccugcuugagcaggaucaaagaaaggugccgggaaugcggauuccucugaucuuucagaagcucaucucccgcauugaggaaagaggccuggagacggaaggccugcuccggauccccggggcugccauucgcaucaaaaaucugugccaggagcuugaagccaaguucuaugagggaaccuuuaacugggagucugucaaacagcaugacgcugcgagccugcucaagcuguucauuagagaacuuccucaaccccugcucuccguggaguaccugaaagccuuucaggcuguucagaaucugcccacaaagaagcagcaacuccaggcccugaaccuucuggugauccuccugccugaugccaaucgggacacccugaaagcccuucucgaguuccugcagagagucaucgauaacaaggagaaaaacaagaugacagugaugaauguugcuauggugauggcgccgaaccuguuuaugugucacgcucucggccugaaaagcucugaacaacgcgaguucgucauggccgccgggaccgcuaauacgaugcaucuucugauuaaguaccagaagcuccuguggacaauccccaaauucauugugaaccagguccggaagcagaauaccgagaaccacaaaaaggacaaaagagccaugaagaaacugcuuaagaagauggcuuaugaucgcgaaaaauacgagaagcaagacaaauccaccaaugacgccgaugugccucagggaguuauccgggugcaggcgccccaccucagcaaggucucuauggccauucagcugacagaagaacugaaggcuuccgacgugcucgccagauuucugagccaagaauccggcguugcucagacccuuaagaagggggagguguuccuguaugagaucggaggcaacaucggcgaacgcugccucgaugacgauacauacaugaaagaccuguaucagcugaauccuaacgccgagugggucauuaagucuaaaccccuuuga

SEQ ID NO: 65995 - RNA, 1320 nt, Artificial Sequence
  derived and/or modified sequence opt5 from ARHGAP1__Homo_sapiens__XP_011518397
auggacccccugagcgagcuccaggaugaccugacccuugaugacacauccgaagcccugaaccaacucaagcuggcuucuaucgaugagaaaaauuggccuagcgacgaaaugccggauuuccccaaguccgacgauucuaaaagcuccucuccugagcuugugacgcaccugaagugggacgaucccuacuaugacauugccagacaucagaucgucgaaguugcgggcgaugacaaauacgggcggaagauuaucguguuuagcgcuugccgcaugccucccucccaccagcucgaccauagcaagcugcugggauaucucaaacacacccuggaucaguacguggagucugacuauacacuucuguaccuccaucacggccugaccuccgauaacaagccuagccuuucuuggcugagagacgccuaucgggaguucgaucgcaaauacaagaaaaauauuaaggcccucuacaucguccacccgacaauguuuaucaagacccugcugauucucuucaaaccccugaucuccuuuaaguucgggcagaaaauuuucuaugugaacuaccuuagcgaacugucugagcauguuaagcucgaacaacugggaaucccuagacaggugcuuaaauaugacgauuuucugaaguccacacagaaaagccccgcuaccgccccuaagcccaugccgccucggcccccucuccccaaucaacaguuuggcgucucccugcagcaucugcaggagaagaaccccgagcaagaaccuauuccgaucgugcuccgcgagacgguugcuuaccugcaggcccacgcgcuuaccacagaagggauuuucagacggucugccaauacccaggugguccgcgaggugcaacagaaauauaacaugggacugcccguggacuuugaucaguacaaugaacuccaucugccugcugucauccuuaagacauuccugagagagcuccccgagccucugcugaccuuugaccucuauccccacguugugggcuuccugaacaucgaugaaagccagcgggugccggccacgcuucaaguccugcagacacucccugaggaaaauuaccaggugcugcgcuuccugaccgcuuuucuuguucagauuuccgcccacagcgaccaaaacaaaaugacaaauaccaaccucgcgguggucuucggccccaaucugcugugggccaaggacgcugccaucacccucaaagcuauuaacccuaucaacacauuuacgaaguuccugcuugaucaccagggggagcuguuucccucuccugaccccuccggacucuga

SEQ ID NO: 65996 - RNA, 3507 nt, Artificial Sequence
  derived and/or modified sequence opt5 from ARHGAP20__Homo_sapiens__NP_001245344
augagcgccagagagcggcagcccgcucugaagaaaaagaugaaaacccucgccgaacgcagacgguccgcgccuucucugauccuugacaaggcucugcaaaaacgcccgacaacgagagauagccccuccgccucuguggauaccugcacauuccucagcucccuggucuguucuaaccggacccuucugauugacggccgcgccgagcucaagagagggcugcagcggcaggaacgccaccuguuucucuucaaugaccuguuuguuguggcuaagaucaaauacaacaauaacuucaagauuaaaaauaagaucaaacuuacagauauguggaccgccagcugcguggacgaggucggagaaggcaacacaaaugcuaugaaguccuuugugcugggguggccuaccguuaacuucguggccacguuuagcucucccgagcagaaggauaaauggcucucccugcuucaaagauauauuaaucuggagaaggaaaaagacuacccuaagagcaucccccucaaaaucuucgcgaaggauauuggaaacugugccuauucuaaaaccaucacagucaugaauagcgacaccgcuaacgaggugauuaauaugagccugccuaugcugggcaucacagggucugaacgggauuaccagcucuggguuaacuccggaaaggaggaggccccguauccccugauuggccaugaauacccuuauggcaucaagaugagccaccuucgcgacuccgcucugcucacccccgggucuaaagauagcacgacaccuuuuaaucugcaggagcccuuccuuauggaacagcugccgagagagaugcaaugccaguuuauucucaagccuucccggcuggccgcggcccagcagcugagcgacucuggacauaaaaccuucaagcgcagacgguccaucaucaacugggcuuuuuggagaggcagcucuacacaccucgacaaccugcccagcuccccuaccucucccaugcccgggcaacuuuucggaauuagccugccuaauaucugugaaaacgauaaucucccgaaacccgugcuggacaugcuuuucuuucugaaccagaagggcccucucaccaaggggauuuuccgccaguccgccaaugucaaaagcugccgggagcugaaggagaaacugaacucuggaguggaagugcaucucgauugugaguccaucuuugucauugcuagcguucugaaggacuuccuuagaaauauccccggcucuaucuuuuccagcgaucuguacgaccacuggguguccgugauggaucaaggcaacgacgaagagaaaauuaauacaguccagcgccuccuggaucagcugccucgggccaacgugguucuucucagauaccuguucggggugcugcacaauaucgaacagcauucuagcuccaaccaaaugacggccuuuaaucucgcugucugcguggcgcccucuauucuguggccgccugccagcuccagccccgagcuugagaacgaguucaccaagaagguuucucugcucauccaguuucugauugaaaauugucugcgcaucuucggagaagagaucacaucccuuuuucgggaagugagcgucagaugcgacacccgcgagaacgcuucugauauuuccuguuuccagcucaacgacagcucuuaugacagccuggagaaugaacugaacgaggauguggacgccccuugcuccgaucucgucaaaaagcugggccaggggagccggucuauggacuccgugcuuacacugagcgauuacgaccucgaucaacccgaaguugagggacugcugacccuuuccgacuuugaucucgcccacucuaaagacgaggaugugcagaugaagagaccucuggaaagcaaacccgucaauauccugguguauacgaagauuccgcuccgcgaccaugcucgggccccuuccgcgaugugcacacccucuuaccugagcaccgcugccgccaacgcugccaagucccuuagacggcaccgcagauguucugagcccagcaucgauuaucuggacuccaaacucagcuaccugcgggaguucuaucagaagaaacugagaaagucuuccugcgacgcuauucuuagccagaaagaugaagacuaccucaagcaaaaucagccucugcaggaagagggcaaaaccuguuucaagcagucucugguuacagggaccgauguguccaagaaaaacgccacaacgcaaaauaccaagaaaaagagccucucuggauccgagggcaaccacgucaaacuguuuccgaaguccaagcccguggcgaucuccguggccagcuacucuccuaugagcucccaggaccauucuaaaaaucagcccuucgauguuaacacaagcggcuauuccccuccccacaccgcugacgcccuuaaggggccucgcacacaucggagaugcucugaacccaauauugaggaucaaaaccgcaaacugaccuaccucagaggaaucuauagcaagaaacagcacaagacguccugugaagcuggccugcugcauggggaggaagacuaccuuaagcggcacaaaucucugcagauggagggacagaagcucaucaaucaaagccuggucaugggcauugagguggggaaauccagcgccaccaaccagaauacagaaaaggugcucccgccucgccugaaccuuugccccagaaccucuuauuccagccugucuuccccuggcacaagccccuccggaucuagcgucuccagccaggauucugcguuuucccagaucagcgagcacucuguguucaccccgacggaaacaagcuccccuauugacuguaccuuucaagcccagcggaaacgcgaggaucucucucccgacuucagcaacgcuucccauguuucuggcaugccugggcccagcuccggacaggccugcagcagacccgcuuacacaaagaaggauaccauggaauggcacucucagaugcauuccgugacccugcacccuagcacauggcugcggaauggcgucgccucccuuaaaaacuggucucugaagaaaaaggccaaagcugcgcgcccggaggaggaaaagaucgccagccccaaagggccucucgagcccccuccccacgcuuccggagugccugaagccaauucucugcaagaggagcagaaggaccucccgcugagagccgcugaaggccuuagccccguucaguccgcccaacgguguucuucuuccccuuuucaggacagcgagcgccauugcagcucccccuucagccugguggaaucuagacucaagcuguguaugaaaagccacgaggaaauugagccugggucccagucuagcuccggcagccugcccugggagcgggcguccgcuucuagcuggacgcuugaagaugccaccuccccggacucuggaccuacagucgugugcgauaucgaggacagauaucugaccaaggauaucuga

SEQ ID NO: 65997 - RNA, 5877 nt, Artificial Sequence
  derived and/or modified sequence opt5 from ARHGAP21__Homo_sapiens__XP_005252599
augauggccaccagacggacaggccugagcgaaggggacggagauaagcucaaggcuugcgaaguguccaagaacaaagacggcaaggagcagucugaaacggucagccuguccgaggaugaaaccuucucuuggcccgggccuaaaacaguuacccuuaagcgcacaagccaaggauuuggcuucacccugagacacuuuaucguguacccgcccgaguccgccauucaguucucuuauaaggacgaggaaaaugggaaccggggaggcaaacagcgcaauagacucgagccuauggauacaaucuuugugaagcaggucaaagaaggcgggcccgcguucgaggcuggacuguguaccggcgaccggauuaucaaggugaacggggagagcguuauuggaaaaacguacucccaagugaucgcccuuauccagaauagcgauaccacacuggaacucucugucaugccuaaggacgaggauauucuccaggugcugcaguuuaccaaggacguuacagcccucgcuuauucccaagaugccuaccugaaaggcaacgaggcuuauagcgggaaugcccgcaacauccccgagccuccgcccauuugcuacccuuggcuucccucugcgccuuccgccauggcucagcccguggaaaucagcccgccugacucuucccugagcaagcagcagaccuccacgcccguccucacacaaccuggacgggccuaucggauggagauucaggugccgcccucuccuaccgauguggcuaaaagcaauacagccgucuguguuugcaacgaguccgugcgcaccgugaucgucccgagcgaaaaggugguugaccugcuuucuaauagaaacaaucauaccggccccucccaccggacagaggaagugcgcuacggcgucagcgagcagacgucucugaaaaccgugagcagaacaaccuccccuccccucucuauuccuacaacccaucugauccaccaacccgcggggagccggucccuggaaccgagcggaauccuccugaagucuggcaacuacuccgggcauagcgacggaauuucuuccagccgcucccaggccguugaggcuccuucugugagcgucaaucacuauucccccaacucucaccagcauaucgauuggaaaaacuacaagacguauaaggaguacauugacaauagacggcuucacaucggcuguagaacaauucaggaacgccuggauagccuccgggccgcuucccaaagcaccaccgacuauaaccagguggucccuaauagaacaacccugcaggggcgccggagaucuacaucccaugaucgcgugccccagagcguucaaauccggcagagaucugugucccaggagcgccuugaagacagcguccugaugaaauacugcccucggucugccagccagggagcccucacgucccccagcgugucuuucuccaaccacagaacccgcagcugggauuauaucgagggccaagacgaaacacuggagaauguuaacuccggcaccccgauuccugauucuaauggggagaagaaacagacauacaaguggagcggauuuaccgaacaggacgaucggagaggcaucugugagcggccccgccagcaagaaauucacaaauccuucagagggucuaacuuuacgguggcucccagcgucgugaauagcgacaaccggagaaugucuggacgcggcguggggagcguuucccaguucaagaagaucccuccggaccugaaaacccuccagagcaaucggaacuuucaaacaaccugcggcaugucucugcccagaggaauuucccaggaucgcagcccucuugucaaggugagaucuaauucccugaaagcgcccagcacacaugugaccaagccuucuuucucccagaaauccuucgucuccaucaaggaccagcggcccgugaaccaccuccaucaaaauagccugcuuaaccagcagacguggguucgcacagauucugccccugaccagcaaguggagaccggcaagagccccucccugucuggggcuagcgccaaaccggccccucaguccucugagaacgcuggaacaagcgaucucgaacugcccgucucccagagaaaucaggaccugucucuccaagaggccgaaaccgagcagagcgauacccuggacaacaaggaagcggugauccuucgggagaaaccucccuccggccgccagacaccgcaaccucugagacaccagagcuacauucucgcuguuaaugaucaggagacggggucugacaccacauguuggcugcccaacgaugcccggcgcgaagugcauaucaagagaauggaggaacggaaagccuccagcaccucuccucccggagacucccuggcuagcauucccuuuaucgaugagccuacauccccgucuauugaccacgacaucgcccacauucccgcuagcgccgucaucuccgcgagcaccucucaggugccuuccaucgccacgguucccccuugccuuacaaccagcgcuccccucauucgcagacaacugucucaugaucacgaaagcgugggcccuccgucccuggacgcccagcccaauucuaagaccgagcggagcaaguccuaugaugaggggcucgacgauuacagagaagacgcuaaacugucuuucaagcaugucagcucccuuaaaggcaucaagauugccgauagccagaaaucuuccgaggacagcggaucccgcaaggauucuagcuccgaaguguuuucugacgcggccaaagagggcuggcugcacuuccggccucucgugacagauaaggggaagagagucggaggcagcauccgccccuggaaacagauguauguugugcugcgggggcacucccuguaccuuuauaaggacaaaagagaacaaaccacaccuagcgaggaggaacagcccauuucugugaacgcuugucucaucgauaucuccuacagcgagacgaagcgcaaaaaugucuuucggcugaccacaucugacugcgaaugccuguuccaggccgaggacagagaugacaugcucgcuuggauuaagaccauccaggaguccagcaaccugaaugaagaggauacaggagugaccaaccgcgaccuuauuucucggagaaucaaggaauauaauaaccugaugagcaaagccgagcaacucccgaagacgccucggcagucccugucuauucgccagacccugcuuggcgccaaaagcgaacccaagacacagagcccccacagcccuaaagaggaguccgaaagaaagcuccugucuaaggaugacaccucucccccuaaagauaaggggacauggcggaaaggcaucccguccaucaugcgcaagaccuuugagaaaaagcccacagcuaccggaacguucggcguuagacuggacgauuguccucccgcgcacacaaaucgguacauuccucucaucguggacauuugcuguaagcuggucgaagagagagggcuugaauacaccggaaucuaucgcgugcccggcaacaaugccgcuauuuccagcaugcaagaggagcugaacaaagggauggccgauaucgacauccaggacgauaaguggcgggaccucaacguuauuuccucucugcuuaagagcuuuuucagaaaacugccggaaccucucuuuaccaaugauaaauacgccgacuucaucgaggcuaaccgcaaggaagauccccuggaccggcugaaaacacucaagagacugauucaugaucuuccugagcaccauuaugaaacccugaaguuucucuccgcccaccugaaaacgguggcggagaauagcgagaagaacaaaauggaaccccgcaaucuggcuaucgucuucggaccuacacuugugcggaccucugaggacaacaugacacacaugguuacccauaugcccgaucaguacaagauuguggaaacacugauccaacaccaugacugguucuuuaccgaggagggcgccgaagaaccccucacgaccguccaggaagaguccacaguggauagccagccugugcccaauauugaccaucugcugaccaacaucgggagaacaggcgucucucccggagauguuuccgacagcgccaccucugacuccacgaaaagcaagggcuccugggggagcggaaaggaucaguauucucgcgaacugcuugugagcuccaucuucgcugccgcgucuagaaaacggaagaaaccuaaggagaaagcucaaccgagcuccucugaggacgaacuggauaauguguuuuucaagaaggagaacgucgaacagugccauaaugacacaaaagaggaaagcaagaaagaguccgagacccucggccgcaagcagaaaauuaucauugccaaggaaaacucuacaagaaaggaucccagcaccaccaaagacgagaagaucucccuggggaaagaaagcacaccuucugaggaacccuccccuccccacaauagcaagcacaacaaaucuccuacgcuguccugucgguuugccauucuuaaggagagcccgcgcucccugcucgcucagaagucuagccaucuggaggaaaccggauccgauagcggcacacuccugucuaccuccagccaagccucucuugcuagauucagcaugaaaaaguccacaucucccgagaccaaacacagcgaauuucuggccaauguguccacgaucacaucugacuacagcaccaccuccagcgcgacauaucucaccucucuggauuccagccggcuguccccugagguucagucuguggccgagagcaagggcgacgaagcugaugacgagagauccgaacuuaucucugaggggcgccccgucgaaacagauagcgaguccgaguucccuguguuucccacggcccugaccagcgaaagacucuucagaggaaaacugcaggagguuacaaagucuucccgccggaacagcgaaggcucugagcucuccugcaccgaagggagccugacaucuucccuugacagcagacggcagcuguuuucuagccauaaacugauugagugugacacccucucccgcaaaaagagcgcuagauucaaauccgauucuggaagccugggcgacgccaagaacgagaaagaagccccgucccuuacgaagguguuugaugucaugaaaaaggggaagucuaccggaagccugcucacaccuacccggggcgaguccgaaaaacaagagcccacauggaagaccaaaaucgcugaccgccugaagcucagaccccgggcgccugccgaugacauguucggcguggggaaucacaaagucaacgcugaaacagccaagcgcaagucuauuagacggcgccacacgcugggaggccauagagaugccaccgagaucagcgugcuuaauuucuggaaaguucacgagcaguccggggaacgggagagcgaacugucugcugugaacagacugaagcccaaaugcuccgcccaggaccucagcauuucugauuggcuggcgcgcgagcggcuuagaacauccaccagcgaccugucucgcggagagaucggcgauccucaaaccgaaaauccguccacacgggagaucgcuacgaccgacacaccccucagccugcauuguaacaccgggucuuccagcagcacacucgccuccaccaauagaccucugcuuucuauucccccucagagccccgaccagaucaacggagaauccuuucagaaugucucuaagaacgccagcuccgcugccaaugcgcaaccgcacaaacugucugagacgccuggcagcaaggcugaguuccaucccugccuguga

SEQ ID NO: 65998 - RNA, 2145 nt, Artificial Sequence
  derived and/or modified sequence opt5 from ARHGAP22__Homo_sapiens__NP_001242953
augcugagccccaagaucagacaggcccggcgcgcuagauccaaaucucucgugaugggcgagcaaagccgguccccugggcgcaugccgugcccccacagacugggaccuguccuuaaggccggcuggcugaaaaagcagcggucuauuaugaaaaacuggcagcagcgcugguucguucucagaggggaccaacuguuuuacuauaaggauaaggacgaaaucaaaccccagggauucauuagccuucagggcacccaggugacagagcugccucccgggccugaagauccgggaaagcaucucuuugagaucucccccggcggcgcgggggaacgggagaaagugccugcuaaucccgaggcccugcugcucauggccucuagccaacgcgacauggaagauuggguccaggcuauuagacgggugaucugggccccucugggaggcgggacggcucgcagaucccacgcccauccccuugagccgcugccucccggaaucuucggccagcggcucgaagagaccguucaccaugagcgcaaguacgggccuagacuggcgccccuucugguggaacagugugucgacuuuauucgggagagaggacucacagaagagggccuguuccgcaugcccggccaagccaaccuggugcgggaucuccaggacagcuuugauugcggggaaaaaccucuguucgacucuaccacagauguucacaccguggcuucccuucugaagcucuaucugagagagcuuccggagcccgucgugccuuuugcccgcuacgaagacuuccugagcugugcucagcuccugacaaaggaugagggagaaggcacccuggagcucgccaaacaagugucuaaucugccccaggcgaacuauaaucuucugcgguacaucugcaaguuucucgacgaaguccaggccuauuccaacguuaauaaaaugagcgugcagaaccuggcuacgguguucgggccuaauauucuuagaccccaagucgaggacccggugaccaucauggagggaacaucucugguucagcaccucaugaccgugcugauucgcaagcauucccagcuguuuacagccccuguccccgaaggcccuaccagccccagagggggacuccagugugcugugggcuggggcuccgaggaaguuacgcgggauucucaaggggagccuggaggccccgggcugccggcccaccgcacaagcucccuugacggagccgcuguggcgguccugagccggaccgccccuacaggccccgggucuagaugcucccccggcaaaaaggugcagacccucccuagcuggaaaucuagcuuccgccagccgcggucccugucuggaagccccaagggcgggggauccagccuggaagucccuaucauuucuuccggcgggaacuggcuuaugaauggacucagcucucugagaggccaucggcgcgcuuccagcggggauagacugaaggacuccggcucugugcagcggcucagcaccuacgauaacguucccgccccuggacuggugcccggcaucccuuccgucgccucuauggcuuggagcggggccuccagcucugaguccagcgugggaggcucucuuuccagcuguacagcgugcagagcuucugacagcuccgcccgcagcucucugcacacggauugggcccucgagcccuccccgcugccuagcuccucugaagaccccaaaagccuggaucuugaccacuccauggaugaggcuggggccggagcuucuaauagcgaaccuuccgagcccgacucuccgacccgggagcaugccagacgcagcgaagcgcuccaaggccugguuacagagcugagagccgaacucugucggcagcgcaccgaguacgaaagauccgugaagcggaucgaggaggggagcgcugaccugcgcaaaagaaugucucggcuugaagaggaacuggaucaggagaagaaaaaguauauuaugcucgaaaucaagcugcgcaacuccgagagagcccgggaggacgcugaacgcagaaaucagcugcuucaacgggagauggaagaguucuuuagcacacucggcucucugaccgucggagccaaaggcgcgagagccccuaaguga

SEQ ID NO: 65999 - RNA, 4476 nt, Artificial Sequence
  derived and/or modified sequence opt5 from ARHGAP23__Homo_sapiens__NP_001186346
augaacggcguggccuucugccuggucgggauucccccuagaccggagccccggccuccccagcucccucugggaccccgcgacggcuguagcccuagacggccguuucccuggcaagggccucgcacccuucugcucuacaagucuccccaggauggauucggcuuuacacugagacacuucaucguuuauccucccgaauccgcugugcauugcagccuuaaagaggaagagaaugggggacggggcggcgggccguccccucgcuacagacuggaacccauggacacgaucuuugugaagaacgucaaagaggauggaccugcccaccgggcgggccuccgcaccggggacagacuggugaagguuaauggagagucugugauuggcaaaacauauagccaggucaucgcucugauucagaacuccgaugacacccucgaacugucuaucaugcccaaggaugaggacauccuucaacuggccuacagccaggaugccuaucucaaggggaaugaacccuacuccggagaggcucggagcauuccugagccgcccccuaucuguuauccccgcaaaacauacgccccucccgcuagagccucuacccgggcgacaauggugccggaaccuaccuccgcccugcccagcgacccucgcucucccgcugccugguccgauccuggccuuagaguucccccggcugcccgggcgcaucuggacaacagcucucucggcaugucccagccuagacccagccccggggccuucccucaccuguccucugagccgcgcacgccccgggcuuuuccugaacccggaagcagagugccucccucccgccuggagugccagcaagcccucagccauuggcugucuaaucaggucccucggagagcuggcgaacgccggugucccgccauggccccgagagcucgcuccgcgagccaggaucggcuugaggagguggccgcuccuagacccuggccuugcucuaccagccaggacgcccugucccaacucgggcaggaaggauggcaccgcgcccggucugacgauuaccugagcagagcuacacgguccgccgaggcgcuuggccccggggcucuggugagcccgcgcuucgaaagauguggaugggccucucagcgguccagcgccagaaccccugcuugccccacacgcgaccucccuggcccccaagcucccccuccgucuggccugcaggggcuggaugaccucggauauauuggcuaccgguccuauagccccuccuuucagagacgcaccgggcugcuucacgcccugucuuucagagauagcccuuuuggaggccuccccacguucaaccuggcccaguccccugcgucuuuucccccugaggccagcgaaccgccccgggucguucgcccugagcccuccacaagagcucuugagccucccgccgaagaccggggagaugagguggugcugcgccaaaagccgccuaccggcagaaaaguccagcucacacccgcucggcagaugaaucugggauucggcgacgaaagccccgagccugaagccucugggcgcggagagagacugggccggaagguggcgccccucgccaccaccgaggauucccuggcuagcaucccuuucauugacgaaccgacaucucccuccaucgaucuucaggccaaacauguuccugcuagcgccguggucucuagcgccaugaacuccgcucccgugcuggggacgagcccuucuucccccaccuuuacauucacccucggacgccacuacagccaagacuguuccucuauuaaggcgggcagacggagcuccuaucugcuggccaucacaaccgagagaucuaagagcugcgacgaugggcuuaauacguuucgcgacgaaggccggguucucagacgccugccgaaccggaucccuucccugagaaugcuccgcucuuucuuuacagauggaagccuggacuccuggggcaccagcgaggaugcugacgcccccucuaaacggcauuccaccagcgaucuuucugacgccacauucuccgauauuagacgcgagggguggcuguacuauaagcagauccucaccaaaaaggggaaaaaggcuggcagcgggcugcggcaguggaaaagaguguacgccgcgcugcgggcucgcucucuuucccucagcaaggaaagacgggagccuggacccgccgccgcuggcgccgcggcugccggggccggcgaagacgaggcugccccugucuguauuggauccugccugguggauaucagcuacucugaaacaaagcgcagacacgucuuucggcugacgaccgcugacuucugcgaguaucucuuucaggccgaggauagagacgacaugcugggcuggauucgcgcgauccgggaaaauagcagagccgagggggaagaucccggaugugcuaaccaagcccuuaucuccaaaaagcugaaugacuaccgcaaagugucucacagcuccggcccgaaggcugauucuagcccuaaagggucccggggacucggcgggcugaagucugaguuccugaagcagagcgccgccagaggccuucgcacacaggaccuccccgcuggauccaaagaugacagcgcggccgcucccaagaccccuuggggcauuaacaucauuaaaaagaacaaaaaggccgccccgcgggcuuuugggguuagacuggaagagugccagcccgccacagagaaucaacgcgugccucugaucgucgcggcuuguugcagaauuguggaagcccggggacucgagucuaccggcaucuaucgcguucccgggaacaaugccguggucuccagccugcaggaacagcuuaacagaggaccuggcgauaucaaucugcaagacgagcgguggcaggaucucaacgugauuucuucccugcuuaagagcuucuuucgcaaacugcccgaaccucucuucacggacgauaaguacaaugacuucaucgaggcuaacagaauugaggaugcccgggaaagaaugcgcacccugcggaaacugaucagagaccucccgggccauuauuacgagacacugaaguuucuuguggggcaccugaaaaccauugcggaccauuccgaaaagaauaagauggagccccgcaaccucgcucugguuuucggaccuacacugguccggaccucugaggauaauaugacggacauggugacacacaugcccgauagauauaaaaucguggaaacccuuauucagcauagcgacugguuuuucuccgaugaggaagacaagggcgagcggacaccugucggggauaaagaaccccaggccgugccgaacaucgaguaccugcucccuaauaucggacgcaccguuccucccggcgaccccgggagcgauucuaccacauguuccagcgccaagucuaaaggaagcugggcucccaagaaagagccuuacgccagagaaaugcuggcuauuuccuuuaucucugccgugaaccggaagcgcaagaaaagacgggaggcgcgcggccucggcagcuccacggacgaugacucugaacaagaggcccacaagccgggggcuggagccaccgcucccggcacacaggaaagaccucaggggccccugccuggagccgucgcccccgaggcuccgggccggcuuagcccucccgcggccccugaggaacgccccgcugccgacaccagauccauugugagcggguauucuacacuguccaccauggaucggagcguuugcuccggagccucuggcagacgcgcuggcgccggggacgaggcggaugacgaacggagcgagcucucccacguggaaacggauacagagggagcugccggcgccgggccuggaggcagacugacccgccggcccucuuucagcucccaucaccugaugccgugugacacccuugcuagacgccggcuggccagagggcgcccugauggagagggcgcgggccgcgggggacccagagcccccgaaccuccgggcagcgcuucuuccagcucucaggagucccuccggcccccugccgcugcccuggcuagccggcccucuagaauggaagcccuccgccugagacuucgggggacagcggacgauaugcuggccguccgccucagacggccucugagccccgagaccagacggcgcagauccucuuggcggcgccauacagugguugugcaaagcccucugacggaccuuaauuuuaacgaguggaaagaacugggaggcgggggacccccggagccugcuggcgccagagcucacuccgauaacaaggacagcggccucuccucucuggaaagcaccaaagcccgggcccccuccucugcugcgagccagccucccgccccgggggauacaggaucccuccagucucagccuccccgcagaagcgcugccucccggcugcaccaaugccuuuga

SEQ ID NO: 66000 - RNA, 1968 nt, Artificial Sequence
  derived and/or modified sequence opt5 from ARHGAP24__Homo_sapiens__NP_112595
augcccgaggacagaaacagcggcgggugcccugccggagcucuggccuccaccccguucauccccaagacaacguaccggcgcauuaaaagauguuuuucuuuccggaagggcaucuuugggcagaaacucgaagauaccgugcgcuaugagaagagauacggaaaucggcuggcgccuaugcuugucgaacaaugcguugacuucauucgccagagaggccugaaagaggaagggcucuuucggcugcccggacaggcuaaccuugugaaggagcugcaggaugccuucgacuguggcgagaagccuagcuuugauuccaauacagacgugcacaccgucgccucucuccugaaacuguaucuccgcgaacugcccgagccugugaucccguacgcuaaguaugaagauuuccuuagcugcgccaaacugcucuccaaggaggaggaagcuggcguuaaagagcuggccaagcaagugaagucucuucccgucgugaacuacaaucugcucaaauauauuuguagauuucuggacgaaguucagagcuacuccggggugaacaagaugagcguccagaaucuggcgacaguguucggaccuaacauccuccggcccaaaguggaggauccucugaccaucauggaaggcacagucguugugcagcaacuuaugucugugaugauuuccaagcaugacugccuguuucccaaagaugccgagcuccagagcaagccgcaggacggggucucuaauaacaaugagauccagaaaaaggcuaccaugggacaacugcagaacaaggaaaauaacaauacgaaagauuccccuagccgccaguguucuugggacaaguccgagagcccccaaagauccucuaugaacaacggcagcccuaccgcccuuuccgggagcaaaacaaauucucccaagaacuccgugcacaaacuggacguuagccggucucccccucucauggugaagaagaauccggcuuucaacaaaggaagcggcauugucaccaauggcuccuuuucuagcuccaacgccgaagggcuggagaagacacagaccacgcccaauggaagccugcaggcgcgcagaucuuccagccucaaagugucuggcacaaagauggggacccauuccguucagaacggaacagugcggaugggcauccugaauagcgauacccuugggaacccuaccaaugucagaaacauguccuggcugcccaauggauacgugacacuccgcgacaacaaacaaaaggaacaggccggcgagcugggccagcacaaucggcuuucuacguaugauaacguccaucagcaauucagcaugaugaaccuggacgauaagcaguccauugacucugcuaccuggagcacauccagcugcgagaucucucucccugaaaauuccaacagcuguagaucuuccaccacaaccugccccgagcaggauuucuuugggggaaauuucgaagacccggugcuggauggcccuccccaggacgaucugagccacccucgcgacuacgagucuaaaagcgaccaccgguccguugggggaagaagcucucgcgccacguccagcuccgauaacucugaaacauuugugggcaauagcuccucuaaccauagcgcucuccacucccuggucucuagccuuaagcaagagaugaccaaacagaagauugaguaugaaucccggaucaaaagccuggagcagagaaaucucacccuggaaacagagaugaugucucugcaugacgagcuugaucaggaacgcaagaaguucaccaugaucgagauuaaaaugcggaacgccgaaagagccaaggaggacgcugaaaaacgcaaugauaugcuccaaaaggagauggagcaguuuuucuccacauuuggggaacugacgguggagccccggagaaccgaacggggcaacacaaucuggauucaguga

SEQ ID NO: 66001 - RNA, 1941 nt, Artificial Sequence
  derived and/or modified sequence opt5 from ARHGAP25__Homo_sapiens__NP_001007232
augagccugaagcuccccagaaacugggacuucaaucugaaaguggaggccgcuaagaucgcccggucccgcucugucaugaccggcgaacagauggcggcuuuucacccuagcuccacaccgaacccccuugagagaccuauuaaaaugggguggcugaagaaacaacggucuaucguuaagaauuggcagcagcgcuacuucgugcucagagcccagcaacuguauuacuauaaggaugaagaggacacgaaaccccagggaugcauguaccuuccuggcuguaccauuaaggaaaucgccacaaaccccgaggaggcugggaaauuuguguucgaaauuaucccugccagcugggaucagaaucggaugggacaggacuccuauguccugauggcuucuagccaagccgagauggaagagugggugaaguuucuccgcagaguugcgggcaccccgugcggggccguguucggacagcggcuggaugagacagucgcuuacgaacagaaauuuggcccccaucuggugccuauccucguugagaagugugccgaguucauucuggagcacggccgcaacgaagaggggaucuuuagacuucccggacaggacaaucuggugaagcaacuccgggaugcuuucgacgccggcgagcgcccuuccuuugauagagacaccgauguccauacaguggcgagccugcuuaaacuguaucuccgggaccugcccgaaccgguggucccuuggucucaguacgagggguuccugcucugcggacagcugaccaacgccgaugaagcuaaggcccaacaggagcuuaugaaacagcuguccauucucccccgcgacaauuacagccugcuuucuuauaucuguagauuucugcacgaaauucagcucaacugcgcuguuaauaagauguccguggacaaccuggccacggugaucggcgucaaucugauucggagcaaaguggaggauccugccguuaucaugagagggacaccccaaauccagcgcgugaugaccaugaugauucgggaccaugagguccucuuccccaagucuaaagauaucccucuguccccgcccgcucagaagaacgacccuaagaaagcgcccguggccagaagcuccguuggaugggaugcuaccgaagaccuucgcauuucucggacagauagcuucuccagcaugaccucugacuccgauacgacaagcccuaccggccagcaacccucugacgccuuuccggaggauagcuccaaggugccuagagaaaaacccggcgacuggaagaugcagucucgcaaacggacacagacccugccuaauagaaaguguuuccucaccagcgccuuucagggggcuaacuccagcaagauggagaucuucaaaaacgaauuuuggucucccuccagcgaggccaaggcgggagagggccaccgccggacaaugucucaagaccugagacagcuuuccgauagccagcgcacguccaccuacgacaaugucccuucucugcccgggagcccgggagaagaggcuuccgcccucucuagccaggccugcgauuccaaaggcgacacacuggcuagcccuaacucugaaaccgggcccggaaagaaaaauuccggcgaggaggaaauugauagccugcaacggauggugcaggagcucagaaaggaaaucgagacacagaagcaaauguaugaagaacagaucaaaaaccuggagaaggaaaauuacgacgucugggccaaagugguucggcuuaacgaggaacuggagaaggagaaaaagaagucugcugcccucgaaauuucccugcgcaauauggagagaagccgggaagauguggagaaaagaaacaaggcgcuggaagaggaagucaaagaguucgugaagucuaugaaagagcccaagaccgaagccuga

SEQ ID NO: 66002 - RNA, 2280 nt, Artificial Sequence
  derived and/or modified sequence opt5 from ARHGAP26__Homo_sapiens__NP_001129080
augggccugcccgcccucgaguucagcgacugcugucuggauuccccucacuuuagagaaacccuuaagucucaugaggcugaacuggacaaaacaaacaaguucaucaaagagcucauuaaggaugggaaaagccugaucuccgcccuuaagaaucugucuagcgcgaagcggaaauuugcugacucccucaacgaguucaaguuucagugcauuggagaugccgaaacggacgaugagauguguaucgcccgcucucugcaagaguucgcuaccgugcugagaaaucucgaagacgaacggauucgcaugaucgagaacgccagcgagguccugaucacaccgcuugaaaaauuuagaaaggagcagauuggcgcugccaaagaagcgaagaagaaauacgauaaggagaccgaaaaauauugcgggauccuggagaagcaccucaaucuguccagcaaaaagaaagagucucagcuucaggaagccgacucccaaguugaucuggugcggcagcauuucuacgaggugagccucgaauaugucuuuaaggugcaggagguucaggaacgcaagauguucgaguuuguggagccccugcuggcuuuccuccaaggacuguuuacauucuaccaccauggcuaugaacuugccaaagacuucggggauuuuaagacccagcugacaauuucuauccagaacaccagaaaucgguucgagggaacgcgcuccgaagucgagagccucaugaaaaagaugaaagaaaacccucuggagcacaagaccauuucucccuacacaauggagggcuaucuuuacgugcaggaaaagagacacuuuggcaccuccuggguuaaacauuacuguacauaucaacgggacagcaagcagaucaccauggugccuuucgaccagaaauccgggggaaagggcggggaggaugaaucugucauucugaaaagcugcacgcgcagaaagacagacuccaucgagaagcgguuuuguuucgauguggaggcuguggaccgccccggagucaucaccaugcaagcccucagcgaagaggauagacggcuguggauggaagcgauggacggcagagagccuguuuacaauucuaacaaagauucccagagcgaagggacagcccagcuggacucuauuggauuuagcaucauucgcaagugcauccacgcuguggagacccggggcauuaaugagcagggccucuauagaaucgugggggucaacucccgcgugcaaaaacugcuuucuguucugauggauccgaagaccgccagcgaaacagagacggacaucugugcugaaugggagauuaaaaccaucacauccgcccucaagaccuaccugcggaugcuucccggaccucugaugauguaucaguuccagcgcagcuuuauuaaggccgcuaaacucgaaaaucaggagucuagaguguccgagauccauagccugguccaccggcugcccgaaaagaacagacaaaugcuccagcugcuuaugaaucaccuggcgaacguggccaacaaucauaaacagaaccucaugacaguugcuaaucugggcguggucuucgggccuacccugcuucgcccccaggaggaaacgguggccgccauuauggauaucaaguuucaaaacaucgucauugagauccucauugaaaaucacgagaaaaucuucaacacagugccggacaugccucugaccaaugcucagcugcaucucucucggaagaaauccagcgacuccaagcccccuucuugcagcgagagaccccugacccuuuuucacacaguucaguccaccgaaaagcaggagcaacgcaacucuauuaucaauagcucccuggaaagcgugucuuccaaccccaauagcauucucaacucuuccagcucucugcagccuaauaugaacagcuccgauccggaccuggccgucgugaaacccacacggccuaauagccuucccccuaaccccucuccgacguccccucucagccccuccuggccuauguucucugcgcccagcuccccuaugcccaccucuagcacauccucugauagcuccccgguuagcaccccuuucagaaaggcuaaagcccuguacgccuguaaggcugagcaugacucugagcuguccuuuacagccggaaccguguucgauaacguccaccccagccaggaacccggcuggcucgaggggacgcugaauggaaaaaccggccuuaucccugaaaacuauguggaguuucuguga

SEQ ID NO: 66003 - RNA, 792 nt, Artificial Sequence
  derived and/or modified sequence opt5 from ARHGAP27__Homo_sapiens__NP_777579
auggccgcugacguggucggcgauguuuacgugcugguggagcaccccuucgaauauaccgggaaggacggacgccgggucgccauccgcccuaacgagagauaccggcuccugcgcagaagcacagaacauugguggcacgugcggcgcgagccgggcgggagacccuuuuaucuuccugcgcaguacguucgggaacugcccgcucucggaaauccugccgccgcugcucccccuggcccgcaucccuccccugcugcccccgagccucuggcguaugauuaccgcuucgugucugccgcugccacggcugggcccgacggagccccggaggaaagcggcggcagagcguccucucuuugcgggccugcccaacggggagcugccacccagcgcagcucccuggcucccggccucccugccugucuguaucugagacccgccgcucccguccggccugcgcagucucucaacgaucuggccugcgcugccgugagcccgcccgccgggcuucugggauccagcggcucuuuuaaagccuguuccguugccgggagcugggugugcccucgcccccucgcgagaucugacuccgagaaugucuacgaagugauucaggaucugcacgugccucccccggaggagagcgcugaacaagucccuccccgggcccuuggaagaggcggcggguggcgcgcccgggacagagcucgcacagagccuggacggaaggaaaccagaucugcccagcgccgggcuagaagacccccucuguccgaggauuucggcuga

SEQ ID NO: 66004 - RNA, 1713 nt, Artificial Sequence
  derived and/or modified sequence opt5 from ARHGAP28__Homo_sapiens__NP_001010000
augagaaagaaagacaagcagagcauccgggaugugcgcgacauuuucggcgucuccgagucucccccuagagauaccugcgggaaccacacaaaucaacuggacggaacgaaagaagagagagaacucccgcgcguuaucaagaccagcggcuccaugcccgaugacgccucucugaacagcacaacccuuuccgaugcuucucaggacaaagaggggagcuuugccgugccuagauccgauagcguggcgauucuggaaacaauccccguccucccugugcauucuaauggaucccccgagccuggccagccgguucagaacgcuauuagcgacgaugacuuccuggagaagaauauucccccugaagccgaggaacuuucuuuugagguguccuacagcgagauggucaccgaagcccugaagcggaacaaacucaagaaaucugagaucaagaaagaagauuaugugcugacaaaguucaauguucaaaagacccgcuuugggcugacggaggcuggagaccucuccgccgaagacaugaaaaagaucagacaccugagccuuaucgagcugaccgcuuucuuugaugccuucggcauucagcucaaacggaacaagacagagaaagugaagggccgcgacaaugggaucuuuggagucccccugaccgugcuucuggauggcgaccggaaaaaggauccuggggugaaggucccccucguucugcagaaauucuuugaaaagguggaggaauccggacuggagucugaaggcauuuuccggcucagcggguguacagcgaaagugaagcaguaccgcgaggagcuggacgccaaauuuaacgcugauaaguucaagugggacaaaaugugccauagagaagccgcugucaugcuuaaggccuucuuucgggagcugccgaccucccucuucccuguggaauauauccccgcguuuauuagccugauggagcgcggaccucacguuaaagugcaauuccaggcccuucaucugauggucauggcucuccccgaugccaauagagacgcugcccaggcccugaugacguuuuucaacaaggugaucgcuaaugaaucuaaaaaccggaugucccuguggaauaucagcacaguuauggcgcccaaccucuuuuucucuagaagcaagcacuccgauuacgaggagcugcuucuggccaacaccgcugcccacauuauccgccucaugcugaaguaucagaaaauucuuuggaaggugccuucuuuucugaucacacaaguccggagaaugaaugaagccaccaugcuccugaaaaagcagcugccgagcgugcgcaaacuccugcggagaaagacccuugagcgcgaaacagcuucccccaagacgagcaaaguccugcagaagucuccuuccgcccggagaaugagcgacgugcccgagggcguuauucgcgugcaugcgccucuccugucuaaagucuccauggcuauccaacugaacaaucagaccaaggccaaagacauccuugccaaguuccaguacgagaacagccacggcuccucugaauguauuaaaauccagaaucaacggcucuaugagauugggggaaacaucggcgaacauugccuggaucccgacgcuuacauucuggauguguacagaaucaauccgcaggccgaguggguuaucaagccucagcagagcuccuga

SEQ ID NO: 66005 - RNA, 3306 nt, Artificial Sequence
  derived and/or modified sequence opt5 from ARHGAP30__Homo_sapiens__NP_001020769
augaaguccagacagaaaggcaagaaaaagggguccgccaaagagcggguguucggaugcgaccugcaagaacaccuccagcauucuggccaggaggucccccagguucugaagucuugugcugaauuuguggaggaauacgggguggucgauggaaucuaucgccuuuccggcgugucuagcaacauucaaaagcugagacaggaguucgaguccgaacggaaaccugaccuccgcagagauguuuaccugcaggacauccacugcgugucuagccuuuguaaggccuauuuucgggagcugccggauccccuccugaccuaccgccuguaugacaaauucgcggaagcugucggggugcagcucgagccugagagacugguuaagauucuugaagugcugcgggagcuccccgucccuaauuaccgcacacuggaauuucuuaugagacaucuggugcacauggccuccuucagcgcccaaacgaacaugcaugcucggaaucucgccaucgugugggcucccaaccugcugcgcucuaaagauauugaggccuccggauuuaauggcaccgcggccuucauggaagucagaguucagagcaucgugguggaguuuauccucacacacgucgaccagcuguucggcggggcugcccuuucuggaggcgagguggaauccggguggcggagccugccuggaacccgcgcuucuggcuccccggaggaucucaugcccagaccucugcccuaucaccuuccuagcauucugcaggccggggacggacccccgcaaaugcggccuuaccauacaaucauugaaaucgcggagcacaagagaaagggcucccucaaaguucgcaaguggcggucuauuuuuaaccugggcagaagcgggcaugaaaccaaacgcaagcugccccggggagccgaggauagagaggacaaauccaauaagggcacacuccgcccugcuaaaagcauggauucucuguccgccgcugccggggccagcgacgaacccgagggacuugugggccccucuagcccucggccgagcccccugcucccugaaucucuggagaacgacagcaucgaagcugcggagggggagcaggaacccgaggccgaagcucuuggaggcaccaauuccgagccuggcacgcccagagccgggcgcagcgccauucgggcuggaggcagcuccagagccgagcgcugcgcggggguccacaucagcgauccguacaacgugaaucugccucuccacaucaccucuauucuguccguucccccuaacaucauuagcaaugugucccuggcucggcucacaagaggacuggaaugucccgcccuucagcaucggccuucucccgccagcggcccggggccuggccccggacugggccccgggccuccggacgagaagcucgaggcuucccccgccucuagcccucuggcugauuccggacccgacgaucuggccccugcgcuugaggacagccucucucaagaaguccaggauuccuucagcuuucuggaggacucuuccagcucugagcccgaaugggugggcgccgaggauggggaagucgcucaggccgaggcugccggagcggccuucagcccuggcgaagacgaucccgggaugggcuaucuggaggagcuccugggagugggcccgcagguugaagaguucuccguggaaccuccccuugacgaccugagccucgaugaggcucaauuuguccuggccccuucuugcuguucccuggacagcgcugggccccgcccggaaguggaggaggaaaacggagaggaaguuuuccuuuccgccuacgaugaccucucuccucugcugggccccaagccucccaucuggaaagggagcggaucccucgagggcgaggccgcugggugcggcagacaggcgcugggacagggcggggaagaacaggccuguugggaagugggagaggauaagcaagcugaacccggcgggcggcuugacauuagagaggaggccgaaggaucuccugagaccaaagucgaagccggcaaggcuagcgaggaucgcggggaagccggcggaucccaggagacaaaagugcggcugagagagggcucucgcgaagagaccgaagcgaaggaggaaaagagcaaagggcagaagaaagcugacuccauggaggccaagggaguggaggaaccgggcggggaugaguauacggacgaaaaagagaaggagaucgaaagagaggaagaugagcagcgggaagaggcccaaguugaggcuggacgcgaccucgaacagggcgcccaggaggaucaggucgcggaagagaagugggaaguggugcaaaaacaggaggcugagggcgucagagaagacgaggacaaggggcagcgggaaaaaggauaccacgaggcccgcaaggaucaaggcgacggggaagauagcagaucucccgaggccgcuacagagggaggcgccggggaaguguccaaagagcgggaaagcggagacggcgaggcugagggcgaucagcgcgccgggggauauuaccuggaagaggacacccugucugaaggcuccgggguugcgagccuugagguggauugcgccaaggaaggaaauccucauucuuccgagauggaggaagucgcuccccagccuccccagccugaggaaauggagccggaaggccaacccagcccugacgggugucucugccccugcucccugggacugggcggcguggggaugagacucgccagcacacugguucaggugcagcagguccggucugugccuguugugcccccgaagccucaauuugcuaaaaugcccagcgccauguguuccaagauccacgucgcccccgcuaacccuugcccccgcccuggaagacuugauggcaccccgggggagcgggcguggggaucuagagccagccgcuccucuuggcggaacggcgggagccuguccuucgacgcugccguggcccucgcuagagaucgccagcggaccgaggcccagggagugagacgcacacagacguguaccgaaggcggcgacuauugccugauuccccggacaucuccuuguagcaugaucuccgcgcauagccccagaccucugucuugccuugagcuccccuccgaaggggcugagggaagcggcucucgcucccggcugagccugccgccuagagaaccccaagucccugauccccuccuguccucucagcggcgcagcuacgccuuugagacccaggccaauccugggaaaggagagggccuuuga

SEQ ID NO: 66006 - RNA, 4335 nt, Artificial Sequence
  derived and/or modified sequence opt5 from ARHGAP31__Homo_sapiens__NP_065805
augaagaacaaaggcgccaagcagaaacugaagagaaaaggggcugccagcgcguucggaugcgaccucaccgaguaccuggaauccucuggccaagaugugcccuauguccuuaagagcugugcugaguuuaucgaaacacacgggauuguugacggaaucuaccggcuguccggcgugacgucuaauauucagcgccucagacaggaguucgggagcgaucagugcccugaccugacccgggaaguguaucuucaagauauccacugugucggaucccugugcaagcucuacuuucgcgagcugccgaacccccugcucacauaugagcuguacgaaaaauucaccgaggccgugucucacuguccugaagagggccagcuugcccgcauucagaauguuauccaggagcugcccccuagccauuaucggacacucgaauaccugauccgccaccuugcucauauugccuccuuuagcucuaagaccaacaugcacgcuagaaaucuggcccucgugugggcgcccaaccugcugcgguccaaagagaucgaagccacaggcugcaauggggacgcugccuuccucgcuguccgcgugcaacagguugugauugaguuuauccugaaccacgucgaucagauuuucaauaacggagccccuggcagccuugaaaaugacgagaacagaccgaucaugaagucucugacccuccccgcgcugucccuuccuaugaaacuggugagccucgaggaagcccaggcucggucucuggccacgaaucaucccgcucgcaaggagagacgggaaaacucccugccugagauugugcccccgauggggacccucuuucacacaguccuggaacuuccugauaauaagcgcaaacugagcuccaagucuaaaaaguggaaaagcaucuucaaccucggaagauccggcagcgacucuaaguccaaacugagccggaacgggucuguuuuugugagaggacaacgccuuagcguggagaaggccaccauccggcccgccaaguccauggauucucuguguagcgucccuguggagggcaaagaaacaaagggcaauuucaacagaaccguuacgacagggggauuuuucauucccgcuaccaaaaugcauuccacaggcaccgggagcucuugcgaccucaccaagcaggagggagaauggggccaggaggggaugcccccuggagcggaaggcggcuucgauguguccagcgaccgcucucaucugcaaggggcccaggcucggccgcccccugagcagcugaaagucuuuagacccguggaggacccugaauccgagcagacagcccccaagaugcucggaauguucuacacgagcaaugauuccccgucuaagagcguuuuuaccuccucucuguuccaaauggaaccuagcccccgcaaccagcggaaagcccuuaauaucuccgagccuuuugcugugagcgucccccugagagugucugccgucauuuccacaaacagcaccccuugucgcacacccccgaaggagcuccagucucuguccagccuggaagaguucucuuuucacggcagcgaauccgggggauggccugaggaagagaaaccccuuggcgcggagaccagcgcugccucugugcccaagaaagccgggcucgaagacgcuaaggccguuccugaggcuccgggcacgguggaaugcuccaagggacugagccaggagcccggcgcccaccuggaagagaaaaagacaccugaguccucucucagcucccaacaccugaaugaacuugagaaacggcccaacccugaaaaggucguggaggaagggagagaggcgggagagauggaaucuagcacccugcaggagucccccagagcccgggcugaagccguucuccugcaugagauggaugaggacgaucuggcuaaugcccuuaucuggccugaaauucagcaggagcucaaaaucaucgaaucugaggaggaacugagcucccugcccccgccugcgcucaagaccagccccauucaaccuauccuggagucuucccuuggccccuucauuccgagcgaaccucccgggucucugccuuguggauccuuucccgcccccgugagcacaccucucgaggucuggaccagagacccggcuaaccagucuacacagggcgccuccacggcugccagccgggaaaagcccgagccugaacaggggcugcaccccgaucuggccucccuugcuccucucgagaucgugcccuucgagaaagcgagcccucaagccaccguggaaguuggcggaccgggcaaucugucucccccucugcccccugcucccccgccucccacaccccucgaggaaagcaccccuguccugcuuuccaagggcggacccgagcgcgaagacucuagcagaaaacugcggacagaucucuauauugaccagcugaagucccaggauucuccugagaucagcucccugugccaaggcgaggaagccaccccgagacauucugacaaacagaacagcaagaaugccgcuuccgaggggaaaggaugcggcuuucccagcccuacgcgcgaaguggagaucgugucucaggaggaagaggacgucacccacuccgugcaggaacccagcgauugugacgaggaugacacaguuaccgauauugcccaacacgggcuugaaaugguggagccuugggaggaaccccagugggucacaucuccgcuccauuccccuacccugaaggacgcgcacaaggcucaggugcagggccugcaaggacaucagcucgagaaacggcugagccacagacccucccuucgccagucucacagccuggauuccaagccuacgguuaaaagccaguggacacucgaagugcccucuuccagcucuugcgccaaccuggagaccgaaagaaauagcgacccucugcaaccccaggccccgcggcgcgagaucacaggcugggaugagaaggcucuuagauccuuccgggaauuuucugggcugaaaggagccgaggcgccucccaaccagaagggccccagcgggguccaaccuaacccggcugaaaccucccccauuucucucgccgagggaaaggaacugggcacccaucucgggcacagcuccccucagauccgccagggcggagugcccggcccugagagcucuaaagaguccagccccuccguucaggacucuacaagcccuggggaacauccggccaagcugcaacuuaaauccacggaguguggacccccuaagggcaaaaauagacccucuagccugaaccucgauccugcuauucccaucgccgaccuguucugguucgaaaauguggcuuccuuuagcucuccggggaugcaggucuccgagccuggagaucccaaggugaccuggaugacaagcucuuacugcaaggccgaccccuggcggguguauucccaggacccucaggaucuggacauugucgcgcacgcccuuaccggccgcagaaacagcgcucccguuucugugagcgccgugcggacauccuucauggucaaaaugugucaagcucgcgccgugccuguuaucccgcccaagauccaguacacccagauuccucagccccugccuucucaaagcuccggcgagaauggggugcagccccucgaaagaagccaggagggaccguccucuacgagcggcacaacccagaaaccugccaaggaugacucccccucuagccuggaauccucuaaagaggaaaagccuaagcaagaucccggggcuaucaaaagcuccccugucgacgcgaccgcccccugcaugugugagggaccgacacucagcccugagcccgggucuuccaaccugcuuagcacccaggaugcugugguucagugccggaagagaaugucugaaacagagcccuccggggacaaucugcucagcucuaaacuggaacgcccuuccggaggcagcaagccguuucaucgguccagacccggccgcccucaaagccugauucuuuucucucccccuuuucccaucauggaucaucugccucccagcuccacggugaccgacucuaaaguccuccugagcccgauucgguccccuacacagaccgugucucccgggcuccuguguggagagcuugccgaaaacacauggguuaccccugagggcgugacgcugagaaauaagaugaccauccccaaaaacgggcagcgccuggagacaagcaccuccugcuucuaucagccgcaacggagaucugucauccucgauggacgcagcggccggcagauugaauga

SEQ ID NO: 66007 - RNA, 6264 nt, Artificial Sequence
  derived and/or modified sequence opt5 from ARHGAP32__Homo_sapiens__NP_001136157
auggagaccgaaagcgaguccucuacacugggcgacgauagcguguucuggcucgaauccgaggucaucauucagguuacggacugcgaagaggaggaaagagaggaaaaguuucggaaaaugaagucuagcgugcacuccgaggaggaugacuucgugcccgaacugcaucgcaacguccacccuagagagcggccggauugggaagagacccuuucugccauggcucgcggggccgacgugcccgaaaucccuggagaucugacacucaaaaccuguggcagcacagcguccaugaagguuaaacaugugaagaagcugcccuuuaccaaagggcacuucccuaagauggcugagugcgcccauuuucacuacgagaaugucgaauucggaagcauucaacuuucucuguccgaggaacagaacgaggugaugaaaaauggcugugaaagcaaggagcucguuuaucuggugcagaucgccugccaggggaaaucuuggauugucaagagauccuacgaggacuuucgggugcuggauaagcaccuccaucuguguaucuaugaccgcagauucagccaacuuucugaacugccccgguccgauacacucaaagacagcccugaguccgugacccagaugcugauggcuuaccuuucucgccugagcgccaucgcuggaaacaagauuaauugcggcccggcccucacguggauggaaaucgauaacaaaggcaaucaccugcugguccaugaggaauccagcauuaacacccccgcgguuggggccgcucacgugaucaagagauauacagcccgggcuccugacgagcucacccuggaggugggagacauugucucugugaucgauaugcccccuaaaguucuuuccacaugguggcgcggcaagcacggguuucaggugggacuguuccccggccauugugucgaacucauuaaucagaaagugccgcaaagcguuaccaacucugugccuaagcccgucagcaagaaacacgggaagcugaucacguuucuuagaacauucaugaaaucccggccuaccaagcagaaacugaagcagcgcggaauccucaaggagagaguguuuggcugcgaccugggcgaacaucugcucaauucuggguucgaggucccccaggugcugcaaagcuguacagccuucauugagcgguacggaaucguugauggcauuuauagacuuuccgggguggcgagcaacauccagcgccugcggcacgaauuugacucugagcauguccccgaucucaccaaagaaccuuacgugcaggacauucacuccguuggaagccugugcaagcuuuacuucagagagcugccgaauccccuccugaccuaucaacuguacgaaaaauuuucugaugccguguccgcugccacagacgaggagcgccucaucaagauccacgaugucauucagcagcugccucccccucauuaucggacgcuugaauuccugaugagacaccucagccugcuggcugacuacuguuccaucaccaacaugcaugccaaaaaucuugccauugugugggcucccaaccuccugcgcucuaagcagaucgagagcgcgugcuuuuccggcacagccgcuuucauggaagugcggauucaaucuguugucguggaguuuauccugaaccacguggauguccucuucagcgggagaaucuccauggccaugcaggaaggagccgcuagccugucucgcccgaagucccuucuggugagcucuccuuccaccaaacuccugacacuggaggaggcccaggcgcggacccaggcucaaguuaauagccccauugugacggaaaacaaguauaucgaggucggcgaaggcccugccgcccuucaggggaaauuucacacaauuaucgaguucccccucgaaagaaagcgcccucagaauaaaaugaagaagucucccgugggaagcuggcgguccuuuuucaaccugggcaaaagcucuuccguuagcaagagaaaacugcagcggaaugaguccgagccgucugaaaugaaggcuauggcccucaaagggggacgcgcugagggcacccugagaagcgccaaguccgaagagucucuuaccagccugcaugcgguggacggggacuccaaacucuuucggccuagacgcccccggucuagcuccgaugcccugagcgcuucuuucaacggcgagaugcugggaaauagaugcaacuccuacgacaaucuuccccacgauaacgaaagcgaggaagagggcgggcuccugcauauuccugcccugaugucuccgcacuccgcugaagacgucgaucucagccccccugacaucggaguggccucucuggauuucgaccccauguccuuucaauguagcccucccaaggcggaguccgagugccuugaaagcggcgccucuuuccuggauagcccuggguauuccaaggacaaacccucugcuaauaagaaagaugccgagacaggaagcucccagugucagaccccgggcucuacagcuagcuccgaaccuguuucuccccuccaggagaagcugagcccuuuuuucacgcuggaccuuucccccaccgaagauaaaagcucuaagccguccagcuuuacagagaagguggucuacgccuucucuccuaaaauugggcgcaagcucuccaaaagccccuccaugucuaucagcgagccuaucuccgugacccugccccccagagugagcgaagucauuggcacaguuucuaacaccacggcccaaaaugcuuccagcucuaccugggacaagugcguggaggaacgggacgcgacaaaccgcagcccuacccagaucgugaaaaugaagacaaaugagaccgucgcccaggaagcuuacgaguccgaggugcaaccgcuggaucagguugccgccgaagagguggaacuccccggaaaggaggaccagucugucagcuccucucagagcaaagcuguggccuccggccaaacgcagacaggggcgguuacccaugauccuccccaggacagcgugccugucucuuccgugagccugauucccccuccgcccccucccaagaacguugcuagaaugcuugcccuggcccucgcugaguccgcccagcaagcgucuacacagagccugaaacggccuggaaccucccaggcuggcuauaccaacuacggggauaucgccguggccacaacggaagacaaucugucuagcuccuauagcgcugucgcccuugauaaggcuuacuuucagaccgaccgccccgccgagcaauuccaccugcagaacaaugcgccgggaaacugugaucacccucuccccgaaacaaccgccacaggcgaccccacccauucuaauacgacagaguccggggaacagcaccaucaaguggaucugaccggcaaccagccucaccaggcuuaucucagcggagaccccgagaaagccagaauuaccucugugccucuggauuccgagaagagcgacgaccaugucucuuuuccggaagaucagagcggcaagaauuccaugcccacaguuucuuuccuugaccaagaucagagcccuccccgguuuuacuccggggaccagccucccagcuaucugggagcuuccguggauaaacuccaccacccgcuggaguucgccgacaagucuccuacccccccuaaccugcccagcgauaaaaucuacccucccuccggcucuccggaagagaauacaagcacggccaccaugacauacaugaccacaaccccugcuacggcgcagauguccaccaaggaagccucuugggacguggcugagcaacccacaaccgccgauuuugccgcugccacacuucagcgcacccauagaacaaaccggccccugccuccgcccccuagccagcgcuccgcggagcagcccccugucguggggcaaguucaggcugccaccaauaucggacucaacaauagccacaaagugcagggcgucgugcccguuccugaaagaccgcccgagccucgggccauggacgaucccgcuucugccuucauuuccgacagcggggcggcugccgcccagugcccuauggcuacggccgugcaacccggccugccggaaaaggucagagacggagcucgcgugccucuccugcaucuucgggccgagucuguccccgcgcaccccuguggcuucccugccccccugccuccgacaagaaugauggaauccaaaaugaucgcugccauucacagcucuuccgcugaugccaccagcuccagcaacuaucauucuuuugugaccgccagcuccacaucuguugacgaugcucucccccugccucugcccgugccucagcccaagcacgcgagccagaagaccgucuacuccucuuucgcccgcccggacgugacgacagagccuuuugggcccgauaauugccuucauuucaacaugaccccuaacugucaauaucggccccagagcguuccuccccaccauaauaaacuggagcagcaccagguguacggagcuagauccgaaccgccugccucuaugggccuccgcuauaacacauacgucgcccccgggcggaaugcuagcggacaccauuccaagcccugcagcagaguggaguaugugucuucccugagcucuuccguucgcaacaccuguuacccugaagacaucccgcccuacccuacaauucggagaguccaaagccuccacgcccccccuuccucuaugauccggagcgugcccaucucccgcaccgaggugccucccgaugacgagccggcguauugcccuagaccccuguaccaguauaaaccuuaccagagcucucaggcucgguccgauuaucaugucacgcaacuucagcccuacuuugaaaauggccgcgugcacuauagauacagcccguacucuagcuccucuagcuccuauuacucuccugacggcgcccugugcgauguugacgccuaugggaccgugcagcugcggccccuccacagacugcccaaccgcgauuucgcuuuuuacaauccucggcuucagggaaagagccuguauuccuacgccggccucgcgcccagaccucgcgccaacgucacaggguauuucagcccgaaugaccauaacgugguuucuaugcccccugcugccgacgugaaacacaccuacacauccugggaucuggaggacauggaaaaguaccggaugcaaagcauuagacgcgagucccgggcuagacagaaggucaaaggacccgugaugucucaguaugauaauaugaccccugccguucaagacgaucucggcgggaucuacgugauucaucugcgcagcaaguccgaccccggaaaaacgggccuucugucugucgcugaaggcaaggagagcagacacgccgcgaaagccaucuccccugagggggaagaucgguuuuaucgcagacauccggaggcugaaauggaccgggcccaccaccauggaggccacgggagcacacagcccgagaagccuucucugccccagaagcaguccagccuccgcucuagaaaacugccugauaugggauguucccuucccgaacaucgggcucaccaagaggccagccacagacaguucugcgagucuaagaacggcccgccuuacccccagggggccggacagcuggacuauggcuccaaaggcauucccgauaccagcgaaccugugucuuaccauaauagcggggugaaguaugcugcguccggacaagagagccuccgccugaaccacaaagaaguccggcucuccaaggagauggaaagacccuggguucgccagccuucugccccggagaagcauagccgggacuguuacaaagaggaagagcaccugacacaguccaucgugcccccucccaagccugaaagaucucauagccuuaaacugcaccacacccagaauguggagcgggaucccuccguccuguaccaauaucagccgcauggcaagcgccagucuagcgugaccguugugucccaguacgacaaccucgaggacuaucacagccugccucaacaucagagaggggucuuuggaggcgggggaaugggcacauacgugcccccuggcuucccccacccgcagucucggacguaugcuaccgcccuugggcaaggagccuuccugccugcugaacucucccugcagcaucccgagacacagauccacgccgaauga

SEQ ID NO: 66008 - RNA, 4500 nt, Artificial Sequence
  derived and/or modified sequence opt5 from ARHGAP35__Homo_sapiens__NP_004482
augaugauggccagaaagcaggacgugcggauccccaccuacaacauuagcgucguuggccuguccgggacagagaaagaaaagggacaaugcggcaucgggaaaucuugucucugcaaucgcuucgugagaccuagcgcugaugaguuucaccuggaccauacguccgugcuuucuaccagcgauuucggaggccgggucgugaacaaugaccacuuucuguauuggggagaaguuucccgcucucucgaggauuguguggaaugcaagaugcauauugucgagcagacagaguucaucgacgaucagaccuuucagccgcacagaagcacagcccugcaacccuacauuaaacgggcggcugccaccaaacuugccuccgcugaaaagcugauguauuucuguacagaccagcucgggcuggagcaggauuuugaacagaagcaaaugccugacggcaagcugcucguggauggcuuccugcuugggaucgacguuagccgcggaaugaacagaaauuuugaugaccagcugaaauucgugucuaaccucuacaaucagcuggccaagaccaaaaagcccaucgucguggugcuuacgaagugcgacgagggcgucgagcgguauauucgcgaugcucauaccuuugcccuguccaaaaagaaccuccagguuguggaaacaagcgcgagaucuaaugugaacgucgaccuggccuucuccacccuggugcaacucaucgauaaaagccgggggaagacaaaaauuaucccuuacuuugaggcucugaagcagcagucucaacagauugccaccgcuaaagacaaguaugaauggcuuguuucccgcaucgugaagaaucacaacgagaauuggcugagcgucuccagaaaaaugcaggccucucccgaauaccaggauuacguguaucucgagggaacgcaaaaggcgaaaaagcuguuccuucagcacauucaucggcugaaacacgagcauaucgaacgcagacggaagcucuaccuggccgcucugccucucgccuucgaggcucugaucccgaaccuugacgaaauugaucaccugagcuguaucaaggccaaaaagcuccuggagacaaaacccgaauuucuuaagugguucguugugcuggaggagaccccuugggacgccacaucccacauugauaauauggaaaacgagagaauccccuuugaccucauggauaccgucccugcugaacagcuguaugaggcgcaucuggaaaaacuccgcaacgagcggaagagaguggagaugcgccgggccuucaaggaaaaucuggagaccagccccuuuauuacaccgggcaaaccuugggaagaggcuagaucuuucaucaugaacgaggacuuuuaccaguggcuugaagaguccgucuauauggacaucuacgggaagcaccaaaaacagauuaucgauaaggccaaagaagaguuccaggaacugcuccuggaguauagcgagcuguuuuacgaacuugagcucgacgccaagcccucuaaggagaaaaugggagugauucaggauguucugggcgaggaacaacgcuucaaggcucugcagaaacuccaggccgagcgggacgcgcugauccuuaagcauauucacuuuguguaccauccuacgaaagagaccugccccagcugucccgcuugcgucgaugccaagaucgaacaccugaucuccucuagauucauucgcccuagcgaccggaaucagaaaaacucccucagcgauccgaauaucgacagaauuaaccuggugauccugggcaaggaugggcuugcccgcgagcucgcuaaugaaauucgggcccuguguacaaacgacgauaaguauguuaucgacggaaaaauguacgagcugucucucagacccauugaaggcaaugugcggcugccugucaacuccuuucaaacccccacauuccagccucacgggugccuuugccuguauaauagcaaggagucucucuccuacgugguggagagcaucgaaaaaucccgcgagucuacccugggaagacgggauaaccaucugguucaccuuccccucacgcugauccuggucaauaagagaggcgacacaagcggggaaacccuccauucccugauucagcaaggacagcagaucgcuucuaaacuucaguguguguuccuggacccggccagcgcgggcauuggcuaugggcgcaacaucaaugagaagcaaauuucccaggugcucaagggacugcuggauagcaaacggaaccuuaaccucgucucuuccaccgccagcaucaaggaccuggcugauguggaccugagaaucguuaugugccucauguguggcgauccuuuuucugccgacgauauucuguuccccgugcuucagucccagacaugcaaaagcucucacugugggagcaauaacuccguccugcucgagcugccuaucggacugcacaagaaacgcauugaacuuagcgugcugucuuaccauuccagcuuuuccaucagaaagucucggcucguucacggcuauauuguguucuacagcgcuaagcgcaaagccucccuggcgaugcucagagccuuucugugcgagguccaagacaucauccccauucagcuuguggcucugaccgauggggccguugacgugcucgauaaugaccugucucgggaacagcugacagagggcgaagagaucgcucaggagauugauggacgcuucacgagcaucccuuguucccaaccccagcauaaacuugaaauuuuucacccguucuuuaaggacgucguggagaagaaaaacaucaucgaagccacccauauguacgacaaugccgcugaggcgugcucuacaaccgaagagguguucaacagcccuagagccggcagcccccuguguaauagcaaccuccaggauucugaggaagacauugagcccuccuauagccuguuucgggaagauacaucucucccuucccugagcaaggaccacucuaaacuuuccauggagcuggaagggaaugauggacucagcuucaucauguccaacuuugagagcaagcugaauaacaaggucccgcccccuguuaaacccaagccucccgugcacuucgagauuaccaaaggcgaccugucuuaccuugaucaagggcaucgcgacggacagagaaagagcguguccucuagcccuuggcugccccaggauggcuucgacccguccgauuaugcugaaccuauggacgccgucgugaaaccccggaaugaggaagagaacaucuacucuguuccucacgacagcacgcaggggaagauuaucaccauucgcaauaucaacaaggcccaauccaacggcucuggaaauggcagcgauuccgagauggacacaagcucucucgaaagagggcggaaaguguccaucgucagcaagcccgugcuguauagaacccgcugcacacggcucggaagauuugcuucuuaccgcaccuccuucagcguuggcuccgaugacgagcuggggccgauucggaaaaaggaagaggaucaggccucucagggauauaaaggcgacaacgcggugaucccuuacgaaacggaugaggaccccagacgccggaauauucuuagaagccugcgccggaacacaaagaagccuaaacccaagcccagaccuuccaucaccaaagcuacaugggagagcaauuacuuuggggucccgcugaccaccgugguuacacccgaaaagccuauucccaucuucaucgagcgguguauugaauauaucgaggccacgggccucucuaccgaaggaauuuaccgcguguccggcaacaaaagcgagauggagucucugcagagacaauuugaucaggaccauaaucuugaucuggccgaaaaggacuucacagucaacaccguggcuggggccaugaaguccuuuuucuccgagcucccugauccccuggugccuuauaauaugcagaucgaccucgucgaagcgcacaaaauuaacgaccgggagcagaagcugcaugcucuuaaagaaguucugaagaaauuuccgaaggagaaucacgagguguucaaguacgugaucucucaccugaacaaagucagccauaauaacaaggugaaucucaugacauccgaaaaccugucuaucugcuuuuggcccacccuuaugcgcccugauuucagcacgauggacgcccugacagccaccagaaccuaucaaacaauuaucgaacucuucauucagcagugccccuuuuucuuuuacaaccggccuaucaccgaacccccgggagcuagaccuuccagccccucugccguugcuuccacagugcccuuccugacgagcaccccugucacaucccagcccucuccuccgcaaagcccuccucccacaccccagucccccaugcagccgcuccugccuucucaacuucaggccgagcacacccuguga

SEQ ID NO: 66009 - RNA, 2625 nt, Artificial Sequence
  derived and/or modified sequence opt5 from ARHGAP42__Homo_sapiens__NP_689645
augggccugcccacccucgaguucagcgacuccuaccuggauucuccugacuuuagagaacggcuucagugccacgagaucgaacuggagcgcacaaacaaguucauuaaagaacucaucaaggaugggagccugcuuauuggagcccugagaaaucucuccauggcugugcaaaaauuuucucagagccugcaggacuuccaguuugaguguaucggcgaugccgagacggacgaugaaauuuccaucgcgcaaucucugaaggaguucgcucggcuccugaucgccgucgaagaggagcgcagacggcuuauucagaacgccaaugacguucugaucgcuccgcucgaaaaauuucgcaaggagcagauuggggccgcuaaggauggaaagaagaaauucgacaaggaaagcgagaaauauuacuccauccuggaaaagcaucuuaaccugagcgccaagaaaaaggagucucaccuccaggaggcggauacccaaauugacagagaacaucagaauuuuuaugaggccucccuggaauacguguucaaaauccaggaggugcaggaaaagaaaaaguuugaguucgucgagccccugcucagcuuucugcaaggccuuuucacauucuaucacgaaggguacgagcuggcucaggaauuugccccuuauaaacagcaacuccaguucaaccugcagaauacccggaacaauuuugagucuacacgccaggaaguggagagacuuaugcaacggaugaaguccgcuaaccaggauuacagacccccuagccaguggaccauggagggauaccuguauguucaggaaaagcgcccccucggcuucacauggauuaaacauuacugcaccuaugacaagggcucuaaaacguuuaccauguccgugagcgagaugaaguccucugggaaaaugaauggacuggucacaagcuccccugaaauguucaagcucaagagcuguauccggcgcaaaaccgacucuaucgauaagagauuuugcuucgacauugaggugguugagcggcacggcaucauuacacugcaagccuuuuccgaagcgaacagaaaacuguggcuugaggccauggaugggaaggaaccgaucuacacccugcccgcuauuaucagcaaaaaggaggaaauguaucucaaugaggccggauucaacuuugugcgcaaguguauccaggcugucgagacgcggggcauuacaauccuggggcuuuacagaauuggaggcgugaauagcaaagugcagaagcugaugaacaccacauucagcccuaaaucucccccugacaucgauauugacaucgaacucugggauaacaagaccaucaccuccggccugaaaaauuaucugcgcugccucgccgagccccugaugacauacaaacuucacaaggacuuuauuaucgccgucaaaagcgaugaccagaacuaccggguugaagcugugcaugcgcuggugcacaagcucccggagaaaaauagagaaaugcuggauauucugaucaagcaucuugucaaagugucccuccacagccaacagaaccugaugacgguuucuaaucugggggugauuuucggaccuacccucaugcgcgcccaggaggagacagucgcugccaugaugaacaucaaguuccagaauauugugguugaaauccugaucgagcacuaugagaaaauuuuucauaccgcccccgacccuuccaucccccuuccccaaccucagagccggucuggcuccagacgcacacgggcuauuugucugagcaccggguccagaaagccgcgcggacgguacacgcccugccucgccgaaccugacucugauagcuauuccucuagccccgacuccacaccuaugggcagcaucgaaucucuguccagccacucuuccgagcagaacagcaccaccaagucugcgagcugucaacccagagagaaauccgggggcauuccguggaucgcuacaccuucuucuuccaauggacaaaagagccugggccuuuggaccacaucccccgaaucuagcucccgggaggaugccacgaaaaccgacgccgaaucugauugccagagcguggcuuccgucacaucuccuggggacgugagcccucccaucgaucucgucaagaaagagcccuacggacuguccggccugaagcgcgccagcgcuucuucccucagaagcauuucugccgcggaggggaacaaguccuauagcggaucuauccagucccugaccagcgugggcuccaaagaaacaccgaaggccagcccuaaucccgaccuucccccuaaaaugugucggagacugcgccucgauaccgcuucuagcaacggguaccagcggccgggcuccguuguggccgcuaaggcccagcuguucgagaaugucggaucucccaaaccugugagcuccggcagacaggcgaaggccauguauucuugcaaggcugaacauagccacgagcuguccuuuccccagggggccauuuucucuaacguuuacccuagcguggaacccggauggcuuaaagcuacguacgagggcaagaccgggcucgucccugagaauuaugugguguuucuguga

SEQ ID NO: 66010 - RNA, 2961 nt, Artificial Sequence
  derived and/or modified sequence opt5 from ARHGAP4__Homo_sapiens__NP_001158213
auggccgcucacggcaagcugagacgggagcgcgggcuccaggccgaauacgagacccaagugaaagaaaugagauggcagcugagcgagcagcuucggugccuggaacuccagggagagcugcgcagagagcuucugcaagaacucgcggaguucaugcggcgcagagcugaagucgagcuggaguauucccggggccuggaaaagcucgccgagcgcuuuucuagcagagggggacggcugggcuccucucgcgaacaucagagcuucagaaaagagcccucccuucugucuccucuccacuguugggccguucugcuucagcauacacggcagcaaagccgcgaauccgcugcccugagcgaggugcucgcugggccgcuggcccagagacugucucacaucgcggaggacgugggacggcucgucaagaaauccagagaucuggaacagcagcuucaagacgagcugcucgaagugguuagcgagcugcagacggccaagaagaccuaccaggcuuaucauauggaaucugugaacgccgaggcuaaacuucgcgaggccgaacggcaagaggaaaagagagcgggccgcuccguccccacaaccacagccggcgcuaccgaggccgggccucugcggaaaagcucucucaagaaaggaggcagacugguggaaaagcuguggcccccucagcgccccguugcugccuccagcugcgccccuguguguuggcuccaggcuggguuucugguccacccgcccugguggggagcgaugugcgccccuuccacacaccagcggcaagcuaaguucauggagcauaaacuuaaguguaccaaagccagaaaugaguaccugcucucucuggccagcgugaacgcugccguguccaauuauuaccuucacgauguccuggaccucauggauugcugugacacgggcuuucaucuggcgcuggggcagguucuccgcagcuauaccgcugccgaaucucggacacaggccucccaggugcaaggacugggcagccuugaggaagcuguggaggcccuggaucccccuggcgacaaggcuaaaguccucgaggugcacgccaccguuuucugucccccgcugagauuugauuaccacccucaugacggggaugaaguggcggagauuugcgucgaaauggagcugcgcgacgaaauccuuccccgggcccagaacauucagucuagacucgaucggcagacaaucgagaccgaggaagugaauaagacgcugaaagcuacacugcaagcccuccuggagguuguggcuagcgacgacggagauguccuugacuccuuccagaccucuccuagcacagaaucccucaagagcaccucuuccgaucccggcagccgccaggccgggagacggagaggacagcaacaggagaccgaaacauuuuaccugacgaagcugcaggaguaucugucuggccgcuccauucuugcgaaacuccaagccaagcacgagaaacugcaggaagcucugcagagaggggacaaggaggaacaggaggugagcuggacccaauacacacagcggaaauuccagaagucccgccagcccagaccuucuagccaauauaaccagcggcucuuuggaggcgauauggaaaaguucauccaguccucuggccagccggucccccuggugguugagagcugcauccgcuuuauuaaucuuaacgggcugcaacaugagggaaucuucagaguguccggcgcccagcuccgggucagcgaaauucgcgacgcuuucgagagaggggaagauccucugguggagggauguaccgcccacgaccuggauucuguugccggcgugcuuaaacucuacuuucggucccuggagcccccucuguuucccccggaccucuucggggaacugcuugcuagcucugagcuggaagcgacagccgagcgcgucgaacauguguccagacuccuguggcggcugccugcucccgugcuuguuguccuccgcuaucuguucaccuuucugaaucaccucgcccaguacagcgaugagaacaugauggacccuuauaaucuggccgugugcuucggccccacgcuucugccugugcccgcuggacaagacccggucgcccuccagggcagagugaaccagcugguucagacacugaucgugcaaccugaucgggucuuuccuccccuuaccucucugcccgggccgguguacgagaagugcauggcgcccccuagcgcuuccugucucggagacgcccagcuggaaagccucggcgccgauaaugagcccgaacuggaggcugaaaugccugcccaggaggacgaucuugaggggguuguggaagcggucgcuugcuucgccuacaccggaagaacagcccaggagcugucuuuucgccggggcgacgugcucagacugcacgaacgcgcuuccagcgauugguggagaggggagcauaacggcaugcggggacugauuccccacaaauauaucacccuuccugccggcacagaaaagcaaguugugggggcuggacugcagacggccggcgaguccgggucuagccccgagggacuccuggcguccgaacucguccaucgcccggagccuuguaccucucccgaagccaugggcccuagcgggcaccggagacgcugccuggugcccgcuuccccggagcagcacguggaggucgacaaagccguugcucagaauauggauucuguguucaaggaacuucugggcaagacaagcgugcggcaaggacucggcccugccuccaccacaagccccucuccugggcccagaucccccaaagccccuccgagcucucggcugggacgcaacaagggcuuuuccagagggcccggagcuccugcgagccccucugccucccauccucagggccuggacaccacgcccaaaccucacuga

SEQ ID NO: 66011 - RNA, 4506 nt, Artificial Sequence
  derived and/or modified sequence opt5 from ARHGAP5__Homo_sapiens__NP_001164
augauggccaagaacaaagagcccagaccuccgagcuacaccaucuccauugugggccugucugggacagaaaaggacaaaggaaauugcggcgucggaaagagcugucucugcaaccgguucguucgcuccaaagcugaugaguauuaccccgaacacacgucugugcugagcaccaucgacuuugggggcagaguggucaauaacgaucauuuccuuuauuggggagacauuauccaaaauuccgaggaugggguggaauguaagauucacguuaucgagcagacagaguuuaucgacgaucagaccuuccugccucaucggucuacaaaccuccagcccuacauuaagcgcgccgcggcuagcaaacugcaguccgccgaaaaacuuauguauaucugcaccgaccaacugggccucgagcaggauuuugaacagaaacagaugccugagggcaagcugaauguggacggguuccugcucuguauugaugucagccaaggaugcaacagaaaauuugacgaucagcugaaguucgugaauaaccuuuuuguucagcugucuaaguccaaaaagcccgugaucauugccgcuacaaaaugugacgagugcgucgaccacuaccuccgggaagugcaggccuucgcuagcaauaagaaaaaccugcuuguggucgagaccucugcccgcuuuaauguuaacaucgaaacguguuucaccgcgcuggugcaaaugcucgauaagacaagauccaaaccuaagauuaucccguaucuggacgccuacaagacccagcggcagcugguggucacagcuaccgauaaauuugagaagcucgugcaaacgguucgcgacuaccaugccacauggaaaaccgugagcaauaagcugaaaaaccaccccgauuaugaagaguacaucaaccuugagggcacaagaaaggcucggaauaccuucucuaagcacauugaacagcugaaacaggagcauauccgcaagagacgggaagaguauauuaacacccucccucgcgccuucaauacacugcuucccaaccuggaagagaucgagcaccucaauugguccgaagcgcugaaacugauggagaagagagccgacuuucagcucugcuucgucgugcuggaaaagacgccuugggaugagaccgaccauauugauaagaucaacgaccggagaauccccuuugaucuucugagcacacucgaagcugagaagguuuaccaaaaucacgugcagcaccugauuuccgagaaacgccgggucgaaaugaaggagaaauucaagaaaacccuugaaaagauccaguuuauuucuccggggcagccuugggaggaggugauguguuucgucauggaagacgaggccuauaaguacaucacagaagcugacagcaaagagguguauggaagacaucaacgcgaaauuguugagaaggccaaagaggaauuucaggagaugcuguucgaacacuccgagcucuuuuacgaucuggaccugaacgccacccccagcucugauaagauguccgaaauccauacggugcucagcgaggagccucgguacaaagcucugcagaaacuugcgcccgacagagaaucucugcuccugaaacacaucggcuucgucuaucaucccacaaaggagaccugccugagcgggcagaauugcaccgauauuaagguggaacaacuucucgccuccucucugcugcagcucgaccacggacgccugcggcuuuaccacgauagcacaaacaucgacaaaguuaaucuguuuauucucggcaaggauggccuggcucaggagcuggccaacgaaaucagaacccaguccacagacgaugaguaugcccuugacgggaaaauuuacgagcucgaucugcgcccuguggacgcuaagagcccguauuuccugucucaacucuggacggccgcguuuaaaccccauggauguuucugcgucuucaauuccaucgaaagccugucuuuuauuggcgaguucaucgggaagauccggaccgaagccucccagauuagaaaggacaaauacauggccaaccuuccuuuuacacugauccucgccaaucagcgcgauagcauuuccaagaaccugcccauccugcggcaccaaggacagcagcuugcuaacaaacuccaguguccuuucguggacgugcccgccggcaccuauccgagaaaguuuaaugagacacaaauuaaacaggcucugcgcgggguucuggagucugucaagcauaaccucgauguggugagcccuauccccgccaauaaggaccuguccgaagcggaucuucggaucgucaugugcgccauguguggagacccuuucucuguggaucugauucucagccccuuucuggacucccacagcugcucugcugcccaggcuggccagaacaauucccugaugcuugauaaaaucauuggcgagaagagacggagaauccaaauuaccauccucagcuaccacucuuccaucgggguucgcaaagacgaacuggugcauggauacauucuggucuauagcgccaagcggaaagcgucuaugggcaugcucagagccuuccugagcgaggugcaggauacgaucccuguucagcuuguggcugucaccgacucccaggccgacuuuuucgaaaacgaggcuauuaaggagcugaugacagaaggggagcacaucgccaccgaaauuacagccaaguuuaccgcucucuacagccugucucaauaucaucgccagacggagguguucacacuguuuuucuccgauguucuugaaaagaagaauaugaucgagaacagcuaccuguccgacaauaccagagagucuacacaccagagcgaagauguguuccuccccuccccgcgggacuguuuuccuuauaacaauuaccccgauucugacgaugacaccgaggcgcccccuccguauagccccaucggagaugacguccaacugcucccuacccccuccgaucgcucuagauaccggcuggaccuugaaggcaacgaguacccuauucauagcacacccaauugccacgaucacgaacgcaaccauaaagugccucccccgaucaagccuaaacccguggucccuaagacgaauguuaaaaagcuggaccccaaccuccugaagaccauugaggccgggaucggcaaaaacccgagaaagcagacaucccgggugccucuggcucaccccgaggacauggauccuagcgacaauuaugccgaacccauugauaccaucuucaaacagaagggauacucugacgagauuuaugugguccccgaugacucccagaaccgcaucaaaaucagaaauagcuuugugaacaauacacaaggcgaugaagagaacggguucucugaccggaccuccaagagccauggagagcgcagaccuucuaaguacaaauauaaguccaaaacgcuuuuuagcaaggccaaauccuacuaucggagaacacacagcgaugcuucugacgaugaagccuucaccaccagcaagacaaagcgcaaaggccggcauagaggguccgaggaagacccgcugcucucucccguugagaccuggaagggaggcauugauaauccugcgaucacaagcgaccaggaacuggacgauaaaaagaugaaaaagaagacgcacaaagugaaggaggacaaaaagaaaaagaagaccaaaaacuuuaaucccccuacacgccggaacugggaguccaauuacuucgggaugccccuccaggaucuggucaccgcugaaaagccuauuccgcuuuuuguggagaaauguguugaguucaucgaagacacaggccugugcaccgaaggacucuacagagugucuggcaacaagacggaucaggacaauauucaaaaacaguuugaucaggaccacaacaucaaucuggucagcauggaggugaccguuaacgccguggccggggcucugaaggccuucuucgcggaucuucccgacccucugauccccuauucccuccauccugagcugcucgaagcugccaaaauucccgauaagacagagcgccugcacgcccuuaaggaaaucgucaaaaaguuucauccggugaacuacgacguguuccgguaugucauuacccaccugaauagaguuucucagcaacacaaaaucaaccugaugacagcugauaaucucagcauuuguuuuuggccuacccugaugcgccccgacuucgagaaccgggaauuucuuuccacaaccaagauccaucagagcgugguggagacguucauccagcagugccaauuuuucuuuuacaauggagagauugucgaaacaaccaacaucguggcucccccucccccuucuaauccgggccagcugguugagcccauggugccucuccagcugcccccuccccuccaaccgcagcugauucagccucagcuucaaaccgacccccuggggaucauuuga

SEQ ID NO: 66012 - RNA, 2385 nt, Artificial Sequence
  derived and/or modified sequence opt5 from ARHGAP6__Homo_sapiens__NP_001274171
augggccaccccguguacagaggggagaagccucagcugcauuaugccggagacuucaccuggaacagcauguccggccggucuguccgccucagaagcguuccgauccaaucccugucugaacuugagcgggcucgccugcaggaaguggccuuuuaccagcuccagcaagauugcgaccugagcugucagauuacaauccccaaagaugggcagaagcgcaaaaagucccuucggaaaaagcuggacucucucggaaaggagaaaaauaaggauaaagaguucauuccucaggcguuuggcaugccccugagccaagugaucgcuaacgaccgcgccuauaagcugaaacaggaucuccagagagacgaacagaaggaugccuccgacuucgucgcuagccugcuuccuuuugggaauaagcggcaaaacaaagagcugucuuccagcaauucuucccucagcucuacguccgaaacccccaacgagagcacauccccuaauaccccggaacccgccccucgcgcuagacggcgcggagccaugucuguggauagcauuacagaccuggaugacaaccaguccagacuucuggaggcgcuccagcugagccugcccgccgaggcucaaucuaagaaagaaaaggcccgggacaaaaagcucucccugaauccuaucuaccgccagguucccagacuuguggauagcugcugucagcaccuggagaaacauggccuccagaccgucggcaucuuccggguggggucuagcaagaagagaguucgccaacugcgggaagaguuugacagaggaauugaugugucccuugaagaggagcacucuguccaugacguggcugcccugcucaaagaguuccugcgcgauaugccggacccucugcucacacgggaacuguauaccgcguuuaucaacacgcuucugcucgaacccgaggaacagcugggcacccuucagcugcucauuuaccugcugccucccugcaauugugauacacuccacagacugcuucaguuccugagcaucguggcccgccacgcugacgauaacauuuccaaggacgggcaagaggucaccggaaauaaaaugacaagccucaaccuggccaccaucuuuggccccaaucugcuucauaagcagaaaucuuccgauaaggaguucagcguucagucuuccgcucgggccgaagagagcacggccauuaucgcuguggugcagaagaugaucgaaaacuaugaggcgcucuuuauggucccuccggaccugcaaaacgaagugcugauuucccuccuggagacagaccccgauguuguggacuaccuucugagacgcaaagccucucagagcuccucuccugauaugcuccagagcgaggucuccuucagcguugggggacggcacucuuccaccgacagcaauaaggcuucuuccggcgauaucagccccuacgacaacaauucuccugugcugagcgaaagaucccugcuugccaugcaggaggaugccgcucccggcgggagcgaaaaacucuaucgcgugccgggacaauucaugcuggucggccaucugucuuccagcaagucccgggagucuagcccugggcccagacucggaaaagaccuguccgaggaaccuuuugauauuuggggcacauggcacucuacccuuaagagcggguccaaggaccccggaaugaccggcucuagcggcgauaucuucgaguccagcucucugcgggccgggccuugcucccucagccagggaaaccugucucccaauuggccgcgcuggcagggcuccccugcggaacuggacagcgauacacaaggggcuagacggacgcaggccgccgcucccgccaccgagggcagagcucaccccgccgugucucgcgcguguuccacaccucauguccagguggccggcaaagcugaacggccgaccgccagaagcgagcaguaccuuacacucuccggggcucacgaccugagcgagucugaacuggacguugccggccuccaaagccgcgcgacgccccagugccagagaccucauggauccggccgggaugacaagagacccccucccccuuaucccgggccgggaaaaccugccgcugccgcugccuggauucagggacccccugaggggguggaaacccccacagaucaaggaggccaggccgcugagagagaacagcaggucacccaaaagaaacugucuagcgcgaacucccuuccggccggggagcaggacucuccucggcugggcgaugcuggauggcucgacuggcagcgcgagagauggcaaaucugggaacugcugagcaccgauaaucccgacgcccuuccugagacacucguguga

SEQ ID NO: 66013 - RNA, 1644 nt, Artificial Sequence
  derived and/or modified sequence opt5 from ARHGAP9__Homo_sapiens__NP_001073625
augagcgagcccccuguguacugcaaccuggucgaccucagacgguguccgcgcucucccccucccggcccugccugcccccugcuucagagacuggaugcuugggaacaacaccucgacccuaauuccgggcgguguuucuauaucaacagccugaccggaugcaaguccuggaaaccgccccgcagaucucggagcgagacaaauccuggcuccauggaagggacgcagacccuuaagcgcaacaaugauguucugcagccccaggccaaaggauuuagaucugacacaggcaccccugagccccucgauccgcaagggagccugucccugagccagcggacaucucagcucgacccucccgcgcugcaggcuccucgcccccuuccccaacugcucgaugacccucaugaaguggagaaguccggacugcuuaacaugaccaaaauugcccagggcggcagaaagcugcggaagaauugggggccgagcugggugguccucacaggaaacucucugguguucuaccgcgagcccccucccaccgccccuuccagcggcugggggcccgcuggaucuagaccggaauccagcguugaucugcggggcgccgcucucgcccacgggcgccaucuguccucuagacggaaugugcuucacaucagaacgauuccuggacaugaguuucugcuccagagcgaccacgaaaccgagcugcgcgcguggcaccgggcccuuagaacagucaucgagcgccuggaucgggaaaacccccucgagcugagacuguccggcagcggcccugcugaacucucugccggggaggacgaagaggaggaauccgagcuggugagcaaaccccuucugcgccucucuagccggagauccucuauucgcggaccugaaggcaccgagcagaaucggguuagaaacaagcugaaacgccuuaucgcuaagcggcccccgcugcaaagccuccaggaaagagggcugcugcgggaucagguguucggaugucaacucgagucccugugccagcgcgagggcgacacagucccuagcuuucuuagacuguguaucgccgcgguggacaaacgggggcucgauguggacggaauuuauagagucucuggcaaucuggccguugugcagaagcugcgcuuccuuguggaucgggaaagagcugucaccuccgacggccgcuacguguuucccgagcagcccgggcaagaaggaagacucgaucuggacagcacggagugggaugacauccauguugugacaggcgcccugaaacucuuccugcgggaacuuccucagccgcuggugcccccucuccugcugccccacuuucgcgcugcccuugcccucucugaguccgagcagugccugagccagauucaagaacugaucggguccaugccuaagcccaaccaugauacccucagauaucugcuugagcaccugugucgggucauugcucacucugacaagaaucgcaugacaccucauaaccucggaaucguuuucggccccacccuguuuagaccggaacaggagaccagcgauccugcggcccacgcucuguaccccgggcagcuugugcagcucaugcugacaaacuucacgucccuguuuccuuga

SEQ ID NO: 66014 - RNA, 1014 nt, Artificial Sequence
  derived and/or modified sequence opt5 from ARHGDIA__Homo_sapiens__NP_001288171
auggccgagcaggaacccaccgcugagcaacuggcccagaucgcggcugaaaacgaggaagacgagcacagcgugaauuacaagccuccggcccagaaauccauucaggagauccaagaacucgauaaggacgaugagucucugagaaaauauaaggaagcccuucugggccgggucgcuguuagcgccgaccccaacgugccuaauguggucgugacagggcucacgcugguuugcuccucugcucccggaccucuugagcuggaucucaccggcgaccuggagagcuucaaaaagcaguccuuugugcugaaggaaggggucgaguaccgcauuaaaaucucuuucagagugaaccgggaaauuguuagcggaaugaaguauauccagcauacauaccgcaaaggcgugaagaucgauaaaaccgacuauaugacaaccacaagacccaccacguguccuggguccggaauuagcccgucucggcgcaccggcagaacagagcccucccagcggcgcgccggccaaaccgaugggagaacaaccgaccggcgcaugugcccuccccagccucuccccagcccguaccagucugcggauagaccuuccgucccccugccucccuggagcgccucucuugcuuggcugaaucgggugcccccuacgccgcuccugucccccccucccccuacaggacccgccagcuccgugucuugucuugucgcugccagcgcgugcgccguuggcgaacgcgggagaucccaggcuagcgccgcucugucugugccgccucgguuuuaucuccccgugaccccugaggccuggcugcaagagggagccgaacagcccuucuccagaccucgcggcugucccuggacaugcgcuagcgcggccccgggguggucuuggggagucggcuguaccgcuagcuggggcccugggcggccccccgccccucugcucccgggacagcccccuugcagaugucgcucccggcugaccaugaugcccuga

SEQ ID NO: 66015 - RNA, 606 nt, Artificial Sequence
  derived and/or modified sequence opt5 from ARHGDIB__Homo_sapiens__XP_011518968
augaccgagaaggcccccgaaccucacguggaggaagacgaugacgaugagcuggacagcaaacucaacuacaagccgcccccucagaaaucccugaaggaacuucaagagauggauaaagacgaugagucucugaucaaguauaagaaaacacuccugggcgacgggcccgucguuacggauccuaaggcucccaaugugguggucaccagacuuacacuggugugcgaaagcgccccuggaccgauuaccauggaccucacaggcgaucuggaggcgcugaaaaaggaaaccaucguucucaaagagggguccgaguaccgggugaagauucauuucaaggucaaccgcgacaucgugucuggacugaaauauguucagcacacauacagaaccggcgugaaggucgauaaagcuacguuuaugguggggagcuauggaccccggccugaagaguacgaguuccuuacccccguggaagaagccccuaagggcaugcuggcccgcggcacauaucauaauaaauccuuuuucaccgacgacgauaagcaggaccaccucucuugggaguggaaccugagcauuaaaaaggaguggacagaauga

SEQ ID NO: 66016 - RNA, 4035 nt, Artificial Sequence
  derived and/or modified sequence opt5 from ARHGEF10__Homo_sapiens__NP_055444
auggaccagagagagccccugccuccggcccccgcugaaaacgagaugaaguacgauaccaauaacaaugaagaggaagagggcgagcaauucgacuuugauagcggggacgaaaucccugaggccgaucggcaggcgcccuccgcuccugaaacaggaggcgccggggccucugaggcucccgccccuacgggaggcgaggacggggcuggagccgaaaccacaccgguggcggagcccaccaaacucguccugccuaugaagguuaaccccuauagcgugauugauaucacaccuuuccaggaagaccagcccccgaccccugugcccuccgccgaggaagagaaugucggccuucacgugccuugcggcuaccugguucccgugcccuguggguaugcugucccuucuaaccucccgcugcuucugcccgccuacagcuccccugugauuaucugcgcuacaucucucgaugaggaagagacccccgaaguuacggaggaccgccaaccuaauagccuguccagcgaggagcccccgaccucugaggaucaggugggaagagaagacuccgcccuggcgcggugggccgcugauccugccaacacagcuuggauggagaaucccgaagaggccauuuaugacgacgucccucgcgaaaacagcgauucugagcccgacgagaugaucuacgaugacguggaaaauggcgaugaagggggaaacuccagccucgaauauggcuggucuuccagcgaguuugaguccuacgaggagcagucugacagcgaauguaaaaaugggaucccuagauccuuccugcggagcaaccauaagaaacagcuuucucacgaucugacccgccucaaggagcauuacgaaaagaaaaugagagaccugauggccuccacagugggagucguugagauucaacagcuucggcagaagcacgagcugaaaaugcagaagcucgugaaagcugcgaaggauggcaccaaggacggccuggaacgcacgagagccgcugugaaacgggggcgcagcuuuaucagaacaaagucucugauugcccaagaucaucggagcucccucgaggaggaacagaaucuguucaucgacgucgacugcaaacaccccgaagccauucuuaccccgaugccugagggacugucucagcaacaggugguucgcagauauauccucggcagcguggucgauuccgagaagaacuacguggacgcucugaaacggauucuugaacaguaugagaagccccugagcgaaauggagcccaaaguucucucugaaagaaagcugaagacaguguuuuaccgcgucaaagagauccugcagugucacucccucuuccaaaucgcccuggcgagccgggugucugagugggauuccgucgaaaugauuggggacguguuuguugcuagcuucuccaagucuauggugcuugaugccuauagcgaguacgucaacaauuuuuccaccgccguggcuguucugaaaaagaccugcgccacaaaaccugcuuuccucgaauuucugaagcaggagcaggaggccucuccggacagaacgacccuuuauagccugaugaugaagcccauccagcgcuucccucaauucauucuccugcugcaggauaugcucaaaaacacauccaagggacaucccgaccggcugccucuucagauggcgcugaccgaacucgagacacuggccgaaaaacugaaugagagaaagcgcgaugcugaccagcggugugaagugaaacaaaucgccaaggcuauuaacgagagauaccuuaauaagcuccugagcucuggcucccgcuaccugauccggagcgaugacaugaucgagaccgucuauaacgauagaggggaaauugugaaaacgaaggagcgccggguguuuaugcucaaugacguucugaugugcgccacagucucuuccagacccagccacgacucucgggugaugagcucccagcgcuaccuucugaaauggagcgugccucucggacaugucgaugcgaucgaauauggaucuuccgccggcaccggggagcacagcagacaccuggcugugcaucccccggaaucccuggccguuguggcuaacgccaagccuaauaaagucuacaugggacccggccagcuuuaucaggaccuccaaaaccugcugcacgaucucaaugugauugggcagaucacccagcugauuggaaaccuuaagggcaauuaccaaaaccugaaucagucuguugcccaugacuggacaagcgggcuccagcggcugauccugaagaaagaggaugagaucagagcugcggacuguugccgcauucagcuucaacucccuggcaagcaggauaaauccggacggcccaccuucuuuacagccguguucaacacguuuaccccggcuaucaaggaaucuugggucaacagccugcagauggccaaacuggcccucgaggaagagaaucacaugggcugguucuguguggaagacgaugggaaccauauuaagaaagagaagcacccucugcuuguuggacacaugcccgugauggucgcuaagcagcaagaguuuaaaaucgaaugcgccgcguauaauccugagcccuaccugaacaaugaaucccagcccgacucuuucagcacagcucauggcuuucucuggauuggguccugcacccaccagaugggacagaucgccauugugagcuuccaaaacucuacaccuaaggugaucgaguguuuuaaugucgaguccagaauccugugcaugcuguacguuccgguggaagagaaacgcagagaacccggcgccccucccgauccugagacccccgcugugcgggccagcgacgucccuacgauuuguguggggaccgaagagggcucuaucuccauuuauaagagcucucagggauccaaaaagguucgccuucagcauuucuuuacaccggaaaagagcaccgugaugucccucgcgugcacaagccaaucucuguacgcuggccuggucaacggggccguggccagcuaugcuagagcccccgauggauccugggacucugaaccucagaaaguuaucaagcucggcgugcugcccguccggagccuucugaugauggaggacacccucugggcugccuccgggggacagguguucauuaucucuguugaaacgcacgcgguggagggccagcuggaagcccaccaagaggaggggauggucaucagccauauggcuguguccggcgugggaauuuggaucgccuucacaucuggcagcacccugcgccuuuuucacacagaaacccugaaacaucuccaggauauuaauaucgcuaccccuguccacaacaugcugcccgggcaucagagacucuccguuacaagccugcuugugugucacggacugcucauggugggcacgucucuggggguccugguggcccuuccgguuccucggcugcagggcauucccaaggugaccggccgcgggauggucuccuaccacgcccauaauagccccgugaaauucaucguucucgcuacagcgcugcacgagaaggacaaggauaaaucuagagacucccucgccccuggccccgaaccucaagaugaggaccagaaggaugcucugccgagcggaggcgccggguccucucuuagccagggagaccccgaugccgcuaucuggcugggcgacucccucgggagcaugacccagaaaucugaucuguccagcucuagcggaucccugucucuuagccauggcuccucuagccuggaacaccgguccgaggacagcacaauuuaugaccuccugaaggauccugugucucuccgcuccaaagccagacgggcgaagaaggcuaaagccagcuccgcccuggucgugugcggcgggcaaggacauagacgcguccaccggaaggcuagacagccccaccaggaggaacuugccccuaccgugaugguuuggcagaucccccugcugaacauuuga

SEQ ID NO: 66017 - RNA, 3726 nt, Artificial Sequence
  derived and/or modified sequence opt5 from ARHGEF10L__Homo_sapiens__XP_011539993
auggccagcuccaaucccccuccgcagcccgcuaucggcgaccagcuggugccugggguccccggaccuucuagcgaggccgaagaugaccccggcgaggcguucgaauuugaugacuccgaugacgaggaagauaccucugcugcccucgggguuccuagccuggccccggagagagacacagaucccccucuuauucaccuggacuccauccccgugacggauccugaccccgcugccgcuccgccuggaaccggcgugcccgccugggucucuaacggggaugcggccgacgcugccuucagcggagcucggcauuccagcuggaagcgcaaaucuuccagacggauugaccgcuuuacauucccugcccucgaggaagaugugaucuacgacgauguucccugcgagagccccgacgcgcaccagccugccggcgcugaaagaaaccugcuuuaugaggaugcccaucgggcuggcgccccgcgccaggccgaggaccugggguggucuuccagcgaauuugagucuuacuccgaagauagcggagaggaagcuaagcccgagguggaggucgaaccugcgaaacacagaguguccuuccagcccaagaugacccaacucaugaaagccgcuaagucuggcacaaaggacgggcuggagaaaacccggauggccguuaugcgcaaggugagcuuucugcauagaaaagauguccucggagacuccgaagaggaagauaugggccugcuugaggugagcgugucugacauuaagccucccgccccggagcuggggccuaugcccgaaggacucuccccucagcaggucguucggcgccacauccugggcagcaucgugcagucugagggcagcuauguggaaucccuuaaacggauucugcaagacuacagaaauccccucauggagauggaaccuaaggcucugucugcccgcaagugucaggucguguucuuuagaguuaaagagauccugcacugccauagcauguuccagauugcgcucuccagccggguggcugagugggauucuacagaaaagaucggggaccuguuugucgccuccuucagcaaaucuauggugcuugauguuuauuccgacuacgugaacaauuuuaccagcgccauguccauuaucaagaaggcuugucugacgaaacccgccuuccucgaguuccugaaaagacgccaggucugcucuccggaucgggugacccuuuauggacugauggucaagccuauucaaagauuuccccaguucauccuccugcugcaggacaugcucaagaacacaccccgcggccacccugaucggcugagccuucaacuggcucucaccgaacuggagacacuugccgagaaacugaaugaacagaagagacucgcggaccagguggccgagauccagcaacugaccaaauccguuucugaucgcagcucccugaacaagcuccugacgagcgggcagcggcagcuucugcucugugaaacacugaccgagacaguguacggagacagaggccagcugauuaaaucuaaggaacgccgggucuuucuucucaaugauaugcuggugugcgcuaacaucaauuucaagccggccaaccauagagggcaacuggagauuuccagccucguuccccugggaccuaaauacguggucaaguggaauaccgcccuuccccagguucaggugguggaggucggccaggacggcgggaccuaugauaaagacaacgugcugauccaacacucuggagcuaagaaagcguccgccagcggccaggcucagaauaagguguaccucgggccuccccgccuguuucaggaacugcaagaccuucagaaggaucucgccgucguggagcagauuacacugcugaucucuacgcuccacggaaccuaucaaaaccugaacaugacaguugcucaggacuggugucuugcccugcagcggcucaugagagugaaagaagaggaaauccauagcgccaauaagugccggcugcgccugcuucucccuggcaaacccgauaaguccgggagaccgauuagcuucauggucguguuuaucaccccuaacccccugucuaaaauuuccuggguuaaucggcugcaccucgcuaagaucggccugagagaggagaaccagccuggauggcuuugucccgacgaagauaagaaaagcaaggcgccguucuggugcccuauucuggccuguugcauccccgcuuuuuccucucgcgcccucagccugcaacugggcgcccuugugcauuccccugucaauugcccccuccugggguucucugcugugagcacaucccugccccagggauaccucuggguuggcgggggacaggagggcgccgggggccagguggaaaucuuuucucugaaccggccuagcccgagaaccgucaaauccuucccccuugcggcuccugugcuguguauggaguauauucccgaacucgaggaggaagccgagagccgcgacgaaucuccuacgguggccgaucccuccgcuacaguccacccuaccaucugccugggacugcaagacggcagcauucuucuguacucuuccguugauaccgggacacagugucucgugagcugcagaucuccgggacugcagcccgugcucugucugcggcauuccccuuuucaccuucuggccggccuccaggacgggacccuggcggcuuauccccgcacaagcggaggcguccugugggaucuugaguccccucccgugugccugacgguugggccgggcccugugagaacccuccugagccucgaggacgccgucugggccucuuguggaccccgggugacaguucuggaagcuaccacacuucaaccccagcagagcuucgaggcccaccaagaugaagcuguguccgucacccauauggugaaggccggcucugggguuuggauggcguucagcuccggaacgucuauccgccuguuucacaccgagacacucgaacaucugcaggagauuaauaucgccaccagaacaaccuuccugcuuccuggccagaaacaccugugcgugacgagccuccugauuugucaggggcuccugugggucggaacagaccaaggcgugaucgugcuucugcccgucccucggcuggaggggaucccgaagauuaccggcaaaggaaugguuucccucaacggccacugcgggcccguggcuuuucuggccguggcuacaucuauccuugccccugacauucugcgcagcgaucaggaagaggccgaaggacccagagcugaggaagacaagccugauggccaggcgcaugagcccaugccggacucccacgucgggcgggagcucacccgcaagaaaggaauccugcuccaguacagacugcggagcaccgcccaucuuccuggcccccugcugucuaugagagaaccugcucccgccgauggcgccgcucucgagcacuccgaagaggacgggagcauuuacgaaauggccgaugacccugauaucugggugcgcucucggcccugugcgagagacgcucaucgcaaggagaucugcuccguugccauuaucagcggaggccaaggguaucggaauuucggauccgcccugggcucuagcgggagacaggcuccgugcggagagacagauuccacgcuucugauuuggcaagugccucucaugcuguga

SEQ ID NO: 66018 - RNA, 4569 nt, Artificial Sequence
  derived and/or modified sequence opt5 from ARHGEF11__Homo_sapiens__NP_055599
augagcgugagacugccccaguccaucgaccggcucucuagccuguccucucuuggcgauagcgccccugagcgcaaguccccgucucaccauagacaacccagcgacgcuuccgaaaccacagggcugguccagcggugcguuauuauccagaaagaucagcacggauucggcuuuacggugagcggggaccgcauugugcucguccaaucugugagaccuggaggcgccgcgaugaaggcugggguuaaagagggagaucggaucauuaaggugaacggcaccauggucacaaauuccagccaucuggaagugguuaaacuuaucaagucuggcgccuacguggcccugacccuccugggguccagccccucuuccaugggaaucagcggccugcagcaggacccuucccccgcuggggccccucgcauuacaucugucaucccgucucccccucccccucccccgcucccucccccucagagaauuaccggacccaagccccugcaagauccugaggugcagaaacacgcuacacagauccuucggaacaugcugcgccaggaagagaaggagcuccaagacauucugccgcuuuauggcgauaccucccagagacccagcgaagggcggcugucucucgacucccaggagggagauagcggccuggacucuggcacggaacgcuucccuagccuguccgagucucucaugaauagaaacagcgugcuguccgaucccgggcuugacagcccucggaccucucccgucaucauggcccgcguugcgcaacaucacagacggcagggauccgacgccgcugugccgagcacaggcgaucaggggguggaccagucuccuaaaccccugauuaucggaccugaggaagauuacgaccccggcuauuuuaauaacgaguccgauaucauuuuccaagaccucgaaaagcugaaaagcagaccugcccaccuuggggucuuucugcgcuacaucuucucccaggcugaucccucuccgcuccuguuuuaucugugugccgagguguaccagcaggcgagcccuaaggacucccggucucucggaaaggauauuuggaauaucuuccuggagaaaaacgcuccccuuagaguuaagauucccgaaaugcugcaagccgagaucgacagccgccucagaaauuccgaagaugcccggggcgugcugugcgaggcucaggaagccgccaugccugagauccaggaacagauucaugacuaucgcaccaaacggacacuuggccuggggagccucuacggagagaacgaccugcuggaucucgacggcgauccgcugagagagcgccaagucgcugaaaagcagcuugcggcccugggggacauccucucuaaauacgaggaagaucgguccgcucccauggacuuugcccugaauaccuauaugagccacgccggaauuagacugcgcgaggcucggccuucuaacacggccgaaaaggcgcaguccgcucccgauaaagacaaguggcuuccuuucuuucccaagaccaaaaagagcagcaauagcaaaaaggagaaagaugcccucgaggacaagaagagaaacccuauccugaaauacauuggcaagcccaaauccagcucucaguccacauuccauaucccgcugagcccuguggaaguuaagcccgggaaugugcggaacaucauucaacacuuugagaacaaucagcaguaugaugccccugaacccggcacacaacgccucuccaccggaucuuucccggaggaccugcuugagagcgauuccucuagaagcgaaauccggcugggcagauccgagucucucaaagggcgcgaagagaugaagcggagcagaaaggcugaaaacgucccucgcuccagaagcgacguggacauggaugccgcugccgaggcgacccggcugcaccagucugccuccagcucuacauccagccugucuacgcgcucccuugagaaucccaccccucccuucacacccaaaaugggaagacggagcauugaauccccuagccucggcuuuuguaccgacacacugcugccgcaucuccuggaggaugaccuugggcagcugucugaucucgaacccgagccugacgcucagaacuggcaacacaccgucggaaaggaugugguugccggccugacgcagcgcgaaaucgacagacaggaggugauuaaugagcuguucgucacagaagcuagccaucuucggacccuccgcgugcuggaucugaucuuuuaccagagaaugaaaaaggagaaccucaugccccgggaggaacuggcccgccuuuucccuaaucugcccgaacucauugagauccacaacuccuggugcgaggcgaugaaaaagcugagagaagaggggccuaucauuaaggaaaucucugaccugaugcuugcccgguuugauggcccggcuagagaggagcuccaacagguugccgcucaguucuguagcuaucaguccauugcccuggaacugaucaaaaccaagcaacgcaaagagucucgguuucaacucuucaugcaggaagccgagagccauccccagugcagacgccugcagcuucgggaccugauuaucuccgaaaugcagagacucacaaaguacccucugcugcuugagucuaucauuaaacacaccgagggaggcacaagcgaacacgagaagcugugucgcgcucgggaucagugcagagaaauccucaaauaugugaaugaggcggucaagcaaacggaaaaccgccaucggcuggagggguaccagaagagacucgacgccaccgcucuggagcgggccuccaauccccuugccgcugaauuuaaaagccuggaccucacaacccgcaagaugauucacgagggaccucugacauggagaaucucuaaagauaagacccuggaccuucaugugcugcuccuggaagaucuccuggugcuucugcagaaacaggacgagaagcuccugcugaagugucacuccaaaacggccguuggcagcucugauuccaagcaaaccuucagccccguccuuaaacugaacgcggugcucauucgguccguggcuacagacaagcgcgccuuuuucaucaucugcaccucuaaacuggggccgccucagauuuacgaacucgucgcccugacaagcuccgauaagaauaccuggauggagcuucuggaggaagcugugagaaacgccacgcggcaccccggagcggcucccaugccuguucaucccccuccgcccggcccuagagagcccgcccagcaggggccuacacccagccgcguggaacuggacgauucugacgucuuucacggcgagccggagccugaggaacuccccggaggcaccgggucccaacagcgggugcagggaaagcaucagguucugcuugaagauccugagcaagaaggcagcgccgaggaggaggaacugggggugcuccccuguccuucuacaagccuggacggagaaaauagaggcauccgcacccggaaccccauucaccucgcuuucccggggccucuguucauggagggccuugccgacuccgcucuggaagaugucgagaaccugagacaucucauccuguggucucuucugcccggacacaccauggagacacaggccgcgcaggaacccgaggacgaucucacgccuaccccgagcgugauuuccguuacaucucaccccugggacccuggcagccccgggcaagccccucccggaggcgaaggggauaauacccagcuggcuggacucgagggcgaacgcccugagcaggaggacaugggccugugcucccuugaacaucugccgccccggacaagaaacagcgggaucugggagucuccugaacuggaucgcaaucucgccgaggacgcuuccagcaccgaggccgccggaggcuauaaaguggucagaaaggcugaaguggcgggguccaaagugguccccgcccugccugagucuggacagagcgaacccggcccgccugagguugaagggggaacgaaggcuacaggcaacugcuuuuacguguccaugcccucugggcccccugauagcuccaccgaccacagcgaggcccccaugucuccuccgcaacccgauucccuuccugccggccagaccgagccccagccucagcugcaaggaggcaaugacgauccccggcgcccgagcagaucuccucccucccucgcucugcgggacguggggaugaucuuccauacaauugaacagcucacccugaaacuuaaccgccugaaggacauggagcuggcccacagagaacuccuuaagagccugggaggcgagucuagcgggggaacaacgccugucggcuccuuucauaccgaagcggcucgguggacagauggcucucugagcccucccgccaaagagccccucgccuccgacagcagaaauucccacgagcuggggccguguccugaagauggaucugacgcuccccuggaggauagcaccgccgacgcggcugccucccccggcccuuga

SEQ ID NO: 66019 - RNA, 4578 nt, Artificial Sequence
  derived and/or modified sequence opt5 from ARHGEF12__Homo_sapiens__NP_001185594
augagcggcacccaguccacaaucacggacagauucccccugaagaaaccuauucggcacgggucuauccucaaccgcgagagcccgaccgauaagaaacaaaagguggaaagaauugccucccaugacuuugaucccacaggacugguccagcggugcguuaucauucagaaagacgauaauggcuucgggcuuaccgugucuggagacaacccuguguuuguccagagcgugaaggaggauggcgcugccaugcgcgcggggguucaaacaggagacagaaucaucaaggugaauggcacccuggucacacacuccaaccaucucgaagugguuaaacugauuaagucuggcagcuacguggcucuuaccguccaggggcggcccccuggaagcccccagaucccucuggccgauuccgagguggaaccgucugugauuggccacaugucccccaucaugacgagcccucauucucccggggccuccggaaauauggagcgcauuaccagcccuguccucaugggcgaggaaaacaauguugugcacaaccagaaaguggagauccugagaaagaugcugcaaaaagaacaggagcggcuccagcugcuucaggaggacuauaaucgcacacccgcucaaagacugcucaaggaaauucaggaggccaagaaacacaucccgcagcugcaagaacagcuuucuaaggcuaccggguccgcccaggauggagcggucgugacaccuagccggccccugggcgacacccucacgguuuccgaggccgaaacagauccuggcgacgugcuggggcgcaccgacuguucuagcggagaugcuuccagacccagcucugacaacgccgauucccccaaaagcggcccuaaggagcggaucuaccuggaggaaaauccggagaaaucugaaacaauucaggacaccgauacccaaagccucgucgggucccccucuacacgcaucgcuccucauauuaucggagccgaggacgaugacuucggcacggaacacgagcagauuaacgggcagugcagcuguuuucaguccaucgagcugcuuaagagcagacccgcgcaucuggccguguuccuccaccacguugugucucaauuugauccugcuacccugcuuugcuaucuguacuccgaccucuauaaacauacaaauagcaaggaaacccggagaaucuuccuggaguuucaccaguucuuucuggaucgcucugcccaucucaaggucuccgugcccgacgaaaugagcgcugaccuggagaaacggagaccggaacuuauuccugaggaucugcaccgccauuacauccagacaaugcaggagcggguccaccccgaagugcaaagacaccucgaggacuuccgccagaagcgguccaugggacugacccuugccgaaucugagcugacgaaacucgaugccgagagagacaaggaucgccugacacuggaaaaagagcggaccugugcugaacagauuguugcgaagaucgaggaagugcucaugaccgcccaggcugucgaggaggacaagagcuccacaaugcaauaugugauucugauguacaugaaacaucuuggcguuaaggugaaagaaccuagaaaccuggagcacaagcgcggccggaucggguuucuccccaaaaucaagcagucuaugaagaaagauaaggaaggagaggaaaaaggcaagagacggggguucccuagcauucugggacccccgcgcagaccuucccggcaugacaauagcgccaucggcagagccauggagcugcagaaagcucgccaccccaagcaccuuucuacccccuccagcgucucuccugagccgcaagauuccgccaagcuccggcagagcgggcuggcgaacgaaggcacagacgcuggauaccugcccgccaacucuaugagcuccguggccagcggcgcuucuuucucccaggaagggggaaaagaaaaugauacgggcagcaaacaggugggggagaccuccgccccuggagacacacucgauggcacccccagaacacugaacaccguuuuugacuucccucccccuccccuugaccaaguccaggaagaggagugcgaaguggagcgcgugacggaacaugggaccccgaagccuuuuagaaaguucgauucugucgcuuuuggcgagagccaguccgaggacgaacaguucgagaaugaucuggaaacagaucccccuaacuggcaacagcucgugucucgggagguucugcugggacuuaaacccugugaaauuaagcgccaggaggugaucaaugagcucuuuuauaccgaaagagcccacguccggacacugaaagugcuggaccagguuuucuaccaacgcgugagcagagagggcauucucuccccgucugaacugcggaagaucuuuagcaaccuugaggacauucugcagcuccauaucgggcugaaugaacagaugaaggcgguccgcaaaagaaacgagaccuccgugaucgaucaaauuggagaggaccugcuuacgugguucagcggcccuggggaagagaagcucaaacacgccgcugccacauuuugcucuaaucagcccuucgcucuggaaaugaucaagucccggcagaaaaaggauagccgcuuucagaccuucguucaagacgccgagucuaacccucuguguagacggcuccagcugaaggauauuauccccacacagaugcagagacuuaccaaauauccccugcuccuggacaauauugcgaaguacaccgaauggccuacagagcgcgagaaagugaagaaagccgcugaucauugccggcaaauccugaacuaugucaaucaggccgugaaggaagcugagaacaagcagagacuugaagacuaccagcgccggcucgacacguccagccugaaacugucugaguauccgaauguggaggaacucagaaaccuggaucuuaccaagcgcaaaaugauccacgagggaccccuggucuggaagguuaaccgggacaaaacaauugaucucuacacccugcugcuugaagacauccuggugcuccugcaaaagcaggaugacagacucgugcugcgcugucacuccaagauucuugccagcacagccgauuccaaacauaccuucagcccugucaucaagcugucuacggugcucguuagacagguggcuacagacaauaaagcgcuguuugucauuagcauguccgauaacggcgcccagaucuacgagcugguggcucaaaccguuucugaaaagaccguguggcaggaccuuaucugccggauggccgccagcgucaaagagcaguccacaaagcccauuccucugccccaaucuaccccuggggagggcgauaaugacgaagaggacccgagcaaacucaaggaggagcagcacggaaucuccgugacaggccugcagucucccgaucgggaccucgggcuggaaagcacgcuuauuuccagcaagccucagucucauucccugagcaccucuggaaaauccgagguucgcgaucucuucguggcugagagacaauuugccaaggaacagcacacagacggcacccugaaagaggucggggaagauuaucagaucgcgauucccgacagccaucugccuguguccgaggaacggugggcucuugaugcccugcgcaaccucggacugcucaagcagcugcuugugcaacagcugggccugacagagaaaucuguccaggaggacuggcagcacuuccccagauaccggaccgccagccaagggccgcagacggauuccguuauccagaauagcgaaaacaucaaggcuuaucacucuggcgagggacauaugccuuuuagaaccggcacaggggacauugccacaugcuacagcccccgcaccuccaccgaaucuuucgcgccccgggauagcgugggacucgcuccucaagacucccaggccucuaauauccuggugauggaucacaugauuaugacacccgagaugccuaccauggagccggaaggcgggcuugacgacagcggagagcauuucuucgaugccagagaagcucacuccgacgagaaccccucugaaggcgauggcgccgucaauaaggaggagaaagacgugaaccugcgcaucagcgggaauuaucucauucuggauggauacgacccuguucaggaauccagcacggaugaggaaguggcuucuucccucacacugcagcccaugaccggcaucccugccgucgagagcacccaccaacagcagcauucuccccagaacacacacuccgacggggcgauuagcccguuuaccccugaauuucuugugcaacagcgguggggagccauggaguauuccuguuuugagauccagucucccagcuccugcgcugauagccagucucaaaucauggaauacauucauaagaucgaggccgaccuggaacaccugaaaaagguugaggaauccuacacgauucucugucagagacuggcuggcagcgcccuuacagauaaacauucugacaaguccuga

SEQ ID NO: 66020 - RNA, 2526 nt, Artificial Sequence
  derived and/or modified sequence opt5 from ARHGEF15__Homo_sapiens__NP_776089
augagcgcccagucccugcccgcugccaccccuccgacacaaaagcccccuagaaucauucggccccgcccucccucuagaagccgggcggcucaguccccuggcccgccccacaacgggucuagcccucaggagcucccccgcaauuccaacgacgccccuacgcccaugugcaccccgaucuucugggaaccucccgccgcuucucugaaaccucccgcccuucugcccccuagcgcuuccagagccagccucgauucucagacauccccggacagccccucuuccaccccuacacccagcccugugucucggcgcuccgcgagccccgagccggccccuagaucccccgucccucccccuaagcccucuggaagcccguguaccccucugcuucccauggcuggcguucuggcccaaaauggguccgcuagcgcccccggaacagugcggcgccucgcgggcagauuugaagggggagccgagggccgggcucaggaugccgacgcuccugaaccgggccugcaggcccgcgccgaugugaacggggagagagaggcuccccugaccggaucuggcucccaggaaaauggggcgccugacgccggacucgcuugucccccuugcugccccugugucugccauacgacccggccuggccuggagcuucgcugggugcccguugggggauacgaagaggugccgagagucccucggagagccagcccccugcgcacaucucggagcagaccucaucccccguccauuggccacccugccgugguucucaccucuuaucgcagcacagcugagcggaaacugcuuccccugcucaagccucccaaacccaccagagugcgccaagaugccacgaucuucggcgacccuccgcagcccgaucuggaccugcucuccgaagaugggauucagacaggagacagcccugaugaggcgccccagaacaccccucccgcuacagucgaaggccgggaggaagaggggcuggaggugcuuaaggaacaaaauugggagcugccucuccaggacgaaccgcuguaccagaccuauagagccgccgugcuuucugaggaacuguggggagucggcgaggacgggucccccagcccugcuaacgccggagaugcucccaccuuuccucggcccccgggcccucgcaauacacucuggcaagagcugcccgccguucaggcgucuggccugcucgacacgcugucuccccaggaaagacgcaugcaggagagccuuuucgaaguggugaccuccgaggccucuuaccugcggagccucagacugcuuacagauaccuuuguccugucccaagcucuccgggacacacugaccccucgcgaucaccauacgcuguucucuaacgugcagagaguucagggggugagcgaacgguuucucgccacacugcuuuccagaguccgcagcucuccccacaucuccgaccugugugaugugguucacgcucaugccgugggaccuuucagcgucuauguggacuacguccggaaucagcaauaucaggaggagaccuacucuagacucauggauaccaacgugcgcuuuuccgcggaacugagacggcugcagagccuuccgaagugcgagcgccucccccugccuucuuuccugcuccugcccuuucagagaaucacacggcuucgcaugcugcuccaaaauauucugagacagaccgaagagggcagcucccggcaggagaacgcccagaaagcucugggggccguuagcaagaucauugaacgcuguucugcugaggugggaagaaugaaacaaacagaggaacuuauccggcucacgcagcgccugagauuccacaaggucaaagcccugccucucguguccuggagccggagacuggaauuucagggcgagcuuaccgagcuggggugccgccggggcggaguucucuucgccuccagaccccgcuucacaccgcugugucugcuucucuuuucugaccugcugcucauuacccaaccuaagagcggccagcggcuucaggugcuggauuacgcucauagaucccugguccaggcgcaacaggugcccgacccuucugggcccccuacauuccgccucagccugcuguccaaucaccagggacggcccacccacagacuucuccaggccucuagccuguccgacaugcaacgcuggcugggcgcuuuuccgacgccugggccccuccccugcagcccugauaccaucuaugaagacugcgauuguucucaggagcugugcuccgaaagcucugccccggccaagacagagggacggucccuugaaagcagagcugcccccaaacaucugcacaagaccccugagggcuggcucaaagggcugcccggcgcguucccugcucagcuggugugugagguuacaggagaacaugagcggcgcagacaccuucggcagaaccaacgccugcucgaagccgucggcuccuccagcgggacccccaacgccccuccgcccuga

SEQ ID NO: 66021 - RNA, 2295 nt, Artificial Sequence
  derived and/or modified sequence opt5 from ARHGEF16__Homo_sapiens__XP_011539555
auggcccagagacacagcgacuccucucuggaggaaaagcuccugggccaucgguuccacagcgagcuucgccuggaugcugggggaaaccccgccuccggccucccuauggugagagggucuccgcggguccgcgacgaugcggcuuuucaaccccagguuccugccccuccucagcccagaccuccgggacaugaagaacccuggccuaucgugcugagcaccgaaucccccgccgcucuuaaacugggcacacagcaacucauuccuaagucucuggccguggcuagcaaagccaagacgcccgcgcggcaccaguccuucggggccgcuguccugagccgcgaggccgcuagacgggacccgaaacuccugccugcccccucuuuuucccuugaugacauggauguggacaaggauccuggaggcaugcugcgcagaaaucuccggaaccagagcuaccgcgcggccaugaagggccuggggaaacccggaggccagggggacgcuauccaacuuucucccaagcugcaggcccucgcugaggaaccuucccagccgcauaccagaagccccgccaaaaauaagaaaacacugggacggaagcgcggccacaaggggucuuucaaagaugacccucagcuguaucaagagauucaggaaagaggacucaacaccucccaggagagcgaugacgacauccuggaugaguccucuagccccgaaggcacacaaaagguugacgccaccauuguggucaaauccuaccggccugcucaggugacauggagccagcuucccgagguuguggaacugggcauccucgaucagcugucuaccgaggaaagaaagcgccaagaggcgauguuugagauccuuacguccgaguucagcuaucagcacucucugagcauucucgucgaggaauuucugcaguccaaagagcugcgggccaccgugacacagauggaacaucaccaucucuucucuaauauccuggacgugcuuggggcuagccaaagaugccuggucgccggaccggagcucuggcugcagggccuugagguugaacgccuggauaugcagcuccagccuuguaccggggaggccuggcugcugcggggauggcaagcucaguccggccccgugagcagagggggaggcacacccgcccaccuccacgcgggcuuuuucgaagaccuggagcagcgccauaaggcucaggugcuugucgaagauauuucugacauccuggaggagcacgccgaaaaacauuuucaccccuacauugccuauugcuccaacgagguguaccaacagcggacccuccagaagcugaucagcucuaaugcugccuucagagaagcucugcgcgagauugagcggagaccugccugugggggacuucccaugcucuccuuucugauccugccgaugcaacgcguuacgcggcucccucugcuuauggauacacugugccucaagacccagggccauagcgaaagauauaaagcggccucccgggcucugaaggccaucucuaaacuggugcgccaguguaacgagggggcucacagaauggaacggauggagcagauguacacacuucacacccaacucgacuucagcaaggucaaaucccugccccugauuucugccagcagauggcuccugaagcgcggagaacuuuuccugguggaggagaccggccucuuucggaagaucgcguccagacccacaugcuaccuguuccuguuuaaugauguucuuguggucacgaaaaagaaaagcgaagagucuuauauggugcaggacuacgcccagaugaaccauauucaggucgaaaagaucgagccuuccgaacucccgcugcccgggggcggaaaucgcucuagcuccgugccucaccccuuccaaguuacccugcucagaaacagcgagggccggcaggagcagcugcuucugucuagcgacuccgcuagcgaucgcgccagauggauuguggcucucacacauucugaacggcaguggcaagggcuguccagcaaaggagaccugccucaggucgagaucaccaaggccuuuuucgccaagcaggcugaugaagugacacuucaacaggcggacguugugcucguccugcagcaggaggauggcuggcuguauggggaacgccucagagacggagagaccggcugguuucccgaggauuucgcccgguuuaucacgucccgcguggcuguggaagggaauguuagacggauggagcgccugagagucgaaacagacguguga

SEQ ID NO: 66022 - RNA, 6192 nt, Artificial Sequence
  derived and/or modified sequence opt5 from ARHGEF17__Homo_sapiens__NP_055601
auggccgacggcgcucccagaccucagcuguaccggagcguguccuucaagcuccuggagcgcuggucugggggaccgggccuuagagaagaggauaccgacacacccgggcugcggcgcagagccagcugccggccuacgaccgcggcucgcggacaacccuccagacgggucucuaagcucgccagcggcccucuggccgcucccgcccagccucgcccgcuuagaucccugucucccagcguucggcagcucucccgcagauuugaugcuccucggcuggacgaugggagcgccggaacccgcgacggcggcgugcugcccgcggccgcugaagaggccgcugaagggccugccagaggagcguggcccucugugaccgagaugcggaaacucuucggcgggccgggauccagacgcccuagcgccgauucugagucccccggcacaccuagccccgacggggcugccugggaacccccugcucgggagucuagacagccgcccaccccucccccucgcacauguuuuccccuggccggacuucgguccgccagaccgcugaccggcccugaaacggagggccgccuccggagaccccaacagcagcaggagcgcgcucaacggccugcggaugggcugcacagcuggcauaucuucucccagccccaggccggagcuagagccucuugcagcuccagcucuauugccgcuuccuauccugucagccgcucucgggccgcgagcuccucugaagaggaagaggaaggacccccgcagcuuccuggggcucaaagccccgccuaccacggaggccauuccagcgggucugacgaugacagagauggagagggcggccaccgguggggaggccgccccggccugagaccuggguccagccuccuggaccaggacugucggccggauucugacggacugaaucucuccagcaugaacuccgccggcgugucugggagccccgagccucccaccuccccuagagcuccccgcgaagagggccugcgggaauggggaucuggcagcccucccugcguuccggggccucaggagggacuuagacccauguccgauagcgugggcggggccuuucgcgucgcuaaagugucuuucccuuccuaucuggccagccccgcgggaucuagaggcuccagccgguacucuagcacagaaacccucaaggacgaugaccugugguccagccgcgggucuggcggauggggcguuuauagauccccgagcuuuggggccggagagggccuucugcggucccaagcucgcacaagagccaaagggccuggaggcaccucucgggcucuccgcgaugggggcuucgagcccgaaaagagcagacagcggaagucccugucuaacccugacaucgccagcgagacgcugacacuccuguccuuucuucgcucugaucugagcgaacucagagugcggaaacccggaggcuccagcggggacagaggaucuaauccccuggauggccgcgacuccccuagcgccggcgggccggucgggcagcuugagcccauuccuauccccgccccugcuucucccgggacccggccuacacugaaggaccucaccgccacccugagacgcgcuaaauccuucacauguagcgaaaagccgauggcccggagacugccccgcacgucugcccucaaauccagcuccagcgagcugcuucugaccggcccuggagcugaggaagauccccucccucugauugugcaggaccaauacgugcaggaggcgcggcaggucuuugaaaagauccagagaaugggcgcccaacaggaugacgggucugaugcucccccgggaagcccugacugggccggcgauguuacacgcgggcagcggucccaggaggagcugucuggacccgaaagcucccuuaccgacgagggcaucggcgccgaucccgaaccucccguggcugccuucugcgggcucggaacaaccggcauguggagaccucugucuagcuccucugcgcaaacgaaccaucacgggccgggaacagaggacagccugggcgggugggcucucgugucccccgaaaccccucccaccccuggagcccugcggcgcagacggaaggugcccccgagcggcucuggcggguccgagcuuagcaauggagaggccggcgaggcuuaucgcucucuguccgauccuauuccccagagacaccgggccgcgacaagcgaggaaccuaccggguuuuccguggacucuaaccuccugggaagccugucccccaaaacaggccuuccugcuacgagcgccauggaugaggggcucaccucuggacauuccgacuggagcguuggcucugaagagagcaagggcuaccaggaggugauccaguccauuguccaagggcccggaacacugggcagagugguugacgaucgcaucgccgggaaagcuccgaagaaaaagucucugagcgacccuucccggagaggagaacucgccggccccggguucgagggacccggcggcgaaccuauucgcgagguggaaccgaugcugcccccuucuagcuccgagcccauccuugucgagcagcgggcugaaccugaggaacccggggccaccagaagccgcgcgcagucugagcgggcccugccugaggcucucccgcccccugccacagcucacagaaauuuccaucuggaucccaaacuggccgacauucuuuccccucgccucaucagacggggaagcaagaagcgccccgccagauccucucaccaagaacugcggcgcgaugagggcagccaggaccagaccgggucccugucuagagcucggccgagcuccagacacgugcgccaugcgagcgucccugccacguuuaugcccaucgugguucccgaaccucccaccucugugggaccuccggucgcugugcccgagccuauuggcuuccccacacgggcccacccuacccuccaggcccccucccuggaagauguuacaaaacaauacaugcuuaaccugcauagcggggaggugccggcuccuguccccguggacaugccuugucucccccuggccgcgccucccucugcugaggccaagccgccugaagccgcuagacccgccgaugagcccaccccugcguccaaaugcuguagcaagccgcaggucgacaugcgcaaacacguugcuaugacgcugcuugauacagaacagucuuaugucgagagccuccggacccugaugcagggauacaugcaaccccugaagcagccugaaaauuccgugcucugcgaccccucucugguggaugagaucuuugaccagauuccugagcuucuggaacaucacgagcaguuccucgaacaagucagacacuguaugcagacauggcaugcccagcaaaaggugggcgcccugcugguucagagcuuuuccaaagacgugcuugucaacaucuauagcgcuuacauugauaauuuccugaacgccaaggacgcugugcggguugccaaagaggcgcgccccgccuuucucaaguuccuggaacaguccaugagagagaauaaagagaagcaggcucucucugaucugaugaucaagccugugcaacggaucccccgcuaugaacuucuggucaaagaccuccugaagcacaccccggaggaucauccugaccacccccugcuucuggaagcccagagaaacauuaaacagguggcugagcggaucaauaagggcguucgcagcgccgaggaagccgagagacacgcucgggugcuccaggaaauugaggcgcauaucgaagggauggaggaucugcaagccccucuccgcagauuucugcggcaggagauggucauugaagugaaagcuaucggaggcaagaaggacagaucccuuuuccuguuuaccgaucucaucgugugcacaacgcugaaacgcaagucugggagccugcggagauccucuaugagccuuuacaccgccgccuccgucauugacacagcuagcaaauauaagaugcuguggaaacucccccuggaggaugccgacaucauuaagggagcgucucaggcuaccaaccgcgaaaacauccagaaagccauuucccggcucgacgaggaucugacaacccuuggccaaaugagcaagcugucugaaucccugggguucccgcaccagagccucgacgaugcccugagagaccuuucugcugccaugcaucgcgaucuguccgagaagcaggcgcucugcuacgcccugagcuuuccucccacgaaacucgagcugugugcuacacggcccgaaggaaccgacuccuacaucuucgaguucccucaccccgaugccagacuuggcuuugaacaggcuuucgacgaggccaagcgcaaacuggcuagcucuaagagcugccuggauccugaauuucucaaagccauuccgaucaugaagacccgguccggcaugcaauucucuugugcggcccccacacugaauagcugcccugagcccuccccugagguuuggguguguaacucugacggguaugugggacaggucugccuucugagccucagagcugaacccgauguggaggccuguaucgcuguuugcuccgcccgcauucuguguaucggcgccgugccugggcuccagccgcggugccauagagaacccccucccucucugcgcagcccucccgagaccgcuccggagccugcgggacccgaacuugacgucgaggccgcugccgaugaagaggccgcuacacuggccgaacccggcccucaacccugucugcacauuuccaucgcggggagcggacucgagaugacgccuggccugggcgagggggacccgagacccgaacuugugccuuuugacucugauuccgacgaugagagcucucccuccccuagcggaacccugcagucccaggccucucggagcacaauuuccagcucuuucggcaaugaagagacccccuccagcaaggaagcuacagccgagaccacgucuagcgaggaagaacaggaaccgggguuucucccucuguccggaucuuucggccccgggggcccuugcggaaccagccccauggacggccgcgcucucagacgguccucucacgggagcuuuacaagaggaucccuggaggaucuucugagcguugacccggaagccuaccaaucuuccguguggcugggcaccgaggaugggugcguccauguguaucagagcuccgacucuauccgggaucgcagaaacagcaugaaacuccagcacgcggccuccguuacauguauccuguaccuuaauaaccagguguucgucucucuggcuaauggagagcucgugguguaucaacgggaagccggccauuuuugggacccucagaacuucaagagcgucacccuggggacacagggcucccccauuaccaaaaugguuagcgugggaggccgccuguggugcgggugucagaauagagugcucguccuuucucccgauacgcugcaacuggagcacauguuuuacgugggacaggacuccagccggugcguugcuuguaugguggauucuucccucggcgucugggugacacugaaggggagcgcccauguuugccuuuaucacccugacaccuucgaacagcuggcugagguggacgucacacccccugugcaccgcaugcucgccggaucugaugcgaucauuagacaacauaaagccgcuugucugcggaucacagcccugcucgucugcgaggaacuucugugggugggcaccuccgcugggguugugcugacgaugccgacaagccccggcaccgucucuuguccucgcgcgccccucagcccuacaggacugggccaggggcacaccggacaugugagauuccuugccgcgguucagcugcccgacggcuuuaaccuccugugcccuacaccgcccccucccccugauaccgggcccgagaagcugccgucccucgaacaccgggacagcccuuggcaccgcggacccgcucccgccagaccuaagaugcuugugauuuccggcggcgauggguacgaggacuuccggcugucuagcggaggcggguccucuagcgaaacggucggacgcgaugacuccaccaaucaucugcuccuguggagaguguga

SEQ ID NO: 66023 - RNA, 2640 nt, Artificial Sequence
  derived and/or modified sequence opt5 from ARHGEF1__Homo_sapiens__NP_945328
auggaggacuucgccagaggcgcugccagccccgggccuucccggccgggacuggugcccgucucuaucauuggcgcggaagaugaggacuuugaaaacgagcuggaaaccaauagcgaggagcagaacucccaauuccagucucuggaacagguuaagcgcagaccugcucaccuuauggcccugcuccagcauguggcccugcaauuugagcccgggccucuugugcugcggguccccgugccuccgaauguugcuuucgaacucgaucgcacaagagccgaccugaucagcgaggaugugcagcggcgcuuuguccaggaggugguucagucccaacagguggcugucggaagacagcuggaagacuuccggucuaaacgccucaugggcaugacgcccugggagcaggaacuggcccaacuugaggcguggguggggagagaucgggccagcuacgaagcucgcgagagacacguggccgagcggcugcucaugcaucuggaagagaugcagcacaccauuuccacagacgaagagaaaagcgcugccgucguuaacgcgaucggacuuuauaugcgccaucugggcgugagaaccaaaucuggcgauaagaaauccgggcggaauuucuucagaaagaaggugaugggaaaccgccggagcgacgaaccugccaaaacaaagaaaggccucucuuccauucuggaugcugccagauggaaucgcggggagccccaggucccugacuuucggcaccugaaggcugagguggaugccgaaaaacccggagccaccgacagaaagggcgggguuggaaugccgagccgcgaccggaacaucggcgcuccuggccaagauacacccggggugucucuccacccucugucccuugacagccccgauagagagcccggagcggacgccccucuggaacucggcgauuccucuccgcaggggcccaugagccuggagucccuugcuccucccgaaagcaccgacgagggagccgagacggaaucuccugagcccggcgaugaaggggagccgggacgcuccggccuggagcucgaaccugaggaacccccuggcuggcgggagcuggugcccccugacacccugcauagccuccccaagucucaggucaaaagacaggaaguuaucagcgagcugcuugugacagaggccgcucacguccgcaugcugcgggugcuccaugaucuguucuuucaaccgauggccgaaugccuuuucuuuccucuggaggaacuccagaauauuuuccccucccuggacgagcugaucgaaguccacucucucuuccuggauagacuuaugaagcggcgccaggagagcggguaccugauugaggaaaucggagacgugcuccuggcgagauuugacggcgcugagggguccugguuccagaaaauuagcucucgguuuuguuccagacagagcuucgcccuggaacaacuuaaggccaaacagcgcaaggauccccgguuuugcgcuuucguucaggaggccgaaucuagaccucgcuguagacggcuccaacugaaagacaugaucccgaccgagaugcagcgccugacaaaguauccccuccugcuucaguccauuggacagaacaccgaggaaccuacggagagagaaaagguggagcuggcugccgagugcugucgggaaauccuccaccaugucaaucaagcggugcgcgauauggaggaccugcugagacuuaaagauuaccagcggcgccucgaccugagccaccugagacaguccucugaucccaugcucagcgaauuuaagaaccuggacaucaccaaaaagaaacuuguucaugagggcccucugacauggcgggugacaaaggauaaggccgucgaagugcacgugcuccugcuggacgaucuucuccugcugcuccaacgccaggacgagagacugcuucugaaaucccauucucggacccucacccccacaccugaugggaagacgaugcugagacccguucugcgccuuaccagcgcuaugacacgggaggucgccaccgaccacaaggcuuucuaugugcucuuuacaugggaccaggaagcccagauuuacgagcugguggcgcaaaccgucuccgaaagaaagaauuggugcgcccugaucacggagacagcuggcagccucaaagugccggccccugcuucucgccccaagccucggcccuccccgagcucuaccagagaaccucugcuuuccagcucugagaacggaaauggcgggcgcgagaccagccccgccgaugcccggacagaacgcauucuguccgaccuccugccuuucuguagacccggacccgagggccagcuggcugcgaccgcccuucggaagguucugagccucaaacagcugcucuuuccugcugaagaggauaacggggccggaccgcccagagacggcgauggggugccuggcggaggcccccugucuccugcccggacacaggaaauccaagagaaccuucugucccucgaggaaacgaugaagcagcuggaggaacuggaggaggaauuuugccgccuuagaccccugcucagccagcucgggggaaauuccgucccucagccgggcuguaccuga

SEQ ID NO: 66024 - RNA, 1860 nt, Artificial Sequence
  derived and/or modified sequence opt5 from ARHGEF25__Homo_sapiens__NP_001104740
augaagcccccugacagaccggcccccggccggaccgaucgcauccugggggugaugggaggcaugcucagagcuugcgcccugccugggcaggagggacccccucggcgcagcccccuuggccuggucgggacagaaccugaguccgaaagaacggagggagaccaccggcgcgauagagaacaugagguucucgcgggcgcucugcaaccggagucuuacagcauugccggcuccgaagggucuaucagcgccuccgcugccucuggacuugcugcccccagcggcccuuccagcgggcugucuuccggacccuguagcccugggcccccggggccugugucuggacuccggcgcuggcuggaccacuccaaacauugccugagcguggagaccgaagcggauucuggccaggccggccccuaugagaacuggaugcucgagccugcucuggccacaggggaagaacuucccgaacugacccuccugacaacccuucuggagggacccggcgacaagacacagccuccggaagaggagacccucucccaggcucccgaaagcgaggaggagcagaaaaagaaagcccuggaaagauccauguacguccugucugagcucguggagacggaaaagauguauguugaugaccuggggcaaauuguggagggauacauggcgaccauggccgcucagggcgucccugaaagccuucgggggcgcgauagaaucguguucggaaauauucagcaaaucuaugaguggcaccgggacuacuuucugcaggaacuccagcgcugucugaaggaucccgacuggcuugcccagcuguucaucaaacaugagagacggcuccacauguauguuguguacugccaaaacaagccuaaauccgagcacgucgugagcgaauuuggcgauucuuacuucgaggaacugagacagcagcugggccaucgccuccaacugaaugaccuucugauuaagcccgugcagcggaucaugaaauaucagcuccugcuuaaggacuuucugaaguacuauaacagagcugggauggauacagccgaccucgagcaggccgucgagguuauguguuucgugccgaaacgcugcaaugauaugaugacccugggacggcugagaggcuuugaagggaagcucacagcucaaggaaaacugcuuggccaggacaccuucugggugacggagccugaagcgggcggccugcucuccagccgcggacgggagagacgcgucuuucuguucgaacagauuaucaucuuuucugaggcccugggcgggggagugcggggcgggacacagcccggauacguuuauaagaacagcauuaaaguguccugucuuggccucgaggggaaucugcaaggcgauccuugcagauucgcucugaccucucgcggacccgaaggcgggauucagcgguacguccuccaggccgccgacccugcuaucagccaggccuggaucaagcacguggcgcaaauucuggagucccagagagauuuucuuaacgcucugcagagccccaucgaauaucagcggcgcgagucucaaacaaauucccucggaagaccgcggggcccugggguuggaagccccggccgcauuagacugggggaccaggcccagggcucuacccauacccccaucaacggaucccugccuagccuucuccuguccccgaaaggcgaaguggcccgggcucugcucccccuggauaagcaagcccuuggggacauuccucaggcuccccacgauucuccucccgucagcccuacacccaagacgccgccuugucaggccagacuggcgaaacucgacgaggacgagcuguga

SEQ ID NO: 66025 - RNA, 2376 nt, Artificial Sequence
  derived and/or modified sequence opt5 from ARHGEF26__Homo_sapiens__NP_001238892
auggacggcgagagcgaaguggauuucuccucuaacagcaucacaccccuguggagacggcgcuccauuccucagccgcaccaaguccucgggagaucuaagccccggccucagagcuaccagucccccaauggacugcuuaucaccgacuuuccuguugaggauggcgggacgcugcucgccgcucagauucccgcccaagugccuaccgcgucugacagccgcacagugcauagauccccgcugcuucugggagcucagcggcgcgccgucgccaacggcgggaccgcuagccccgaauauagagccgcuucuccucggcuccgcagacccaaauccccuaagcugcccaaagccgugccgggaggcagcccuaagucucccgcgaauggcgccguuacacugccugcucccccucccccgcccgugcuccggccuccccgcaccccuaacgcccccgcuccgugcacaccugaggaagaucugaccgggcuuacggccucccccgucccuagccccaccgcgaauggacuggccgcuaacaaugacucuccuggcuccgggagccaguccggaagaaaagccaaggaucccgagcggggccucuucccggggccucagaagucuagcuccgagcaaaaacugccccuucagcgccugcccagccaggaaaacgagcuccuggaaaauccuucugugguucuguccacaaacagcccggcugcccucaaggugggaaaacagcaaaucauucccaagucucuggccagcgagaucaaaaucuccaagucuaauaaccagaaugucgagccucacaagagacuucugaaagugcggagcaugguggaaggccucggcgggccccugggacaugcuggcgaggaauccgaggucgacaacgauguugacagcccugggucucuuagacgcggacugcgguccaccagcuacagacgcgcgguggugucuggcuuugauuucgacucccccacaagcuccaagaaaaagaaucggaugucucagccuguccucaaagugguuauggaagauaaggagaaauuuagcucccuggggagaauuaagaagaaaaugcugaagggacaaggcaccuucgacggcgaggaaaacgccgugcucuaucagaacuacaaagagaaggcucuggacaucgauucugacgaagagagcgaacccaaagagcagaaguccgaugagaagauugucauccaccauaaaccgcuucgcagcacguggucucagcuguccgccgugaagcggaaagggcucagccaaacaguuucucaggaagagagaaagcgccaggaagccauuuuugaggugaucuccagcgaacacucuuaucugcuuagccuggagauucucauccggauguucaaaaauuccaaggagcugagcgacaccaugacaaagaccgaaagacaccaucuguuuucuaacaucaccgaugucugugaggcuuccaaaaaguucuuuauugaacucgaggcccgccaccagaauaacaucuucauugacgauaucagcgacauuguggagaaacauacagcguccacguuugauccuuacgucaaguauugcaccaaugaaguguaccaacagcggacacugcagaaacuucuggcuaccaaccccucuuucaaggagguucucagcagaaucgaaucccacgaggacugucggaaucugccuaugaucucuuuccugauucuucccaugcagcgcgugacaagacucccgcugcugauggauaccaucugccaaaagacgccuaaagacagccccaaguacgaagucuguaaacgggcccucaaggagguguccaaacugguuagacuuugcaacgagggagcccgcaagauggaacggacagagaugauguauaccauuaauucucagcuggaauuuaaaaucaagccuuucccccucgugagcuccagcagauggcuggucaagcgcggcgagcugaccgcuuacguggaagacacagugcucuuuucuagacggaccuccaaacagcagguuuauuucuuucuuuucaacgauguccugauuaucacaaagaaaaagagcgaggagucuuacaaugugaacgacuauucccugcgcgaucaacuccugguggaaagcugugacaaugaggaacuuaacucuucccccgggaaaaauagcuccacgaugcuguacagcagacagucuagcgccucccaccucuuuacccugacaguccugucuaaccaugcuaacgagaagguggaaaugcuucucggagccgagacccagagcgagcgggcgcgcuggaucacagcccugggccacuccucugggaagccuccggcugauagaaccugcggcuga

SEQ ID NO: 66026 - RNA, 5196 nt, Artificial Sequence
  derived and/or modified sequence opt5 from ARHGEF28__Homo_sapiens__NP_001073948
auggagcugagcugcuccgaagccccccucuacggccagaugaugaucuaugcuaaguucgacaaaaacguguaccugccugaggaugccgaauuuuauuucaccuacgacgggucucaccaaagacaugucaugauugcggagcggaucgaagauaauguucuucagagcuccgugccgggacacggccugcaggagacagugacggucucugugugucucugcagcgagggguauucccccguuaccaugggaucuggcagcgugacauacgucgacaacauggcuugucgccuggccagacuucuggugacccaggccaaucggcucacagcuugcucccaucaaacccugcugacaccuuuugcccucaccgcuggggcccugcccgcgcuugaugaagagcugguucucgcccugacgcaccuugaacugccucucgaguggaccgugcugggaagcucuucccuggaggucagcucucaucgcgaaucccuccugcaccuugcuaugagauggggccuggccaagcucagccaguucuuucugugucuucccggcggggugcaggcucuggcccucccuaacgaggaaggagcgacaccgcuggaccuggcccuccgggagggccacucuaaacugguggaagaugucaccaauuuccaggggcgcuggucccccagcuuuuccagaguucaacuuucugaggaggcuagccugcauuauauucacuccagcgaaacacucacccugacgcuuaaccauacagccgagcaccugcucgaagcugacaucaagcuguuccggaaauacuuuugggaucgcgccuuccuggugaaggccuuugagccugaagcuagacccgaggagcggaccgcgaugccuucuuccggagccgaaacagaggaagagauuaagaauagcgugucuagccgcuccgcugccgaaaaagaggacaucaagagagucaaaucucucgugguucagcacaacgagcaugaagaucagcacagccuggaccuugaucgguccuucgacauccugaagaaaagcaagcccccgucuacccuccuggccgcuggccgccuguccgacaugcuuaaugggggagaugagguguacgccaacugcauggucauugaccaggugggcgaucucgacaucagcuauauuaauaucgaaggcauuaccgcgacaacgucuccugaguccagaggguguacccuguggccccaaagcuccaagcauacacugccuaccgagacaucucccagcguuuacccccucuccgaaaacguggagggaaccgcucacacggaagcccagcagucuuuuaugagcccuuccagcucuugcgccuccaaucugaaccuuagcuucggcuggcauggguucgagaaagaacaaucucaccugaagaaacgguccagcucucucgaugcucuggacgccgauagcgagggagagggccacuccgaaccgagccauaucuguuauacacccgggucucaguccagcuccagaaccggaauuccuucuggcgacgagcuggauagcuuugaaaccaauacagagcccgacuucaacaucucccgcgcugaaucucuuccucucagcuccaaccugcagucuaaggagagccugcucuccggcguccggagcagaucuuacuccugcagcucucccaaaaucucccuggggaagacccgccuugugcgggagcugacagucuguagcucuuccgaagagcagagagccuauagccucuccgaaccgccucgcgagaaucggauucaagaagaggagugggauaaauacaucauucccgcgaagagcgaaucugagaaguauaaagugagcagaacguuuuccuuccugaugaaccgcaugaccucuccucggaauaagagcaaaacaaaguccaaagacgccaaggacaaggaaaaacugaacagacaccaguuugcucccggaaccuucucuggcguucuucagugccucgugugcgauaagacacugcuggggaaagagagccuccaguguuccaauugcaacgccaauguccauaagggauguaaagacgcugccccugcgugcaccaagaaguuucaagagaaauacaacaagaauaaaccccagacgauccugggcaacucuagcuuccgcgauauuccgcagccugggcuuucccugcaccccagcucuuccgugcccguuggccucccuaccggacggagagaaacagugggccagguccacccgcugagccggucugugcccgggaccacacuggaguccuuucgcagaagcgccaccucccuugaaucugagagcgaccauaauuccugucggagcagaucucacuccgaugaacuccugcaaagcaugggaucuagcccuuccacggagucuuucaucauggaggacgugguugauagcucccuguggucugaccucagcuccgaugcucaggaauuugaggccgaaagcuggucucuggucguggaccccuccuucugcaaccgccaggagaaggaugugaucaaacggcaggacgucauuuuugaacuuaugcaaacagagaugcaucacauccagacccuguucauuaugagcgagaucuucagaaagggcaugaaggaagagcuccagcuggaucauuccacaguggacaaaauuuuuccuugucuggacgaacuucuggagauccaccgccacuucuuuuacucuaugaaggaaagacggcaagagagcugcgcuggguccgaucgcaauuucguuaucgacagaauuggagauauccucgugcagcaguuuucugaggaaaacgccagcaaaaugaagaaaauuuauggcgaguucuguugccaucacaaggaagccgucaaucuguuuaaagagcuccagcaaaacaagaaguuccagaacuuuaucaaacugcggaauuccaaccuucuggcucgcagacgggggauucccgaguguauccuccuggugacccagcgcauuaccaaguacccuguucugguggaaagaauccuucaguauacaaaagagcggacggaagagcauaaggaccugcgcaaagcgcucugccugaucaaggauaugauugccaccgucgaccucaaggugaaugaauacgagaaaaaccaaaaguggcuggagauccuuaauaaaauugaaaacaagacauauaccaaacugaagaauggccacguuuucagaaagcaggcucucaugagcgaggaacggacacugcuguacgauggacuuguguauuggaaaaccgccacgggcagauuuaaggacauccuggcccuccugcucacagauguccugcuuuuccugcaggagaaagaccagaaguacauuuuugcugccguggaucaaaaacccucugugaucucccugcagaagcucaucgcgcgcgaagucgcuaacgaggagcgggggauguuccugauuagcgccucuuccgccggaccggaaauguacgagauccauaccaauagcaaggaagagagaaacaauuggaugcgccggauucagcaagcuguugaaucuugcccugaggagaaaggcgggagaaccagcgaauccgacgaggauaagcgcaaagccgaagcgcggguggcuaagauccagcagugucaggagauucuuacaaaccaagaccagcagaucugcgccuaucuggaggaaaaacuccacaucuacgccgagcugggagaacucucuggcuucgaggacgugcaccuggaaccccaucuucugauuaagccugaucccggggagccgccucaggcugccagccugcucgcugccgcgcugaaagaggccgaaucccuucaagucgcugugaaggccagccagaugggcgcuguuucccagucuugugaggacagcugcggagauuccgugcuggccgacacccucucuagccacgauguccccggcuccccuacagccucucuggugacggggggaagagaaggccgcggguguagcgacguugaucccggaauccagggcguggucaccgaccucgcuguguccgaugcgggggagaagguugaaugccggaauuuucccggcagcucucaauccgagauuauccaggccauucagaaccugacaagacuucuguauagccugcaggcugcccucaccauccaagacucucauaucgagauucaccggcuggugcuucagcagcaagaaggacugucccucggccacagcauccugcgcgggggaccucuccaggaucagaaaucuagagacgccgaccggcagcaugaggaacuggcuaauguccaccaacuucagcaucagcugcagcaagagcagcgcagauggcugcggagaugugaacagcagcaacgcgcccaggcgacacgggaguccuggcuccaggagagagaacgcgagugccaaagccaggaagagcugcuucugcgguccagaggcgagcucgaucugcagcugcaggaauaccaacacagccucgagcgccuucgggaagggcagagacugguggagcgcgaacaggcuagaaugcgggcccagcaaucucugcucggacauuggaagcacggccgccagagaagccugccggccgugcuucugcccggcgggccugaggucauggagcucaaccgguccgaaucucugugucacgagaacagcuucuuuauuaaugaagcucugguucagauguccuucaacaccuuuaauaaacucaaccccucugugauccaucaggacgccacguauccuaccacacaaagccacuccgaucuugugcgcaccucugagcaucaggucgaccugaagguggaucccagccagccuuccaauguuagccacaaacuguggacagcggcuggaucuggccaccagauucucccguuccaugaauccagcaaggacucuugcaagaacggguccagcaugaccaaauguuccugcacacugaccucucccccuggacuuuggacgggcacaaccagcacccugaaggaucucgacacaucccacaccgagagccccacgccucaugauucuaauucccacagaccccaacugcaggccuuuaucacagaggccaaacugaaccucccgacccggacaaugaccagacaggacggggaaacaggagauggcgcuaaggagaauauuguguaccuuuga

SEQ ID NO: 66027 - RNA, 2961 nt, Artificial Sequence
  derived and/or modified sequence opt5 from ARHGEF2__Homo_sapiens__NP_001155855
augagcagaaucgagucccugacccgggcccgcauugacagaucucgggaacucgcuagcaagacacgcgagaaagaaaagaugaaagaggccaaggaugcgagauacacgaacggccaccuguucaccacaaucuccgugucugggaugaccaugugcuaugcuuguaauaaaagcauuacagccaaggaagcccuuaucugccccaccuguaacgucacaauucauaaucggugcaaggacacccuggcuaacuguacgaaaguuaagcagaaacaacagaaggccgcucuccugaaaaauaacaccgcccuucaguccgugucucugcgcagcaagacaaccaucagagagcggccuuccagcgcgaucuacccgucugauuccuuucgccagagccuccugggaucuagacggggccgcuccagccugucucucgccaaguccgugagcacaaccaauauugcugggcacuucaacgacgagucuccccugggacuuagacggauccugucccaaagcacggauucccucaauaugcgcaacagaacacugagcgucgaaucucuuauugacgaggccgaagugaucuauuccgagcugaugagcgauuuugagauggacgaaaaagauuucgcugccgacucuuggagccucgcgguugauuccucuuuucugcagcagcauaagaaagaggugaugaagcagcaagacgucauuuacgaacugauccagaccgagcuccaccaugugcggacacugaaaauuaugaccagacuuuuccgcaccggcaugcuggaagaacuccaccuggagccugggguugugcagggacuuuuucccugcgucgaugaacugagcgacauccacacacgguuccucucccagcugcuggagagacgccggcaagcccucuguccuggcagcacgagaaauuuugugauccaucgccugggcgaccuucugauuucucaguucuccgggcccagcgcugaacagaugugcaagaccuauucugaguuuuguucccggcacagcaaagcccucaagcuguacaaggaacuuuaugcuagagauaaacgcuuccaacaguuuauccggaaggugacaagaccugccguccugaaacgccauggaguucaggagugcauucuccuggugacccagcggaucacaaaguacccgcugcucauuuccagaauccugcaacacucucacggcaucgaggaggagcggcaggaccuuaccacggcccuggggcucgugaaagaacugcugagcaacgucgaugagggaauuuaccagcuugaaaagggcgcucgccuccaggagaucuauaauagaauggacccccgggcgcaaacaccugugcccgggaagggaccuuucggcagagaggaacugcugcgccggaaacucauucaugauggcugucugcuuuggaagaccgccaccgggagauucaaagacguucuggugcuccugaugacagauguccugguguuucuucaggagaaggaccagaaauacaucuuccccacccucgauaagccguccguugugucucugcagaaccugauuguccgcgacaucgcuaaucaagaaaagggaauguuucucaucagcgccgccccucccgagauguaugaggugcacacagcuuccagagaugaccggagcacguggauucgcgucauccagcagucugugagaaccugcccuucccgggaagacuucccccugauugagacagaagaugaggccuaccuucgcagaaucaaaauggaacugcagcaaaaggaccgggcgcucguugagcugcugcgcgagaaagugggccuuuuugcugaaaugacccauuuccaggccgaggaagaugggggaagcggcauggcccuccccacacugccuagagggcuguuucggucugagucccucgaaagcccgcgcggagagagacugcuucaggacgcuauucgggaggucgaaggccugaaggaucuccuggugggccccgggguugagcugcuucucaccccuagagaacccgcccugccucuggagcccgacucuggaggcaacacgagcccgggggugaccgcuaacggagaagcccgcacauucaauggcuccaucgagcucugccgggcggauagcgacucuucccaaagagaucgcaacgggaaucagcugcggagcccucaggaggaagcccuucagagacuggucaaccucuauggccugcugcacggacuucaagcugccguggcucagcaggacacccugauggaggcccgcuuucccgaaggcccugagcggagagagaaacucugucgcgccaauucccgggauggggaagcgggcagagcuggagccgcucccguggccccugagaagcaggccacagaacuggcucuccugcaacggcagcaugcgcuucugcaggaggaacuccgcagaugccggcgccugggggaggagagagccaccgaagcuggaucucuggaggcccggcuuagagaaagcgagcaggcccgcgcucugcucgaacgggaggccgaggaagcgagacgccaacuggcugcccucggccagacggagccccugccggccgaagcuccuugggcccggagacccguugacccccgccggagaucccuuccugcgggggaugcucuguaccucucuuucaacccgccccagccuagccgcggcacagacagacuggaccugcccgucaccacacgguccgugcaccgcaauuuugaggauagagaacggcaagagcuuggaucuccugaggaacgccugcaggacagcuccgaucccgacaccggcagcgaggaagaggggucuuccagacucagcccuccccacucuccgcgggauuucaccagaaugcaggacauuccugaggaaacagagucccgcgauggagaagccguggccagcgagucuuga

SEQ ID NO: 66028 - RNA, 2334 nt, Artificial Sequence
  derived and/or modified sequence opt5 from ARHGEF38__Homo_sapiens__NP_001229658
auggagcccaaggaagccaccggcaaagagaacauggugacaaagaaaaagaaucuggcuuuccucagaagccggcuguacaugcuugaacgcagaaaaacggacaccgucguugaguccucugugagcggggaucacuccggaacacugcggcgcucucagagcgacagaaccgaauauaaccaaaagcuccaggagaagaugacaccucagggcgagugcuccguggccgaaacccugacaccggaggaagaacaucacaugaaacggaugauggcgaagcgcgagaaaaucauuaaggaacuuauccagaccgagaaagauuaccugaaugaccucgaacugugugucagagaggugguucaaccccugcggaacaagaagacggaucgccucgacguggauucucuguuuagcaauauugaauccguccaucagaucagcgcuaaacuucugucucuccuggaggaggccaccacagacguggaaccugccaugcagguuauuggggagguguuccuucagaucaagggaccccuggaagauaucuauaaaauuuacugcuaucaccaugacgaggcucacuccauccucgaaagcuacgagaaggaggaagaacugaaagaacaccugucucauuguauucaaucccucaagaaaaucuauaugcaggagggcaagccuaaccugcuugauauggggagccugaugauuaagcccauccagagagucaugaaauacccucuccugcuuugcgaacugcgcaauucuaccccgcccucccacccugacuaccgggcccucgaugacgcuuuugccgcggugaaggacauuaacgugaauaucaacgagcugaaaagacggaaggaucugguccucaaauauaagaagaaugacgaggaugaaagccugaaagacaaacuuuccaaacugaacauccauucuauuagcaagaaauccaagcgcguuacaaaucaccucaagauccugaccagaggagagagccaggugaaagauaacacguucaaucgggaagagaaacuuuuuagagcccuggagaagacagugcgccucugugucaagaacauuucucugugccugcaacacauccaggacgcuaugccccucgcccugcaguccgugauggaucuucaagaaauuagcuacaacaaagacgaugagauggacuauucugaaacccugagcaaugcucucaacuccugucaugauuucgccucucaucugcagcggcugauccuuacaccucucagcgcgcugcugucccucuuucccggcccgcacaagcugauccagaagagauacgacaaacuucuggacugcaauagcuaucuccagcgcucuaccggcgaggaauccgaucuggccaagaaagaguacgaggcucugaacgcccaacuuguugaggagcuccaggcuuucaaucaggccgcccggaagauucugcugaacugucucugcagcuuuaucacccugcuuagagaccugaugcucguggcucagcaagcguauucuacacuggucccuaugccccugcuuguguccagcauuuccgaaauccagaaucagguucucgaggaaauucagaaccugaauugugugaaagagaacucugccacguucaucgagcgcaagcugagcuuugaaaagaagaagccuguccaaauccuccccgagaugccccaccagaccgauauucaucgguccaaacugcuuucuacauacagcgcugaggagcuguaccaggccaagagaaaaugcaaugccacccaggaauaugacaucaaccuccuggagggggaucugguggcugucauugagcaaaaggacccucuuggauccacaagccgcuggcucguggauaccggcaauguuaaaggguacguguauucuuccuuccugaagccguacaaccccgccaagaugcagaaagucgacgcggaaaaucgguuuugcgaugacgauuucgagaacaucagccuguucgugucuuccagaccugcuagcgacucuguuacgggaacaagcgaauccagcauuggcgauucuuccagcucccucucugggaccuguggaaaguuugagaccaacggcacagacguggacagcuuccaggaggucgaugaacaaaucuuuuaugccgugcacgccuuccaggcucgcuccgaccacgagcugucucuucaggaauaccagcgggugcauauucugagauuuugcgaucucagcggcaauaaagagugguggcuggccgaagcucaagggcagaagggauauguucccgccaacuaccugggcaaaaugaccuacgcguga

SEQ ID NO: 66029 - RNA, 1677 nt, Artificial Sequence
  derived and/or modified sequence opt5 from ARHGEF3__Homo_sapiens__NP_001122087
auggacagcuccaccgccaugaaccagugcucuuguagaggcauggaggaaaauaaggagcggcccaaacgccaaagacagaacaauuucccuauguuuccgagccccaaggcuuggaacuuccgggggcgcaaaagaaagcaguccacacaggaugaagacgccgugucucugugcagccucgauaucuccgagccuucuaauaaacgggucaagccccugagccgcguuacgucccuugcgaaccugauuccucccgugaaggcuaccccucucaaaagauuuagccaaacacugcagcggucuaucuccuuccgcagcgaaucuagaccggacauucuugcuccccggccuuggucccgcaaugccgcccccagcucuaccaagagacgggauuccaaacuguggagcgagacauuugacgugugugucaaccagaugcucaccuccaaggagaucaaacgccaggaagccauuuucgagcugucucaaggagaagaggaucugaucgaggaccucaagcuggcuaagaaagccuaccacgauccuaugcuuaagcugagcaucaugacagaacaggagcucaaucagauuuuuggcacccuggacucccuuaucccccugcaugaggaacuccugagccagcugagagaugugcggaaaccggacgggucuacggaacacguuggaccuauucucgugggcuggcugcccugccuuuccagcuaugauucuuacuguagcaaccaagucgcggccaaggcucugcucgaccauaaaaagcaggaccacagagugcaggauuuccugcaacgcugccuugaguccccuuuuucucggaaacuggaccucuggaauuuccuggauauccccagaagccgccugguuaaguauccccuccugcuucgggagauucugagacauaccccuaacgacaauccggaucagcagcaccucgaagaggccaucaacauuauccaggggaucguggcugaaauuaauacaaagaccggagaguccgaaugucgcuacuauaaagagcggcugcuuuaccuggaggaaggccaaaaggacagccucaucgauucuuccagaguccugugcugucacggcgagcugaaaaacaaccgcggggugaagcuccauguguuucuguuccaggaaguccuuguuauuacacgggccgugacccacaaugagcagcugugcuaucagcucuacagacaacccaucccugugaaagaccugcugcuugaagaucuccaggacggagagguccgccugggcgggagccugcggggagcguuuucuaacaaugagagaauuaagaacuucuuccggguguccuuuaagaauggcagccagucccagacgcauucucuccaagccaacgauacauucaauaaacagcaguggcugaacuguauccgccaggcuaaggaaaccguucuuugcgccgcugggcaagccggagugcuggacagcgagggcuccuuucucaaucccacaaccggcucuagagaacugcagggggagaccaaacuggagcagauggaccaaagcgauuccgaaagcgacugcucuauggauacauccgaggucagccuugacugugaacggauggagcagacggauucuuccugcggaaacagcagacacggcgaaucuaauguguga

SEQ ID NO: 66030 - RNA, 2073 nt, Artificial Sequence
  derived and/or modified sequence opt5 from ARHGEF4__Homo_sapiens__NP_056135
augcccugggaggaaccugccggcgagaagccgagcugcucccacucucagaaggcuuuccauauggaacccgcccaaaaaccuuguuuuaccacagacauggugacgugggcgcugcucugcaucagcgcugagaccgucagaggggaagcccccucccagccucggggcauuccccaccgcucuccuguuagcguggaugaccuguggcuugagaaaacacagagaaagaaacugcagaagcaagcccauguggagcggcgccuccacaucggagcuguccauaaggauggggugaaauguuggagaaagaccauuaucacauccccggaaucucugaaccuuccccggcgcagccacccucugucccagagcgcccccaccggacucaaucacaugggcuggccugagcauacacccgggaccgcuaugccggacggagcccuggauacggcgguuugcgccgacgaagugggcucugaggaggaucuguacgacgaucuccacuccagcucucaucacuauucccacccuggcgggggaggcgaacagcuggcuauuaacgagcuuaucagcgacgggucugucgugugugccgaagcucugugggaucauguuaccauggacgaucaggagcucggauucaaagccggcgacgugaucgaagucauggacgcgacaaauagagagugguggugggggcggguggccgauggagagggcugguuucccgcuuccuucgugcgccugagagucaaccaagacgaaccugccgaugacgaugcuccccuugccggcaauagcggggccgaggacggaggcgcugaagcgcaguccucuaaggaucagaugcggaccaacguuauuaaugagauccugagcacagaacgcgacuacauuaaacaccucagagauaucugcgagggguaugugcggcagugucgcaagagagccgacauguuuuccgaggaacaacugcggaccauuuucggaaacaucgaggauauuuacagaugccagaaggcuuuugugaaagcccuggaacagcgcuucaaucgggagagaccccaucucagcgaacugggcgccuguuuucuugagcaccaagcugacuuccagaucuauucugaguacugcaacaaucauccuaacgccugugucgaacugucccgccucacgaagcugagcaaauauguguacuuuuucgaggcgugccggcuucugcagaagaugaucgacauuucucucgauggguuucugcugacaccgguucagaaaaucugcaaguacccccuccaacuggcugaacuucugaaauauacccacccucagcacagagacuucaaggauguggaggccgcccuccaugcuaugaagaaugucgcccagcugauuaacgagcgcaaacggagacuugaaaauaucgacaagauugcucaguggcaaagcuccaucgaggauugggaaggagaggaccugcucgugcgcucuagcgaacugaucuacuccggcgagcugacacggguuacccagccccaggccaaaagccagcaaagaauguucuuucucuucgaucaccagcugauuuauuguaagaaagaccuucugcgccgggaugugcucuacuauaagggcagacuggacauggaugggcuggaggucguggaccuugaagauggaaaggaccgggaccuccaugucucuaucaaaaacgcguuucgccugcacagaggcgccaccggggauucccaucugcucugcacacggaagccugagcagaaacagagauggcugaaggcuuucgcccgcgaacgggagcaagugcagcuugaccaggaaacgggauuuagcauuaccgagcugcaaagaaaacaggcuaugcucaacgccucuaagcagcagguuacaggcaagcccaaagcgguggggcgcccguguuaccugaccagacaaaagcacccugcccugcccuccaaucggccucagcagcagguccuugugcucgcugagccccgcagaaaaccuagcacauucuggcacuccaucucucggcuggcccccuuucgcaaguga

SEQ ID NO: 66031 - RNA, 4794 nt, Artificial Sequence
  derived and/or modified sequence opt5 from ARHGEF5__Homo_sapiens__NP_005426
auggaggccgaagaggcucagagaggcgccagcccgcccaucuccgcgauugaagaguucucuaucauucccgaagcucccaugcggagcucccaagugucugcccuggggcucgaggcccaggaggacgaagauccuagcuacaaguggcgcgaggaacacagacuguccgcuacccagcagucugagcuucgggacgucugcgauuaugccaucgagacaaugcccagcuuuccuaaagaaggauccgcugacguugagcccaaccaagaaagccugguggccgaggcgugugauacgccugaacauugggaggccgugccgcagucucucgcuggccgccaggccagaacccuggcucccccugagcuuugggccugccccauucaguccgaacaccuggacauggcgccuuucagcucugaucucggguccgaggaagaggaagucgaguuuuggcccggacugacaagccugacccucggcucugggcaagccgaggaagaggaagagacauccagcgacaauuccggacagacccgguacuauucuccgugugaggagcauccugcugagacaaaccagaaugaaggcagcgaguccggcaccauccgccagggggaggaacugcccccugaggaacuucaagagagccagggacugcuccacccccaggaagugcaaguucuggaggaacagggccagcaggaggccggguucagaggagagggcacgcuucgggaagaugugugcgcugacgggcugcucggagaggaacaaaugaucgagcaggucaacgaugaaaagggcgagcagaaacagaagcaagaacaggugcaggacguuaugcugggccgccagggggaaagaaugggacugaccggcgagcccgaagggcucaaugauggagagugggaacaagaggacauggagcggaaagcccagggccaagggggaccugaacagggcgaggaacgcaagagagagcugcaagugccggaggaaaaccgggccgacucucaggaugagaagucccagacauuucuuggcaaaagcgaagaggucaccgggaagcaagaagaccauggaauuaaagagaagggcgugcccgugucugggcaggaggcuaaagaaccugagagcugggauggaggccgccugggggcggucggcagagcccgguccagagaagaggaaaaugagcaccacggacccucuaugccugcucucaucgcccccgaggacagcccgcauugugaucuguucccuggcgccuccuaccuuaugacacagauucccgggacccagacggaaagccgcgcugaggaacugucuccugccgcgcucucccccagccuggagccuauccggugcucucaccaacccauuucccugcucggcagcuuucugacagaagaguccccggacaaggagaucgaucagaacucucagcaggaagagagcagacuucgcaagggaaccguuuccucucaagggacagaagugguguucgcuagcgccuccgucaccccuccccggacccccgacagcgccccuccgucucccgcugaggccuauccuauuacacccgcuuccgugagcgccagaccucccguugcguuuccucgccgggagacgucuugugccgcuagagcccccgaaaccgcuuccgccccgcugagcauggaugacccuucucccugcggaacaagcgagauguguccugcggcccucuacggcuuccccuccaccgggacaagcccgccucggcccccugcuaauucuaccggcacggugcagcaucugcgguccgauagcuuucccggaucccacagaacagaacagacccccgaccuugucggcaugcugcucucuuauagccacuccgagcugccucagcgcccgcccaaaccugccaucuacucuagcgugacaccccggagagaccggcgcuccgggagagauuacucuaccguuagcgcuuccccuaccgcccugagcacacucaagcaagacucucaggaauccaucagcaaccuggagcggcccucuuccccuccgagcauucagcccugggugucuccucauaaucccgccuucgcuacggaguccccugcguauggaagcucccccagcuuugucucuauggaagaugugagaauccacgagccgcuuccuccucccccuccccaacgccgggacacccauccuagcgucguggaaacagauggccacgccagaguuguggucccgacccugaaacagcauucccaucccccuccccucgcucuggggucuggacugcacgccccucacaagggcccccuuccgcaggccagcgacccugcuguggcccgccagcacagaccccucccuuccacacccgauucuagccaucacgcgcaagcuaccccucgguggcgcuacaacaaaccccugccgccuacgcccgaccugccccagccucaccucccgcccauuuccgccccugggucuagcagaaucuaucggccccugccuccccuuccuauuaucgauccgcccaccgagccucccccucugcccccgaagucccgcggcagaagccggucuacacgcggaggccauaugaacuccgggggacacgccaaaaccagaccugcuugccaggacuggacaguuccccuccccgccagcgcgggccggaccucuuggccucccgcuacggcccgcuccacagagagcuucaccuccacaucuagaagcaaguccgaagugagcccugggauggccuucucuaauaugaccaauuuucuguguccguccagccccaccacaccuuggacgcccgagcugcagggaccuaccucuaaggaugaagcuggcgucagcgagcaucccgaagccccggcucgggagccucuuagacgcacaacaccccaacagggggccuccggcccuggacggucucccgugggccaggcgagacagccugaaaaacccagccaccuccaucuggagaaggccuccucuuggccgcaccgccgggacagcgggagaccucccggagauuccagcggccaagcuguggcccccucugagggggcuaacaaacacaagggauggucccgccagggccugcggagaccuagcauccucccggaaggcuccucugacagccgcgggcccgccguugagaaacauccuggacccuccgacaccgucguguuccgggaaaagaagccuaaagaggugaugggcggguuuucuagacggugcagcaagcugauuaacuccagccagcuucuguaccaggaguauucugaugucgugcucaauaaagaaauccaaucccagcagcgccuggagagccugucugaaacccccggaccuuccagccccagacaaccgcggaaggcccuuguuucuagcgaguccuaccuccagcgccugucuauggcuagcuccggcagccuguggcaggaaauuccuguggucagaaacuccacggugcuccugucuaugacacacgaggaccagaaacuucaagagguuaaguucgaacugaucgugagcgaggcguccuaucuccggucucugaauauugccgucgaucauuuucagcugagcaccucccuuagagcuacccucucuaaccaggaacaccaguggcuguucagccgccugcaagacgugcgggauguuuccgccacauuucucagcgaccuggaggaaaauuucgagaacaauaucuuuucuuuccaggugugcgaugucgugcuuaaccaugcccccgacuuuagacgcguguaccugccuuacgucaccaaucagacauaucaggagcggacguuccaaucccucaugaacagcaauucuaacuuuagagaaguucuggagaagcuggaauccgaucccgugugucagcgccuuagccugaaaucuuuccucauccugccguuccagcggauuaccagacucaagcugcuucugcaaaauauccucaaacgcacacagccuggguccagcgaggaagcugaggccaccaaggcgcaccacgcucuggagcagcugauuagagacugcaacaauaacgugcaguccaugcggcgcacagaggaacuuaucuaccugagccagaaaauugaauuugaguguaagaucuucccccucauuucucagagcagauggcuggucaaguccggagagcucaccgcccuggaauuuucugccagccccggccuucggcgcaaacugaacacgagaccugugcaucuccaccuguucaaugauugccugcuucugucccggcccagagagggcucucgcuuucucguuuucgaccaugcuccuuuuagcuccauccgcggggaaaagugugagaugaaacugcacggaccgcacaagaaccucuucagacuguuucuucgccagaauacccagggcgcccaagcggaguuccuguuucggacagaaacccagucugagaaacugagauggaucagcgcucucgccaugccccgggaggaacuggaucuucuggaaugcuauaacuccccucaggugcagugucuccgcgccuacaagcccagagagaaugacgaacuggcucucgagaaagccgacgucgugaugguuacacaacagagcucugauggguggcuggagggagugcggcuuuccgacggcgaacgcgggugguucccuguccaacagguggaguuuauuagcaaccccgaaguuagagcucagaaucugaaggaggcccaucgggugaagaccgcgaaacugcagcucgucgaacagcaagccuga

SEQ ID NO: 66032 - RNA, 2331 nt, Artificial Sequence
  derived and/or modified sequence opt5 from ARHGEF6__Homo_sapiens__NP_004831
augaaccccgaggaacagaucgugaccuggcugauuagccucggcguccuggaguccccuaagaaaacaaucugcgacccggaagaguuccuuaagucuagccugaaaaaugggguugugcucuguaagcugauuaacagacuuaugcccggauccguggaaaaauuuugccuggauccucaaacggaggccgacuguaucaauaacauuaaugauuuccucaagggcugcgcuacccugcaggucgagaucuuugaccccgaugaccuguacucuggggugaacuucagcaagguucucuccacacugcuugccgugaauaaagcgaccgaagaucagcugucugagcggccuuguggacgcagcuccagccucucugcugccaacacaucccagaccaauccccaaggcgccgucagcucuacaguguccgggcugcagagacagagcaagaccguugaaaugacggagaacggaucucaccagcuuaucgugaaagcucgguuuaauuucaagcaaaccaacgaggacgaacuguccgucugcaaaggcgauauuaucuaugugacacgcguggaggaaggcggguggugggagggaacccucaauggcagaacagggugguuuccuagcaacuacguccgggaaauuaaguccucugagcgcccgcugagccccaaggccguuaaaggauucgagaccgcuccucugacgaagaauuauuacacaguggugcuccagaacauccuggacaccgaaaaagaguaugccaaggaacuucagucccugcucgucacauaccugagaccccuucagagcaacaauaaccugucuaccguggagguuaccucccuccugggcaauuuugaagagguguguacauuccaacagacgcugugccaggcgcucgaggaauguagcaaauuuccugagaaccaacauaaggucgggggaugccugcuuucucugaugccccacuucaaaagcauguaucucgccuacugugcuaaucauccguccgccgugaacguucugacccagcacucugaugaacuugagcaguuuauggaaaaucagggcgcuagcuccccuggcauucugauccucacaaccaaccugagcaagcccuucaugcggcuggagaaguacgugacacuccugcaagagcuugaacgccauauggaggacacccacccugaucaccaggacauucugaaagccaucgucgcguucaagacgcucauggggcagugccaggaccugagaaaacggaagcaacuggaacuucagauccucucugagcccauucaggccugggagggagaagauaucaaaaaucugggcaacgugauuuuuaugucccaggucauggugcaauauggggcuugcgaggaaaaggaggaacgcuaccugaugcuguucagcaauguucucaucaugcuuucugccucccccagaaugagcggauuuauuuaucagggcaagaucccuaucgcugggacaguggucacccggcuggacgagauugagggaaacgauuguaccuucgaaaucacaggcaauaccguggagcgcauuguugugcauugcaacaauaaccaggacuuucaggaauggcucgagcaacugaacagacugauccggggcccggccuccuguucuagccuuuccaaaacaucuagcuccagcugcucugcccacuccagcuucucuuccacggggcagcccagaggaccucucgaacccccucagauuaucaagcccuggagccugucuugucugcgcccggcuccuccccuccggccuagcgcggcccugggcuacaaagagagaauguccuauauccuuaaggagagcucuaaaucccccaagaccaugaagaaauuucugcauaagcgcaaaacagaacggaagccuagcgaggaagaguacgucauuagaaaauccaccgcugcccucgaagaggaugcccaaauccugaaggugauugaggcuuauugcacaucugccaauuuccagcaggggcacggaagcuccacccgcaaggacucuaucccccaggugcugcuuccggaagaggaaaaacucauuaucgaggagacgcggagcaacggccaaaccauuauggaagagaagucccugguugauacagucuacgcgcugaaagacgaagugagagagcucaagcaggaaaauaaacgcaugaagcagugucuggaggaggaacuuaaaucucggagagaucuggagaagcucgugcgccggcugcugaagcagaccgacgaaugcaucagaggggagagcuccagcaaaacaucuauccuuccuuga

SEQ ID NO: 66033 - RNA, 2412 nt, Artificial Sequence
  derived and/or modified sequence opt5 from ARHGEF7__Homo_sapiens__NP_001106983
augaacagcgccgagcagaccgugacauggcugaucacgcucggcguccuggaaucccccaagaaaaccauuucugacccugagggguuccuucaagcuagccugaaggauggaguugugcucugccggcugcuugaacggcugcucccgggcacaaucgagaaaguguaccccgaaccucgcuccgagucugagugucugagcaauauuagagaauuucugcgggggugcggagccucccuccgccuggagcuucuguuucccccuucucagcccccucagcaccucgucaccacaauccugcuuagcgcguccaccuucgacgcuaacgaucuguaucagggccaaaauuucaacaaggugcucagcucucugguuacacugaauaaagugaccgccgacauugggcucggauccgauagcgucugugccagaccgucuucccaucggaucaagagcuuugacucucugggcucccagagccuucacacgcgcaccuccaagcuguuccagggccaguacagaucucucgauaugacagacaacagcaauaaccaacuggugguucgggcuaaauuuaauuuccagcagaccaacgaagaugagcuuuccuuuagcaagggggacgugauccaugucacacgcguggaggaaggaggcuggugggaggggacccugaauggaagaacgggcugguuccccucuaacuaugugcgggaagucaaagccuccgagaagccuguuagccccaaaucugggacacucaagagcccucccaagggauuugauaccacagcuauuaauaaauccuacuauaacguggugcugcagaauauccuggaaaccgagaacgaguacucuaaggaacuccaaaccguccugagcacauaucuucgcccgcugcagacguccgagaaacucagcucugccaacauuuccuaccugaugggcaaucuugaagagaucugcagcuuccagcaaaugcuggugcagucucucgaagaguguaccaagcugccugaggcgcagcagagaguuggcgggugcuuucugaaccucaugccccaaaugaaaacacuguaccuuaccuauugugccaaucacccuuccgcugugaacguccugacagaacauagcgaggaacucggagaguucauggaaaccaagggcgccuccucucccgggauucuggugcugacgacaggacuuagcaaacccuucaugcggcucgacaaguacccuacccugcugaaggagcucgagcgccacauggaagauuaucacaccgacagacaggacauccagaaauccauggcugccuuuaagaaucugucugcgcagugccaagagguucggaaaagaaaggaacuugagcugcagauucucacagaggccauccgcaacugggaaggcgaugacaucaaaacccuggggaaugugacauacaugagccagguccugauucagugugcuggauccgaggaaaagaacgagcgguaucuucuccuguucccgaaugugcugcucaugcugagcgccucucccagaauguccggcuuuaucuaccaaggcaagcugccuacgaccgggaugacaauuaccaaacuggaagauagcgagaaccaucgcaaugcuuucgagaucucuggauccaugauugaacggauccucgucagcugcaacaaucagcaggaccugcaggaguggguggaacaccuucaaaagcagacaaaaguuaccucugugggcaaccccacgaucaagccucauagcguccccucccacacccuuccgagccacccugugacacccucuuccaaacaugccgauagcaagccugcuccccucaccccugccuaucacacacugccccauccgucccaccaugggaccccucacacgacaauuaauuggggaccccuggagcccccuaagaccccgaaacccuggucucucagcugucugagaccugcgcccccucuucgccccuccgccgcucugugcuacaaggaagaccucucuaaaagcccuaagacaaugaaaaagcugcugcccaagcggaaaccggagagaaagccuuccgaugaggaauuugccucucgcaaaagcaccgccgcucuugaggaagacgcccagauccucaagguuauugaggcguacugcaccuccgcuaaaacacggcaaacgcugaacagcaccuggcagggcacagaucugaugcacaaccaugugcucgccgacgaugaccagcccucucuggacucccuugggagacgcagcucucugucccggcucgaaccuagcgaucugucugaggacuccgauuaugacagcaucuggaccgcccacuccuacagaaugggcagcacaucuagaaagagcuguugcuccuauauuucucaucagaauuga

SEQ ID NO: 66034 - RNA, 1392 nt, Artificial Sequence
  derived and/or modified sequence opt5 from ARHGEF9__Homo_sapiens__NP_001166950
augcaguggaucagaggcgggagcggaaugcugugggugaaccaagaggacgaagucgaggaaggccccuccgauguucagaaugggcaccucgacccuaacucugauugccugugucuuggacggccgcugcagaaucgcgaccagaugagagccaacgugauuaaugagaucaugagcaccgaacggcauuacauuaagcaccucaaagauaucugcgagggcuaucugaagcaaugucgcaaaagacgggacauguucuccgaugagcagcuuaaggugauuuuugggaacaucgaagacaucuaccgcuuccagaugggauuugucagagaucuggagaaacaguauaauaacgacgauccccaucucucugaaauuggcccuugcuuccuggagcaccaagacggcuuuuggaucuacagcgaguauuguaauaaccaucuggaugcuugcauggaacucuccaagcugaugaaggacucucgguaccagcacuucuuugaggccugucgccuucugcagcagaugauugacaucgcgauugauggguuccuccugacacccgugcagaaaaucugcaaguauccucuucaacuggcugaacuccugaaauacacggcccaggaccacagcgauuacagauauguugccgcugcccuggcugugaugcggaaugucacccaacagauuaacgagcgcaagagacggcucgaaaauaucgacaaaaucgcccaguggcaggcguccgugcuggauugggagggagaggacauucuugaucgcagcucugaacugaucuacacaggcgagauggccuggauuuaucaacccuacgggagaaaccagcagcggguguuuuuccucuuugaccaucagaugguucuguguaagaaggaucuuaucagacgcgacauucuguauuacaaaggacggaucgauauggacaaguaugaagucguggacaucgaggauggcagagacgaugacuucaauguguccaugaaaaacgcuuuuaagcuccacaacaaagaaaccgaggagauucaucuguucuucgccaagaaacuggaagagaagauccgcuggcuccgggcuuuuagagaggaacgcaagaugguccaagaagaugagaaaauuggguucgagaucagcgaaaaucagaagcggcaggccgcgaugacaguuagaaaagugccuaagcagaaaggagugaacucugcccgcuccgucccgcccagcuacccucccccucaagacccccugaaucacggccaguaccuugugccggauggcauugcucagucucagguuuuugaguucaccgaaccuaagcggucccaaagccccuuuuggcagaacuucuccagacugacaccuuuuaagaaauga

SEQ ID NO: 66035 - RNA, 2763 nt, Artificial Sequence
  derived and/or modified sequence opt5 from AR__Homo_sapiens__NP_000035
auggaggugcagcugggccucgggagagucuacccccggccuccgagcaagaccuaucgcggagccuuccaaaaccuguuucaguccguuagagaagugauccagaaucccggcccucggcaccccgaggcugccucugcggcuccucccggggccagccuucugcuccugcagcaacagcagcagcaacagcagcagcaacagcagcaacagcagcagcaacagcagcagcaacagcaggaaacauccccucgccagcaacagcagcagcaaggagaggacggcucuccgcaggcccauagacgggggcccacgggauaccuugugcuggaugaggaacagcaaccuagccagccccaguccgcucucgagugccacccugaacgcggcuguguccccgagccgggcgccgcuguggccgcgucuaaagggcugccucagcaacugcccgccccucccgacgaagaugacagcgcugcccccuccacccucagccugcuuggaccuacauucccgggccugucuuccugcagcgcugaucucaaggacauucugucugaggccuccaccaugcagcuucugcagcagcaacagcaggaggcgguuagcgaagggucuuccagcggcagagcccgggaggcuuccggagcccccacaucuagcaaagauaacuaucucgggggaaccuccacaaucagcgacaaugcuaaggaacuguguaaagccgugucugucuccaugggccugggcguggaggcccucgaacaucugagcccuggggagcagcuucgcggagauugcauguacgcuccccugcucggcguuccucccgcggugagaccgaccccuugugcuccccuggcugagugcaaggggucucuucuggacgauagcgccggaaaguccacggaagacaccgccgaguauucuccuuuuaaaggcggguacacaaagggacucgaaggcgagagccugggcuguuccgggagcgcugccgcgggaucuuccggcacccuggaacuccccagcacacugucucuuuauaaauccggggcucuggaugaggccgccgcuuaccaaagccgggacuacuauaacuucccucucgcccuggcuggacccccgccucccccucccccgccccacccucaugcccgcauuaaacuugagaauccccuggacuacggcuccgcgugggccgcugccgcugcccagugcagauauggggaucucgcgucucugcacggcgccggagcugccggcccugggagcggaucccccucugcugccgccagcuccagcuggcacacccuguuuacggcugaagagggccagcucuacgggccuuguggaggcgggggcggaggcgggggaggcgggggaggcgggggcggaggcgggggaggcgggggaggcggggaagcgggcgccgucgcucccuauggauacacacggccgccucaaggccuggccgggcaggagucugacuucaccgcccccgaugugugguauccuggaggcauggugucccgcguccccuacccgagcccuacaugcguuaaaucugaaauggggcccuggauggacuccuacagcggaccuuauggcgauaugagacuugagaccgcucgggaccaugugcugcccaucgauuacuauuuucccccucagaagaccugucucauuugcggcgacgaggccucugggugccacuacggagcgcugacauguggcagcugcaagguguucuuuaaaagagcugccgaagggaagcagaaauaucugugugccucccgcaacgauugcacgaucgacaaguuccggagaaagaauuguccgagcugccgccuucggaaguguuacgaggcuggaaugacccucggcgccagaaaacugaagaagcuggggaaccucaaacugcaagaagagggagaggcgucuuccacaaccagccccacagaagagaccacgcagaaacuuacagucucccauaucgaaggcuaugagugccagccuauuuuucugaaugugcucgaagcuaucgagcccggcguugugugugccgggcacgauaacaaucagccugacucuuucgccgcucugcugagcucccuuaacgagcucggagaacgccaacugguccacgugguuaagugggccaaggcucugcccggcuuucggaaucuccauguggacgaucagauggccgucauucaguacucuuggauggggcugaugguguucgcgaugggauggcgcagcuucaccaacgucaauuccagaaugcuuuacuuugccccugaccugguguucaacgaguaucggaugcacaaaucuagaauguacagccagugcguucgcaugcggcaucucucccaagaauuuggcuggcugcagaucaccccgcaggaguuccuguguaugaaggcccuucuccuguuuagcauuauccccguggaugggcugaagaaccagaaauucuuugacgaacucagaaugaauuauauuaaggagcuggaucggaucaucgccugcaaacgcaagaacccuacaucuugcuccagacgguucuaccaacuuaccaaacugcucgacagcguccagcccauugcuagagagcugcaccaguuuacauucgaucugcuuaucaagucucauaugguguccguugacuuuccugaaaugauggccgagauuaucagcgugcaaguccccaagauucucucuggaaaagugaagccgaucuauuuccacacgcaguga

SEQ ID NO: 66036 - RNA, 6711 nt, Artificial Sequence
  derived and/or modified sequence opt5 from ARID1B__Homo_sapiens__NP_059989
auggcccacaacgcuggcgccgcggcugccgccgggacccauagcgcuaaguccggaggcucugaagccgcucucaaagaagggggaagcgccgccgcccucuccucuagcuccucuagcuccgcugccgcugccgcggccuccucuagcuccucuagcggccccgggagcgcuauggagacaggacugcuuccuaaucacaagcugaaaacggugggcgaagcccccgcugcgcccccucaucagcaacaccaucaccaccaucacgcccaucaccaccaucaccaugcucaccaucuccaccaccaucacgcgcugcagcagcagcuuaaccaauuccagcagcagcaacagcagcagcaacagcagcaacagcagcagcaacagcagcagcaucccaucucuaauaacaauucccugggcggggccggaggcggggcuccucaacccggaccugacauggagcagccgcagcacggcggggccaaggacagcgccgcuggaggccaggccgaucccccuggacccccucuccuguccaaacccggggaugaagacgaugcgcccccuaagaugggagagcccgcuggcgggagauacgagcacccuggacugggcgcccucgggacccaacagccgcccgucgccguuccuggaggcggcgggggaccggcugccgugcccgaauuuaacaauuauuacggcucugcugccccugcgagcgggggacccggcgggcgggccggcccuugcuucgaccagcauggaggccagcaaucccccgggaugggaaugaugcacagcgcuucugccgcugccgcgggcgccccgggguccauggauccucugcagaacagccaugagggauaucccaauucucaguguaaccacuacccuggcuauagccgccccggggcuggcggaggcgggggaggcgggggaggcgggggcggaggcuccgggggaggcgggggaggcgggggcgccggagcuggcggggccggagccggcgcuguggcggccgcugccgccgcugccgcggcugccgccgggggaggcggcgggggaggcuacgggggaucuagcgcuggcuaugggguccuuuccagcccuagacaacagggaggcggcaugaugauggggcccggaggcgggggagccgcgucucuguccaaggcugccgccggcagcgcugccgggggauuucagcgguucgcuggccagaaucaacauccgucuggcgccacaccuacccucaaccagcugcuuacaucccccagccccaugaugcgcuccuacgggggaucuuacccugaauauagcuccccgucugcgcccccucccccucccagccagccucagucccaagccgcugccgcuggcgccgccgcugggggacagcaggcggccgcuggcauggggcugggaaaagacaugggcgcccaguacgccgcugccagccccgcgugggcugccgcccaacagagaucucacccggcuauguccccuggcacccccgggccuacaaugggacggagccagggcucucccauggauccgauggugaugaagcgcccucaacucuaugggaugggauccaauccccacagccagccucagcagucuagccccuaccccggcggguccuauggaccuccgggcccccaaagauacccuauuggcauccaggggcggacccccggagccauggcgggcaugcaguauccucagcaacagaugcccccucaguacgggcagcaaggaguuagcggcuacugccagcaggggcagcaaccguauuacucucagcagccccaaccuccccaucugccuccccaggcucaguaucugccgucccagagccaacagcgcuaccagccucagcaagacaugucccaggagggauauggcacgagaucucagccuccccuggcccccggcaaacccaaccacgaggaucugaaucuuauucagcaagaacggccuagcucccugccggaccucucugggagcaucgaugaccugcccaccggaacagaggccacccuuuccucugcugugagcgccuccggcagcacaucuucccagggggaccagagcaacccugcucaaucucccuuuuccccucaugccagcccccaccugucuuccauuccgggaggcccuagccccuccccugucgggagccccgugggaucuaaccagagccgcuccggcccuaucucucccgcgagcaucccgggcucccagaugccuccccagcccccugggucucaaagcgaauccucuagccauccggcccucucccagagccccaugccucaggagagaggauucauggcuggcacccagcggaauccccaaauggcccaguacgggccucagcagacgggacccucuauguccccucacccgagccccggcgggcaaaugcacgcuggcauuucuuccuuucagcagagcaacuccucuggaacauauggcccucagaugagccaauacgggccccagggaaauuacucccgcccucccgccuauagcggcguuccgucugccuccuacagcgggccuggacccggcauggggaucucugcuaacaaucagaugcauggccaaggacccagccagccuuguggcgcggugccccuggggagaaugccuuccgccggaaugcagaaccggccguuccccggcaauaugucuagcaugaccccuuccucucccgggaugagccagcaaggaggcccugggaugggcccucccaugcccacagucaacagaaaggcucaggaagccgccgcugccgugaugcaggcggcugccaauuccgcccagagccgccaaggaucuuuucccggcaugaaccaguccgggcugauggcuagcuccucuccuuauagccagcccaugaauaacuccucuagccucaugaauacccaggccccucccuacuccauggcgccggccauggugaacagcucugcugccuccgucggacuggcugauaugaugagcccuggcgagucuaaacuuccccugccccucaaggccgacgggaaggaggaaggaaccccucaaccggaguccaaaagcaagaaaucuagcuccucuacaacgaccggcgaaaagauuacaaaaguuuaugagcugggcaaugaacccgagcggaaacuuuggguggauagauaccugaccuucauggaggaacgcgggagcccuguguccagccuccccgcugucggcaagaagccucuggaccuguuucggcucuaugugugcguuaaggagaucggcgggcuggcccaggugaacaaaaacaagaaauggagagaacuugcgacaaaucugaacgucggaaccuccucuagcgccgcuuccucucucaagaaacaguacauucaauaccuguucgccuuugaguguaagaucgaacgcggcgaggagcccccucccgaaguguucagcacgggggauacaaagaaacagccgaagcugcagccucccuccccugcuaauucuggaagccuucagggcccccaaaccccgcaguccaccggcagcaacucuauggccgagguuccuggggaccucaaaccgcccaccccugccuccacaccccacggacagaugacaccuaugcagggcgggcggagcucuacgauuuccgugcaugauccguucagcgacgucucugauuccagcuuucccaagagaaauuccaugaccccuaacgcucccuaucaacagggaaugagcaugccugacgugaugggccgcaugcccuacgaaccuaauaaagauccguucgggggaaugcggaagguccccggcucuagcgagccuuuuaugacacagggccagaugcccaacuccucuaugcaagacauguauaaucagagcccuuccggggcgaugucuaaccugggaaugggccagagacaacaguuccccuacggggccagcuaugaccgccggcacgagccguacggacagcaguauccuggccaagggccgcccuccggacagccucccuacggcggccaccagccugggcuguacccgcagcaacccaauuauaagagacauauggauggaauguacggcccucccgcuaaacggcacgaaggggacauguauaacaugcaguacucuagccagcagcaagagauguauaaucaguacggaggcuccuauagcgggccugaucgcagacccauccagggacaguacccguacccuuauucucgggaaagaaugcaaggccccggccagauccagacccaugggauuccuccccaaaugaugggaggcccgcuccaguccuccucuagcgaggggccucagcagaacaugugggccgcccgcaaugacaugcccuaccccuaucaaaaccggcagggaccuggcgggcccacacaggcuccuccguaccccggaaugaacagaaccgaugacaugauggugccugaucagcgcaucaaucacgaaagccaauggcccucccauguuucucagagacagccuuauaugagcuccagcgccucuaugcagcccauuacgcggccuccgcaacccuccuaccagaccccucccagccugccuaaccacaucucucgcgcgcccagcccggccuccuuucagagaucucuugagaaucggaugagcccuuccaagucucccuuccugcccagcaugaaaaugcaaaaggugaugccuacaguccccaccucccaggugacaggcccuccgccccagccucccccuauucgcagagagaucaccuuucccccgggcagcguugaggcuucucagccugugcucaaacaacggcgcaagaucacguccaaggacauugucacacccgaggccuggagagugaugaugagccugaaauccgggcugcuugcugaaucuaccugggcccucgauacaaucaacauucugcuguaugacgauagcaccguggcgaccuucaaucucucccagcugucuggauuucuugagcugcucguugaauacuuccggaagugccugaucgacauuuuuggcauccugauggaguacgaggucggggauccuagccagaaagcccuugaccacaacgcugcccgcaaggacgauucccagagccucgcugacgauucuggaaaagaagaggaagacgccgaguguaucgaugacgaugaagaggacgaggaagaugaggaagaggacuccgagaagacagaaagcgaugagaaaucuuccauugcucugacggcccccgacgcggccgcugauccuaaggaaaagcccaaacaagccagcaaguucgacaaacugccgaucaagauugugaaaaagaauaaccucuuuguggucgacagaucugauaagcugggccgggugcaggaguucaauuccgggcuucugcauuggcagcucggaggcggcgacaccacagaacacauccagacccauuucgagagcaaaauggagauucccccuagacgccggcccccuccgccccugucuagcgcugggagaaagaaagaacaagagggaaagggcgauuccgaagaacagcaggagaaaagcaucauugccacaaucgacgauguucuguccgcccgcccuggggcgcuucccgaggacgcuaacccuggaccccagaccgagucuagcaaguuuccuuucggcauccaacaggccaagucccaccggaauauuaaacuccuggaagaugagcccagaucucgcgacgaaacgccgcugugcacaaucgcucacuggcaggauagccucgccaagcgguguauuugcguguccaacaucgucagaucucugagcuuugugccugggaaugacgccgagauguccaaacaucccggccuuguucugauucucggaaagcugauccugcuucaccaugaacacccugagcgcaaacgggcuccccaaaccuaugagaaggaagaggaugaagacaagggcguggccuguagcaaagacgagugguggugggauugccuggagguccucagagacaacacccuggugacacucgcgaauaucucugggcagcuggaucuuuccgccuacaccgaaagcauuugccugccgauccucgacggacugcugcauuggaugguuuguccuucugcugaggcccaggaucccuuccccacagugggcccuaacuccguccuuagcccccagcggcuggugcucgaaacgcugugcaagcucucuauucaagacaacaauguggaucugauccuugcuaccccuccguuuucccgccaggagaaauucuaugccacacuggucagauacguuggggaccggaagaaccccgugugucgcgaaaugagcauggcgcuccugucuaaucuggcccagggagaugcucuugccgcuagagccauugcugugcagaaaggcuccaucgggaaccugaucagcuuucucgaggacggcgucaccauggcccaauaucagcagagccagcacaaucugaugcacaugcaaccucccccucucgagcccccguccguggauaugaugugccgggcggccaaggcucugcuugccauggcuagaguugacgaaaaccgcucugaguuccugcugcaugaaggacggcuccuggauauuagcaucuccgccgugcuuaauucucuggucgccagcgugauuugugacguucucuuucagaucggccagcuguga

SEQ ID NO: 66037 - RNA, 5508 nt, Artificial Sequence
  derived and/or modified sequence opt5 from ARID2__Homo_sapiens__NP_689854
auggccaacagcacaggcaaggcucccccugacgaaagacggaaagggcuggccuuccucgaugaacugcgccaguuucaccauuccagaggaucucccuucaagaaaauccccgcggugggcgggaaggagcuugaccugcacggacucuacacacgggugacgacccugggcggguuugcuaaaguuagcgaaaagaaucaauggggagagauuguggaagaguucaacuuuccucgcuccugcucuaaugccgccuucgcucuuaagcaguauuaccugagauaucucgagaaauacgaaaaggugcaucacuuuggcgaggaugacgaugaagugcccccuggcaaccccaaaccucagcugccgaucggggccauucccagcuccuauaauuaccagcaacauucugugagcgacuaucugcggcaguccuacggacucagcauggauuucaacucuccuaaugacuacaacaagcugguucuuucccugcucagcggccugcccaaugagguggauuuugcuaucaacgucuguacacuucugucuaaugaguccaaacacgugaugcagcucgaaaaggacccuaagauuaucacccugcugcucgccaacgcggggguuuucgaugacacacugggauccuuuucuaccguguucggcgaggaauggaaagagaagacagaucgcgacuuugucaaauucuggaaggacaucguggaugacaaugaagugagagaucuuauuuccgaccggaacaaaagccacgaggggaccuccggagaguggaucugggaaucucuguuccaucccccgcgcaagcucggcauuaaugauaucgagggccagagaguccugcaaauugccguuauccuucggaaccugagcuuugaagaggggaacgugaaacuccuggcugccaaucgcacgugccugagauuccuccugcuuuccgcucacagccauuuuauuucucugcggcagcucggacuggacacccuuggcaacaucgccgcggaacugcuccuggauccuguggacuucaagacaacccaccugauguuucacacagucaccaagugucucaugucccgcgauagauuccugaaaaugcgggggauggagauccuuggaaaucugugcaaggccgaggacaacggcgugcucauuugugaauauguugaucaggacagcuacagagagaucauuugccaucugacgcugcccgacgugcuucucgucaucucuacacuggaagugcuguauaugcucaccgagaugggggauguugcuuguacaaaaauugccaagguggagaaaagcaucgacaugcuggucugccuuguguccauggauauccagauguuuggaccugacgcucuggccgccgucaagcucauugagcaccccucuagcucccaucaaaugcugagcgagauccgcccccaggcuauugaacaggugcaaacccagacccacguugcgucugccccugcuucccgggccguggucgcccagcauguggcuccgcccccuggcaucguugagauugauagcgaaaaguucgccugucaguggcugaaugcgcacuuugaggugaaccccgacugcucugucuccagagcugagauguacagcgaauaucuuuccacauguucuaaacucgcccgcggcgggauccugacgagcaccggauucuacaagugccugcggacaguguuuccuaaucacaccgugaaaagaguugaggauuccucuagcaacggccaagcccauauccacgucgugggggugaagcgccgggcuauuccccucccgauccagauguauuaccagcagcaaccugucuccacaagcgugguuagaguggacucuguccccgauguguccccugcccccagcccugcuggcauuccccauggaucucagaccaucgggaaucacuuccagcgcacgccgguugccaaccaguccagcaaucugacagcgacccaaaugucuuuuccugugcagggcguccacaccguggcccagacaguuagccggauuccccagaaccccuccccucauacccaccaacagcagaaugcuccggugacagucauccaaagcaaagcccccauuccuugcgaaguggugaaggcuacggucauccagaacucuaucccccagaccggaguuccuguguccauugccgugggcgggggacccccucagagcuccgucgugcaaaaucauucuacaggcccccagccgguuaccguggucaacagccagacacuucugcaccauccuuccgugaucccccagcaaucuccucuccacaccguugugcccgggcagauuccgagcggaacgccugucaccgugauccagcaggcgguuccccaaucccacauguucggcagagugcagaacauuccugccuguacaucuaccgucagccaggggcaacagcugaucacaaccagcccccagcccgugcagacgagcucucaacagacauccgcuggcagccagucucaggacaccgugaucauugccccuccgcaauacgucacaaccuccgcuagcaauaucguuucugccaccuccgugcagaacuuccagguggccacaggacagauggucacgauugcuggcgugcccagcccucaagcgucccgcguuggguuucagaauaucgcccccaagccucugcccagccagcaggucucuagcaccgucgugcaacagccuauucagcaaccgcagcagcccacacagcaauccguugugaucgucucucagccugcucagcagggacaaaccuaugcccccgccauccaucagauugugcuugcuaacccugccgcgcuccccgcuggccagacaguccagcugaccgggcaaccgaauaucacgccuagcuccucucccagccccgugccugccacaaacaaucagguucccaccgccauguccucuagcuccaccccucagagccaaggaccgcccccuacagugucucagaugcuguccgucaaacggcagcagcaacagcagcacagccccgcuccucccccgcagcaagugcagguucaggugcagcaaccucagcagguccagaugcaagugcagccccagcaaucuaacgccggcguggggcagccugcguccggcgagagcucccucauuaagcagcugcuucugcccaaaagaggaccuucuacccccggcgggaagcucauccugccggcuccucagauuccgcccccuaauaacgcccgggccccgagcccccaaguugucuaccagguggcuuccaaucaggccgcuggauucggcgugcaggggcaaaccccugcccagcagcugcuugucggacagcaaaacgugcagcucguucccagcgcgaugccucccucuggcggggugcagacggucccuaucuccaaucugcaaauccugccgggcccccucauuagcaacucuccugccaccaucuuucagggaacaagcggcaaucaggugaccauuacaguugugcccaacaccuccuucgcuccugccacggucucucaggggaacgcuacccaacugaucgcccccgccggaauuacaaugagcggcacccagacaggggugggacuuccgguucagacccugccugcuacacaggcgucccccgccggccaaucuagcugcaccacggcuacacccccuuuuaaaggcgauaagaucauuugucagaaggaagaggaggccaaagaagccaccgggcuccaugugcacgagcgcaagaucgaagucauggagaaucccuccugcagacggggagcuaccaacacaagcaauggcgacaccaaagaaaacgagaugcauguggggucucugcugaauggaagaaaguauuccgauagcucccuuccuccgucuaacagcggcaaaauccaguccgagacgaaucaguguucucugauuagcaacgggcccucccucgaacugggagagaauggcgccagcggcaagcaaaacucugaacagaucgacaugcaggacauuaaauccgaucuccgcaagccucuggugaaugggaucugcgacuucgauaagggagacggcagccaccuuucuaaaaacauucccaaucacaagacauccaaccaugucgggaauggagagaucagcccuauggaaccccaaggcacccuggauaucacacagcaggacaccgcgaaaggggaucagcucgagcggauuucuaacggaccgguucugacacugggcggcagcuccgugucuagcauccaagaggcuuccaacgccgccacccagcaguuuagcgggacggaccuucugaauggaccucucgcuuccucucugaacagcgaugugccccagcaaagaccuuccgucgugguuucuccccacagcaccacauccgugauucagggccaucagaucauugccgucccugacucugggagcaaggugucccacagccccgcgcucucuuccgauguucgcagcaccaauggaacagcugaauguaaaaccgugaagagaccggccgaggacacggaucgggaaacagucgccggcaucccuaacaagguggggguccgcaucgugaccauuucugaccccaauaacgcuggaugcuccgccacaaugguugcugugcccgccggcgcggacccuagcaccguggccaaagucgcuaucgagucugccguucagcaaaagcagcagcacccgcccaccuacgugcagaauguggucccucaaaacacacccaugccucccuccccugcugugcagguucagggccaacccaauagcucccagccgagcccuuucucugggagcucccagcccggagauccuaugagaaaacccggccagaacuuuaugugucuguggcaaucuugcaagaaaugguuccagacgccgagccagguguuuuaucaugccgccaccgagcacgggggaaaggacgucuacccuggccagugucuuugggaagggugcgagcccuuccaacggcagcgcuuuuccuucauuacacaucugcaggauaagcacugcucuaaagacgcucuccuggcgggacugaagcaggaugaacccggccaagccggcagccagaaauccucuaccaagcagccuacagucgggggaaccagcuccacgcccagagcucaaaaagccaucgucaaucauccuagcgccgcucuuauggcccugcggcgcggcucuagaaaccucguguuccgggacuuuacagaugagaaggaagggccgauuaccaagcacauccgccugaccgcggcucucauucugaaaaauaucggaaaguauuccgaguguggcagacggcuucugaaaagacacgagaacaaucugagcguucucgccaucucuaacauggaagccuccagcacacuggcuaagugccuuuacgagcugaauuucaccgugcaguccaaagaacaggagaaggacucugaaaugcuccaguga

SEQ ID NO: 66038 - RNA, 1782 nt, Artificial Sequence
  derived and/or modified sequence opt5 from ARID3A__Homo_sapiens__NP_005215
augaagcugcaggccgugauggagacccuccugcaaagacagcagcgggcucgccaggaacuugaggccagacaacagcugcccccugacccgcccgcggcuccucccggccgggcccgcgccgcuccugaugaagacagagagcccgaaagcgcccggaugcagcgcgcucagauggccgcgcucgccgcuaugagagccgcugccgcggggcugggacacccugccuccccgggcgggucugaggauggacccccuggcagcgaggaagaggacgcugcccgggaagggacacccggauccccuggccgcggcagagaggggcccggagaggaacauuucgaggauauggcuucugacgaagauaugaagccgaagugggaggaagaggagauggaagaggaccuuggcgaagaugaggaagaggaggaagaggacuacgaagaugaggaagaggaggaagacgaggaagggcugggaccucccggcccugccagccucgggacgaccgcccuguuuccccggaaagcucaacccccucaggcguuccgcggagauggcgucccgagaguucugggcgggcaggagcggcccggaccuggccccgcccacccugggggagcugcccauguggcuccccagcuccaaccgccugaccacggcgacuggacauaugaggaacaguuuaagcagcuguacgagcuugauggggaccccaaacgcaaggaguuccuggaugaccucuuuuccuucaugcaaaagagaggaaccccugugaaccggauccccauuauggcuaaacagguccuggaucuuuuuaugcuguaugugcucguuacagaaaagggcggccugguggaagucaucaauaaaaagcuguggagagagauuaccaaagggcucaaccugccuacaucuaucaccagcgccgcguucacgcuucgcacccaguacaugaaguaucuguaccccuaugagugcgaaaagcggggacucuccaauccgaacgagcugcaggcugccauugacagcaauagacgcgaaggccggagacaaucuuuugggggaucccuuuucgccuacagcccuggcggggcucauggcaugcugucuucccccaaacuccccgugagcucucugggacuggccgcuuccacaaacggcagcuccaucaccccugccccgaagaucaaaaaggaggaagauucugcgauucccaucacaguuccugggcgccuccccgugagccuggccggacacccugucguggcugcccaggcugccgcggugcaggccgcugccgcucaggccgccgucgcugcgcaagccgcugcccuugagcagcugcgggagaaacucgaauccgccgagcccccugaaaagaaaauggcucugguugccgacgagcagcagagacuuaugcaacgcgcgcugcagcagaauuuucucgcuauggccgcccagcugcccaugagcauucggaucaacucucaagccuccgaaagcagacaggauucugccgugaaucugaccggcacgaacgggagcaauuccauuucuaugagcguggagaucaacggaauuauguacacaggcguccucuucgcgcagccgccugcucccaccccuacauccgcccccaauaaagggggcggaggcgggggaggcucuagcuccaacgccgggggacgcggcgggaauaccggcaccagcggaggccaagcugggccggccggacugucuacaccuuccacgagcaccuccaacaacucucuucccuga

SEQ ID NO: 66039 - RNA, 1683 nt, Artificial Sequence
  derived and/or modified sequence opt5 from ARID3B__Homo_sapiens__NP_006456
auggagccccugcagcaacagcagcagcaacagcagcagcaacagaagcagccucaccucgccccgcugcagauggacgcuagagaaaaacaaggccagcagaugcgggaggcccaauuccuuuacgcgcagaagcuggugacccagcccacacuccugagcgcuacggccgggcgcccuuccggaucuacaccccuuggcccucuggccagaguucccccuaccgcugccgucgcucagguguuugaacgggggaacaugaauagcgagccggaagaggaggauggaggccucgaagacgaggauggggacgaugaaguggccgaggucgcggagaaagaaacccaagccgcuuccaaguauuuccaugugcagaaaguugcccgccaggaccccagaguggcuccuaugucuaaccugcugcccgccccuggacugcccccgcacggccagcaagcgaaggaggaucauacaaaggacgccagcaaagccuccccuucugucagcaccgccggccagcccaauuggaaccucgaugaacagcuuaagcagaaugggggacuggcuugguccgacgaugccgacggcgggcggggacgcgagaucagcagagauuuugccaaacucuacgaacuggacggcgacccugagcggaaggaguuccuugaugaccuguuuguguucaugcaaaaacgcgggacacccauuaacagaauccccauuauggcuaagcagauccucgaucuguauaugcuguacaagcucguuaccgaaaaaggaggccugguggagauuaucaauaagaaaaucuggcgggaaauuacgaagggccuuaaccugccuaccucuaucacauccgcggccuuuacccuccgcacacaguauaugaaauaccuguaugcuuacgagugcgaaaagaaagcccuuagcucuccggccgagcugcaggcugccauugacgggaauagacgggagggacgcagacccuccuacucuagcucccucuucggcuauagcccugcggcugccaccgccgcugccgcugccggggcgcccgcccugcuguccccucccaagauccgguuuccgauucucggacugggcucuagcuccgggacgaacacaagcucuccuagaaucucccccgcuaccacacuucgcaagggagauggcgccccugucaccaccgugcccgugccuaaucggcuggcuguccccguuacacucgccagccaacaggcgggcacgagaaccgccgcucuggaacagcuucgcgagcggcuggaaucuggggagccggccgagaaaaaggcuagcagacucuccgaagaggaacaacgccuggugcagcaggccuuccagcggaacuuuuucucuauggccagacaacugccuaugaaaauucgcaucaauggacgggaggacagagcugaagcgagcgccgcugcccucaaccugacaaccuccagcaucggcucuauuaauauguccguggauaucgacgggacaaccuacgccggaguccuuuuugcucagaagcccgugguucaccugauuacgggcagcgcuccccagucucucggguccagcgcguccucuagcuccucuagccauuguuccccuagcccgacaucuucccgcggcacccccagcgcugagccuucuaccuccuggagccuguga

SEQ ID NO: 66040 - RNA, 3774 nt, Artificial Sequence
  derived and/or modified sequence opt5 from ARID4A__Homo_sapiens__NP_002883
augaaggccgcugacgagcccgccuaccugaccgugggcacagaugucagcgcgaaauauagaggggcuuucugcgaagccaagaucaaaacgguuaagcggcucgugaaagugaagguccugcuuaagcaggacaacaccacacaacuggugcaggaugaccagguuaaaggaccucuccgcgugggcgccauugucgagaccagaacauccgaugggucuuuucaggaagcuaucauuagcaagcugaccgacgccuccugguacacagugguuuucgaugacggagaugagcggacccuucgcagaacgucucugugucucaaaggcgaacggcacuuugcugagagcgagacccuggaccaacugccgcucacaaaucccgaacauuucgggaccccugugaucgccaagaaaacaaaccgcggaagacgguccucucugcccgucaccgaggaugaaaaggaggaggaaagcuccgaggaagaggacgaagauaagcgcagacuuaaugacgagcugcucggcaaaguggugagcgucguuucugcgacggagcggacagaaugguauccugcccuggugauuucccccagcugcaacgacgauaucaccgugaagaaagaccagugucuuguccgcucuuuuaucgauuccaaguucuacagcauugcuagaaaagacaucaaggagguggauauucugaaucucccugaaucugagcuguccacaaaaccgggccugcagaaggccagcaucuuucucaagacccggguugugcccgacaacuggaaaauggauauuuccgaaauccuggagucuagcuccagcgacgaugaggacgggccugcugaagagaaugaugaagagaaggaaaaagaggccaagaaaaccgaggaagagguccccgaagaggagcuugacccugaggaacgcgacaacuuccugcagcaacucuauaaguuuauggaagauagaggaacacccauuaauaagccgccugugcugggcuacaaagaccuuaaccuguucaagcucuuucggcugguuuaucaccaagggggaugcgauaauaucgacucuggcgcgguguggaaacagaucuacauggaucuggggauucccauccucaacuccgccgcuagcuacaaugucaagacggccuauagaaaauaccuguauggauucgaggaauacugucgcucugcuaacauucaguuucggaccgugcaucaccaugagccuaaggucaaggaggaaaagaaggaccuugaggaaagcauggaggaagcccugaaacucgaucaggagaugccccugacagaggugaaguccgaacccgaggaaaauaucgacucuaacagcgaguccgaaagagaggagauugaacuuaaaagcccucgcggccggagacgcaucgcccgggauguuaacucuaucaagaaggagauugaagaggagaaaaccgaagacaagcugaaagauaaugacacagagaacaaggauguggacgacgauuaugaaaccgcugagaaaaaggaaaaugagcuccugcugggcagaaagaacacgccgaagcagaaggagaaaaagaucaaaaagcaggaagacuccgauaaagacagcgaugaggaagaggaaaagucucaagagcgcgaggaaacagaguccaagugcgacagcgaaggggaggaagaugaggaggacauggaacccugucucaccggaaccaaagucaaggugaaauacggccgggggaagacacagaaaauuuaugaggcguccaucaagucuaccgaaauugaugacggagagguucuguaccuugugcacuacuauggcuggaaugucagauacgaugagugggugaaggccgaccgcaucaucuggccucuggauaaagggggacccaagaaaaagcagaaaaagaaggcuaaaaacaaggaagacagcgagaaagacgaaaagcgggaugaggaaagacagaaauccaagcggggccgcccuccccucaaaucuacacugagcuccaauaugccguauggccugagcaagacggccaacucugaggggaaguccgacagcugcuccuccgauagcgagaccgaagacgcccuugagaaaaaucucauuaacgaggaacugucucugaaggaugaacucgagaaaaaugagaaccugaaugacgauaaacuugacgaagagaacccuaaaaucagcgcucacauucugaaggaaaaugauagaacacaaaugcagccccucgagacccugaagcuggaagugggagagaacgagcagaucguucagauuuucggcaacaaaauggaaaagacagaggaagucaaaaaggaggccgagaaauccccuaaggggaagggacggagaagcaaaaccaaggaccuuucucucgaaaucauuaaaaucuccagcuucggccaaaaugaggcgggguccgaaccccauaucgaggcucacucucuggaacugagcucccucgauaacaagaauuuuucuagcgccacggaggacgagauugaccagugugugaaagaaaagaagcugaaacgcaagauccuuggccaguccucuccugagaaaaagauucggaucgaaaacggaauggagaugaccaauacagugagccaggaaagaaccuccgauugcauuggcagcgaggggaugaaaaaccugaauuucgagcaacauuuugaacgcgagaacgaaggaaugcccucucucaucgccgaguccaaucaguguauccagcagcugacaagcgaaagauucgacucuccggcugaggagaccgucaacauuccucugaaggaagaugaggacgccaugccccuuaucggccccgaaacgcucgugugccacgagguugaucuggacgaucuggacgagaaggauaaaacauccauugaagacguggcugucgagagcucugaauccaauagccucguguccaucccuccggcccugcccccuguugugcaacacaacuuuagcgucgcgucuccccuuacccugagccaggaugagucccggucuguuaagagcgaauccgacauuacaaucgagguggauucuaucgccgaggaaagccaggaggggcucugcgaacgcgaguccgcuaauggauucgaaaccaacguggccucuggcaccuguagcauuaucguccaagagagagagucccgggaaaaagggcagaagcgcccuagcgacggcaauucuggacugauggcuaaaaagcagaaaagaacacccaagcggacguccgccgcggccaagaacgagaaaaacggcaccgggcagagcucugacuccgaagaucugccugugcuugacaauagcuccaagugcacacccgugaaacaucucaacgucucuaagccgcaaaaacuggcucgcagcccugccagaauuucuccccacaucaaggauggagagaaggacaaacaucgggaaaagcacccuaauagcucuccccgcaccuacaaaugguccuuucagcugaacgagcucgauaauaugaacagcacagagagaauuucuuuccugcaggaaaaacuucaggagauccggaaauauuacaugagccugaaguccgaaguugcuaccaucgacagacgccggaagagacucaaaaagaaagaucgcgaggugucucaugccggcgccagcauguccucugcuagcuccgacacggggaugagcccgucuuccagcuccccuccccaaaaugugcuggcggucgagugucgguga

SEQ ID NO: 66041 - RNA, 3939 nt, Artificial Sequence
  derived and/or modified sequence opt5 from ARID4B__Homo_sapiens__NP_057458
augaaggcccuggacgagcccccuuaccucaccgugggcacagaugucagcgcuaaauauagaggggccuucugcgaagcgaagaucaaaacggcuaagcggcugguuaaagugaaggugaccuuucgccacgacuccucuacagucgaggugcaggaugaccauauuaagggaccgcuuaaaguuggcgccaucguggaagucaagaaccuggauggggccuaccaagaggcugugauuaauaaacucaccgacgccagcugguauacaguuguguucgaugacggagaugaaaagacccugagacgguccucucuuugucugaaaggcgagcgccacuuugcugagagcgaaacacucgaccagcugccccugaccaacccugagcauuucgggacgcccgucaucggaaagaagaccaauagaggccggcgcuccaaccacauuccugaagaggagucuagcuccucuagcuccgaugaagacgaggaugacagaaaacagaucgacgaacuccugggcaagguggugugcgucgauuacaucagccuugacaaaaagaaagcccugugguuucccgcgcucguuguguguccugauugcucugacgagauugccgugaagaaagauaauauccugguccgguccuucaaggacgggaaguuuacaagcgugccgcgcaaagauguucaugaaauuaccucugacacagcucccaagccugaugccgugcuuaaacaggcuuucgagcaagcccuggaguuucacaaguccagaaccauccccgcgaacuggaaaacggaacucaaggaggacagcuccucuagcgaagccgaggaagaggaggaagaggaagaugacgagaaggaaaaagaggacaauuccagcgaggaagaggaagagauugagccuuuccccgaggaacgggaaaacuuucugcagcagcuguauaaguucauggaggaucgcggaacaccgaucaauaaaagaccuguccucggcuaccggaaccugaaucuuuuuaagcuguuccgccucgugcacaaacuugggggauucgacaacauugaaucuggcgcuguuuggaaacagguguaucaagaucuugggauccccguccuuaauuccgccgcuggauacaacgugaagugugccuacaaaaaguaucucuacggcuuugaggaguauugcagaagcgccaauaucgaguuccagauggcucugccugaaaaagucgugaacaagcaguguaaagaaugcgagaacguuaaggaaauuaaggugaaagaggagaaugaaaccgagaucaaggaaauuaaaauggaggaggaacggaacaucauucccagagaggaaaagcccaucgaggacgaaaucgagcgcaaagagaauauuaagccuucucugggcagcaaaaagaaccuccuggaauccaucccgacacauucugaucaggagaaggaagucaauauuaaaaagcccgaggacaacgaaaaucuugaugacaaagaugacgauaccacccggguggacgagagccugaacaucaagguugaggcggaagaggaaaaagccaaguccggggaugagacaaauaaggaagaggacgaggacgaugaagaggcugaagaggaagaggaggaagaggaagaggaggaagacgaggaugacgaugacaacaaugaagaggaagaguuugaguguuacccucccggaaugaaagugcaagucagauauggccgcgggaagaaccagaaaauguacgaagccagcauuaaggauucugacguggagggaggcgaagugcucuaucugguucacuacugcggguggaauguccgguacgaugaguggaucaaagccgacaagaucgugagaccugcugauaagaacgugcccaaaauuaagcaucgcaaaaagaucaaaaauaagcuggacaaggaaaaagauaaggacgagaaauauuccccgaagaacuguaaacugcggagacucagcaagccucccuuccagacgaacccuucucccgagauggucuccaaacuggaccugaccgaugccaagaauagcgacacagcgcacauuaaguccaucgaaauuaccucuauccucaacggacugcaagcuagcgaguccucugccgaagauagcgagcaggaagacgagcgcggcgcccaggauauggacaauaacggcaaagaggaauccaagauugaucaccuuacaaauaaccggaaugaccugaucagcaaagaggaacagaacucuuccagccuccuggaggagaauaaggugcaugcugaucugguuaucucuaaaccuguguccaagagccccgaaagacuucgcaaggacauugagguccucucugaagauaccgacuacgaggaagacgaggugacgaaaaagcggaaagauguuaagaaagacacaaccgauaagagcuccaagccgcaaaucaaaagagggaagcggcgcuauugcaacaccgaggaaugccugaaaacaggaagcccuggcaagaaagaggaaaaggccaagaauaaagagucucuguguauggaaaacuccagcaauuccucuagcgacgaggaugaggaagagaccaaggcuaaaaugacacccacgaagaaauacaacgggcucgaagagaagagaaagucccugcggaccacaggauuuuauucuggcuucagcgaaguggccgagaaaagaauuaagcugcugaauaacuccgacgagcgccuccagaacucucgggcgaaagauagaaaggacgucuggagcuccauccaggggcaguggcccaaaaagacccugaaagaacuguuuagcgauucugacacagaggccgcugccuccccuccgcaccccgcuccugaagagggcguggccgaggaaagccuucaaaccguugcggaggaagagucuugcucccccagcguggaacucgagaagccucccccugucaauguggauucuaagcccauugaggaaaagacgguggaggucaacgaccgcaaggccgaguucccguccagcggauccaauagcguucugaacaccccucccacaaccccugaaucucccagcuccgugacagugaccgaaggcucuagacagcagagcuccgucacggugucugagccgcuggcuccuaaucaggaggaaguucggagcaucaaauccgagacagauucuaccaucgaaguggacagcgucgccggggagcuccaagaccugcaguccgaaggaaacagcucucccgcuggcuuugaugccuccgugucuagcuccagcuccaaucagccugagcccgagcaucccgaaaaggccuguacagggcagaaacgcguuaaggacgcucaaggaggcgggucuagcuccaagaaacagaagagaagccacaaagcgaccguggucaacaauaagaaaaagggcaagggaaccaacucuuccgauagcgaggaacuuucugccggcgagagcauuacaaaaucccagccugugaagucuguuagcacggggaugaaaucccauucuaccaagagcccggcucggacacaaucccccggaaaaugcggcaagaauggggacaaggauccugaccugaaagagcccagcaaccgccucccuaagguguacaaauggucuuuccagauguccgaucuggaaaauaugaccagcgccgagagaaucacaauucugcaggaaaaacuucaggagauccggaagcacuaucucucccugaagucugaagucgccagcauugaccgcagacggaaacgccugaagaagaaagagagagaguccgcugccaccucuagcuccucuagcucccccucuagcuccagcaucacggcggcugugaugcucacacuggccgaaccuucuaugagcuccgccucucaaaacggaaugagcguggagugucgguga

SEQ ID NO: 66042 - RNA, 2838 nt, Artificial Sequence
  derived and/or modified sequence opt5 from ARID5B__Homo_sapiens__NP_001231567
auggcccccaaccugaagggcagaccucggaaaaagaaaccgugcccccagcgcagagacagcuucuccggggugaaggauucuaauaacaauagcgacggaaaagcugucgccaagguuaagugugaggcgcgguccgcucucaccaaaccuaagaacaaucacaacugcaaaaaggugucuaaugaagagaaacccaagguggccaucggcgaagagugucgcgccgaugaacaggcuuuucuggucgcccuuuacaaguauaugaaagagagaaagacaccuauugagcggauccccuaccugggguucaaacaaauuaaccucuggacgauguuucaggcugcccagaagcugggaggcuaugaaaccaucacagcgcgcagacaauggaaacauauuuacgacgagcuugggggaaauccuggcagcaccuccgccgcuacaugcacccggcgccacuaugaaagacugauccucccguacgagcgguucaucaagggcgaggaagauaaaccccugccucccauuaagccucgcaagcaggagaacucuagccaggaaaaugagaacaaaacaaagguguccgggaccaaaagaaucaagcaugaaauucccaaaagcaagaaggagaaagagaaugccccgaagccucaggacgcugccgaaguuucuuccgagcaagaaaaagagcaggaaacgcugaucagccagaagucuauucccgagccucuccccgcggccgauaugaaaaagaagaucgagggauaucaggaauuuuccgcuaaaccccuggccagccggguggacccugagaaggauaacgaaaccgaccaaggcucuaauuccgagaaagucgcugaagaggccggggagaagggaccgacacccccucuucccagcgccccucuggcucccgaaaaagauuccgcgcucgugccgggcgccucuaagcagccucugaccagccccuccgcucuuguugacagcaagcaggagucuaaacuguguugcuucacagaauccccugagagcgagccccaagaagccucuuuuccuagcuuccccaccacgcagccgccucucgccaaccagaacgagacagaagaugacaagcugcccgcuauggccgacuacauugcgaauuguaccgugaaagucgaucagcugggguccgacgauauccacaacgcucucaagcaaacacccaaagugcuggugguccagucuuuugacauguucaaggauaaagaccuuaccggaccuaugaaugagaaccauggccugaauuacaccccgcuccuguauagccgcggcaaccccgggaucauguccccucuugccaagaagaaacugcucagccagguuucuggagccucccuguccucuuccuaccccuauggcagcccucccccucugauuuccaagaaaaagcucaucgcuagagaugaccugugcucuagccuuucccagacacaccacgggcaaucuacggaucauauggccgugagccggcccuccgugauucagcacguccagagcuuuagaucuaaaccguccgaggaacgcaagaccaucaaugacauuuucaagcaugagaaacugagccggucugauccucacagauguuccuuuagcaagcaccaucucaacccccuggcugacucuuacgugcuuaaacaggaaauccaagagggaaaggacaaacugcucgaaaagcgcgcccugccucacagccauaugcccuccuuccuggcggauuucuauagcucuccgcaccuccauucccuguaccggcacacagagcaccaucuucacaaugaacagaccagcaaguauccuuccagagacauguaccgcgagucugagaacagcuccuuucccucucaucggcaccaggaaaaacugcacguuaauuaccucacaagccugcaucugcaggauaagaaauccgccgcugccgaggcuccuaccgacgaucaacccacggaccuuucucuccccaagaacccucacaaaccgacaggcaaggugcuggggcuggcccauagcaccaccggaccccaggaauccaagggcaucagccaguuccaaguccucggcucucaguccagagauugccacccuaaagcgugucgcgugagccccaugacaaugucugggccuaagaaauaucccgagucccugagccggucuggaaagccucaucacguuagacuugaaaauuuucgcaaaauggagggcauggugcacccgauucugcaucggaagaugagcccccagaacaucggggccgcuagaccuauuaaacggagccucgaggaccuggaucuggucaucgccggaaagaaggcucgcgccgugagcccccuugacccuuccaaagaagucucuggcaaggagaaagccagcgaacaggaguccgaggggucuaaggcugcgcacggcggacauagcggcgggggauccgaaggccacaaacucccccugucuagcccgauuuucccugggcuguacuccggaucucucugcaauagcggccugaacuccagacuucccgccggguauagccauucucugcaauaccucaagaaccagaccgugcugagcccccugaugcagccucuugcuuuucacucccucguuaugcagcggggcaucuucacaucucccaccaauucccaacagcuguauagacaccuggccgccgcuacgccugugggaagcuccuacggcgaucuccugcauaacucuaucuauccgcuugccgcgauuaauccccaggcugccuuuccuagcucccagcugagcucuguccaccccuccacaaagcucuga

SEQ ID NO: 66043 - RNA, 1674 nt, Artificial Sequence
  derived and/or modified sequence opt5 from ARIH1__Homo_sapiens__NP_005735
auggacagcgaugagggcuacaacuaugaguucgacgaagaugaagagugcuccgaagaggacucuggggccgaggaagaggaagaugaggacgaugacgagcccgaugacgauacccuggaccucggagaaguggagcuggucgaaccuggccuugggguuggaggcgagagagaugggcugcucuguggagaaacaggcggcgggggaggcagcgcucuggggccgggaggcgggggaggcggcgggggaggcgggggaggcgggggacccggccacgagcaggaggaagacuaccgguaugaggugcuuacggccgaacaaauccugcagcauaugguggagugcauucgcgaagucaaugaggugauccagaacccugcgaccauuacaagaauccuccugucccacuuuaauugggacaaggagaaacugauggaacgguacuucgauggcaaccucgagaagcuguuugcugaaugucauguuauuaaucccucuaaaaagagccgcaccagacagaugaacacacgguccucugcccaagacaugccuugccagaucuguuaucuuaauuaccccaacagcuauuucaccgggcuggagugcggacacaaauuuuguaugcagugcugguccgaauaccucacaaccaagaucauggaggagggcauggggcagacgauuagcuguccugcccauggaugcgauauccugguggacgauaauaccgucaugcgccuuauuacagacucuaaggugaaacugaaguaccaacaccucaucaccaacuccuucguugaauguaauagacugcugaaauggugcccggcucccgauugccaccauguggucaaggugcaguauccugacgccaaacccgugcgguguaagugcggccgccaguuuuguuucaacugcggggagaauuggcacgauccugucaaguguaaauggcucaagaaauggauuaagaaaugcgacgaugacagcgaaacaucuaacuggaucgcugccaauaccaaggagugucccaaaugccauguuacgauugagaaggacggcggauguaaccacauggugugcagaaaccagaauuguaaggcggaauuuugcugggugugccugggcccgugggagccucacggguccgccugguacaacuguaaucgguauaacgaagaugacgcuaaagccgcucgcgaugcccaagagagaagccgggcggcccuucagcgcuaccuguucuauugcaauagauacaugaaccauaugcagucucuccgguuugaacacaagcuguaugcucaagucaaacagaagauggaggagaugcagcagcauaauauguccuggaucgaagugcaauuccuuaaaaaggccguugacgugcugugucagugcagagcuacacucauguacaccuacgucuuugccuucuaucugaagaaaaacaaucagagcaucauuuucgagaacaaucaggccgaucuggaaaacgcuacagaggugcucuccggauaccuggaacgcgacaucucucaagauagccuucaggacauuaagcagaaaguucaggauaaguaucgguacugugaguccagacgccgggugcugcuccaacacguccaugagggcuaugaaaaagaccugugggaguacaucgaagauuga

SEQ ID NO: 66044 - RNA, 591 nt, Artificial Sequence
  derived and/or modified sequence opt5 from ARL11__Homo_sapiens__NP_612459
augggcagcgugaacuccagagggcacaaggccgaggcucaggucguuaugaugggacuggacucugccggcaaaaccacacuccuguacaaacuuaaggggcaucaacugguggaaacgcuccccaccgugggauucaaugucgagccucugaaggcgccgggccacgugagccuuacacugugggauguugggggacaggcuccccuccgggccuccuggaaagacuaucuggaaggcaccgauauccugguguacguccucgacucuacagaugaggcccgccugccugaaagcgcugccgagcuuaccgaggugcugaacgaccccaauauggcuggcguuccuuuucucgugcuggccaacaagcaggaagcgcccgaugcccuuccucugcucaagauuagaaaucggcugucccuggagcgcuuccaggaccauugcugggaacucagaggguguucugcucugacaggagagggccuuccggaggcccugcaaagccucuggucccugcuuaaaagccggucuugcaugugucugcaggcucgcgcccacggggcggaaagaggagauuccaagcggagcuga

SEQ ID NO: 66045 - RNA, 771 nt, Artificial Sequence
  derived and/or modified sequence opt5 from ARL13A__Homo_sapiens__NP_001155963
auguucagacugcucagcuccugcuguucuugccugcggaccacagaggaaacgcgcagaaacgugaccauccccauuaucggccuuaauaacagcgggaagacaguccugguugaggccuuucagaaacuccugccuuccaagaccgaccacuguaugaaaucugaacuuacaacccugcuccuggacgaguacgaacugagcauuuaugaccucaauggagaucugaagggccgggaggcuuggccgaacuacuaugcccaagcgcaugggcuuguguucgugcuggacuccucugauauccgcagaaugcaggaggucaaaauuauccucacacaccuucuuagcgacaagcggguggcuggaaagcccauccugauucucgccaauaaacaggauaagaaaaaggcccugaugccuugcgacaucauugauuaccugcuccugaaaaagcugguuaaggaaaacaaaugucccugccgcguggagccuuguuccgcuaucagaaaucuggaacggcgcaaccaucagcccauugucgagggccucagauggcugcuugccgugaucgauaccugccaacugccuccgacgagcucuauuuccaucagcaagaauaacaccgggucuggagagcgguguuccagccacucuuuuuccacacgcaccggcaugagcaaagaaaagagacagcaucucgagcagugcuccaucgaagcuaaaccccugaagucuauucugcagccuagcaaucaauccuauacacacuga

SEQ ID NO: 66046 - RNA, 1287 nt, Artificial Sequence
  derived and/or modified sequence opt5 from ARL13B__Homo_sapiens__NP_001167621
auguucagccugauggccuccugcuguggcugguuuaagagauggcgggagcccgugcgcaaagucacccuccugaugguugggcuugacaacgcuggaaagacagccacggcgaaaggcauccagggggaauacccugaggauguggcuccgaccgugggauucucuaagauuaaucugagacaaggcaaauuugaagucacaaucuucgaccucgggggaggcauucggauccgcggcauuuggaagaacuauuacgccgagagcuauggggugaucuuuguuguggauuccucugacgaagagagaauggaggaaaccaaggaggccaugagcgaaaugcugcggcacccccgcaucuccggaaaaccuauucuuguccuggcuaauaagcaggauaaagagggcgcccucggggaggcugacgugaucgaaugccugucucuggagaagcucguuaacgaacauaaaugucugugccagauugagcccuguagcgccaucuccggauacggcaagaagauugauaaaagcaucaagaaagggcuuuauuggcugcuccacgugauugcgagagacuucgaugcccugaaugaacggauccagaaggagacaaccgagcaacgcgcucuugaggaacaggaaaaacaggagagagccgaacggguccgcaagcugagagaggagcggaaacagaacgaacaagagcaggcugaacucgacggaacaucuggccuggccgagcuggauccugaacccaccaauccuuuucagccgaucgcguccgugauuaucgagaacgagggcaagcucgaacgcgagaagaaaaaucagaagauggaaaaagacagcgaugggugccaucugaagcacaaaauggagcaugagcaaauugaaacgcagggacaggugaaccacaauggccaaaagaacaaugaguucgggcuugucgaaaacuacaaggaggcccugacccagcagcucaaaaaugaagacgagacagacagacccucucuggaguccgcuaacggaaagaaaaagaccaaaaagcuccggaugaagagaaaccaccgcguugaaccucugaauaucgaugacugugcccccgagagcccuacacccccgccucccccuccgcccgugggcugggggaccccuaaagugacgcggcucccgaagcuggaaccccugggagagacacaucacaacgauuuuuauagaaaaccucuucccccucuggcugucccccagcgccccaauucugacgcccaugaugugauuuccuga

SEQ ID NO: 66047 - RNA, 783 nt, Artificial Sequence
  derived and/or modified sequence opt5 from ARL14EP__Homo_sapiens__NP_689529
augauggaccccugcagcgugggcguccagcugagaaccacaaacgagugucacaagacguacuauacccggcauacaggguucaaaacccuccaagaacuguccucuaaugauaugcuucugcuccagcugcgcacaggaaugacccuuagcggcaacaauacaaucugcuuucaccauguuaagauuuacaucgacagauucgaggaucugcagaaauccuguugcgacccuuuuaacauucacaagaaacucgccaagaagaaucugcaugugaucgaucuggacgaugcuaccuuccucucugccaaauuugggcggcagcuggugccgggauggaaacuuugucccaagugcacgcaaauuaucaacggcagcgucgacguggauaccgaagaccgccagaagagaaaaccugaguccgaugggcggacagcgaaggcucugcgcucucuccaguucaccaaucccggaagacagacagaauuugccccugagaccggcaagcgggagaaacgcagacugacgaagaacgccacagcuggcagcgaccggcaaguuauccccgccaaauccaagguguaugauagccaggggcuucugauuuucucuggaauggaccucugugacugccuggaugaagacugucugggcugcuuuuacgcuuguccugccugcggguccaccaaaugcggagcggagugucgcugcgauagaaaguggcucuaugaacagaucgagauugagggcggggaaaucauucacaauaaacacgccggauga

SEQ ID NO: 66048 - RNA, 579 nt, Artificial Sequence
  derived and/or modified sequence opt5 from ARL14__Homo_sapiens__NP_079323
augggcagccugggguccaagaacccccagaccaaacaagcccaggugcuccugcuuggacuggacucugcuggcaagagcacacuccuguacaaacuuaagcuggccaaagauaucacgaccauuccuacaaucggguucaaugucgagaugauugaacucgagcggaaccugucccugaccguuugggacgugggaggccaggaaaagaugcggacagugugggggugcuauugugagaauaccgauggacucgucuacgugguugacucuacagauaagcagcgccuggaagagagccaaagacaguuugagcacauccuuaaaaacgaacauauuaagaaugugccggucgugcugcucgcgaacaaacaggacaugcccggcgcucugaccgccgaggauaucacgcggauguucaagguuaaaaagcugugcuccgaccgcaauugguaugugcagccuuguugcgcccuuaccggcgaagggcucgcucaaggauuuagaaagcugacaggcuucgucaaaucucacaugaaaagcagaggggauacccuggccuuuuucaagcagaacuga

SEQ ID NO: 66049 - RNA, 615 nt, Artificial Sequence
  derived and/or modified sequence opt5 from ARL15__Homo_sapiens__NP_061960
augagcgaccugagaaucaccgaggccuuccucuacauggauuaucugugcuuucgggcucuuuguugcaaggggcccccuccggcccgccccgaauacgaccugguguguauuggccucacaggauccggcaaaacgucucugcuuagcaagcugugcuccgagucuccugauaacgucguuagcaccacaggguucuccaucaaagcggugcccuuucagaaugcuauucucaacgugaaggaacugggaggcgccgacaauaucagaaaauauuggucucgguacuaucaagggagccagggagucauuuucgugcuggauuccgccagcucugaggacgaucucgaagcugcccgcaacgagcugcacuccgcccuucagcauccucagcuguguacccuccccuuucugauccuugcuaaucaccaagacaagccugcggccagaagcguucaggagaucaagaaauacuucgaacuggagccgcucgcucggggcaagcgcuggauucugcagcccugcucucuggaugacauggaugcccucaaagacuccuuuagccagcugaucaaccuucuggaagagaaggaucaugaggcugugagaauguga

SEQ ID NO: 66050 - RNA, 546 nt, Artificial Sequence
  derived and/or modified sequence opt5 from ARL1__Homo_sapiens__NP_001168
augggcggguucuuuagcuccaucuucucuagccuguuuggaaccagagagaugcggauucucauccugggccuugacggggccggaaagacaacgauucuguaccgccuccaggugggcgaagucguuaccacaauccccaccauuggguucaacguggagacagugaccuauaaaaaucugaaguuucaagucugggaucuuggaggccagacauccaucagaccuuacuggcggugcuauuacucuaacaccgacgcugugaucuauguuguggauagcugugaccgcgauagaauuggcaucuccaaaucugaacuggucgccaugcucgaggaagaggagcugcggaaggcgauucuggugguuuucgcuaauaaacaggacauggaacaggccaugacgagcuccgagauggccaacagccucgggcugccggcucuuaaggaucgcaaguggcaaaucuuuaaaaccucugccacaaagggaaccggccuggacgaagcuauggaguggcucguggagacacugaaauccagacaguga

SEQ ID NO: 66051 - RNA, 492 nt, Artificial Sequence
  derived and/or modified sequence opt5 from ARL2BP__Homo_sapiens__NP_036238
auggacgcccuggagggcgaauccuucgcucucagcuuuucuagcgccuccgaugcggaguucgacgcuguggucggguaccuggaagauaucauuauggacgaugaguuucagcuucugcaaagaaacuucauggacaaguauuaccucgaauuugaggauaccgaggaaaauaaacugaucuauacacccauuuucaacgaguacaucucucuuguugaaaaguauauugaggagcagcugcuccagcggaucccugaauuuaauauggccgccuucacgaccacacugcagcaccauaaagacgagguggcuggagauaucuuugacaugcugcucaccuucacagauuuucuggccuucaaggaaauguuucuugacuaccgcgcugagaaagaaggcagagggcuggaucucagcuccggacugguggucaccucucuuugcaagagcuccagccugccggccucucaaaacaaucuccggcacuga

SEQ ID NO: 66052 - RNA, 474 nt, Artificial Sequence
  derived and/or modified sequence opt5 from ARL2__Homo_sapiens__NP_001186674
augggccugcucaccauccugaagaaaaugaagcagaaagagagagaacuucggcugcucaugcuggggcuugacaacgccggaaagacaacgauucugaaaaaguucaauggcgaggauaucgacaccauuagccccacacucggguuuaacaucaagacccuggaacaccgcggauucaaacugaauauuugggaugugggcgggcaaaagucccucagaucuuacuggcggaacuauuuugagagcacagacggacugaucugggucguugauuccgcugaccgccagagaaugcaggauugccagcgggaacuucaaucucugcucguggaggaggugcuggaacuugacagcauccgcucccaucacugguguauucagggcugcucugccgucaccggcgagaaucugcucccugggaucgauuggcugcuggacgauauuagcuccagaaucuucacagcggacuga

SEQ ID NO: 66053 - RNA, 549 nt, Artificial Sequence
  derived and/or modified sequence opt5 from ARL3__Homo_sapiens__NP_004302
augggccugcucagcauccugagaaaacuuaaguccgcccccgaccaggaggugcggauucugcuccuggggcuugauaacgcuggaaagaccacacugcucaaacaacuggccucugaagacaucagccacauuacgccuacccagggcuucaauaucaaguccguccagucucagggguuuaaacugaacguuugggauauuggaggccaacgcaagaucagaccguacuggaagaauuauuucgagaacacagacauccucauuuacgugaucgauagcgcggaccggaaacgcuuugaagagaccgggcaggaacuggcugagcuucuggaggaagagaagcucuccugcgugcccguccugauuuucgccaauaaacaggaucuucugacagccgcuccugccucugaaaucgcugagggacucaaccugcauaccauuagagaccggguguggcagauccaaagcuguuccgcccugacaggcgagggcguucaggaugggaugaauugggugugcaagaacgucaaugcgaaaaagaaguga

SEQ ID NO: 66054 - RNA, 603 nt, Artificial Sequence
  derived and/or modified sequence opt5 from ARL4A__Homo_sapiens__NP_001182325
augggcaacgggcugagcgaccagaccuccauccucucuaaucugcccagcuuccaauccuuucacauugugauccuuggacuggauugcgccggcaagacaacgguccucuacagacugcaguucaacgaguuuguuaauaccgugccuacaaaaggguucaacaccgaaaagauuaaagugacacuuggaaauucuaagaccgucacauuucauuucugggacgugggcgggcaggagaaacugcggccgcucuggaaaagcuauacccgcuguacggauggaaucguuuuuguggucgacuccguggauguugaaagaauggaggaagcuaagaccgagcugcacaagauuacacggaucucugagaaccagggcgugcccguccugaucguggccaauaagcaagaccuccgcaacagccugucccuuagcgaaauugagaaacugcucgcgaugggcgaacugucuuccagcaccccuuggcaucuucagcccacaugcgcuaucauuggggauggacugaaggagggccucgagaaacugcacgacaugaucauuaagagacggaagaugcugcgccagcagaaaaagaaaagauga

SEQ ID NO: 66055 - RNA, 606 nt, Artificial Sequence
  derived and/or modified sequence opt5 from ARL4C__Homo_sapiens__NP_001269360
augggcaacaucagcuccaauauuucugccuuccagagccugcacaucgugaugcucgggcuggacuccgcuggaaagaccacaguccuuuacagacugaaauuuaacgaguucguuaauacggugcccaccauuggcuuuaacacagaaaagaucaaacucucuaaugggaccgccaagggaauuagcugccauuucugggaugugggcgggcaagagaaacugcggccucuuuggaaguccuauucucgcuguacagacggaaucaucuacgucguggauagcguugacguggauagacuggaagaggcgaagaccgaacuccacaaagucacaaaguuugcugagaaccagggcaccccgcugcuggugauugccaauaaacaggaccuccccaagucccugccuguugccgagaucgaaaaacagcuugcucugcaugagcucauucccgccacgaccuaucacgugcaaccugcuugcgccaucauuggcgaagggcugacagagggaauggauaaacuuuacgagaugauccugaagcggcgcaagagccucaagcagaaaaagaaaagaaccggcgaccugcggucuugugaagucuga

SEQ ID NO: 66056 - RNA, 606 nt, Artificial Sequence
  derived and/or modified sequence opt5 from ARL4D__Homo_sapiens__NP_001652
augggcaaccaccugaccgagauggcccccacagcuagcuccuuccucccucauuuucaggcccugcacguggucguuaucgggcuugacucugcgggaaagacgagccugcucuacagacugaaauucaaggaauuugugcaauccgugccgaccaaaggcuucaauacagagaagauucgggucccccuugggggaucucgcggcaucaccuuucaggugugggauguugggggacaggaaaaacugagaccucucuggcggagcuauacacgcagaaccgacggccugguguucgucguggaugcugccgaggccgaacggcuggaggaggcuaagguugaacuccaucgcauuuccagagccucugacaaccagggcgugcccguccuggugcuugcuaauaagcaagaucagccuggggcccugagcgcggccgagguggaaaaacggcucgcuguccgcgagcuggccgcugccacacuuacccacguucagggaugcuccgcgguggacggccuggggcuccagcaaggacuggagagacuguacgaaaugauccucaagcggaaaaaggccgcucgcggcgggaaaaagagacgguga

SEQ ID NO: 66057 - RNA, 429 nt, Artificial Sequence
  derived and/or modified sequence opt5 from ARL5A__Homo_sapiens__NP_001032251
augaacgaggugguccacaccagccccacaaucggcuccaauguugaagagauugugaucaacaauacgagauuccugaugugggacauugggggacaggaaucucuccggagcuccuggaacaccuacuauacaaauaccgaguuugugaucgucgugguugauucuacagaccgcgaaagaauuagcgugacccgggaggagcuguacaagaugcuugcccaugaagaucugcgcaaagcuggccuccugaucuucgccaacaagcaagacgucaaagagugcaugacaguggcggaaaucucccaguuucuuaagcugaccucuauuaaagaucaccaguggcauauccaggcuuguugcgcccucacgggggagggacugugucaaggccuggaguggaugaugagcagacucaagauucgguga

SEQ ID NO: 66058 - RNA, 540 nt, Artificial Sequence
  derived and/or modified sequence opt5 from ARL5B__Homo_sapiens__NP_848930
augggccugaucuucgccaagcucuggagccuguuuugcaaccaggagcacaaagugauuaucgucgggcuugacaaugcuggaaagaccacaauucuguaccaauuccucaugaacgaaguugugcauacgucccccaccaucggcucuaauguggaggaaauugucgugaaaaacacacacuuucugaugugggauaucgggggacaggagagccuuagauccucuuggaauaccuauuacagcaacacagaguucaucauucugguuguggacuccaucgaucgggaacgccucgccauuaccaaggaggaacuguauagaaugcuggcgcaugaggaccuccggaaagcugccguccugaucuuugccaauaagcaggauaugaagggcuguaugacagcugccgaaauuucuaaauaccuuacccugagcuccaucaaggaccacccuuggcauauucagagcugcugugcucucacgggggagggacugugccaaggccuugaguggaugaccucucgcaucggcgugagauga

SEQ ID NO: 66059 - RNA, 561 nt, Artificial Sequence
  derived and/or modified sequence opt5 from ARL6__Homo_sapiens__NP_816931
augggccugcucgacagacugagcgugcuucuggggcucaagaaaaaggagguccacguucugugccuuggacuggauaacuccggcaaaaccacaaucauuaauaagcucaaacccucuaacgcccagagccaaaauauccugccuacgauuggguucuccaucgaaaaguuuaagucuagcucccugucuuucaccguguuugacaugagcggacagggccgguaccgcaaccucugggagcauuauuacaaagaagggcaggcuauuaucuucgugaucgauuccagcgacagacugcggauggucguggccaaggaggaacuugauacacugcucaaucacccggacauuaaacaucgcagaauccccauucuguuuuucgcgaacaagauggaucuucgggacgcuguuaccucugugaaagucucccagcugcucugucuggagaauaucaaggauaagccuuggcacauuugcgccagcgacgccaucaaaggagagggccugcaagaaggcguggauuggcuccaggaccagauucagacaguuaagaccuga

SEQ ID NO: 66060 - RNA, 612 nt, Artificial Sequence
  derived and/or modified sequence opt5 from ARL6IP1__Homo_sapiens__NP_055976
auggccgagggcgacaacagaagcaccaaucugcucgcugccgaaacagcgucccuggaggaacagcuucaaggguggggagaggugaugcugauggcugauaagguccuccggugggaacgcgccugguuucccccugccaucaugggcguugugucucugguguuccuuauuaucuacuaucuggacccgagcguccucuccggggugucuugcuucguuauguuucugugucuggcugauuaccucgugcccauucuggccccuagaaucuucggaagcaacaaauggacgaccgagcagcagcagcgguuucacgagauuugcuccaaucuugucaagacacgcagacgggcugugggcugguggaaacgccuguucacccucaaggaagagaaacccaagauguauuuuaugacaaugaucguuucucuggccgcgguggccugggucgggcaacaggugcauaaccuucugcucaccuaccugaucgugacaagccugcuccugcuuccuggacugaaucagcacggcauuauccucaaguauauuggcauggcuaaaagagaaaucaacaagcugcuuaaacagaaggagaaaaagaaugaguga

SEQ ID NO: 66061 - RNA, 567 nt, Artificial Sequence
  derived and/or modified sequence opt5 from ARL6IP5__Homo_sapiens__NP_006398
auggacgugaacaucgcuccccugagagccugggaugacuucuuuccuggcagcgaucgguucgcccgcccggacuuuagagauauuuccaaguggaauaaccgggucguuucuaaucuccuguacuaucagaccaacuaccuugugguggcggcuaugaugaucagcauugucggguuccugucccccuuuaauaugauccucggaggcauugugguugugcuggucuucacaggguuugugugggccgcccacaacaaagacguucuucgcagaaugaagaaacgguauccuacgaccuucgugauggucgugaugcuggcuucuuacuuucucaucagcauguucggaggcgugauggucuuuguuuucgggaucacauuuccccugcugcucauguucauucaugccucccugcgccuuagaaaucugaagaacaaacucgagaauaagauggaaggaaucggccugaagcggaccccuaugggcauugugcuugaugcucuggagcaacaggaagaggggaucaaccgccucacagacuauauuucuaaagugaaggaauga

SEQ ID NO: 66062 - RNA, 927 nt, Artificial Sequence
  derived and/or modified sequence opt5 from ARMC10__Homo_sapiens__NP_001154481
augggcgggcccagaggagccggcuggguggcugccgggcugcuccugggagcgggcgcuugcuacuguaucuaucggcuuacccgcgggagacggcgcggagacagagagcugggcauucggagcuccaagucugccgaagaucucacagacggcagcuacgaugacguccugaacgccgagcagcuucaaaaacugcucuaucugcuggaauccacggaggauccuguuaucauugaacgcgcucucaucacccuggggaauaacgccgcuuucucugugaaucaggccauuaucagagagcuuggaggcaucccgauuguggcgaacaagaucaaucacagcaaccaguccauuaaagagaaggcccugaaugcucucaacaaucugucugucaacguggaaaaucagaucaaaauuaagaucuacauuagccaaguuugcgaggacguguuuuccgggccccuuaacagcgccguccagcuggcuggacucacacugcugaccaauaugacagugaccaacgaucaucagcacaugcuccauucuuauaucacagaccuguuccagguucuucugaccggcaaugggaacacgaaggugcaaguccucaaacugcuucugaaccucuccgaaaauccugccaugaccgagggacugcugcgggcgcaaguggauagcucuuuucucucccuguacgacagccacguggccaaggagauccuucugcgcguccucacacuguuccagaacauuaaaaauugucuuaagaucgaaggccaucuggcuguucagcccaccuuuacagagggcucucucuucuuucugcugcacggggaagagugcgcccagaaaauuagagcucucguggaucaccaugacgccgaagugaaggagaaggucgugaccaucauuccuaaaaucuga

SEQ ID NO: 66063 - RNA, 543 nt, Artificial Sequence
  derived and/or modified sequence opt5 from ARMC1__Homo_sapiens__NP_001273631
augagcgccuggcccuacuucaucuauggcccuucccagccgucuagcagaccccugcgguuugcuugcuccucuauucucgggcgcaugccuuguaagcaaagaaaagacgagcggcgcaccggauacgauguggaacugacaaagugcuauacggagagcagacggaaccuuugugaagaggcccugcucaaaaucaagggcgucauuuccuucaccuuucagauggcgguucagcgcugcguggugagaauccggucugaccugaaagcugaagcccuugccagcgcuauugccuccacaaaggucaugaaggcucagcaagugguuaaaagcgagucuggggaggaaaugcuggugcccuuccaggauaccccugucgagguggaacagaauacagagcuccccgacuaccugccugaggaugaauccccgaccaaggagcaggacaaagccguuagccgcgugggaucucaccccgaaggcggggcguccuggcugagcacagccgcuaacuuucucucuagauccuucuauugguga

SEQ ID NO: 66064 - RNA, 2604 nt, Artificial Sequence
  derived and/or modified sequence opt5 from ARMC2__Homo_sapiens__NP_115507
augcugagccccaacgacaagaugcucggcaaacuggauccuuucuaccagccguccgugucuaagcagaaaaccagcgccgagaucauuuccgaagcuagaaaugcccuucggacaguccgcacgcaaagacccuuuaccccucaggaggcgcagcggaagcuguucgggcccgcuucuagccgcacauccgaaaacagaccucccucuagcuuuucccuccacgccagcucuuucgaguccagcgacucucggccuaucuccggaacccgccugagcccgcuugaacugaaacccaagguuccugccucucccacaagagaggaggauuccugcuuuagcuucccuaagcccccgguggacccugcuaaaauucggcgcguguccaaugccagagcucggcucuuucgcgccgcgucucaaagagcccugcugcccgaucggagccucccucccuccgacagcaagaaaaccgucgaaucuaaggagacagugaugaugggcgauuccaugguuaaaaucaacgggauuuaucugaccaagagcaaugcuaucugucaucuuaagucucacccccugcagcucacggacgauggaggcuucagcgaaaucaaagagcaggagauguuuaaggggaccacaucccugccuucucaucuuaaaaacggaggcgaccagggcaagcgccacgccagagcuagcuccugcccgucuagcuccgaucugagccggcuccaaaccaaagccgugcccaaggcggaccugcaggaagaggaugccgaaauugaggucgacgaaguguucuggaauacaagaaucguuccuauucugcgcgagcucgagaaagaagagaacaucgaaaccgugugugcugccugcacgcagcugcaucacgcucuugaggaagggaauaugcugggaaacaaguuuaagggccggucuauucuccugaaaacacuuuguaagcuggucgacgugggguccgauagccucucccugaaacuggccaagaucauucucgcccugaaagugucuagaaagaaucuucugaacgucugcaagcucaucuucaaaaucagccgcaaugagaagaacgacucccugauucagaaugauucuauccuugagagccugcucgaaguucugcgguccgaggaccugcaaaccaacauggaggcuuuucucuacuguaugggaagcauuaaauucaucucuggcaaccugggguuccuuaaugaaaugauuuccaagggagcgguggaaauccugaucaaccucauuaaacagaucaaugagaacauuaagaagugcggcacauuucugcccaauagcggccaucugcuugugcaggucaccgccacccucagaaaccugguggauucuucccugguucgcagcaaauuccucaauaucucugcucugccucaacuuuguacagccauggagcaguauaagggggacaaagaugugugcacgaacauugcccggaucuuuagcaagcugaccuccuacagagacuguugcacagcucucgccagcuauucucgcugcuacgcgcuguuccugaaucuuaucaacaaauaucagaagaagcaggaucucgucgugcggguuguguuuauucugggaaaucugaccgcuaaaaacaaucaagccagagaacaguucuccaaggagaaaggcagcauccagacacuccugucccuuuuucagaccuuccaccaacuggaccuccacucucagaagcccgucgggcagcgcggagaacagcaucgggcccaaagaccgccuagcgaggcugaggaugugcugauuaaacugacgcggguccuugccaacaucgcuauucaccccggcguggggccuguucucgccgcgaaucccggaaucgugggccugcugcucacaacccuggaauacaagucccuugacgacugugaggaacuggucauuaacgccaccgcuacaaucaacaaucucucuuacuaucaggugaaaaacagcaucauucaggauaagaagcuguacaucgccgagcugcuucucaaacugcugguuuccaauaacauggacggcauucucgaagcugugcgcgucuuugggaaucugucucaggaucacgacgugugcgauuucaucgugcaaaacaauguucauagauuuaugauggcccuucuggacgcgcagcaccaggauauuuguuucagcgccugcggaguccuccugaaccugaccguggacaaggauaaacgggugauccuuaaggagggcgggggaaucaaaaagcuggucgacugucucagagaucugggcccuacagacuggcaacucgcuugccugguguguaagacgcuuuggaauuuuuccgagaacauuaccaaugccagcucuugcuucgggaacgaagauacaaauacccugcuccugcugcuuuccagcuuccuggacgaggaacucgcucuggacggcucuuuugaucccgaccucaaaaacuaucauaagcugcacugggagacagaguucaaaccgguugcccagcagcuucugaaucgcauccagcggcaucacaccuuucucgaaccucugcccauucccuccuucuga

SEQ ID NO: 66065 - RNA, 2598 nt, Artificial Sequence
  derived and/or modified sequence opt5 from ARMC3__Homo_sapiens__NP_001269674
augggcaagaaaaucaagaaagagguggaacccccuccgaaggacgucuucgauccccugaugauugagagcaaaaaggccgcuaccguugugcucaugcugaacuccccugaagaggaaauccuugccaaggcgugcgaggcuauuuacaaauuugcccugaagggggaggaaaauaaaacaacgcuccuggagcuuggagccguggaaccccugaccaagcuccugacacacgaggacaaaaucgucagacggaacgcuaccaugauuuucggcauccuggccucuaauaacgaugugaagaagcuccugcgcgagcuugacguuaugaauagcgugaucgcucagcuggccccugaagaggaagucgugauucaugaguuugcgucccucugucuggccaacaugucugcugaauauacaagcaaaguucaaaucuucgagcacgggggacuugagccccugauuagacuccuguccucuccugauccggacgugaagaaaaauagcauggaaugcaucuacaaccugguccaggauuuucagugucgggccaagcuccaggagcugaaugcuauucccccuauccuugaccugcucaaauccgaauaucccgugauucaacugcuugcccugaagacccucggcgugaucgcgaacgauaaagagagccgcacaaugcugagagacaaucaggggcuggaucaucucaucaagauucuggaaaccaaggagcuuaacgaccugcacaucgaggcccucgcugucauugccaauugccuggaagauauggacacgaugguucagauccagcaaaccggaggccuuaaaaagcugcucucuuucgcugagaacuccacaauuccugacauccagaaaaaugccgccaaggcuaucaccaaagcggccuacgaucccgaaaaccggaagcuguuucaugagcaggaaguggagaagugucugguggcucuccugggcagcgagaacgacgggacaaaaauugccgccucucaggcuaucuccgccaugugcgaaaauagcggaucuaaggauuucuuuaacaaucaaggcauuccgcagcuuauccagcugcucaaauccgacaacgaggaaguccgcgaggcggcugcccuggcccuggcuaaucuuaccacguguaacccugccaaugcuaacgccgcggccgaggcugaugggauugacccccucaucaaucugcugagcuccaagagagauggagccaucgcuaacgccgcgacagugcucaccaauauggccaugcaagaaccucugcggcuuaacauucagaaucacgacaucaugcacgcuauuaucucuccccugcgcagcgccaacacaguugugcaguccaaagcugcccucgccgucaccgcuaccgcgugcgauguggaggccagaacagaacugcggaauagcggcgggcuggagccccuuguugaacuccugcgcucuaagaacgacgaggugagaaagcaugcuuccugggccgucauggugugugccggagaugagcugacggcuaacgaacucugccggcugggcgcccuugacauucuggaggaagucaaugugagcggcacccgcaaaaacaaguucucugaggcggcuuauaauaaacuccugaacaauaaccugagccuuaaguacucccagacaggguaucucucuagcuccaauaucauuaacgacggauuuuacgauuacggcagaaucaauccugggaccaaacugcugccgcucaaggaacugugucuucaagagcccagcgaccugcgggccguucuccugaucaacucuaaguccuaugugagcccucccucuuccauggaggauaaaagcgacgucggauacggcagauccauuucuagcuccucuagccugcgccgguccagcaaggagaaaaauaacgccggguucggaucuccuaucgaagauaaguccgaacccgcuagcggcagaaauacagugcuuucuaaauccgccaccaaggagaaaggcuggcgcaagagcaaggggaaaaaggaagaggagaaaguuaaggaagaggaagaggugauggucgugccgaaauuugugggagagggcucuagcgacaaggaauggugcccucccuccgauccugacuucagcauguauguuuacgaggucacgaagucuauucuccccaucacaaacauuaaagaacagaucgaggaucuggcgaaguauguggcugagaaaaugggagggaagaucccuaaagaaaagcugcccgacuucuccugggagcuccacauuagcgaacugaaguuucagcuuaaauccaaugugaucccgauuggccaugucaagaaagggaucuucuaccaccgggcccugcucuuuaaggcccuggcugauagaauuggcaucggaugcucucuggugcgcggcgaguaugggcgggccuggaacgaaguuaugcuucagaacgacagcagaaaaggagugaucggcgggcugccugcucccgagauguacgucauugaucucauguuccaccccggaggccugaugaagcuccgcucccgggaagccgaccuguacagauuuaucuga

SEQ ID NO: 66066 - RNA, 1839 nt, Artificial Sequence
  derived and/or modified sequence opt5 from ARMC4__Homo_sapiens__NP_001276950
augagagacuucagccuggcccaggagaccugccaacucgcuauccgggaugugggcgggcuggaaguccuuauuaaccugcucgagacagacgaaguuaaguguaaaaucggaucccugaagauucuuaaagagaucucucacaauccccagauucgccagaacaucguggaucugggcgggcucccuaucauggugaauauucuggacagcccgcauaagucccugaaaugccucgccgcggaaacgaucgcuaacgucgccaaguuuaagagagcccggcgcgugguuagacagcacggaggcauuaccaaacugguggcccuucuggauugugcucaugacucuacaaagcccgcucaaagcucccucuacgaggcccgggaugucgagguggcgcgcugcggggcccuggcucuuuggucuuguagcaaaucccacaccaauaaggaagccaucagaaaagcuggaggcauuccucugcucgcccggcugcugaagacaagccaugagaacaugcucauccccguugugggcacccugcaggaaugcgcgucugaggagaauuaucgcgccgcuauuaaggccgaaagaaucaucgagaaccuugucaaaaaucugaacuccgaaaaugagcagcuccaggaacacugugcuauggccauuuaccaaugcgccgaggacaaggagacacgggaucuggugcgccuucacgggggacugaaaccucucgcuagccugcugaacaauaccgacaacaaggaaagacucgcggccgugacgggcgcuaucuggaaauguucuauuuccaaggagaaugucaccaaauuccgggaauauaaggccaucgagacacugguugggcuucugaccgaucagcccgaagaggugcucgugaacgucgugggagcccugggcgagugcugucaggaacgcgagaacagaguuauugugcggaagugcgggggaauccagccucuugucaaucugcucgugggcaucaaccaagcucugcugguuaaugugacaaaagccgucggcgcgugcgcuguggaaccggagagcaugaugauuaucgacagacucgaugggguccgccugcuuuggucucugcucaagaacccccauccugacgugaaagccuccgccgcuugggcccugugucccugcauuaagaaugcuaaagacgccggagaaaugguucggagcuuugugggcgggcuggagcuuaucgucaaccuccugaaguccgauaauaaggaggugcuggcgucuguuugugccgcuauuaccaacaucgccaaagaccaggaaaaucucgcugugaucacggaucacggagucgugccucugcuuagcaagcuggccaacacaaauaacaauaaacucagacaucaccuggcggaggccauuucccgcugcuguauguggggccggaacagaguggcuuucggggaacacaaggccguugcuccccugguccgcuaccuuaaaagcaaugacaccaacgugcaucgggccacagcccaggcucucuaucaacugucugaggaugcggacaacugcaucaccaugcacgagaauggagccgugaagaccgaauccagacaugucgcucgccuggaguguagcgauaacgaccucggcucucugcagccgccucccccuggcuuuaagcgguucagcugccuuucccugcucucuagcugggauuacuccuuuuauuggauuuggcuggggccccugacaagaaucagccgcaaacuucagcucgugguuuaccccauuucugccggauggcugcugcuccagcggagacaagacacgcuggaaaucuga

SEQ ID NO: 66067 - RNA, 2808 nt, Artificial Sequence
  derived and/or modified sequence opt5 from ARMC5__Homo_sapiens__NP_001098717
auggccgcugccaagcccacccugacagacagccucuccuucugccuggcgcagcuugcugccgccgcuggcgaggcccucgggggagaaaaagauccugcuacgaacgagaccccgcugucuagagcccugcuugcgcugcggacacgccacaucaaggccgcuggcgggauugaaagauuucgggcccgcggaggccucagaccccugcuggcucuccugcggcgcgccgcggccgcugggagcgccccuucccaagcuggacccggcucugccccuagcuccgccgcuucuggcgcgagcucccccgccccugcuagcgggccggcccccucugccguguccuccucuuccccuaccccuccugucagacuucggaaaacacuggaccucgcucugagcauccuugccgauuguugcaccgagggagcgugucgcacagaaguuagacggcugggcgggauucucccccuggugaccauccugcagugcaugaagacggacucuauucagaaucgcaccgcuagagcccucggaaaccuggccauggagccggaguccuguggcgauauccauugcgcuggggccgugccucuucuggucgaaagccucacagcuugucaggacucccaaugccugcagucugugguucgggcccuucgcaaucuggcggauagcccccagcacagacucgcccuggcucagcaaggagccgugcggccucuggcugagcuccuggccaccgcgcccgacgccgcucuuacacuggcccucgucagagcucugcuugaacugucccgcggcuguagccgggccugcgccgagcagcucucucugggcgggggacugggcccccucgugucccuggcuagccauccuaaaagagcgguucgcgaggggaccauccuuauucuggccaaccucugugcucagggacugauccggccggcccugggcaaugccgggggaguggaaguccuuguggaugagcucagacagcgccgggaccccaacggcgcuucuccuacgagccaacagccccuggugagagccgucugccugcucugccgcgaagcgauuaaucgggcuagacugcgcgaugccggcgggcuugaccugcucaugggacugcugcgggauccuagagccuccgcuuggcacccccggaucguugccgcgcuugugggcuuccucuacgacacaggggcucugggacgccugcaggcccucggccuggugccgcuucuggccgggcaacucuguggcgaggcuggagaagaggaggaagagggcagagaagccgcuucuugggacuuuccugaggaacggacccccgagagagcccagggagggagcuuccgcucccugcggagcuggcugauuucugagggcuaugcgacagggccugaugacaucucccccgauuggagcccugaacagugucccccggagccuauggaacccgccucucccgcuccuaccccgaccucccuuagagcuccccgcacacagagaacgccuggacggagccccgccgccgccauugaggaaccuuggggccgcgaggggcccgcucuccugcugcucuccagauuuucucaagcgccugaccccagcggcgcccuggucaccggaccggcucuuuacggccugcucacauaugugaccggggccccuggacccccuagcccccgggcccugcgcauccugucuagacuuacaugcaacccggcuugccucgaggccuucguucggagcuacggcgcggcucugcugcgcgccuggcucgugcugggggucgccccugaugacuggcccgcuccuagagcccggcccacccuucauucccgccacagagaacugggagagcggcuccugcagaaucugacggugcaggcggaaagccccuuuggcguuggggcucuuacacaucugcuccugucuggcuccccugaggauagaguggccugugcccucacccugccguucaucugccgcaagcccagccuuuggcggagacugcuccuggagcagggaggccugcgccuucugcucgcugcccugacccggccugcuccccacccucucuuucuguucuuugccgcggacucucuuuccugucugcaagaucucgucagccccacagugucuccugccgucccgcaggcugugcccauggaccuggauagcccuucccccugccuguaugaaccucuucuggggcccgccccgguuccugcucccgaccuccacuuccugcucgacagcggacugcagcuucccgcccagagagccgcuucugcgaccgccucccccuuuuuccgcgcucugcugagcggcuccuucgccgaggcccaaauggaucucgugccccugcgggggcuuucuccuggagcugccuggccgguccugcaucaccuccacggcuguagagggugcggcgcggcucugggacccgugccucccccuggccagccccuccuggggagcgaagccgaggaagcccuugaggcugccggacgcuuucugcugccgggccucgaggaggaacuggaagaggcgguugggcggauucaucuuggaccucagggcggccccgaauccgugggggaggucuucagacugggacggccucgccucgccgcucacugugccagauggacacugggcucugagcagugcccccggaagcgcgggcucgcucuggugggacuuguggaagccgcuggcgaggaagccgggccucugacggaggcgcugcucgccguugucaugggaaucgaacugggcgcuagagugcccgccuga

SEQ ID NO: 66068 - RNA, 1929 nt, Artificial Sequence
  derived and/or modified sequence opt5 from ARMC8__Homo_sapiens__NP_001253970
auggccugccugcucgagacccccaucagaaugagcgugcuguccgaagucacagcuucuagccggcacuacguugaccgccuuuucgauccugacccgcagaaggugcugcaaggcgugauugauaugaaaaacgccgucaucgggaauaacaagcagaaagcgaaucucauugugcugggagcuguucccagacuucuguaucuccugcagcaggagacguccucuaccgaacugaagacagagugugccgugguccucggcagccuggccauggggaccgaaaacaaugugaaaucccuucuggacugccauaucauuccugcucuccugcaaggacuucugucucccgaucucaaguuuaucgaggccugucugcggugccugcgcacaaucuucaccagcccuguuacacccgaggaacuccuguacaccggcccugaccaccagacgauucuuuuuaaccauggggcugugcagaauaucgcccaccuucucaccucccugagcuauaaggucagaaugcaggcgcuuaaauguuucucugugcuggccuuugagaacccgcaaguguccaugacacucgucaauguucugguggauggagaacugcucccccagauuuucgugaagaugcugcagcgggacaaaccuaucgagaugcagcuuaccagcgcuaagugccugacauacaugugucgcgccggcgcuauuagaaccgaugacaacugcaucguccucaaaacgcugcccugucuugugcggaugugcucuaaggagcgccugcucgaagagagaguugaaggcgccgagacacuggcguaucugauugaaccugauguggagcuccaacggaucgccuccaucaccgaccaucugauugcuaugcuugccgauuacuuuaaguaucccagcucugucuccgcuaucacagacauuaaacgccuggaccacgaucucaagcacgcccaugagcugagacaggccgcuuucaaacuguacgcgagccuuggggccaaugacgaagauauccggaagaaaauuaucgagaccgaaaacaugauggaccgcaucgugaccggacucuccgagucuagcguuaaggugagacuggcugccguccggugucugcacucccucagcagaucugugcagcaacugcgcacauccuuucaggaucaugccgucuggaaaccgcuuaugaaggugcugcagaaugcuccugacgaaauucucguuguggccagcucuaugcugugcaaccugcuucucgaguucagccccuccaaggagccuauccuggaaucuggcgcggucgagcugcucugcgggcugacgcagagcgaaaaucccgcucugcgggugaacggaauuugggcccugaugaacauggccuuucaagcugagcagaaaaucaaggccgauauucucagaucccugagcaccgaacagcuguuccgccuucucucugacuccgaucugaauguucugaugaaaacacucggccugcuucggaaccugcucagcaccagaccccacaucgacaagaucaugucuacacacgggaaacagauuaugcaagcugugacccugauccuggagggagagcauaauauugaagucaaggagcagacgcuuuguauccucgccaacauugcggauggcacaaccgccaaggaccugaucaugaccaaugacgauauucugcagaaaaucaaguacuauaugggccacucccaugugaaacuccagcuggcugccauguuuugcaucagcaaccuuauuuggaaugaagaggaggggucccaagaacgccaggacaagcugcgggauaugggaaucguggacauucuccacaaacugucucagagcccugauuccaaccugugugacaaggcuaagauggcccuucagcaauaccuggcguga

SEQ ID NO: 66069 - RNA, 2457 nt, Artificial Sequence
  derived and/or modified sequence opt5 from ARMC9__Homo_sapiens__NP_001258395
augggcgacauccuggcccacgagagcgaacuccuggggcuugugaaggaguaccuggauuucgcugaauuugaggacacccucaaaacauucuccaaggaaugcaaaauuaagggaaaaccccuguguaagacggucggcgggucuuuuagagauagcaagucccuuaccauccagaaagaccugguugccgcguucgauaacggagaccaaaagguguuuuucgaucucugggaggagcauauuucuagcuccauccgggacggcgauucuuuugcucagaaacuggaguucuaucugcacauucauuuugccaucuaccuccugaaguauagcguggggcgcccugacaaagaggaacuugaugagaagaucuccuacuucaagacauaucuggagaccaaaggagccgcucucagccagacaaccgaauuucugccguucuacgcccuucccuuugucccuaaucccauggugcacccuucuuucaaggagcuguuccaggacuccuggacacccgaacucaaacugaagcuggagaaauuucucgcucugauuagcaaggccucuaacaccccuaaacuucugacgaucuauaaggaaaauggccaauccaacaaggagauucuccagcagcugcaucagcaacuuguugaggcggaaagacggagcgugaccuaccugaaacgcuacaauaagauccaggccgauuaucacaaccucauuggcgucacagcugagcugguggacucucuggaagccaccguuuccgggaaaaugaucacaccggaguaccuccagagcgugugcgucagacuguucuccaaucagaugcggcaaucucuugcucacagcguggacuuuacccgccccggaacggccuccacaaugcugagagcgagccucgccccugugaagcugaaagaugucccccuucugccuucucucgacuaugaaaagcugaagaaagaucugauucucggcuccgaccggcugaaggcuuuccuucugcaggcccuccgcuggagacugaccacaagccaucccggggagcagcgggagaccguucugcaagccuacaucucuaacgaucuucucgacuguuauagccacaaucagcgcuccgugcugcagcugcuccauucuaccagcgauguggucagacaguacauggcccggcugaucaacgccuuugcuucccuugcggaaggacgccuguaucucgcccaaaauacaaaagugcugcagaugcuggagggcagacuuaaggaagaggacaaagauauuaucacgcgggaaaacguucucggggcucugcagaaguucagccugagacgcccgcuccagaccgccaugauucaagacggacugaucuuuuggcuuguggauguccugaaggacccugacugccucucugauuacacacuggaguacuccguggcccugcuuaugaaucucugucugcggagcaccggcaaaaacaugugcgcuaagguugccggccuggugcucaaaguccugucugaccuucuggggcacgagaaucacgaaauucagcccuaugugaacggagcgcucuacuccauccugagcgucccuuccaucagagaggaagcucgcgccaugggcauggaggauauucugcgguguuucaucaaggaggggaacgccgaaaugauuagacagaucgaguuuauuaucaaacagcuuaauucugaagaacuccccgacggagugcuggaaagcgaugacgaugaggacgaggaugacgaagaggaucaugacaucauggaagcugaucuggacaaggacgagcucauucaaccccagcugggcgaacuuuccggggagaagcugcucacaaccgaguaucugggaaucaugacgaacacaggcaaaacccgccggaagggccuggccaauguucaguggucuggggaugaaccucuucagagaccggugacccccggaggccaccgcaacggguacccugucguggaggaccaacauacacccccucagaccgcucagcacgcccggaauggacauccccaagcgcugccggccgcucacgaagccguuuauagagagggcaaaccuagcacacccgaauccugcgugucuagcuccagcgcuauuaucgccaagccuggggaguggcucccccgcggccggcaggaggaaccuagacccgcgccgacgggaaccccucggcagccccgcgaggcuccccaggauccuggcaacggggucacaaccagagaaugugcuucugccuucacaugcaaaccgcgggcucccuguaccccugagaugcuggacuggaaucccccuaaggccaaagccuccgugcucgcuccccuguuuagcucuugcggaccucaacaggcgagcagacccggcuccacggccagcucuacccgcgggcuuccguccagccagucccaccggaaguga

SEQ ID NO: 66070 - RNA, 1362 nt, Artificial Sequence
  derived and/or modified sequence opt5 from ARMCX1__Homo_sapiens__NP_057692
augggcagaacccgggaggccgggugcguggcugccggagucguuaucggcgcgggggcuuguuacugcguguaucgccuggccuggggaagagacgaaaacgagaagauuugggaugaagacgaggaaagcacagauacguccgagaucggcguggagaccgucaaaggggccaagacaaaugcuggagccggcucuggcgcuaaacuccagggggacagcgaagugaagcccgagguuucccugggacuugaagauuguccuggcgugaaagagaaggcccacucugggagccauuccggaggcgggcuggaggcgaaggccaaagcucucuucaacacccugaaggaacaagccucugcuaaagccggaaagggcgcgcgggucggcacaauuagcgggaaucgcacccuugccccgucccugcccugcccuggaggcagagggggaggcugucaccccacacggagcgggucucgcgcuggaggcagagccuccggcaaaagcaaggggaaggcucggucuaaauccacccgcgccccugccacgaccuggcccgugagacggggaaaguuuaacuucccuuacaaaaucgacgauauucucagcgcuccggaccugcagaagguucugaauauccucgagcgcacaaacgaucccuuuauccaggaaguggcgcuggucacccuuggcaauaacgccgcuuauucuuucaaucagaacgccauuagagagcucgggggagugccuaucauugccaaacugaucaagacaaaagaccccauuauccgggaaaagaccuacaaugcucugaacaaucuuuccgugaacgccgagaaucaaggcaagauuaaaacguauaucagccaggucugcgaugacacaaugguuugucgccuggauuccgcggugcagauggcugggcucagacugcugaccaacaugacagugaccaaccauuaccagcaccuccugucuuauagcuuuccugacuucuuugcccuucuguuccucggcaaucauuuuaccaagauccaaauuaugaaacugaucauuaacuucacagagaaucccgccaugacgcgggaacuugucuccugcaaggugccgagcgagcugaucucucucuuuaacaaagaaugggacagagagauucugcugaauauccucacccuguucgaaaacaucaaugauaacauuaagaaugagggacuugcuuccagccgcaaggaguuuucucggagcucccuguucuuccucuuuaaagaaucuggcguuugugugaagaaaaucaaggcccuggcuaaccacaaugaccuugucgugaaaguuaaggugcugaagguccucacaaaacuguga

SEQ ID NO: 66071 - RNA, 324 nt, Artificial Sequence
  derived and/or modified sequence opt5 from ARMS2__Homo_sapiens__NP_001093137
augcugagacucuaccccggcccuauggugaccgaggccgaagggaagggaggcccggagauggcuagccuguccucuagcgucguucccguguccuucaucucuacacuucgggaaagcgugcuggacccuggggucggaggcgagggggccuccgauaaacagcgcucuaagcucagccugucccacagcaugauucccgcggcuaaaauccauacggaacuuugccugccugccuuuuucucucccgccggaacccaaagacgguuucagcagccucagcaccaucucacacuguccauuauccacaccgcugcccgcuga

SEQ ID NO: 66072 - RNA, 969 nt, Artificial Sequence
  derived and/or modified sequence opt5 from ARMT1__Homo_sapiens__NP_001273491
auguacagacggauccacgaggccauuauccagagcccucccauugacuauuucgauguguuuaaggaauccaaagagcaaaacuucuacggcucucaggaaagcaucauugcucugugcacccaucuccagcagcugauccgcacaaucgaggaccuugaugaaaaucaacugaaggacgaguuuuucaaacuccugcagauuucccuuugggggaacaagugugaucugucucucagcggaggcgaguccucuagccagaauacgaacguccucaauucccuggaagaccugaaaccguuuauccugcuuaacgauauggagcaccuguggagccuccugucuaauugcaagaagaccagagaaaaagccuccgcgacacggguuuauauugugcuugacaacagcggguucgagcuggugaccgaucucauccuggcugacuuucugcucucuuccgagcuggccacagaaguccauuucuacggaaagaccauucccugguuugugagcgauacaaccauccacgacuucaauuggcuuauugagcagguuaaacauucuaaccacaaguggauguccaaauguggcgccgauugggaagaguauaucaagauggggaaguggguguaccacaaucauaucuuuuggacgcugccucacgaauauugcgcuaugccccaagucgccccugaccucuacgcugagcugcagaaagcccaucuuauucuguucaagggagaccucaacuaccgcaaacugaccggcgauagaaagugggaguuuagcgugcccuuccaccaggcgcugaauggcuuccacccugccccgcucuguacaauccggacccugaaagcugaaauucagguugggcuucaacccggacagggcgagcagcugcucgccuccgaaccuucuugguggacaaccgggaaguauggaaucuuucaauacgacggcccccuguga

SEQ ID NO: 66073 - RNA, 2154 nt, Artificial Sequence
  derived and/or modified sequence opt5 from ARNT2__Homo_sapiens__NP_055677
auggccacccccgcugccgugaacccuccggagauggcgagcgacauccccggcuccgucacacugccuguugcucccauggccgccacgggacaggugagaauggcuggggccaugccugcucggggcgggaagcgcagaucuggaauggauuucgacgaugaagacggcgaggggcccagcaaauuuucccgggaaaaucacucugagauugaacgcagacggcgcaacaagaugacccaauacaucacagagcucagcgauauggugccuaccugcuccgcccuggcgagaaaaccggacaaacuuacaauucugcggauggccgucucucauaugaaaagcaugcgcggaaccggcaauaaguccacagauggcgcuuauaagcccagcuuccucaccgagcaggaacugaaacaccuuauccuggaggccgcugacggguuucucuucgugguugccgcggaaacgggaagagugauuuacgucucugauuccgugaccccuguucugaaccagccccagagcgagugguuuggcucuacacuguaugagcaagugcauccugacgaugucgaaaagcuccgggagcagcuguguaccuccgaaaauagcaugacagggcgcauccuugaccugaaaaccggaacggugaagaaagagggccagcagucuuccaugagaaugugcauggggagccggcgcuccuucaucuguagaaugcggugcggaaacgcuccccucgaucaucugccgcuuaauagaauuacaaccaugcgcaagcgguuuagaaacggccugggcccugugaaggaaggggaggcucaauacgccgucguucacuguacaggauauaucaaagccuggcccccugccggcaugaccauucccgaggaagacgccgacguggggcagggaucuaaguacugccucguggcuaucggccgccugcaggucaccagcucccccguguguauggauaugaaugggaugagcguuccuacagaguuccugucucggcacaacuccgacggaauuaucacguuuguggauccgagaugcauuagcgucaucggcuaucagccccaagaccuccugggcaaagauauccuugaguucugucacccugaagaccagucucaucugcgcgagagcuuucagcaagugguuaagcucaaaggacaggugcuguccgucauguaccgguucagaaccaagaaucgcgaauggaugcuuauucggacaucuagcuuuaccuuccagaaccccuacuccgaugagaucgaauauauuaucugcacaaauaccaacgugaaacagcugcaacagcagcaggcggagcucgaaguccaccaaagagacgggcugagcucuuacgaucugucccaggugccuguucccaaucucccggccggcgugcaugaggcuggaaagagcgucgaaaaggccgacgccauuuucucucaggagcgcgauccucgguuugcugagauguucgccgggaucuccgcgagcgagaaaaagaugauguccucugcuagcgccgccggcacgcagcaaaucuauucccaggggucucccuuuccuagcggccacuccggaaaggcuuucucuagcuccgugguucacgugcccggcgucaacgacauucagucuagcuccagcacagggcagaacaugucucaaaucagcagacagcugaaucagucccaaguggccuggaccggaagccggccucccuuuccgggccagcagauuccuucucaguccagcaagacccaauccucucccuucgggaucggaacaagccauaccuaccccgcugacccuuccucuuauagcccgcuuuccucucccgccacaagcuccccuagcggcaacgcguacucuucccuggccaaucgcacgcccggguuugcugaaagcggccagucuuccggacaguuccagggcagaccuagcgaaguguggucucaauggcagucccagcaccaugggcagcaaagcggagagcagcacucccaucagcaacccggccagaccgagguuuuucaggauaugcucccuaugcccggggacccgacacagggaaccggcaacuauaauauugaagauuucgccgaccuggggauguuuccucccuucagcgaguga

SEQ ID NO: 66074 - RNA, 2319 nt, Artificial Sequence
  derived and/or modified sequence opt5 from ARNT__Homo_sapiens__XP_011507849
auguaccaccauugggugcagccccugccucucgagacccuggaccuugaguucaaggucgaagaaccgcugagcagaggccuccuguccggggaucaagccggacuuaaauaucugcuccuggcuuuucugcggcucgacuucgaugacgauggcgaggggaacucuaaguuucugcgcugcgacgaugaccagaugagcaaugauaaagaaagauucgcccgggagaaccacuccgagaucgaacgcagacggcgcaauaagaugacagcguacauuacggagcuuucugacaugguucccaccuguagcgcucuggccagaaaaccugauaagcucacaauccugcggauggccgugucccauaugaagucucuucgcggaaccggcaacacaagcaccgacggguccuauaaacccagcuuucugacagaucaggaacucaagcaccugauucuggaggcugccgacggauuccucuuuaucgugucuugcgagaccggcagagucguguacguuuccgacagcgugacgccuguccugaaucagccccaaucugaaugguucggcuccacccuuuaugaucaggugcauccugacgauguugacaaacugcgggagcagcucagcacaucugaaaacgcucugaccgggcgcauucuugaucugaagacaggaaccgugaaaaaggagggccagcaauccagcaugagaauguguauggggucccggcgcucuuuuaucugcagaaugcgguguggaagcuccagcgucgacccggugucugugaauagacucuccuucguccgcaaccggugcagaaauggccuggggagcguuaaggauggagaaccccacuuuguggugguccacuguacgggcuacaucaaagccuggccucccgcgggcgugucucugccugacgaugaccccgaggccgggcagggaagcaaguucugccucguugcuauuggccgccuucaggugacauccucuccgaacuguaccgauaugagcaaugucugccagccuacagaguuuaucucccggcauaacauugaagggaucuucaccuucguggaccacagauguguugccaccgugggauaucaaccccaggagcuucugggcaaaaauauugucgaauuuugccauccugaggaccagcaacuccugcgcgauagcuuccaacagguggucaagcugaaaggacaggugcugucuguuauguuucgguucagauccaagaaccaggaauggcucuggaugcgcacaagcucuuuuacguuccagaaucccuacuccgacgagaucgaguacauuaucugcaccaacacaaacgugaaaaauagcucccaggaaccccggccuacccugucuaacacaauccagagaccgcaacuggggcccaccgcuaaucucccucuggagaugggcagcggccagcuugcgccccgccagcagcaacagcagacggaacuggauauggucccugggcgggacggacucgccuccuauaaccacucucaggugguucaacccgugacaaccaccggcccggagcacagcaagccucuggaaaaguccgaugggcuguuugcccaggacagagauccccgguucagcgagauuuaccauaauaucaacgcugaccagucuaaaggaauuuccagcucuacagucccugccacccaacagcuuuucucccagggcaauacauuucccccuacgccccgcccggcugagaacuuuagaaauagcgggcucgccccucccgugaccaucgugcagcccucugccagcgcuggccaaaugcuggcgcagauuucccggcacagcaacccuacacagggagccaccccgacauggacccccacgaccagaucuggcuucuccgcucagguugccacacaagccaccgcuaagacacgcaccagccaguuuggggucggauccuuccagacgccuucuagcuucuccucuaugagccugcccggcgccccuacagcgucccccggggcugccgccuauccuucucucaccaaucggggaagcaacuuugcucccgaaacaggccagaccgccgggcaauuccagaccagaacagcugagggcgugggaguguggccgcaguggcaaggccagcagccucaucaccgcuccucuagcuccgaacagcauguccaacagcccccugcccagcagcccgggcaaccggagguguuucaggagaugcugagcaugcuuggagaucagucuaauuccuacaacaaugaagaguucccugaccugacgauguuucccccuuucagcgaauga

SEQ ID NO: 66075 - RNA, 1869 nt, Artificial Sequence
  derived and/or modified sequence opt5 from ARNTL2__Homo_sapiens__NP_001234931
auggccgcugaggaagaggccgcggcuggcgggaaggugcugagagaagagaaccagugcaucgcccccgucguuagcucccgggugucuccuggaacccgcccgacagccaugggcagcuucuccucucacaugacggaauuucccagaaaacggaaggggagcgacuccgauccuucucaaagcggaauuaugaccgagaaaguggucgagaagcucucccagaauccccugacauaccuucugagcacccgcaucgaaauuucugcuuccagcggcucuagagaggcccauucccagacagaaaaacggcgcagagacaagaugaacaaucucaucgaggagcugagcgcuaugauuccucaguguaaccccauggcccggaaacuugauaagcugaccgugcuccgcauggcgguucaacaccugagaucucugaaggggcucacaaauuccuaugugggaagcaacuaccggccuuccuuccugcaggacaaugaacuucgccaucugauccucaaaaccgccgagggcuuucuguucgucgugggcugcgaaagagggaagauccuuuuuguuucuaaaagcguguccaagauucugaacuaugaucaggcuagccucacgggacagucucuguucgacuuucugcacccgaaggaugucgccaaagugaaggagcaacucuccagcuucgacaucucuccccgggaaaaacugauugaugcuaagaccggccuucaggugcauagcaaucugcacgccgggcgcacaagagucuacuccggaucucggagauccuuuuucugucgcaucaaauccugcaagauuagcguuaaagaggagcacggcugucucccuaacucuaagaagaaagaacaucggaaguuuuauaccauccacugcacaggguaccugagauccuggcccccuaauauugugggaauggaggaggaacgcaacagcaaaaaggacaauucuaacuucaccugucuuguggcgaucggccggcugcagcccuauaucgucccgcagaauagcggcgaaauuaacgugaaaccuacggaguuuaucacaagauucgccguuaacgggaaguucguguacgucgaucaacgcgcuaccgccauucucggauaccugccccaggagcugcucggcacaagcugcuaugaauacuuucaucaggacgaucacaauaaccugaccgacaagcacaaagcugugcuucaauccaaggagaaaauccugaccgacucuuauaaguuccgggccaaagaugggagcuuuguuacacucaagucccagugguucucuuuuacgaauccuuggaccaaggaacuggaguacauugugagcgucaacacacuugugcugggacauuccgaacccggcgaggccagcuuccuccccuguucuucccagagcucugaggaauccagcagacagucuugcaugagcgucccugggauguccaccggaacagugcugggcgcuggcagcaucgggaccgacaucgcgaaugagauucuggaucuccaacgccugcagucuuccagcuaucuugacgauuccucuccgacgggacugaugaaagacacacacaccguuaacugucggagcauguccaauaaggaacucuuucccccuucucccagcgagaugggcgagcuggaagccaccagacagaaccaguccacaguggcuguccauucucacgagccucugcuuagcgauggggcccaacucgacuucgaugcccugugcgacaaugaugacaccgcuauggccgcguuuaugaacuaccuggaagcugagggaggccucggggaccccggcgauuucuccgacauccaguggacacuguga

SEQ ID NO: 66076 - RNA, 1878 nt, Artificial Sequence
  derived and/or modified sequence opt5 from ARNTL__Homo_sapiens__NP_001025443
auggccgaccagagaauggauaucagcuccaccauuucugacuucaugagccccggcccuacagaucugcucuccucuagccuggggacguccggaguggacugcaaccggaagcgcaaaggcucuagcaccgauuaccaagaguccauggacacagauaaggacgauccgcacgggagacuugaauauaccgagcaucagggacggaucaaaaaugcucgcgaagcccacagccagauugagaagagacggcgcgacaaaaugaacucuuuuaucgaugaacuggcgucccucguccccacauguaaugcuaugagcagaaagcuggacaaacuuaccguucugcggauggccgugcagcauaugaagacacuccgcggcgccaccaacccuuacacggaggcuaauuauaagcccaccuuccugucugaugacgagcugaaacaccucauucugagagccgcugacggguuucuuuucguggucggaugcgaucggggcaagauccuguuuguguccgaaagcguuuucaaaauccucaacuacucucaaaaugaccugauuggccagucccuuuuugauuaucugcauccuaaggacaucgccaaggugaaagagcagcucagcuccucugauacagcgccccgcgaaagacugauugacgccaagaccgggcugccugucaaaacagauaucaccccgggacccagccggcucuguuccggcgcucgccggagcuucuuuugcagaaugaaguguaacagaccuucugugaaaguugaggacaaggauuuccccuccacgugcagcaaaaagaaggaccgcaaaucuuuuuguacaauucacagcaccggguaccugaaguccuggccucccacaaaaaugggacuugaugaggacaaugaaccggacaacgagggcugcaaucugucuugucucguggccaucgggcggcugcacagccaugucgugccucagcccgugaacggagaaauuagagucaaguccauggaguauguuagccgccacgcuaucgauggcaaauucguguuuguggaccaacgggccaccgcgauccuugccuaccugccucaggaacuccugggcaccucuugcuacgaguauuuccaucaggaugacauugggcaccuggcugagugucacagacagguccuccaaacacgcgaaaagaucacgaccaauugcuacaaguucaaaauuaaggauggauccuuuaucacacugcggagcagaugguucucuuuuaugaaccccuggaccaaagagguggaauauauuguuuccacaaauaccgugguccuugccaacgugcuggagggcggggaccccacguucccucagcucacagcuagcccgcauuccauggauucuaugcugcccagcggagaaggcgggccuaagcgcacccaccccaccguuccuggaauccccggcggcacacgggccggggccggaaaaaucggcagaaugauugcugaggagaucauggaaauucaucgcauccggggguccucuccgagcuccugcggaagcucuccucuuaacauuaccuccacacccccucccgacgcgagcucuccuggcgggaagaagauccugaauggcggaacgcccgauaucccguccagcggccuccugucugggcaggcccaagagaacccuggauaccccuauagcgacuccagcucuauucugggcgaaaauccccacaucgggauugauaugaucgacaacgaucagggauccagcuccccuucuaaugacgaggcugccauggccgugauuaugagccuccuggaagcugacgccggccuugggggcccggucgauuuuuccgaccugcccuggccucucuga

SEQ ID NO: 66077 - RNA, 1071 nt, Artificial Sequence
  derived and/or modified sequence opt5 from ARPC1A__Homo_sapiens__NP_001177925
augcccggcaccgggaucgugcugauugcccucagcccuaacaaucacgagguccauaucuacaagaaaaacggaucccaguggguuaaggcucacgaacugaaagagcauaauggccacauuacagggaucgacugggccccgaagucugauagaauugugacgugcggagcggaccggaacgcuuauguguggagccaaaaagauggcgucuggaagcccacccuugugauccugcgcaucaauagagccgccacauucguuaagugguccccucucgaaaacaaauuugcuguggggucuggagcccggcugauuagcgucuguuacuucgaguccgaaaaugacuggugggugucuaagcauaucaaaaagcccauucgcagcaccguucuuucccuggauuggcacccuaacaaugugcuccuggcugccggcagcugcgacuuuaaauguagagucuucucugcguauaucaaggagguggaugagaagcccgccuccacaccuuggggcagcaaaaugccguuugggcagcugaugucugaauuuggaggcuccgggaccggaggcugggugcacggggucagcuucucugcuuccggaagccggcucgccuggguuucccaugacucuacagugagcguggcugaugccuccaagagcguccaggugucuacccugaaaacggaguuccuuccccugcucuccguuagcuuugugucugaaaacagcgucguggcggccggccacgacugcuguccuaugcuguucaauuacgaugaccgcggcugccuuaccuuuguuuccaagcuggauauucccaaacagucuauccaaagaaacaugagcgcuauggagcgguuccgcaauauggacaagagagccacaaccgaggaccggaacacagcucucgaaacccugcaucaaaauuccauuacacaggugagcaucuaugaggucgauaaacaggacugucgcaaguuuugcacgaccgggaucgauggagccaugacaauuugggacuucaagacccuggaaucuuccauccagggccucagaauuauguga

SEQ ID NO: 66078 - RNA, 1119 nt, Artificial Sequence
  derived and/or modified sequence opt5 from ARPC1B__Homo_sapiens__NP_005711
auggccuaccacagcuuccugguggagcccaucuccugccaugcuuggaacaaggacagaacccagauugccaucuguccuaauaaccacgaagugcauauuuaugagaaaucuggcgcgaaguggacaaaaguucacgaacucaaggagcauaaugggcaagugacgggaaucgauugggcuccggaaagcaaccggauugugaccugcggcacagaccgcaaugccuacgucuggacccugaaagggagaacauggaagcccacccuugugauccugcggaucaaccgcgccgcuagauguguucggugggccccuaaugagaacaaguuugcugugggauccggcucucgcgucauuagcaucugcuauuucgagcaggaaaaugauugguggguguguaaacacauuaagaaacccaucagauccacaguucucucucuggacuggcacccuaacaaugugcuucuggccgcggggagcugcgauuuuaagugucggauuuucuccgccuacaucaaagaggucgaggaacgccccgcuccuaccccguggggaagcaagaugcccuuuggcgagcucauguucgaaucuuccagcucuugcggcugggugcaugggguguguuuuuccgccagcggaucuagagucgcuuggguuucccacgacagcacggugugccuggccgaugcggacaagaaaauggccguggcuacccuggccuccgagacacucccucugcuugcucugaccuucauuacagauaacucucucgucgccgccggccaugacuguuuucccgugcuguucaccuaugaugcugcggccgggaugcuuagcuuuggaggccggcuggacguuccuaagcaguccagccagcgcgggcucacggcuagagaacgguuccaaaaucuggauaaaaaggccucuuccgagggaggcacagccgcuggcgccgggcuggacagccuccacaaaaacucugugagccagaucuccguccugucuggaggcaaggcgaaaugcagccaguuuugcaccacagggauggacggaggcauguccaucugggaugucaagagccuugaaucugcucugaaggaccucaaaauuaaguga

SEQ ID NO: 66079 - RNA, 903 nt, Artificial Sequence
  derived and/or modified sequence opt5 from ARPC2__Homo_sapiens__NP_005722
augauccugcucgaggugaacaauagaauuaucgaagagacccuggcccuuaaguucgaaaacgcugccgcgggcaauaaacccgaggcugucgaaguuacauuugccgacuucgauggggugcuguaccacauuagcaacccuaauggagacaagacgaaagugauggucuccaucucucucaaguuuuauaaagagcugcaggcccauggcgcugaugagcuucugaagcggguguacgggagcuuccucguuaacccggaauccggauauaaugugucucugcuguacgaccucgagaaccugcccgccagcaaggauuccauuguccaccaagcuggcaugcuuaaacgcaauugcuuugccucuguguucgaaaaguauuuucaguuccaggaggaggggaaagaaggagagaacagagcgguuauccauuaccgggacgaugaaaccauguauguggagagcaagaaagaccgcgucacagugguguuuuccaccgucuucaaggaugacgaugacguugugaucggcaagguguuuaugcaggaguucaaagaaggcagacgggccagccacacagcuccucaaguccuguuuucucaucgcgagcccccucucgaacugaaggauaccgacgccgcugugggggacaauauuggauacaucacauucguucuuuuccccagacacaccaacgccuccgcgcgggauaauacgauuaaccugauccacaccuuucgcgacuaccuccauuaucacauuaaauguagcaaggccuacauccauacaagaaugcgggcuaaaaccucugauuuccugaaggugcugaaucgcgccagaccugacgcugagaaaaaggaaaugaagacaauuaccggcaaaacguuuuccagccgguga

SEQ ID NO: 66080 - RNA, 537 nt, Artificial Sequence
  derived and/or modified sequence opt5 from ARPC3__Homo_sapiens__NP_001265485
augcccgccuaccacagcucccugauggacccugauaccaagcucaucggcaacauggcucugcuuccgauuagaucucaguucaaagggcccgccccucgggagacaaaggacacggauaucguggacgaagcgauuuauuacuuuaaagcuaaugucuucuuuaagaacuaugagaucaaaaaugaagccgaucgcacccugauuuacaucacacucuauaucagcgagugccugaagaaacuucaaaaguguaacuccaagucucagggagaaaaagagauguacacccugggcauuacaaauuuccccaucccuggggagcccggauuuccucucaacgccauuuaugcuaagccggccaauaaacaggaagacgagguuaugagagcuuaccugcagcaacugcggcaggaaaccggccuccgccugugcgagaagguguucgauccccagaacgacaagccuagcaaaugguggacauguuuugugaagagacaguucaugaauaaaucccuuucugggcccggacaauga

SEQ ID NO: 66081 - RNA, 465 nt, Artificial Sequence
  derived and/or modified sequence opt5 from ARPC5__Homo_sapiens__NP_001257368
augagcaagaacaccguguccucugccagauuccggaaagucgacguugaugaguacgacgaaaauaaguuuguggaugaggaagacggcggggauggacaggcuggccccgacgagggggaaguggauagcugccugcgccacuccaucacaggaaacaugacggccgcgcuccaagcugcccugaaaaauccuccgauuaacaccaagucucaggccgucaaagacagagcuggcagcaucgugcuuaagguucugauuuccuucaaggccaaugauaucgagaaagcugugcagucucucgacaagaacggggucgaucugcuuaugaaauauauuuacaagggauuugagagccccuccgacaauagcucugccaugcugcuccaguggcaugaaaaagcgcuggccgcuggcggcgugggguccaucguucgggugcugacagcccgcaagaccgucuga

SEQ ID NO: 66082 - RNA, 681 nt, Artificial Sequence
  derived and/or modified sequence opt5 from ARPIN__Homo_sapiens__NP_872422
augagcagaaucuaccacgacggcgcccugcggaacaaggcugugcaguccguccgccuccccggggccugggauccugcggcucaucaaggaggcaaugggguucugcuugagggagaacugauugacgugucuagacacagcauccucgauacccauggccggaaagagcgcuauuacgugcuguauauuagaccgucccacauccaucggcgcaaguucgacgccaaagggaacgaaauugagcccaauuuuucugccacaagaaaggucaacacgggauuccuuaugagcuccuacaaaguggaagcuaagggcgauaccgaccggcugacaccugaggcccucaagggccugguuaauaaacccgagcugcucgcucugaccgaaucucuuacaccugaucacaccguggccuuuuggaugcccgagagcgaaauggaggucauggagcuggaacucggggcgggagugcgccugaagacaagaggcgacgggccuuuccuugauucccuggccaaacucgaggcuggaaccguuacgaagugcaacuuuaccggcgacgggaaaacaggagccagcuggaccgauaauaucauggcucagaaguguucuaagggcgccgcggccgaaauccgggagcagggcgacggggcugaagaugaggagugggacgacuga

SEQ ID NO: 66083 - RNA, 270 nt, Artificial Sequence
  derived and/or modified sequence opt5 from ARPP21__Homo_sapiens__NP_001020240
augagcgagcagggcgaccugaaccaagccaucgcugaagaagggggaaccgagcaggagacagccacgcccgaaaauggcauugugaaguccgagucucucgaugaggaagagaaacuggaacuucagagacggcuggaggcgcagaaccaagagcgcagaaagagcaaauccggggcuggaaagggcaaacucacccggucucuggccgucugcgaagagagcuccgcccgcccugggggagaaucucuucaggaccagacacuguga

SEQ ID NO: 66084 - RNA, 1167 nt, Artificial Sequence
  derived and/or modified sequence opt5 from ARR3__Homo_sapiens__NP_004303
augagcaagguguucaaaaagaccuccucuaacggcaaacugagcaucuaccucgggaagagagacuuugucgaucacguugacacaguggagcccauugauggagugguccugguggacccugaauaucuuaaaugccggaagcuguucguuaugcucacgugugccuuucgcuacggcagagaugaccuggaggugaucgggcuuaccuuccggaaggaucuguauguccagacacuccaagugguuccggcugaauccucuagcccccagggaccucugaccgugcugcaggagcgccuccugcauaaacuuggcgacaaugccuaccccuuuacacugcagauggucaccaaccucccuugcuccgugacacugcaacccgggccugaagaugcgggaaagccguguggcauugacuucgaggugaaaucuuuuugcgcugagaaucccgaagagaccgucagcaagagagauuauguucggcuuguggugcgcaaaguccaguucgccccucccgaagccggcccugggcccuccgcucagacgaucagacgguuucugcucagcgcccagccgcugcaacugcaggcuuggauggaccgcgaggugcacuaccauggagagccuauuucuguuaacguguccaucaauaacuguaccaauaaggucaucaagaaaauuaagaucagcguggaucagauuacagacguugugcucuauucucuggacaaauacaccaagacagucuucauccaggaauuuaccgagacgguggccgcgaacuccagcuucucucaauccuuugccgucacacccauucuugcugccagcugccagaaaagaggccuggcucucgaugggaagcugaaacacgaagacaccaaucuugccuccucuacaaucauucggccuggaauggauaaggagcugcucggcauccuggugagcuacaagguucgcgugaaccugauggucuccugugggggaauccucggcgaccugaccgcgagcgaugugggcguugaacuuccccuggugcucauucaucccaaaccuucucacgaggccgcuuccagcgaggacaucgucauugaagaguucaccagaaagggggaagaggaaucucagaaagccguggaggcugagggagaugaaggcagcuga

SEQ ID NO: 66085 - RNA, 1257 nt, Artificial Sequence
  derived and/or modified sequence opt5 from ARRB1__Homo_sapiens__NP_004032
augggcgacaaggggaccagaguguucaaaaaggccagccccaacggaaaacugacagucuaccucggcaagcgggauuuuguugaccacaucgaucugguggacccuguggauggggucgugcuuguugacccggaguaucugaaagaacgcagaguguacgucacgcugaccugcgcuuuccgguauggacgcgaggaucucgacgugcuuggccugacauuuagaaaggaucucuucguugccaaugugcaguccuuucccccugcgcccgaagacaagaaaccucugacccggcugcaagagcgccucauuaagaaacugggggaacaugcuuaccccuucacauuugagaucccuccgaaccuucccuguucugucacccugcagccuggacccgaggauacaggcaaggccugcggcguggacuaugaagugaaagccuucugugcugagaaucucgaagagaagauucacaagagaaacagcguccggcugguuauccgcaaagugcaguacgccccugagagacccgggccgcagccuaccgcugaaacgacccggcaauuucuuauguccgauaagccccugcaucucgaggccucucuggacaaagaaauuuauuaccacggagagccuaucagcgugaauguccaugugacaaacaauaccaacaagacaguuaaaaagaucaaaauuuccgugcgccaguacgcggacaucugccuguucaauaccgcccaguauaagugucccgucgcuauggaagaggccgaugacacgguggcucccucuagcacauuuugcaagguuuacacccucacaccuuuccuggccaacaauagagagaaacggggccuugcgcuggaugggaagcucaaacacgaagacaccaaccuggccuccagcacccuucugcgcgagggagcuaauagagaaauucucggcaucauugugucuuauaaggucaaagugaagcuggucguguccagagggggacugcucggcgaucuggccagcucugacguugcuguggagcuuccguuuacacugaugcaccccaagccuaaagaggaacccccucaucgggagguccccgaaaacgagacgccgguggauaccaaucucaucgaacuggacacaaacgaugacgauauuguuuucgaggacuucgcccgccagcggcuuaagggcaugaaagacgauaaggaagaggaggaagacgggaccggauccccucaacugaacaauagauga

SEQ ID NO: 66086 - RNA, 993 nt, Artificial Sequence
  derived and/or modified sequence opt5 from ARRB2__Homo_sapiens__NP_001244258
augggcgagaagcccgggaccagaguguucaaaaagagcuccccuaacugcaaacugacagucuaccucggaaagcgggacuuuguugaucaccuggacaaaguggauccgguggacggcgucgugcuuguugaucccgacuaucugaaggaucgcaagguguucgucacgcucaccugugccuuuagauacgggcgggaagaccuggaugugcuuggacugucuuuccgcaaagaccucuuuaucgcuacauaucaggccuucccucccguuccuaaucccccuagaccgcccacccggcugcaagaucgccugcucagaaagcugggccagcaugcgcaccccuuuuucuuuacaauuccucagaaccuuccuugcagcgugacccugcagcccgggccggaggacacaggaaaggcuuguggcgucgauuucgaaauccgggccuuuugcgccaaaucccucgaggaaaaaucucauaagcgcaauagcgugagacuggugauucggaagguccaauucgcuccugagaaacccggcccucagcccuccgccgagaccacgcgccacuuucuuaugucugacagaagccugcaucucgaggcuucccuggacaaggaacuguacuaucacggggaaccccucaacguuaaugugcacgugaccaacaauagcacaaaaaccgucaagaaaaucaaggugucuguucggcaguacgccgauauuugucuguucuccacagcgcaguauaaaugcccuguggcccaacuugagcaggacgaucagcgcgagggaggcugucagcaagggggagcuggcaacccggggguccugcagggacagggcgaagccggcggggugagcagacggggaugccucuguggcgcugccuucugcucuuacgcgccccaagccccuagaccccauccucccccgcagaccccuguuucccgcagcggggaccggugucccugcggacaccagccucauuga

SEQ ID NO: 66087 - RNA, 1209 nt, Artificial Sequence
  derived and/or modified sequence opt5 from ARRDC2__Homo_sapiens__NP_001020775
augagaagcggcggggugcgguccuucgcccuggagcucgcucgcggacccggcggggccuacagaggaggcgaacggcugugcgggcgcguccuucuggaggcggcugccccucucagaguucgggcccuggaagugaaggcucgcggaggcgccgcuacccacuggcuugagggcagaucugugggggucaacgccgugagcuccgacuaugcggccgcugaaacauaccugcggcgcagacagcuccugcugcgggauacgggagagaccacaacccucccgcccggccgccaugaguuucuguucucuuuucaacuuccucccacacugguuaccagcuucgaagggaaacacggauccgugagauauuguaucaaggccacacuccaucggccuuggguccccgcucgcagagcccggaaaguguuuaccguuauugagccuguggacaucaauacgccggcgcugcuugcuccccaggccggcgccagagaaaaggucgcucgcucuugguacugcaaccgggggcuggugagccucuccgccaaaauugauagaaagggauauaccccuggcgaggugauccccgucuucgccgagauugacaauggcagcacacgcccuguucugccccgggcugcgguggugcagacccagacauuuauggccagaggggcucgcaagcaaaaacgggccgucguggccucucuggcuggagaaccgguuggcccugggcagagagcccucuggcagggacgcgcgcugcggauucccccugugggccccuccauccuucacuguagaguccugcauguggauuacgcucucaagguuugcguggacauccccgggaccagcaaacugcuucuggagcucccucuggucaucggaacgauuccgcugcaccccuucggcucucgcuccagcucugugggcucccacgccagcuuucuccuggauuggcggcuuggggcccugccugaaagacccgaggcuccucccgaauauuccgaggucguggccgacacagaggaagcugcccucggacagucuccguucccucugccccaagauccugacaugagccuugagggccccuuuuucgcguacauccaggaauuucgguaccgcccucccccgcuguauuccgaggaagauccuaacccccuccugggggacaugagaccccgguguaugaccugcuga

SEQ ID NO: 66088 - RNA, 1245 nt, Artificial Sequence
  derived and/or modified sequence opt5 from ARRDC3__Homo_sapiens__NP_065852
auggugcugggcaaggucaaaagccucaccaucuccuucgacugccugaacgauucuaauguucccguguacagcuccggggacacagugucuggaagagucaaccuugaggugacgggcgaaauucggguuaagagccugaaaauccacgcccgcgggcaugcuaaggugagauggaccgagucccggaaugccggaucuaacacagcguauacccagaauuacacagaagaggucgaauauuuuaaccacaaagauauucucaucggccaugagcgcgacgaugacaauagcgaggaaggguuccacaccauucauuccggaagacacgaguacgcuuuuagcuucgaacugccucaaacaccgcuugccaccucuuuugagggccggcacggcuccgugcgcuauuggguuaaggccgagcugcauagacccuggcuccugccugugaagcugaaaaaggaguucacggucuuugagcacaucgauaucaacacccccagccuccugucuccucaggcugggacaaaagaaaagacccuuuguugcugguucuguacauccggacccauuagccugucugccaaaaucgagcggaagggcuacaccccuggggaauccauucagaucuuugcugagauugagaauugcagcucccgcaugguggugccgaaggccgcgaucuaucagacgcaagccuucuacgcuaaaggaaagaugaaagaagucaagcagcucguugccaaccugagaggcgagucucuuagcuccgggaaaacagaaaccuggaauggaaagcugcucaaaauucccccugugagccccucuauccuggacuguuccaucauucggguggaguacagccugauggucuauguggauaucccuggcgcuauggaccucuuucugaaccuuccccugguuauuggcacaaucccgcuccauccuuucgggucucgcaccagcuccgugucuagccagugcuccaugaauaugaacuggcugagccuuucucugcccgaaagaccugaggccccucccuccuacgcggaggucgugaccgaagaacagcggcgcaauaaccucgcccccguuagcgcuugugaugacuuugaaagagcccugcaaggaccgcuguucgcuuauauucaggaguuccgguuucugcccccuccccucuacucugaaaucgauccuaaccccgaccaguccgccgacgauagaccgagcugcccuucccgcuga

SEQ ID NO: 66089 - RNA, 1257 nt, Artificial Sequence
  derived and/or modified sequence opt5 from ARRDC4__Homo_sapiens__NP_899232
augggcggggaggccggaugcgcugccgcggugggcgcugaagggagagucaagagccugggacucguuuucgaggacgaacggaaaggcuguuacuccucuggggagaccguggccggacacgugcugcuugaagccagcgagcccgucgcucugcgcgcccucagacuggaggcucagggccgggccacagcggccuggggcccuuccacgugcccgcgcgcuucugccagcaccgcugcccuugcgguguuuuccgaaguugaguaucugaacgugagacucucucugcgggaacccccugccggggagggaaucauucugcuccaacccggcaagcaugaguucccuuuucgcuuccagcugcccagcgaaccucuugucacauccuuuaccgggaaauacggaagcauccaguauugugugagagcuguucuggagcggccgaaggugcccgaucagucugucaaacgcgaacuccaaguggugucccacgucgacguuaauaccccugcccugcuuacacccgugcugaagacacaggagaagauggugggcugcugguucuuuaccagcgggccugucucucucuccgcuaaaauugaaagaaagggauacuguaacggcgaggccauccccauuuaugccgagaucgaaaauugcagcucucggcugaucgugccgaaagcugcgauuuuccagacgcagaccuaccuggccuccggcaagacaaaaaccauccgccauaugguugcuaacgugagagggaaucacauugccagcggauccacagauaccuggaacggcaagacgcucaagaucccucccgucacaccuucuauucuggacuguugcaucauucggguggauuauagccuugccguuuacauccauauccccggggcuaaaaagcugaugcucgagcugccccuugugauuggaaccaucccuuacaauggcuuugggucccgcaacagcucuauugccucccaauucagcauggacaugucuuggcugacacucacccugccggaacagcccgaggcgccucccaauuaugcugaugucgugagcgaagaggaguuuuccagacacaucccucccuacccgcagccucccaacugugaaggagaggucugcuguccuguguucgccugcauucaggaauuucgguuccaacccccuccccuguauucugagguugacccgcacccuagcgauguggaagagucccagcccgucagcuucauccucuga

SEQ ID NO: 66090 - RNA, 1530 nt, Artificial Sequence
  derived and/or modified sequence opt5 from ARSA__Homo_sapiens__NP_001078895
augagcaugggcgcccccagaucccugcuccuggcucuugccgcggggcuggcuguggcccggccuccgaacaucguccucauuuucgccgacgaucugggauacggcgaccuugggugcuauggacaccccucuagcaccacaccuaaucuggaucagcucgcugccggcgggcugcgcuuuacggacuucuacguucccgugucccuguguaccccuucuagagcugcccuccugacaggacggcuucccgugcgcaugggcauguauccuggcguccuggugccgagcuccagagggggacucccccuggaggaaguuaccguggcggagguccuugccgcucggggcuaccugacagggauggccggaaaguggcaucucggcguggggccugaaggagcuuuucugcccccucaccaaggcuuccaucgcuuucugggcauccccuauucucacgaucaggggccgugccagaaccucaccuguuucccucccgccacaccuugcgacggaggcugugaucaggggcugguucccauuccccuucuggcgaaucucagcguggaggcccaaccuccguggcugcccggacuugaagcuagauacauggccuuugcucaugaccugauggccgaugcccagcggcaggaccgcccuuucuuucucuauuacgcuucccaccacacccauuacccccaguucagcggccaaucuuuugcggagagauccgggcggggaccuuucggcgauagccugauggagcuggacgccgcugucggcacgcucaugaccgccaucggggaucugggacuucuggaagagacacucgugauuuuuaccgccgacaacggccccgaaacaaugcgcaugucuagagggggaugcuccggccugcuucggugugggaaaggcaccacguaugagggaggcgugcgcgagccggcucuggccuucuggccugggcacaucgcgcccggagucacacaugaacucgcuagcucucuggaccugcucccuacccuggccgcccuugcuggcgcuccccugccuaauguuacacucgauggguucgaccugagcccccugcuucucggaaccggcaagagcccgagacagucccuguuuuucuacccuucuuaucccgaugaggugagagggguguuugccguccggaccggcaaauacaaggcccacuucuuuacacagggaagcgcgcacuccgacacgaccgccgaucccgcuugccaugccuccucuucccugacagcucacgaaccuccgcuccuguaugaccuuagcaaagaucccggcgagaacuacaaucugcucgggggaguggccggcgcgaccccugaaguucugcaggcccugaagcaacuucagcuccugaaggcucagcuggacgccgcugugacauucgggcccucucaagucgcccgcggagaggauccugcccuccagaucuguugccaucccggcuguaccccucggcccgcuugcugccacuguccggacccucaugcguga

SEQ ID NO: 66091 - RNA, 1602 nt, Artificial Sequence
  derived and/or modified sequence opt5 from ARSB__Homo_sapiens__NP_000037
augggccccagaggggccgcuagccugccucggggaccgggcccccgcagacuccugcuuccugugguccugccccuccugcuucugcuccugcuggccccucccggguccggagcgggcgcuucucggccuccgcaccucguuuuccugcuugccgacgaucugggguggaacgacgugggauuucauggcagccgcaucagaacaccccaccucgaugcccuggcugccggcggggugcuucuggacaauuacuauacccagccucucugcacgcccucccggucucaacugcugaccggacgcuaccagauuagaacaggccuccagcaucagaucauuuggccuugucaacccagcugcgucccgcuggaugagaagcugcugccucagcuccugaaagaagcuggguauaccacacacauggugggaaaguggcaucuuggcauguaccggaaagagugucugcccacccgcagaggguucgacacauauuuuggauaccuccugggcuccgaagauuauuacucucacgagcggugcacccugaucgacgcccucaacguuacgcgcugugcgcuggauuucagagacggcgaagagguggccaccggguacaagaauauguauagcacaaacauuuuuaccaaacgggcuaucgcccuuaucacaaaucacccucccgagaagccccuguuccucuaccuggcccuucaguccguccaugaaccucuucaggugccggaggaauaucucaagcccuacgauuuuauucaagacaaaaaccgccaccauuaugcuggaaugguuagccugauggaugaggcggugggcaaugucaccgccgcucugaagucuuccgggcucuggaacaauacgguguucaucuuuagcacagacaacggaggccagacccuggccgggggaaauaacuggccucuuagaggccggaaauggucucugugggagggcggggugagaggagucggcuucguugcuagcccccuccugaagcagaaaggggugaagaaucgcgaacugauucacaucuccgacuggcuuccuacacucgugaagcuggcccggggacacaccaacggcaccaaaccccuggauggguuugacgucuggaagacaauuucugagggcuccccgagcccuagaaucgaacuccugcauaauauugaucccaacuucguggacuccucuccuugcccccgcaacagcauggccccugcuaaagaugacuccagccuucccgaguacucugcguuuaauacguccguucacgccgcuauccggcauggaaacuggaagcugcucaccggcuauccgggguguggauacugguucccuccucccagccaguacaaugugucugaaauccccagcuccgauccgcccacaaaaacccuguggcuguucgacauugauagagacccugaggagcgccacgaucuuucucgggaauauccccauaucgucacaaagcuccugagcagacugcaauuuuaccacaaacacuccgugccuguuuauuuccccgcccaggacccucgcugcgaccccaaggccaccggcgugugggggccguggauguga

SEQ ID NO: 66092 - RNA, 1782 nt, Artificial Sequence
  derived and/or modified sequence opt5 from ARSD__Homo_sapiens__NP_001660
augagaagcgccgcucggcgcggcagagccgcgcccgcugcccgggacucccugccugugcuccuguuccuuugccugcuccugaagaccugugagccgaaaacagccaacgcuuuuaagcccaauauccuucugauuauggccgaugaccucgggacgggagaucugggcugcuacgggaacaauacccugcgcacaccuaacaucgaccagcucgcugaagagggagucagacugacccaacaccuugccgcggcuccccuguguacaccuucucgggccgccuuccucaccggccgccauagcuuuagauccgggauggaugcuucuaauggauaucgggcccugcaguggaacgcgggcagcggcgggcuucccgaaaaugagacaaccuucgcccgcauucugcagcagcacggauacgcuacgggccucaucgggaaauggcaucaaggaguuaacugcgccuccagaggcgaccacugucaucacccucugaaucacggguuugauuauuucuacggaaugccguuuacccugacaaacgacugcgaucccggccggccucccgaaguggacgcugcccuccgcgcccagcuguggggcuauacccaguuccuugcucuggggauucucacacuggcggccggacagaccuguggcuuuuucucugugagcgcuagagccgucacggggauggccggagugggcugccuguuuuucaucuccugguacagcucuuuuggguucguucggcgcuggaauuguauccugaugagaaaccaugaugugacagagcaaccuaugguccucgagaagaccgcuucccugaugcugaaagaagccgugagcuauauugagcggcacaagcauggacccuuccuccuguuucuuucucugcuccacguucacaucccgcuggugacaaccuccgcguuccuuggcaagagccagcauggccuguacggggacaaugucgaagagauggauuggcucauuggaaaagugcugaacgcuaucgaggacaauggccugaagaacucuaccuuuacauacuucacguccgaccacgggggacaucucgaagccagagauggccacagccagcuugggggcuggaacggaauuuauaaaggcgggaagggaaugggcgggugggagggaggcauccgcgugccugggauuuuucauuggcccggcguccuuccugccggacggguuaucggcgaacccaccucccugauggacguguuccccacagugguccagcucguugggggagaggugccucaagauagagugaucgacggccacucucuggucccgcugcuucagggggcugaagcccgcagcgcucacgaguuucucuuccauuacugcggacagcaucugcacgccgcgcgguggcaccaaaaagauuccggcagcguguggaagguucacuauaccacaccccaguuucauccugagggggccggcgcuuguuacggaagaggcgugugccccugcucuggggaaggagucacccaccaucgcccuccccuccuguucgaccugucccgggauccgagcgaggccagaccucuuacgcccgacucugaaccucuguaucacgcugugauugcccgcgucggcgcggccgugagcgagcaucggcagacacucucccccguuccucagcaauuuucuaugagcaauauccuguggaagcccuggcugcagccguguugcgggcacuucccuuuuuguuccugccacgaagauggagacggcacccccuga

SEQ ID NO: 66093 - RNA, 1845 nt, Artificial Sequence
  derived and/or modified sequence opt5 from ARSE__Homo_sapiens__NP_001269557
augagacccgugaucaaccggugcgccccuggcagccuggaccucaugcugccgcaggcugccuccgaggggauugucuuccacucucuucaaaucagccuguguuuucgcuccuggcuccccgcgaugcuggcuguucuucugucucucgccccuagcgccuccucugauauuagcgcuuccagacccaauauccugcugcucauggccgacgaucugggaauuggcgacaucgggugcuacggaaacaauaccaugcggacaccuaacaucgaucgccuugcugaagacggcgugaagcugacgcagcauauuagcgccgcgucucucuguacccccuccagagccgcuuuccugacagggcgguauccugugcgcagcggaauggucucuuccaucggcuacagagugcuucaguggaccggcgccagcgggggacugccgacaaaugagaccacauuugcuaaaauucucaaggaaaaaggcuaugccaccgggcugaucggaaaguggcaccugggccucaacugcgagucugcguccgaucauugucaccauccccugcaccacggguucgaccauuuuuacggaaugccuuucagccuuaugggcgauugcgcccggugggaacuguccgagaaacgcguuaaucucgagcagaagcugaacuuucuuuuccaagugcuggcucucgucgcccugacgcugguggcuggcaagcucacccaccugauucccguuucuuggaugccugugaucuggagcgcccuuuccgccguccugcuccuggcuagcucuuauuuugugggggcgcuuauugugcaugccgacuguuuccugaugagaaaucacacaaucaccgaacagcccaugugcuuucagcggacaaccccgcucauccugcaggaggucgcuuccuuccugaaacgcaacaagcacggaccuuuucuccuguucguuagcuuccuucaugugcacauuccccugaucacgauggaaaauuuucucggcaaaucucugcaugggcuguacggagauaacguggaggagauggacuggauggucggccggauucuugauacacucgacguggaagggcugagcaauuccacccugaucuauuucacaucugaccacggaggcagccucgagaaccaacugggcaauacccaguacgggggauggaacggcauuuacaaagggggaaagggcaugggcgggugggaaggaggcaucagaguuccugggaucuuucgcuggcccggagugcuucccgccggcagagucauuggggagccuaccucccugauggauguguucccgacaguugugcggcucgccggaggcgaagucccccaggacagagugaucgaugggcaggaccugcugccucuucuccugggcacggcucaacauagcgaucacgaguuucugaugcacuauugugagcgcuuccuccaugccgcgcgguggcaccagagagaccgcggaaccauguggaagguccauuuugugacacccguuuuccagccugaaggcgcuggggccugcuacggacggaaggugugucccugcuuuggcgagaaagucgugcaccacgauccgccucugcuuuucgaccugucuagagaucccuccgaaacccauauucucaccccugccagcgagcccguguuuuaucaaguuauggaacgcguccagcaggcugugugggagcaccagcggacacugucuccugugccccugcaacuugacagacucgggaacaucuggcgcccguggcugcagccuugcuguggacccuucccccugugcuggugucuccgggaggaugacccucaguga

SEQ ID NO: 66094 - RNA, 1773 nt, Artificial Sequence
  derived and/or modified sequence opt5 from ARSF__Homo_sapiens__NP_004033
augagaccccggcgcccucugguguucaugagccucgucugcgcccugcuuaacaccugucaggcucacagaguucaugacgauaagccgaauaucgugcugauuaugguggacgaucucggcaucggggaccugggaugcuacggcaacgauacaaugcggacgccccacauugaccgccuugccagagaggggguccggcugacccaacauaucuccgcggcuucucucuguagcccuucccgcucugccuuucugacaggaagauaucccauucggagcggcaugguguccucugggaaucgcagaguuauccagaaccuggccgugccugcuggacucccccugaaugaaaccacacuugccgcucugcucaaaaagcagggcuacagcaccggccugaucgggaaauggcaccagggacuuaacugcgauucccggagcgaccaaugucaucacccuuauaauuacggcuucgauuauuacuaugggaugccguuuacacuggucgacucuugcuggcccgauccuucccgcaacaccgagcucgccuucgaaagccagcuguggcugugugugcagcucguugcgauugccauccugacgcuuaccuuuggaaagcugucuggcuggguguccguccccuggcuccugauuuucagcaugauccuuuuuauuuuccugcucggguacgcuugguuuucuucccacacaagcccucuguacugggacugccugcucaugagaggacaugagaucaccgaacagcccaugaaagccgagcgggcuggcuccauuauggugaaggaggccaucucuuuccuggaacgccacagcaaggagacauuucuucuguucuuuuccuuccuccaugugcacaccccgcugccuacgacagaugacuucaccggcacaagcaaacacgggcuuuauggagacaaugucgaagagauggauucuaugguuggcaagauccuggacgcgauugaugacuuugggcucagaaacaauacccugguguacuucaccuccgaucauggaggccaccuggaggcccggagagggcaugcucaacucggaggcuggaacggcaucuauaaagggggaaagggcaugggagggugggaaggcgggauucgcgugcccggcaucguccgguggccuggaaaagugcccgccggcagacugauuaaggagcccacaagccuuauggacauccugccuacgguugcuucugugagcgggggaucccucccgcaggaucgcgucaucgacggccgggaucugaugccccugcuucaggggaaugugagacacucugaacaugaguuucucuuccacuacuguggaagcuaucugcacgccguucgcuggauuccuaaggacgauuccggcagcguguggaaagcccauuacgucacccccguguuucagccucccgcuucugggggcugcuaugucacaucccugugucggugcuucggagaacaagugaccuaccacaacccgccucuccuguuugaccuuagcagagaccccucugaguccacaccucugacccccgcgacggagccucuccaugauuucguuaucaagaaaguggccaaugcucugaaggaacaccaggagacaauuguccccgugaccuaccagcugagcgaacuuaaccaaggccgcaccuggcucaaaccgugcugugggguuuuuccuuucugccugugugacaaggaggaagaggugucccagccccggggacccaacgagaaaagauga

SEQ ID NO: 66095 - RNA, 1578 nt, Artificial Sequence
  derived and/or modified sequence opt5 from ARSG__Homo_sapiens__NP_055775
augggcuggcuguuccucaaggugcugcuugccggggucagcuuuuccggauuccuguacccccucguugacuuuugcaucucuggcaaaaccagagggcagaagccuaacuucgugauuauccuggcugaugacaugggauggggcgaucuuggggccaauugggcggagacaaaagacacggcuaaccuggauaagauggccagcgaaggaaugcgguuuguggacuuccacgccgcugccuccaccuguucuccgagccgcgcuucccuccugacaggcagacugggccuccggaauggggucacccgcaacuuugccgugacaucuguuggaggccugccccuuaaugagaccacacuggcggaagugcuccaacaggccggguaugucaccggaauuaucggcaaauggcaucuggggcaccauggaagcuaccacccuaacuucagaggcuuugauuauuacuucggcauucccuauucccaugacauggggugcacggauaccccuggauacaaucaucccccuuguccggcuugcccccagggcgacgggccuagccggaaccuucagcgcgauuguuauacagacguggcccugccccucuacgagaaucugaacaucguugaacaaccugugaaucugucuucccucgcucagaaguacgccgagaaggcgacccaguuuauccagagagccagcacaucuggacggcccuuccugcuuuaugucgcucuggcccacaugcacgugccgcucccugugacccaacugcccgcugccccucgcggcagaucccuuuacggggccggacugugggagauggauagccucgucggccagauuaaagacaagguugaccacacggugaaagaaaacacauuucugugguucaccggcgauaaugggcccugggcucagaagugcgagcuggcgggaucugugggccccuucacaggguuuuggcagacccggcaaggaggcuccccugccaaacagaccacaugggaagggggccaucgcgucccggcucucgccuauuggcccggaagagugccuguuaacgugacgagcaccgcccugcuuuccguccuggacaucuuccccacagugguugcucucgcccaggcgucucugccucaaggccggcgcuuugaugggguggacgucagcgaggugcuuuucggaagaucccagcccggccaccggguccuguuucacccgaauagcggggcugccggagaguucggcgcccuccagaccgugagacuggaacgcuacaaggcuuuuuauauuacagggggcgcccgggcuugugauggaucuaccggcccugagcugcagcauaaguucccccucaucuuuaaccuggaagacgauacggccgaggcgguuccucuugaaagagggggagccgaguaccaagcugugcugcccgagguccgcaaagugcucgccgacguucugcaggauauugcuaacgacaauaucuccagcgccgauuauacacaggacccuucugugacccccugcuguaacccguaccagauugcgugccggugucaagccgcuuga

SEQ ID NO: 66096 - RNA, 1689 nt, Artificial Sequence
  derived and/or modified sequence opt5 from ARSH__Homo_sapiens__NP_001011719
augaccagaaacgcccggcccaauaucgugcugcucauggcugacgaucugggcgucggggaccuuugcuguuacggaaacaauagcguuuccacaccuaacauugaucgccuggccucugagggcgugagacucacgcagcaccuggcggcugccagcaugugcaccccgucccgggccgcuuuccuuacagggcgcuaucccaucagaucuggaauggugagcgccuacaaucugaaccgggcuuuuaccuggcucggcggguccggaggccugccuacaaaugaaaccacauucgccaagcugcuccaacaucgcggcuauagaaccgggcugauuggaaaauggcaccuuggccugucuugugcgagccggaacgaccauugcuaccacccccucaaucauggguuucacuauuucuacggagucccuuuuggccugcuuuccgauugucaggccagcaagacgcccgagcugcaccgcuggcucagaaucaaacuguggauuucuaccguggcucuggcccucguuccuuuccugcuucugaucccgaaguuugcucggugguucuccgugcccuggaaagucaucuuuguguucgcccuccuggcguuucuuuucuuuacaagcugguauucuuccuacggguucacccgcagauggaacugcauucugaugcggaaucaugaaaucauucagcagccuaugaaggaggaaaagguugccagccucaugcugaaagaggcucuggccuucaucgagcgcuacaagagagaacccuuucuccuguucuuuucuuuccuucacgugcauacaccucugauuuccaaaaagaaauuugucggacggagcaaguauggcagauacggcgacaacguggaggaaauggauuggaugguggggaagauccucgacgcucuggaucaagagcgccuugccaaucacacccuggucuauuucacguccgacaacggaggccaccucgagccccuggauggggccguucagcugggaggcuggaaugggauuuacaaaggaggcaagggcaugggagggugggaaggcgggauccgggugccgggaaucuuuagauggccuucugugcucgaggcuggccgcgucauuaacgaacccacaagccugauggacaucuauccuacccuuuccuacauugggggcggaauccugagccaggaucgggugauugacggccagaaccucaugccccugcuggaggggagagcgucucauuccgaccacgaguuccuuuuucauuauuguggaguuuaccuccacacagugcgcuggcaucaaaaagauugcgccaccgucuggaaggcucacuacgugacccccaaauucuauccugaaggcacaggggccuguuacggaagcggcaucugcucuuguagcggggacguuacguaucacgauccgccccugcuguuugacaucucccgggauccuucugaggcccucccccugaauccugacaacgaaccccuuuucgauagcgugauuaagaaaauggaggcugccaucagagaacaucgccggacccugacaccggucccucagcaguuuuccguguucaauaccauuuggaagcccuggcuccagccuugcugcggcacauuccccuuuuguggaugcgacaaggaggaugacauccugccuauggcgcccuga

SEQ ID NO: 66097 - RNA, 1710 nt, Artificial Sequence
  derived and/or modified sequence opt5 from ARSI__Homo_sapiens__NP_001012301
augcacacccugacaggcuucagccucgugucccugcuuucuuuuggguaccugagcugggacugggccaagcccuccuucgucgcugauggaccuggcgaggccggggaacagccgucugcggcucccccucaacccccucauaucauuuuuauccucacggacgaucagggauaucacgacguuggcuaccaugggagcgauauugagacccccacacuggacagacuugccgccaaaggagugaagcuggaaaacuauuacauccagccuauuugcaccccgucccggucucagcuccugacaggccgcuaucaaauccacaccggccugcagcauagcaucauuagaccccagcagccuaauugucucccccuggaucaagugacacuuccucagaaacugcaggaggcuggguacuccacccacauggucggaaaguggcaccucggcuucuaucggaaagaaugccugcccacgcgcagaggguuugacaccuuccuuggaagccugacaggcaacguggauuacuacaccuaugacaauugugaugggccgggaguuugcggcuuugaccuccaugagggcgagaacguggccugggggcugucuggacaguacuccacaaugcuguaugcucaacgggccagccacauccucgcgucucauuccccucagcgcccccuguuccuuuacgucgccuuucaggcugugcacaccccucugcaaagccccagagaauaucucuaccgguaucgcacgaugggcaauguugccagacggaaguacgcugccauggugacauguauggaugaggcgguccgcaacauuaccugggcccugaagagauacggguucuauaauaacucugugaucauuuuuagcagcgacaauggaggccagacauucuccgggggaucuaacuggccccuucggggccgcaaaggcaccuacugggaagggggagugagaggccugggguuuguccacagcccucuccugaagcggaaacagagaaccucccgcgcucugaugcauaucacagacugguauccgacgcucguuggacuggccggcgggaccacaagcgcugccgauggccuugacggauacgauguguggcccgccauuucugagggccgggcuuccccuagaaccgagauccugcacaauaucgacccccucuauaaccaugcgcagcacgggagccuggaaggaggcuucgggauuuggaauacagccgugcaagcugccauccgcgucggagaguggaaacuucugaccggcgauccuggguacggcgacuggauucccccgcagacgcucgccacauucccuggaucuugguggaaccuggaacggauggcuagcgugagacaggccguuuggcuguuuaauaucuccgcggaucccuaugagcgcgaagaccucgcuggccagcggccugauguggucagaacccugcuugcccgccuggccgaguacaaccggaccgcuauucccgugagauacccugccgagaacccccgcgcucauccggacuucaaugggggagccuggggcccuugggcgucugaugaagaggaagaggaagaggaggggcgggccagauccuuuucccggggacgcagaaagaagaagugcaaaaucuguaagcuccggagcuucuuuagaaaacugaacacacgccugaugucucaacggaucuga

SEQ ID NO: 66098 - RNA, 1800 nt, Artificial Sequence
  derived and/or modified sequence opt5 from ARSJ__Homo_sapiens__NP_078866
auggcccccagaggcugcgcugggcacccuccgcccccuagcccccaggccugugugugcccuggaaagaugcuggcgaugggcgcucucgccggguucuggauccugugucuucugaccuacggauaucucuccuggggccaagcccuggaggaagaggaagagggggcccuucuggcucaggcuggagaaaaacucgagcccucuacaacgagcaccucccagccucaucugauuuuuauccuggccgacgaucagggcuuccgggacgucggcuaccacgggucugagauuaagacaccgacccucgauaaacuggcggccgaaggaguuaaacuugagaacuauuacgugcaacccaucugcacaccuagccgcucccaguuuauuaccggcaaauaucagauccauacagggcugcagcacucuaucauuagacccacccaaccuaauugucucccccuggacaacgcuacgcuuccgcagaagcugaaggaagugggauacagcacccauauggucggcaaauggcaccucggguucuaucggaaggagugcaugccuacacgcagaggauuugauaccuucuuuggcucccugcugggcagcggggacuacuacacacacuauaaaugugauucucccggaaugugcggcuacgaccucuaugagaaugauaacgccgcuugggacuacgauaaugggaucuauuccacccagauguacacgcagcgggugcaacagauucuggccagccauaacccuacaaagcccaucuuccuuuauauugcguaccaggccguucacucuccccugcaagcuccuggacgcuacuuugaacauuauagauccaucauuaauaucaaccggcgcagauacgccgcuaugcucagcugucuggacgaggccaucaauaacgugacccuugcccugaaaacauauggcuucuacaauaacucuauuaucauuuauuccagcgauaaugggggacagccgaccgcuggcggcuccaacuggccccuccgggggucuaagggaaccuacugggaaggcgggauccgcgcggucggauuugugcacagcccucugcugaagaauaaaggcacaguuugcaaggagcucgugcacauuacggacugguaucccacccugaucucccuugccgaagggcagaucgacgaggauauucagcuggacggcuacgauaucugggagacaauuagcgaaggacucagaucuccucgggucgacauccugcauaacauugaucccaucuacaccaaagcuaagaacggcuccugggccgccggguauggaaucuggaauacagcuauucaaagcgccauccgcgugcagcacuggaaacuucugaccggcaacccgggguacucugacugggugccuccccagagcuucuccaaucucggaccuaacagauggcauaaugagcggauuacgcugucuacaggcaagagcgucuggcuguuuaacaucaccgcggaucccuaugaaagaguugaccucuccaaucgcuacccugggauugugaaaaagcugcuucggagacugagccaguucaacaagaccgcugugcccguccgcuauccgccuaaagauccccggucuaaucccagacucaacggcggaguguggggcccuugguacaaggaggaaacaaagaagaaaaagccguccaagaaucaagccgagaaaaagcagaaaaagagcaaaaagaagaaaaagaaacagcagaaggccguuucuggguccaccugucacagcggagugacaugcggcuga

SEQ ID NO: 66099 - RNA, 1611 nt, Artificial Sequence
  derived and/or modified sequence opt5 from ARSK__Homo_sapiens__NP_937793
augcugcuccugugggugagcgucguugccgcucuugcccuggcggugcucgcucccggcgccggggagcagagacggcgcgccgcuaaggccccuaacgugguccuggugguuuccgacucuuucgauggaagacuuaccuuucacccgggcagccaaguggucaaacugcccuucaucaauuuuaugaagacacgggggacguccuuccucaacgcuuacaccaauucuccuauuugcugucccagccgcgccgcgaugugguccggacuguuuacacaucugaccgaaucuuggaacaauuucaaaggccucgacccuaacuauacaaccuggauggaugugauggagagacacggguaccggacacagaaguuuggaaaacuggacuauaccagcggccaucacuccaucagcaaucgcguugaagccuggacgagagauguggcuuuccuucugcggcaggagggccgccccauggucaaccucauuagaaaucggaccaaggugcgcgugauggaaagagacuggcagaacacagauaaggccgucaauuggcugcggaaagaggcuaucaacuacaccgagccuuuuguuauuuaucuugggcugaaucucccgcaucccuacccuucucccuccagcggagaaaacuucggcuccuccacauuucacaccagccuguauuggcuggagaaggugucucacgacgccaucaaaaucccuaaguggucuccccucagcgaaaugcauccgguggauuacuacuccucuuauacgaaaaauugcacagggcgcuucaccaagaaggagauuaaaaacaucagagcguuuuacuaugccaugugugcugagacagacgccaugcugggagaaauuauccuugcucugcaccaacucgaucugcuucagaagaccauugucaucuacagcuccgaccauggcgagcuggccauggaacaccggcaguucuauaaaaugagcauguacgaggccucugcucacgugccucuccugaugauggggcccggaauuaaggcgggccugcagguuuccaacguggucagccucguggauaucuauccuaccaugcuggacaucgccggcauuccccuuccccaaaaucugucuggguacagccuccugccucuuuccucugaaacauucaaaaacgagcauaagguuaaaaaucugcacccgcccuggauccucagcgaguuucauggaugcaacgugaaugcuuccacguacaugcugagaaccaaccacuggaaguauauugccuacagcgacggcgccucuauccugccucaacucuucgaucuguccagcgaccccgaugaacuuacaaaugucgcugugaaguuuccugagauuaccuauucucuggaccagaaacuccauuccaucaucaacuaccccaaggucagcgccuccgugcaccaguauaauaaagaacaguucauuaaguggaaacagucuaucgggcagaacuacagcaauguuauugcgaaccugcgcuggcaccaagauuggcagaaggagccgcggaaguaugaaaaugcuaucgaccaguggcugaaaacacauaugaacccuagagccguguga

SEQ ID NO: 66100 - RNA, 984 nt, Artificial Sequence
  derived and/or modified sequence opt5 from ART1__Homo_sapiens__NP_004305
augcagaugcccgccaugaugagccugcuccugguguccgucggccuuauggaggcucugcaagcccagucucacccuaucaccagacgggaccucuucagccaggaaauucagcuggauauggcgcuugcuuccuuugacgaucaauacgccgggugcgccgcugccaugacagcugcccugccggaccucaaccauacggaguuccaggcgaaucagguuuaugccgauucuuggacccuggcuagcucccaguggcaagaacgccaggccagauggcccgaguggucucugagcccuacacggcccuccccucccccucucggauuucgcgacgaacacggcguggcucugcuugccuacaccgcgaacagcccgcugcauaaggaguucaaugccgcugugagagaggccgggcggucucgcgcucacuaucuccaucacuuuuccuucaaaacacugcacuuucuucugaccgaagcccuccagcugcugggaagcggccagagacccccucggugucaucaagucuuccgcggggugcacggacucagauuucggcccgccggcccucgcgcuacaguuagacugggcggguucgcgucugccucccuuaagcauguggcugcccagcaguuuggagaggauaccuucuuuggcaucuggacgugccugggggcccccauuaaaggauacagcuucuucccgggcgaagaggagguccucaucccucccuuugaaaccuuccaagugauuaacgcuucucggcuggcccaggggccugcgcgcaucuaucuuagagcucugggaaagcacuccacauacaauugugaguauaucaaagacaagaagugcaaaagcggccccugucaccucgauaacuccgccaugggccagucuccccugagcgccguuuggucccugcuccugcuucugugguuucucgugguccgggcuuucccugacgggccgggacugcuuuga

SEQ ID NO: 66101 - RNA, 1170 nt, Artificial Sequence
  derived and/or modified sequence opt5 from ART3__Homo_sapiens__NP_001123488
augaagaccggccacuucgagaucgugacaaugcugcucgccacgaugauucuggucgacaucuuucagguuaaagcugaagugcuugauauggccgacaacgcguucgaugacgaguaccugaagugcaccgauagaauggaaauuaaauaugugccccaacuccugaaggaggaaaaagcuagccaucagcagcuugacacagucugggagaaugccaaggccaagugggcugcccggaaaacccagaucuuucugccuaugaacuucaaggauaaucacgggauugcucucauggccuacaucuccgaggcgcaagaacagacaccguuuuaucaucuguucucugaggccgugaaaauggcuggacagagccgcgaagacuacaucuauggcuuucaguucaaggccuuucacuucuaccugaccagagcucuccaacugcuucggaaacccugugaggccuccucuaagacaguuguguaucgcaccagccaggggacguccuuuaccuucggaggccugaaccaggcgagauuugggcauuucacacucgccuacucugcuaagccucaggccgcuaaugaucaacugaccguccuuagcauuuacacaugccugggaguggacaucgagaacuuccucgauaaagaauccgagcggauuacccugaucccccugaaugaaguuuuucaggugagccaggagggcgccggcaacaaucucauucugcaaucuaucaacaagacguguucccacuaugaaugcgccuuccuugggggacugaaaacagagaauuguauugagaaccucgaauacuuucagccuaucuaugucuacaaucccggcgagaagaaccagaaacuggaagaccacagcgagaagaauuggaaacuugaagaucauggggagaagaaccagaagcuggaggaccacggagugaaaauccucgaaccuacccaaauuccgggcaugaagauccccgagccuuucccccugccugaagacaaaucucaggggaacauuaauaaccccacaccgggaccugugcccgucccuggccccaagucccaucccagcgcuucuuccggcaaacugcuccugccucaguuugggaugguuaucauucuuaucagcguguccgcgaucaaucuguucguggcccucuga

SEQ ID NO: 66102 - RNA, 945 nt, Artificial Sequence
  derived and/or modified sequence opt5 from ART4__Homo_sapiens__NP_066549
augggcccccugaucaacagaugcaagaaaauucuccugccuaccacagugccgcccgccacgaugcggaucuggcuucucgggggacugcugccuuuccuucugcuccugagcggccugcagcgccccaccgagggguccgaagucgcuauuaagaucgacuuugauuucgccccuggaucuuuugacgaucaauaccagggcuguagcaaacagguuauggagaagcucacacagggggacuauuucaccaaagauauugaagcgcaaaagaauuacuuuagaauguggcagaaggcucaccuggccuggcuuaaccagggaaaagugcugccccagaauaugacaaccacacaugccguggcuauccucuucuauacccugaacuccaauguccacucugacuuuacgcgggccauggcuagcguggcccgcaccccucaacaguacgagagauccuuccauuuuaaguaucuucacuacuaucugacaucugcgauccagcuccugcggaaagauagcauuauggaaaacggcacccugugcuacgagguucauuaccgcacaaaggacgugcacuucaaugccuauaccggcgcuacgaucagauuugggcaguuccucuccacaagccugcuuaaagaggaagcccaagaguuuggaaaccagacccuguucacaauuuucaccugucucggcgcuccgguccaguacuuuucucugaagaaggaagugcuuauucccccuuaugagcuguucaaaguuaucaauauguccuaccacccccgcggggauuggcuccaacugcggagcaccggaaaccugucuacauauaauugccagcuccugaaggccuccagcaaaaaguguaucccugaccccauugcgaucgccucucuuuccuuucugacgagcgugaucauuuucuccaaaucuagagucuga

SEQ ID NO: 66103 - RNA, 2871 nt, Artificial Sequence
  derived and/or modified sequence opt5 from ARVCF__Homo_sapiens__XP_005261300
auggaggacugcaacgugcacagcgccgcuuccauccuggccucugucaaggaacaggaggcgagauucgaacggcucacccgcgcucuggagcaagaaagacggcauguugcccuucagcuggagcgcgcccagcagcccggcauggugagcgggggaaugggcuccgggcaaccucucccgauggcuuggcagcagcuggugcuucaggagcaaucucccggaagccaggccucccuggcuacaaugccugaagcccccgauguccucgaggaaacggugaccguugaggaggacccuggcacacccaccucucacgugagcauugucacauccgaagaugggaccacaagacggaccgagacgaaagugaccaagacaguuaaaaccgugacaacccgcacggucagacaggugccugugggaccggacggccugccccugcucgauggcgggccuccccugggaccuuuugcggacggcgcccuugaucggcauuuccugcuccgcgggggaggccccgucgcuacacugagcagagccuaccuuucuuccgggggaggcuuuccggaaggcccugagccccgggacagcccuucuuaugggucccugagccgcggacucggcaugagaccuccccgggcugggccccugggaccgggccccggggauggauguuucacccugccuggccaccgcgaagccuuucccguuggcccugagcccgggccgccuggaggcagaucucuccccgagcgguuccaggcggaaccuuacgggcuggaggacgauacaagaucccuugccgcugacgaugaaggaggccccgagcuggaaccugacuaugggaccgccacccgccggagacccgagugcggccgcggacuccauacacgggcuuacgaggacacggccgaugacggcggggaacuggccgaugagagaccggcuuuuccuauggugaccgcgccccuugcccaacccgaacgcggaagcaugggcucccuggaccggcucgugagacgcucuccuagcgucgauuccgcucggaaggagccgagauggcgcgaccccgaacugccugaggugcuggccaugcuccggcaccccguugauccugugaaagccaaugcugccgcguaucugcagcaccuuuguuucgagaacgaaggggucaagagacgggugcgccagcugagaggacucccccugcuuguugcucugcucgaccauccucgggccgaggugagacgccgggccugcggcgcucugagaaaucugagcuacgggcgcgauacagacaacaaggccgcuaucagagauuguggcggaguccccgcccucgugcggcugcuucgcgcggccagagacaaugaaguccgggagcuggugaccggcacacucuggaaccugucuuccuaugagccgcugaaaaugguuauuaucgaccacgggcuucaaacccucacgcaugaagugauugucccucacagcggaugggagcgcgaacccaaugaggauucuaagccuagagacgcugaauggacaaccguguuuaaaaacaccagcggcugccugcggaauguuuccucugauggggccgaggcucgcagacggcugcgcgagugugaaggacucguggacgcccugcuucacgcgcugcagagcgccgucggcagaaaggauacagacaacaaauccguggagaauugcguguguaucaugcggaaccucagcuaccauguucacaaggaaguccccggggcugauagauaccaggaggccgaaccgggcccucugggaucugcugugggcucccagcgccggagacgcgacgaugccagcugcuucgggggaaagaaagccaagggcaaaaaggacggggagauggaucggaauuuugacacccuggaucuucccaaaagaacagaggcugcgaagggauucgaacuccuguaucaaccugaggugguccgccuguaccucucucugcuuacggaaucccggaacuuuaauacccuggaggccgcugccggcgcccuccagaaccugagcgcugggaacuggaugugggccacauauaucagagcgaccgugcgcaaagaacggggccugcccguucuuguggagcuccugcaguccgagacagacaaggucgugagagcuguugccauugcccugcggaaucucucucuggaccgcagaaacaaggaucuuaucggaagcuacgcuauggccgaacuggugcggaauguccgcaacgcgcaggcucccccuagaccgggcgccugucucgaggaagacaccgugguugccgugcugaauacgauucaugagaucgucuccgauucucuggacaacgcucggagccuucuccaagccagaggggugcccgcucugguggcccuggucgcguccagccagucuguucgcgaggccaaagcugccucccacgugcuccagaccguguggagcuauaaggaacugcggggaacacuucagaaagauggcuggaccaaggcuagauuccaaucugccgccgcuacagcgaaagggccuaagggagcccugucccccggcggcuucgacgauagcacccucccucuggucgacaagucucuggagggggagaaaacgggaagccgcgaugugauucccauggacgcucuuggcccugauggguacuccacaguugaccggagagaacgccggccgagaggagccagcucugccggcgaagccuccgagaaggagccccugaaacucgauccuagccgcaaggcucccccucccgggccguccagaccugcggugcggcuggucgacgcugugggagacgccaaaccccagcccguugauucuuggguguga

SEQ ID NO: 66104 - RNA, 1689 nt, Artificial Sequence
  derived and/or modified sequence opt5 from ARX__Homo_sapiens__NP_620689
augagcaaccaguaccaagaggaaggcugcuccgagagacccgaauguaagucuaaaagcccuacccugcucuccucuuauugcaucgacagcauucuggggcggcgcuccccguguaagaugagacuucugggagccgcucagucucuccccgccccucugacaagccgggcggaucccgagaaagcugugcagggcuccccuaagucuucuuccgcccccuucgaagccgagcuucaccucccuccgaaacuccgcagacuguacgggcccggaggcgggcggcugcuccagggagcugccgcugccgcggccgcugccgcugccgcggccgcugccgcugccacggccaccgcuggcccucgcggcgaggcgcccccucccccgccucccacagccagaccuggggaacggcccgacggagcuggcgccgccgcugccgcggcugccgccgcugccgcugccugggauacccugaagaucagccaagcgccccaggucucuauuucccgcagcaagucuuauagagagaauggggccccuuuuguuccgcccccucccgcucuugacgaacugggaggcccugggggagugacacaucccgaggagcggcucggcguggccggcgggccgggauccgcuccugccgcgggcgggggaaccggcacagaagaugacgaggaagaacugcuugaagaugaggaggacgaagaugaggaagaggaacugcucgaggacgaugaggaggagcugcuggaagacgaugcccgcgcucuccugaaagagcccagacggugcccugucgccgcuaccggggccguggccgcugcggccgcugccgccguugcuacggaaggaggcgagcuuagccccaaggaggaacugcuccugcacccugaggacgccgaaggcaaagacggggaggauuccgugugucuuucugcgggaagcgacuccgaggaaggccugcucaagcgcaaacagagacgguacagaaccacauucaccagcuaucagcuggaggaacuggagcgcgcuuuucaaaagacacauuaccccgaugucuucacccgggaggaacucgccaugagacuggaccuuacggaggcccgcgugcagguuugguuucagaaccggagagcuaaguggcgcaaacgggaaaaggccggggcgcagacacacccgccuggacugcccuuccccggcccucucucugcuacccauccgcugucccccuaucuugaugccagcccuuuucccccucaccaccccgcccuggacucugcuuggacagccgcugccgcggccgcugccgcugccuucccuagccugcccccgccucccggguccgccucucugccucccagcggcgcuccgcugggacucuccaccuuucugggcgcggccguguucagacauccugcuuuuaucagccccgccuucgggcgccuuuuuagcaccauggccccucugacauccgcuagcacggccgcggcucuccugcggcaacccacccccgccgucgagggagccguggcuucuggcgcccuggcggauccugcuacagccgccgcugacagacgcgccuccagcauugcugcccuucggcucaaagcgaaggaacacgccgcucagcugacccagcugaauauccucccggggacauccaccggaaaagaggugugcuga

SEQ ID NO: 66105 - RNA, 1128 nt, Artificial Sequence
  derived and/or modified sequence opt5 from AS3MT__Homo_sapiens__NP_065733
auggccgcucugagagacgccgagauccagaaggaugugcaaaccuacuauggccagguccucaaacggagcgcggaccugcagacaaacgggugcguuacgaccgcucgccccgugccuaagcacauuagagaagcccuucagaaugugcaugaggaagucgcccugcgguacuauggauguggccucgugaucccggagcaccuggaaaacugcuggauucuugaucugggguccggaucuggccgcgacuguuacguucucagccaacuggugggggagaaaggacaugucacaggcaucgauaugaccaagggccagguggagguugcugaaaaauaucuggacuaccacauggagaaguauggguuccaggccuccaaugugacauuuauucauggauacaucgaaaagcucggcgaggcugggaucaaaaacgagucucacgauauugucgugagcaauugcgugaucaaccugguccccgacaagcagcaaguucuucaggaagccuacagagugcugaaacacggaggcgagcucuauuucuccgauguguacaccucucuggaacuuccugaggaaauucggacacauaagguccuguggggagagugucucgggggcgcgcuguauuggaaagagcuggccgugcucgcucagaagaucggcuuuugucccccucgccugguuaccgccaaucuuauuacgauccagaacaaggaacuggagagagugauuggggacugccgguucgucagcgcuaccuuucgccucuucaaacacuccaagacaggacccaccaaaagaugccaagugaucuacaauggcgggaucacaggacaugaaaaggagcugauguuugaugccaacuucaccuuuaaagaaggcgagauuguugagguggacgaagagacggcggccauccuuaagaauagccgguucgcucaggauuuucugauucgcccuaucggggaaaaacucccgacaucuggaggcuguuccgcccuggagcugaaggacauuaucaccgaccccuucaagcucgcugaagagagcgauucuaugaaauccagaugcgucccugacgccgccggcggguguugcggaacaaagaaaagcugcuga

SEQ ID NO: 66106 - RNA, 1170 nt, Artificial Sequence
  derived and/or modified sequence opt5 from ASAH1__Homo_sapiens__NP_001120977
augaacugcuguaucggccugggggagaaggccagaggaagccaccgggcuuccuaccccucucucagcgcccuguucaccgaagcguccauucuuggcuuugggucuuucgcugugaaggcccaguggacagaggacugccgcaagagcacguauccuccguccggacccaccgucuuuccugccguuaucagauaccggggcgcugugcccugguauacaauuaaucuggaucucccucccuacaaacgcuggcaugaacugaugcuugacaaggccccugugccggggcugcucggaaacuuccccggcccuuuugaggaagagaugaaaggcaucgcugccgucaccgauauuccccugggggagaucaucucuuucaauaucuuuuaugaacuguucacaauuuguaccagcauuguggcggaggacaagaagggacaccucauccauggcagaaacauggauuuugggguuuuccugggauggaauauuaacaaugacacaugggugaucaccgaacaacuuaaaccucugacggucaaccucgauuuucagcggaauaacaagaccguguucaaagccuccagcuuugcuggcuacguugggaugcugacaggauucaagcccggccuuuucucucugacccucaaugagcgcuuuuccauuaacggcggguaucugggaauccuggaguggauccucggcaaaaaggacgugauguggauuggguuccugacaagaaccguccuugaaaauagcacgucuuacgaggaagccaagaaccugcucacaaaaaccaagauccuggcuccggccuacuuuauucuuggaggcaaucaguccggggagggaugcgugaucacacgggaucgcaaagaaagccuggacguguaugagcucgaugcgaagcagggcagaugguacgucguucaaaccaacuaugaccgguggaaacacccuuucuuucuggaugaccgcagaacccccgccaagaugugucugaaccggacaucucaggagaauauuuccuucgaaacgauguacgacgugcucagcaccaaaccugugcugaacaaacuuacagucuauaccacacugaucgaugugaccaagggccaguuugagacguaccuccgcgacugccccgaucccuguaucgggugguga

SEQ ID NO: 66107 - RNA, 2238 nt, Artificial Sequence
  derived and/or modified sequence opt5 from ASAH2__Homo_sapiens__NP_001137446
auggccaagagaaccuucagcaaccuggagacauuucucaucuuccugcuugugaugauguccgcuauuacggucgcccugcucucucugcuuuuuaucaccagcggcacaauugaaaaucacaaagaccucgggggacauuucuuuuccaccacacagucucccccugcgacccaaggcagcacagcugcccagcgguccaccgccacgcagcacucuaccgcuacacagagcuccaccgccacacaaaccagcccgguuccccugacgccugagucuccccuguuccagaacuuuuccggguaccauaucggagugggccgcgcugauugcacaggacagguggccgacauuaaucugaugggguauggcaagagcggccagaacgcgcaagggauccucaccagacuguacucucgggccuucaucauggcugaaccugauggauccaaucgcacagucuuugugagcauugacaucggcaugguuucucagagacuucggcuggaggugcucaaccgccugcaguccaaauaugggagccuuuacagacgggauaaugucauucuguccggaacccacacccauucuggccccgccggguauuuccaguacacaguguuuguuaucgcuagcgaaggauucuccaaccaaacguuucagcacauggugaccggcauucucaagagcaucgacauugcccacacaaauaugaaaccuggcaagaucuucaucaacaaggggaaugucgauggagugcagauuaaccgcucuccguauuccuaccugcaaaauccccagagcgagagagcgcgguacucuagcaacaccgacaaagagaugaucgugcugaagauggucgaucucaauggcgacgaucuggggcuuauuuccugguucgccauccauccuguuucuaugaacaacagcaaucaccuggugaacuccgacaaugugggauaugcuagcuaccuccuggaacaggagaaaaacaagggcuaucuucccgggcagggaccuuuugucgccgcuuucgccucuuccaaucugggcgaugugagccccaacauucucggcccgcgcuguaucaauacaggggaaucuugcgacaacgccaauuccaccuguccuaucggaggccccagcaugugcauugcuaaagggccuggacaagacauguuugauuccacgcagaucauuggcagagcgauguaccagcgggccaagucuaagacauguaaacccgcucugggguauagcuucgccgccggcaccaucgacggaguuggcgggcugaacuuuacccagggaaagacagagggcgaucccuucugggacaccauucgcgaucaaauccucgggaaaccuuccgaggaaaucaaggagugccauaaaccgaagcccauucugcuucacacaggagaacugucuaaaccucaccccuggcauccugacaucguggauguccagauuaucacgcucggcagccuggcuauuaccgccauccccggggaguuuacaaccauguccggcagacggcuuagagaagcggugcaggcugaguucgccagccacggaaugcagaauaugacaguugugauuucuggccuguguaacgucuacacccauuauaucacgaccuacgaggaauaccaagcccagcgcuaugaggcugccuccacaaucuacgggccgcacacccucagcgcuuauauucagcuguuucggaaucuggccaaggcgaucgccacagacaccguggcuaaccucucuagaggaccugaacccccuuucuuuaagcagcugauugucccccuuaucccuuccauuguggaucgcgcccccaaaggccggacguucggggacguucugcaaccggcuaagccugaguacagagugggagaagucgccgaggugaucuuuguuggcgcgaaucccaaaaacagcgugcagaaccagacacaucaaaccuuccucacagucgagaaguaugaagccaccucuaccagcuggcagaucgugugcaaugaugcuuccugggagacacgcuucuacuggcacaaagggcugcugggccuuagcaacgccacgguggaauggcacauucccgacaccgcucagccuggaaucuaucggauuagauacuuuggccauaaucgcaagcaggacauccucaagccggccguuauucugucuuucgaggggacaucccccgccuuugaagucgugaccaucuga

SEQ ID NO: 66108 - RNA, 3390 nt, Artificial Sequence
  derived and/or modified sequence opt5 from ASAP1__Homo_sapiens__NP_060952
augagaagcuccgccucucggcugagcuccuucucuagccgcgacucccucuggaacagaaugcccgaucagaucucugugagcgaguuuauugcugaaaccacagaggacuacaauuccccuacgaccagcucuuucacaacccggcugcacaacugccgcaauacagucacccuucuggaagaggcccucgaucaagacagaacagcgcugcagaagguuaaaaaguccgugaaagcuaucuauaacagcggccaggaucaugugcagaaugaagagaacuacgcccaaguccuugacaaguuugggucuaauuuccugucccgggauaacccggaccucggaaccgccuuugugaaauucagcacgcugaccaaggagcugucuacacuccugaagaaucuucugcagggccucucccacaacguuauuuuuacccuggauagccuucugaaaggggaccucaagggagugaaaggcgaucugaagaaacccuucgacaaggcuuggaaggauuaugaaacaaaauuuaccaagaucgagaaagaaaagcgcgagcaugccaaacagcacgggaugauuagaacggagaucacaggagcugaaaucgccgaggaaauggagaaggaacggcgccuguuccagcuccaaaugugugaguaccugauuaaagucaaugagaucaagaccaagaaaggcguggaccuucugcagaaccucauuaaguauuaccaugcgcagugcaacuuuuuccaggacggccugaaaacagccgauaaacuuaagcaauauaucgaaaagcuggcugccgaccucuacaauauuaagcagacccaggaugaggagaaaaagcaacugaccgcucugagagaccucaucaaauccucucugcagcuugaucagaaggaggacagccagucccggcaagggggauacagcaugcaccagcugcagggcaauaaagaauaugggucugagaagaagggauaccuccugaaaaaguccgauggcauucgcaaaguuuggcagagacggaaguguagcgugaaaaacgggauccuuacaaucucucacgccacgagcaaccgccaaccugcgaagcugaaucuccugaccugccaggucaagcccaacgccgaggacaaaaaguccuuugaucugauuucucauaauagaacauaucacuuccaggcugaagacgagcaggauuacguggccuggaucagcgugcucaccaacuccaaagaagaggcucugacaauggccuuccggggagaacaaagcgccggcgaaaauucucuugaggaccugaccaaggcuauuaucgaagacguccagagacucccuggcaacgauauuuguugcgacuguggguccagcgagcccacguggcugucuacaaaucugggaauccuuaccugcaucgaauguuccggcauucaucgcgagauggggguucacaucagccggauucagucccucgagcuggauaaacugggaaccucugaacuccugcuugcgaagaacgugggcaauaacagcuuuaaugacaucauggaggccaaccugccuuccccgucucccaaaccuacacccagcuccgauaugaccgugagaaaggaauauauuacagcuaaguacgucgaccaccgcuucagccggaaaacgugcucuaccuccagcgccaagcucaaugagcugcuggaagccaucaaaucuagagaucuucucgcucugauccagguguaugccgaggggguugagcugauggaaccucuccuggagcccggacaagaacuuggcgagacagcgcugcaucucgcugugcgcaccgccgaccagacaucccugcaccuggucgauuuucuugugcagaacuguggcaaucucgacaagcaaaccgcccuggggaacacgguucugcauuacugcagcauguacucuaaaccggaaugccucaagcugcuucugcggagcaagccuaccguggauauugucaaccaggcuggagagacagcccucgacaucgcuaaaagacugaaggccacccagugugaggaucugcuuucccaggcgaaaagcggcaaguucaauccccacgugcaugucgaauaugaguggaaccuccgccaagaagagauugacgaaucugacgaugaccuggaugacaaaccuucccccaucaagaaggagcggagccccagaccucaguccuuuugccacucuagcuccauuucuccgcaggauaaacuggcccuccccggguucagcacaccucgcgacaagcagcggcuguccuacggagcuuuuaccaaucaaaucuucgugucuacgagcacagauucccccaccagcccuacaaccgaggcucccccgcuuccucccagaaacgccggcaaagggccuaccggacccccuucuacacugccccucuccacgcagaccagcucuggcuccagcacacugucuaagaaacggccgccucccccucccccgggccacaagcgcacccuguccgaucccccuagcccccuuccucaugggcccccuaauaagggagccguucccuggggcaacgacgggggaccguccagcucuagcaaaacaaccaauaaguuugaaggccugucccagcagucuagcacguccucugcgaaaacagcccucgggccuagagugcugcccaagcucccucaaaaagucgcucugcggaagaccgaccaccuuagccuggauaaagccaccauucccccggagaucuuccagaaguccucucagcucgcugaacugccucaaaagcccccucccggcgaccugcccccuaaaccgacagagcuugcccccaagccucagaucggagaucugcccccuaaacccggcgagcucccuccgaagccccagcugggggaccucccucccaaaccucagcugagcgaccuucccccgaagccucaaaugaaggaucugccucccaaaccccagcucggagaccugcuggccaagucccagaccggcgaugugagccccaaagcucagcaaccuucugaaguuacacuuaagucccauccgcuggaccucagccccaacgugcagucuagagaugcgauucagaaacaggccuccgaggacagcaaugaucugacgccuacccuccccgaaacaccugucccccugccgcgcaagaucaacaccgggaagaauaaagugcggagagugaagacaauuuaugacugucaagcugauaacgacgaugagcuuaccuuuaucgaaggagagguuauuaucgucacgggcgaggaagaccaggagugguggaucgggcacauugaaggccagccugagcgcaaaggaguguuccccguguccuuuguccacauccugucugacuga

SEQ ID NO: 66109 - RNA, 2886 nt, Artificial Sequence
  derived and/or modified sequence opt5 from ASAP2__Homo_sapiens__NP_001128663
augcccgaccagaucagcguguccgaguucgucgccgaaacccacgaggauuacaaggcuccuacagccucuagcuuuacgaccagaacagcgcaaugccggaacaccguugcugccauugaagaggcccuggacguggaucgcauggugcucuauaaaaugaagaaauccgucaaggcuaucaauucuagcggccuggcccauguggaaaacgaggagcaguacacacaggcucuugaaaaauucgggggaaauuguguuugcagagacgauccggaccugggcuccgccuuucucaaguucucuguguuuaccaaggagcugacagcgcuuuucaaaaaccugauucagaauaugaacaauaucauuagcuuuccccucgauucccugcugaagggggaccucaaaggagucaagggcgaucugaaaaagccuuucgacaaggccuggaaagauuaugaaaccaagaucacgaaaaucgagaaggagaaaaaggaacacgcuaaacuucaugggaugauucggaccgagaucagcggagccgaaauugcugaggaaauggagaaggagcgcagauuuuuccaacugcagaugugugaauaccuccugaaggugaacgagaucaaaauuaagaaaggcguugaccuucugcagaaucucaucaaguauuuucacgcccagugcaacuucuuucaagauggccugaaagcgguggaaucucugaagcccuccauugagacacucagcaccgaccugcauacaaucaagcaggcccaggacgaggaacggcgccagcuuauccaacugagagauauucucaaaucugcucugcaggucgagcagaaggaagacucccaaauccggcagagcaccgccuacucucuucaccagccucaggggaauaaagagcacggaacggaacgcaacggcucccuguauaagaaaagcgaugggauuagaaagguguggcaaaagcggaaauguuccgugaagaauggauuccucacaaucucucauggcaccgcuaacagacccccugccaaacugaaucugcucacaugccaggucaagaccaacccggaggagaaaaaguguuucgaccugauuagccacgaucgcaccuaccauuuucaggccgaagacgagcaggaaugccaaaucuggauguccguucuucagaacagcaaggaggaagcucugaauaacgcguucaaaggggaugacaauacaggagagaacaauaucgugcaggagcucacgaaggaaauuaucucugaggugcagcggaugaccggcaacgaugucuguugcgacuguggcgcccccgauccuacauggcuguccaccaaucuugggauucugacaugcaucgaaugcagcggcauucaccgcgagcucggagugcacuacucuagaaugcaaagccugacccuggacguucucgggacguccgaacugcuucuggcuaaaaacaucggaaaugccggcuuuaacgagaucauggaguguugccuccccgccgaagacucugugaagccuaaucccgggagcgauaugaacgcucggaaagacuauauuacagccaaguacaucgagagacgcuaugcgcggaaaaagcaugcugauaaugccgccaagcugcacucccugugugaagcugucaaaaccagagacauuuucggacuucuccaggccuacgcugauggcguggaccugaccgagaagaucccgcuggccaacggccaugaaccugaugagacagcgcuccaccuggccguucgcagcguggaccggaccucucuucauauugucgauuuucuggugcaaaauuccgggaaccucgacaaacagacaggaaagggcagcacggcucugcacuauugcugucugaccgauaacgccgagugccuuaaacuccugcugagagggaaggcuucuaucgaaauugccaaugaguccggagaaacaccccucgacaucgcgaagcgccugaaacacgagcauugugaggaacuucugacccaagcccucagcggccgguucaacucccacguccauguggaguacgaauggagacugcugcacgaggaucuugacgaaucugacgaugacauggaugagaagcuccagccuagccccaaucgccgggaggacagacccaucuccuuuuaucagcuggggucuaaccaacugcagagcaaugcuguuucccucgcccgcgaugcugccaaccuggccaaagaaaagcagcgggcuuucaugccuagcauucuucagaaugagacauacggcgcgcugcucucuggauccccgcccccugcccaacccgcugccccuagcaccacgucugcucccccgcugccucccagaaacgugggcaaagacccucugacccccacaccucccccgccugucgccaagacccccuccgugauggaagcccuuagccagcccucuaagccugcgccgcccgggaucagccagauucggccucccccucugcccccucagcccccgucccgccucccucagaaaaagcccgcuccuggagccgauaaaagcacaccccugaccaauaagggccagccgagagggccuguugaccucucugccacggaggcucugggaccccuuuccaacgccauggugcugcagccucccgcgcccaugccucggaaaagccaggcuacaaagcucaagccgaaaagagucaaggcccuguacaauugcguggccgauaaccccgacgaacugaccuuuuccgagggcgaugugaucauuguugacggggaggaagaucaagagugguggaucggccacaucgacggagacccuggccgcaaaggggcuuuccccgucucuuuugugcauuucauugccgauuga

SEQ ID NO: 66110 - RNA, 1404 nt, Artificial Sequence
  derived and/or modified sequence opt5 from ASB10__Homo_sapiens__NP_001135931
augcugaugagcuggucccccgaggaaugcaagggccagggggagccucucgacgauagacacccgcugugugcccggcuuguggaaaaacccucucgcggaagcgaggaacaucugaaguccggcccugggcccaucgucaccagaacagcuucuggaccugcccucgcguucuggcaagcuguucuggccggcgacguggggugcgugagccggauucuugccgauuccucuacgggacuggcucccgacagcgucuuugauaccuccgacccugagcgcuggagagauuuccgguuuaacauccgcgcccucagacuguggagccugacauacgaggaggaacucaccacaccgcugcacguggcugccucucggggccauaccgaaguucuucgccugcuccugagacggcgcgcgagacccgacuccgccccuggcgggcggacagcccuucacgaggcuugugcugccggacauaccgcgugcgugcacguccugcucguggccggcgcugaucccaauauugccgaccaggaugggaaacgcccucugcaccuguguagaggacccggcacgcucgagugcgcugaacugcuucugcgguucggggccagaguugacggacgcagcgaggaagaggaagagaccccgcuccauguggccgcucggcugggccacgucgagcuugcggaucugcuccugagacgcggcgccuguccugacgcucggaacgccgaaggguggacaccccugcucgccgcuugcgacgugagaugucagucuaucaccgaugccgaggcgacaaccgcucgcugccugcagcuuuguucccugcuccugagcgccggagccgacgcugaugccgcugaccaagauaagcagcggccucuucaucuggccugcagacgcggccacgcggccguggucgaacuccugcugucuugcgggguuuccgcuaauacgauggacuauggaggccacacaccccuccauugugcccugcaggggcccgcugccgcgcuugcccagagcccugagcacguggugcgggcucugcucaaccauggagccgucagaguguggccgggcgcucugcccaaaguucuggaacgcuggucuaccugcccucggacaauugaggugcuuaugaauaccuacuccgucgugcaacuccccgaggaagccguuggccuggugaccccugagacacugcagaagcaccagagauuuuauagcucccucuucgcccugguccggcagccccgcagccuucaacaucugucuagaugugcucuccggucccaccuggaagggagccugccgcaggcgcuuccuagacucccccugccuccccgccugcuccgguaccugcagcuugauuuugagggagugcuguauuga

SEQ ID NO: 66111 - RNA, 837 nt, Artificial Sequence
  derived and/or modified sequence opt5 from ASB13__Homo_sapiens__NP_078977
auggagcccagagccgcugacggcugcuuccugggggaugugggauuuugggucgaacggaccccuguucacgaggccgcgcagcgcggcgaaagccuccaacugcagcagcuuaucgaguccggggcuugugugaaccaggugacagucgacucuauuacgccgcugcaugccgccagccuccaaggacaggcuagaugcgugcagcugcuucuggccgcuggcgcccagguugaugcgcggaauaucgacggguccacaccccucugugaugccugcgcuucuggaagcauugaaugugugaagcugcugcucuccuacggcgccaaagucaacccuccccuguauaccgcuucuccucuucacgaggccugcaugagcggcuccagcgagugugugcgccugcucaucgacguuggggcgaaucuggaagcccaugauugccacuucggaacaccccuucauguggcuugugccagagagcaccuggacugcgucaaggugcuccugaacgcuggcgccaaugugaacgccgcuaaacugcacgaaaccgcgcuccaucacgccgcuaaggucaaaaauguugaucugauugagaugcuuaucgaguuugggggaaacaucuacgcccgggacaaucgcggcaagaagccuucugauuauaccugguccagcucugccccggcuaaauguuucgaauacuaugagaagacaccccugacccucucccaacugugcagagugaaccuucggaaagccacgggggugcgcggacuggaaaagauugcgaaacucaauaucccucccagacugauugacuaccugagcuauaacuga

SEQ ID NO: 66112 - RNA, 1767 nt, Artificial Sequence
  derived and/or modified sequence opt5 from ASB15__Homo_sapiens__XP_005250203
auggacaccaacgaugaccccgaugaggaccaccugacaagcuacgauauccagcucuccauucaagaaucuaucgaggccagcaagacggcucugugcccugaaagauucgugccgcuuuccgcccagaaucggaaacuggucgaggcgauuaagcagggccauauccccgaacuccaggaguauguuaaauacaaguaugcuauggacgaggccgaugaaaaagggugguuuccucugcacgaggccguggugcaacccauucagcagauccuugaaaucguccuggacgcuucuuacaagacccucugggaguucaagacaugugauggagagaccccucugacacuggccgugaaagcuggccucguugaaaacgugcgcacccugcuugagaagggggucuggcccaauacaaagaacgacaagggagaaaccccucugcucauugccgugaaaaagggcagcuaugauaugguuuccacgcugaucaagcauaauaccucucuugaccagccgugcgugaaaagauggagcgcgaugcacgaggccgcuaagcaagggcggaaagauauugucgcccugcuccugaagcauggaggcaacgugcaccuccgcgacggcuuuggggugacaccccucggagucgcugccgaauacggccacugugacguucuggagcaucuuauccacaaagggggagaugugcuggcgcucgccgacgauggcgcuuccgugcuguucgaggccgcugggggaggcaauccugacugcauuagccuucugcucgaauauggcgggucuggaaacguccccaauagagccggccaucugccuauccaccgggccgcuuacgaggggcacuaccuggcgcucaaguaucugauucccgugaccuccaaaaacgccauccgcaagagcggacuuacaccgauccauucugcugccgauggccagaaugcccagugucuggaacuccugauugagaacggguuugacguuaauacccuucuggcugaucacaucucccagagcuacgacgaugaaagaaagacggcccucuauuucggagugucuaacaaugacguccauugcacagaggugcugcuggcggcuggcgccgauccuaaccucgacccccugaacugucuucugguugccgugcgggcuaauaacuacgagauuguccgccuccugcugucccacggcgccaaugugaacugcuauuuuaugcaugucaaugacaccagauucccuagcgugauccaauacgcucuuaacgaugaaguuaugcuccggcugcugcucaauaacggguaucagguggagauguguuuugacugcaugcacggagauauuuucggcaauuccuuugucuggucugaaauccaggaggaagugcugcccggguggacaagcuguguuaucaaagacaaccccuucugcgaguuuauuaccgugccuuggaugaagcaccuugucggacgcgugaccagagugcugaucgauuacauggacuacguuccgcucugcgccaaacugaaguccgcgcuggagguccaacgggaauggcccgagauucgccagauccuugaaaauccuuguagccucaaacaucugugcagacugaagauucggagacucaugggccugcagaaacuuugucagcccgccucuguggagaaacugccucugcccccggcuauccaacgcuauauccuguucaaggaguacgaucuguaugggcaggaacuuaaacucacauga

SEQ ID NO: 66113 - RNA, 1401 nt, Artificial Sequence
  derived and/or modified sequence opt5 from ASB18__Homo_sapiens__NP_997721
augagcaacuccgacuaccugcccgauuauccucucaauucugaccuggugaagagacuuaaaagcgcccuggaugcuaaggacgaggaacggguccgcgaucucaucugcaccgagauuacaccgguugacgccgugaucgaacuggcgaacgaugacuggaugaaagaucccuccgcucagcuuccuacgggcaugcugcucggggaccuggaucaccugaagccccucauggaccaauucuuucaggaugccaauguggucuucgagauuaacaaagacgaaauggaguggcaagugaagucuccugccaccuuuggacugagcggccuuuggacacuggaguacaagagagaacucaccacaccccuguguaucgcugccgcucaugggcacaccgccugcguucggcaucuucugggacgcggcgcggacccugaugccucccccgggggaagaggcgcucuccacgaggccugucugggcgggcauacagcuugcgugcggcugcuccugcagcaccgcgccgaccccgaucuucugucugcggaaggacucgccccucugcaccuuuguagaaccgcugccagccugggcugcgcucaggcccuccuggagcauggggccuccguccagcgggugggaggcacggggcgcgacaccccgcugcacguugcugcgcagagaggacucgaugagcaugcccggcuguaucuuggccgcggcgcucacguggacgccagaaaugggcggggagaaacagcccugagcgcugccuguggcgcggcucgcagaccugaugagcacgggcggugccucagacugugugcccuucugcuccgccggggagccgaagcugacgccagagaugaggacgaacgcucuccccugcauaaggcuugcggccacgccucccauagccuggcgcggcuccugcuuagacacggggccgaugcuggagcccuggacuacggcggcgcuucuccgcucgggcgcguccugcagaccgccuccugugcgcugcaagccagcccucagcggacagugcaggcccuucucaaccauggaucucccaccguguggccugacgcuuuccccaaaguccugaaaacgugcgcuuccguucccgccgugauugaggugcuguuuaauagcuauccucagcucugccuguccgagucuuggaaggaagucaucccggaggaaguguuccaaaugcacaaacccuuuuaccagagccuuuucgcccuggcucucacaccuagaugucugcagcaccugugccgcugugcgcuucggagacucuuuggcaagcgcugcuucgaucugaucccccugcucccucugcccaagccgcuucaaaacuaucugcuccuggagccucaggggguucugcauuga

SEQ ID NO: 66114 - RNA, 1008 nt, Artificial Sequence
  derived and/or modified sequence opt5 from ASB1__Homo_sapiens__NP_001035535
auggccgagggcgggagccccgacggcagagcuggaccuggguccgccggacggaaccugaaggaauggcuccgcgagcaguucugcgaucacccgcuggaacauugugaggacaccagacuucacgaugcggcuuacgugggcgaccugcaaacacuccggucucugcuucaggaagagagcuaucgcuccagaaucaaugagaaaucugucuggugcuguggguggcugcccugcacgccucuccggauugccgccaccgcuggacauggcagcuguguugauuuucugauccgcaagggcgccgaaguggaccugguggaugucaaagggcagacagcucucuacguggccguugugaacggacaccuggaguccacccagauucuucuggaagcgggcgccgaccccaaugggucuagacaucaccggagcacaccugucuaucacgcuucccgcgugggcagagccgauauccucaaggcucugauucgguacggagccgacguugaugugaaccaucaccuuacccccgacguccaaccucgcuucagcagacggcugacaucucucguggugugcccgcuguauaucuccgcggccuaccauaaucugcaguguuuucgccuccugcuucuggcuggggccaaccccgauuucaauugcaacggaccugucaauacccagggcuuuuauagaggcagccccggguguguuauggacgcugugcuccggcacggaugcgaggccgccuucgugucucugcuugucgaguuuggcgcuaaccugaaucucgugaaaugggaaucccuggggccugagagcagaggacgccggaagguugaccccgaagcgcuccagguguucaaggaggccagaucugucccgcgcacgcugcugugucuuugccggguggcuguuagacgcgcccugggcaaacaccggcuccaucugaucccuucccuuccccugccugaucccauuaagaaauuucuccugcacgaauga

SEQ ID NO: 66115 - RNA, 1764 nt, Artificial Sequence
  derived and/or modified sequence opt5 from ASB2__Homo_sapiens__NP_057234
augaccagauucagcuacgccgaguauuuuucccuguuccacucuugcagcgcucccucccggucuacagccccuccggaaagcucccccgcgcgcgcuccuaugggccucuuucagggggugaugcaaaaguacucuagcucccuguucaaaacgagccagcuugcccccgccgacccucugaucaaggcuauuaaagauggagacgaggaagcccucaagaccaugaucaaagagggcaagaaccuggcugaacccaauaaggagggguggcuuccucugcaugaggccgcguauuacggacaggucggcugucucaaaguucugcagagagccuauccggggacaauugaucaacggacccugcaggaagagacagcuguguaccucgcuaccugccgcggacaccuggacugucuucugucucuccugcaggccggcgccgaacccgauaucuccaacaagagcagagagacaccucuuuauaaagcgugcgagcggaagaaugccgaagcugugaaaauucugguccagcauaacgccgacaccaaucaccgcuguaacagaggcuggacggcucuccaugagucugugucccggaaugaucuggaaguuaugcaaauccuggugagcgggggagccaaggucgagucuaagaacgccuacggcaucacaccccucuuuguggcugcgcaguccgggcagcuggaagcccuucgcuuccuggcuaaauacggagccgacauuaauacccaggccagcgauaacgcuuccgcccucuaugaggcgugcaagaaugagcacgaagagguuguggaauuucugcuuucucaaggcgcugacgccaacaaaaccaauaaggaugggcugcucccucugcacaucgccagcaaaaagggaaacuacagaauuguccagaugcugcuccccgugacaucccggacccgcaucagacggagcggcgugucuccgcugcaucuugcugccgagcgcaaucacgacgaaguccuggaggcucuccuguccgccagauucgauguuaacacgccucuugcgcccgagcgggccagacuguaugaagaccgccggagcucugcucucuacuuugccguggugaacaauaacgucuaugcuacagagcugcugcuccagcauggcgccgacccuaauagagaugugauuagcccccugcuuguugcgauccgccacgggugucugcggaccaugcaacuccugcuggaccacggagccaacauugaugcuuacaucgccacacaucccaccgcuuucccugccaccaucauguuugccaugaaaugccuuucccuccugaaguuccugauggaccucggcugugauggggaaccgugcuuuucuugucuguauggaaauggcccccacccucccgcuccucagcccagcuccagauucaacgacgcgccggccgcugauaaggagccuagcgugguccaguucugcgaauuugugucugcccccgagguuucccgcugggccgggccuauuaucgacgugcuucuggauuacgucggaaaugugcagcucugcagccggcugaaagagcauauugacucuuucgaagauugggcugucaucaaggagaaagccgaacccccuagaccccuggcgcaccuuugucgccuccgggugagaaaggcuauuggcaaauaccgcaucaagcugcuggacacacucccgcugccuggccggcuuaucagauaucugaaguacgagaacacgcaauga

SEQ ID NO: 66116 - RNA, 1266 nt, Artificial Sequence
  derived and/or modified sequence opt5 from ASB6__Homo_sapiens__NP_060343
augcccuuccugcacggcuuuagacggaucauuuucgaguaccagccucucguggacgccauccuggggagccuugggauucaagauccggaacgccaggagucccuggacagacccucuuaugucgcuagcgaagagucccggauccucguucugaccgaacuucuggagcgcaaggcccauucuccuuuuuaccaggagggcgugagcaacgcgcuccugaaaauggcugaacuggggcucacaagagccgccgaugugcugcuucggcacggagcuaaucugaacuucgaggaccccgucacguauuacaccgcccuccauauugcugugcugcgcaaucagccugauaugguugaacuucuggugcaccauggcgccgacgucaacagacgggaucgcauccacgaguccucuccccucgaccuggcgagcgaggaaccugagagacugccgugccuccaacggcugcuugaucugggggccgacgugaaugcugccgauaagcacggaaaaacagcucuccugcaugcccuugcguccagcgacggcguucagauccacaacaccgaaaauauucgccugcuccuggagggcggggccgaugugaaggcuacaaccaaagacggagacacagucuuuaccuguaucauuuuccugcucggcgaaacggugggaggagauaaggaggaggcccagaugaucaacagauuuugcuuccaggugacccggcugcuucuggcucauggcgccgaccccucugaauguccugcccacgagucccucacacacauuugccuuaagagcuuuaaacugcauuucccccugcuccgcuuucugcuggaaucuggggcugcguauaauuguucccuccacggagccagcugcuggucuggcuuccauaucauuuuugagagacuguguucccacccuggcugcaccgaagaugagagccaugcugaccuucugcggaaggccgagacaguccucgaucugaugguuaccaacucccaaaaacugcagcuucccgaaaauuucgacauccacccgguggggucucucgccgagaagauccaggcucugcacuucagccugagacagcucgaauccuacccucccccucugaaacaucuuugucgcguggccauucggcuguaucuccaacccuggcccgucgaugugaagguuaaggcgcugccucugccggacagacuuaaaugguaccuccugagcgagcacucuggauccguggaagaugacaucuga

SEQ ID NO: 66117 - RNA, 825 nt, Artificial Sequence
  derived and/or modified sequence opt5 from ASB7__Homo_sapiens__NP_078984
augcugcaccaucacugcagacggaaccccgagcuccaggaagaacugcaaauccaggccgcuguggccgcgggcgacguccauaccguucgcaagaugcuugaacagggguacagcccuaauggaagagaugcuaacggcuggacacugcuccacuucuccgccgcccgggggaaagagcgcugugugagaguguuucuggaacauggagcugacccgacggucaaggaucuuauuggcggguucaccgcccugcacuaugcugccaugcacggacgggcgcgcaucgccagacucaugcuggagucugaguaccggagcgacauuaucaaugcuaaauccaacgauggcuggacaccccugcauguggccgcucacuauggccgcgacucuuuuguuagacuccugcuugaguucaaggccgagguggauccucugagcgacaaagggaccacaccccuccagcuggcgauuauccgggaacgcuccucuugcgucaagauccuucuggaucauaaugccaacauugacauccaaaauggauuucuccugagauacgcugugauuaagagcaaccacuccuauugucggauguuccugcagcgcggcgccgauaccaaucucgggagacuggaggacggacagacaccucuucaccugagcgcucuccgggaugacguucugugcgccagaaugcuuuacaacuauggcgccgacaccaauacgcgcaacuacgaggggcagacaccccuggcugugucuaucuccauuagcggaucuucccggccuugucucgauuuucugcaagaagucaccagcauguga

SEQ ID NO: 66118 - RNA, 1074 nt, Artificial Sequence
  derived and/or modified sequence opt5 from ASCC1__Homo_sapiens__NP_001185727
auggaggugcugagaccccagcucauccggauugacggccgcaacuacagaaagaauccuguccaagaacagaccuaucagcacgaggaagaugaggaagacuucuaccaggggagcauggagugcgccgaugagccgugugacgcuuaugaaguugagcaaacaccccagggauuucgguccacgcugcgcgccccuucucuucuguacaaacauaucgugggcaagagaggggauacccggaaaaagauugaaauggagacaaaaaccagcaucuccauucccaagccuggacaggacggcgagaucgugaucacagggcagcaccgcaacggagucauuucugcgagaacccggaucgaugugcuccuggacacauuccgcagaaagcaacccuuuacccauuuccuugcuuucuuccugaaugaaguugaggugcaggaaggcuuucuccgguuccaggaggaaguccuggccaaaugcagcauggaucacggcguggacuccucuauuuuucagaacccuaagaaacugcaucucacgaucgggaugcugguucuucugagcgaggaggaaauucaacagaccugugagaugcuccagcaaugcaaggaagaguucaucaaugauauuuccggaggcaaaccgcuggaaguggagauggccgggaucgaguauaugaacgacgaucccggaauggucgacgugcuuuacgcuaaggugcacaugaaggacggcagcaaucgccugcaggaacucgucgauagaguucuggagcgguuucaggccucugggcugaucgugaaagaauggaacuccgugaagcuccacgcuacagucaugaauacccuguuccgcaaagacccuaacgccgagggaagauauaaucuuuacacagcggaaggcaaguacauuuuuaaagagcgggagagcuucgauggcagaaacauccugaagcucuuugaaaauuuuuauuucgggucucugaaacuuaacuccauucauaucagccagcgcuuuaccguggacucuuucggaaauuacgccuccuguggccaaauugauuuuagcuga

SEQ ID NO: 66119 - RNA, 2046 nt, Artificial Sequence
  derived and/or modified sequence opt5 from ASCC2__Homo_sapiens__NP_001229835
augcccgcccugccucucgaccagcugcaaaucacccacaaggauccgaaaacaggcaaacuuagaacgagccccgcucuggugauuuucgacgagacccuccagaagugccuggauuccuaccuucgguaugucccucgcaaguuugacgaagggguugccucugcgcccgaggugguggauaugcagaaaagacugcaucggagcgucuuccucacauuucugcgcauguccacccacaaggaaucuaagauccuggaccucugugugcuguucggaaaaggcaacagcccucuucugcagaagaugauugggaauaucuuuacacaacagcccuccuacuauucugaucucgacgagacccugccuacaauucuucagguuuucagcaacauccugcagcauugcggacuccaaggcgauggggcuaauaccacgccgcagaaacuggaagagagaggacggcugacccccuccgacaugccucuccuggagcuuaaggauaucgugcuguaccucugugacacaugcaccacacugugggccuuucuugauauuuucccccuggccugucagaccuuucagaaacacgacuucugcuaucgccucgcuagcuuuuacgaagccgcuaucccugagauggaaucugccauuaagaagagacggcuggaggacuccaaacugcucggcgaucuguggcaacgccuuagccauucuagaaagaaacugauggagaucuuccacauuauccucaaccagauuugucugcuucccauccuggaauccagcugcgacaauauccagggcuuuauugaggaguuccuccaaaucuucucuucccugcugcaggaaaagcgguuucuccgcgauuaugacgcgcuguucccggucgccgaagauauuagccuucugcagcaggcuuccucugugcucgacgagacgagaacagccuacauccugcaagcuguugagagcgccugggaagggguggaucggcgcaaagcgaccgacgccaaggauccuuccgucauugaggaacccaacggagagccuaauggcgugacagugaccgcugaagccgucagccaggcuucuucccaccccgagaacagcgaggaagaggaauguaugggggccgccgcugcgguuggacccgccaugugcggcguggagcuggacucucuuaucagccaggugaaagaucuccugccugaccugggggaaggauuuauccucgcuugucuggaguacuaucauuacgacccggagcaggucauuaauaacauccuugaagagagacuggcccccacccucucccaacuggaucggaaucuggacagagaaaugaagccugaucccacaccucuucucacgucucgccacaacguguuccagaaugacgaguuugauguuuucagccgggacuccguggaucugagcagaguccauaagggcaaaucuacccgcaaggaggaaaacacacggucccugcucaaugacaaaagagccguggcugcccagcgccagcgguaugagcaauacagcguuguggucgaagaggugccccugcagccgggcgaaucucuuccuuaucacuccgucuacuaugaggaugaguacgacgauaccuacgacgggaaccaggugggagcgaacgaugcugacagcgacgaugaacugauuuccagacgccccuuuacaaucccucagguucuccggaccaaggugcccagagagggccaagaagaggacgaugacgaugaagaggacgaugccgacgaggaagccccuaaacccgaucacuucguccaggacccggcugugcugcgcgagaaggccgaagcucggagaauggccuuucuggcgaagaaaggguaucggcaugauucuagcacggccguugcuggauccccucgcggccacgggcagucuagagagacaacccaagaacggagaaagaaagaggccaauaaggcuacccgcgccaaccauaaucggagaacaauggcggaccgcaaaagaagcaagggaaugauucccuccuga

SEQ ID NO: 66120 - RNA, 2196 nt, Artificial Sequence
  derived and/or modified sequence opt5 from ASCC3__Homo_sapiens__NP_001271200
auggcccugcccagacucaccggcgcucugcggagcuucuccaacgugacaaagcaggacaauuacaacgaggaagucgccgaucuuaaaaucaagcgcucuaaacugcacgagcaaguucucgaccuggggcuuacguggaagaaaauuaucaaguuucugaaugaaaagcucgagaaaagcaagaugcaguccauuaacgaagaucugaaagacauccugcaugcggcuaagcagauugugggaaccgauaauggcagagaggccaucgagucuggggccgcuuuccucuuuaugacauuccaccugaaagacagcgugggacauaaggaaaccaaggccaucaaacagauguuuggcccuuucccguccucuagcgcuacagccgcgugcaacgccaccaaucggauuaucucccacuuuagccaagaugaccuuacagcucugguccagaugaccgagaaggaacauggggaucgcguguucuuuggcaaaaaccucgccuucucuuuugacaugcacgaucuggaccacuucgaugagcuucccauuaauggagagacgcagaagaccaucucccuggacuauaaaaaguuucucaacgaacaucugcaggaggcuuguacaccugaacugaaacccguugagaagaccaauggcagcuuccucuggugcgaaguggagaaguaccugaacucuacacuuaaagagaugaccgaagucccuagaguggaggaccuguguugcacgcucuaugauaugcuggccuccauuaagagcggggacgaacuucaagaugagcuguucgaacuccugggacccgagggccuggagcucaucgaaaaacugcuucagaaucggauuacaaucguugaccgcuuucugaacucuuccaaugaucacagauuccaggcgcuccaggacaacuguaagaaaauccugggggagaacgccaagccuaauuacggaugccaagugaccauucagagcgaacaggagaagcaacuuaugaaacaguaucggcgcgaagagaagagaaucgcucggcgcgagaaaaaggccggcgaagaucuggaggucuccgaagggcucauguguuuugacccgaaagagcugcggauucagagagagcaggcucugcucaacgcccgcucugugcccauccugagcagacaacgggaugccgacguggaaaagauucauuacccucacgucuaugauucccaggcugaggcgaugaagacaagcgccuucaucgcuggagccaaaaugauccuucccgaaggcauucagagagagaauaacaagcuguacgaagagguucgcaucccuuacucugagcccaugccgcucuccuuugaagagaaaccuguguauauucaggaccuggacgaaaucggccaacuggccuucaaggggaugaaacggcuuaaucgcauucagagcaucguguuugagaccgcuuacaacaccaaugaaaacaugcucaucugcgcccccacaggagcgggcaagacgaauauugcuaugcugaccguccugcacgagaucagacagcauuuccagcaaggggugauuaagaaaaacgaguuuaagaucguuuauguggccccuaugaaagcccucgcugccgaaaugacagauuacuucucucggagacuggagccccuuggaauuaucgucaaggaacugaccggcgacaugcagcucagcaaauccgagauucugcgcacacagaugcuggugaccacgcccgaaaagugggauguugugacacggaaaucugucggggacguggcucuuagccagaucgucagacuccugauccuggaugaggugcaccuccugcaugaggaccgcggaccuguucuugaauccauuguggcccggacccugagacaagucgagagcacccagucuaugauccgcauucucggccuguccgcgacacugccgaauuaucuugauguggccaccuuucuccacguuaaccccuacaucggccuguucuuuuucgacgggcgguucagaccugugccccugggacagacauuucucggcauuaagugugcuaauaagaugcaacagcugaacaauauggaugaagucugcuaugagaacgugcuuaaacaggugaaggccgggcaucagguucaccuguucuaccuccugcugcaccuuuuuaucuguuucuga

SEQ ID NO: 66121 - RNA, 711 nt, Artificial Sequence
  derived and/or modified sequence opt5 from ASCL1__Homo_sapiens__NP_004307
auggagagcuccgccaagauggaaucuggcggggcuggacagcaaccccagccucagccgcagcaacccuuccugccucccgccgcgugcuuuuucgcuaccgccgccgcugccgcugccgcggccgcugccgcugccgcgcagagcgcccagcagcaacagcagcagcaacagcagcaacagcaggcuccucagcucagacccgccgcugacggccaaccuuccgggggaggccacaaaucugccccgaaacaggugaagcggcagcgcagcuccucucccgagcugaugagauguaagcggcgccuuaacuuuagcggguucggauacucccugccucagcaacagcccgccgcugucgcgagacggaaugaacgcgagagaaaccggguuaaacucgugaaucugggcuuugccacacuucgcgaacaugugccuaacggcgcugccaauaagaagaugagcaaagucgagacgcugagaucugccguggaguauauccgggcucuccagcagcugcuggaugaacacgacgccguuuccgcggcuuuccaagccggggugcucagccccaccauuucuccgaacuacuccaaugaucugaacagcauggccggaucuccugucuccagcuauuccucugacgagggcagcuacgauccccuuuccccugaggaacaggagcugcucgacuuuacaaauugguucuga

SEQ ID NO: 66122 - RNA, 582 nt, Artificial Sequence
  derived and/or modified sequence opt5 from ASCL2__Homo_sapiens__NP_005161
auggacggcgggacccugcccagaagcgccccuccggcucccccugugcccgucggaugcgccgcgcggcgcagaccugcuucccccgagcuccugcgguguucucgcagacggcgcccugccacagccgaaacgggcgggggagcugccgcuguugccagacggaacgagcgcgaaagaaaucgggugaaacuugugaaccugggcuuccaggcgcuccgccaacacgucccgcaugggggagccagcaagaagcuguccaaaguggagacccuuagaucugcuguugaauacauccgggcccugcagcgccuccuggcugagcacgaugccgugagaaaugcgcuggccggcggccuccggccccaggcugucagaccuagcgcuccccgcgggccucccggaacaaccccgguggccgccuccccuucucgggccagcuccagccccggcagagggggaucuuccgagccuggcagcccccgcucugcuuauuccagcgacgauucugggugcgaaggagcgcugucccccgccgagcgggaacuucuggacuuuagcuccuggcucggcggcuacuga

SEQ ID NO: 66123 - RNA, 522 nt, Artificial Sequence
  derived and/or modified sequence opt5 from ASCL4__Homo_sapiens__NP_982260
augauggagaccagaaagcccgccgaacggcuggcucucccuuacagccugcgcacagccccgcuuggcgugcccgggacgcugccuggacuccccagacgggacccucugcgcgucgcgcuuagacuggaugcugccugcugggagugggcccgguccggcugugcucgcggguggcaguaucuccccguuccucuggacucugccuucgaaccggcuuuucugagaaaacggaacgagcgcgaaagacaacgggugcgcugcgugaaugagggauacgccagacuccgggaucaccuuccccgcgagcuggcggacaagagacugagcaaagucgaaacccuccgggccgcuaucgauuauauuaagcaucugcaggagcuucuggaaagacaggccuggggccucgagggggcugccggagcggugccucagcgccgggccgaguguaacuccgacggcgaaucuaaagcuagcuccgcccccucuccuagcuccgagcccgaagagggcgggagcuga

SEQ ID NO: 66124 - RNA, 615 nt, Artificial Sequence
  derived and/or modified sequence opt5 from ASF1A__Homo_sapiens__NP_054753
auggccaaggugcaggucaacaauguuguggugcuggacaaccccagcccuuucuacaauccguuucaauucgagaucaccuuugaaugcauugaggaucucuccgaagaccuggaguggaaaaucauuuaugucggcucugcugaaagcgaggaguacgaucaggugcuugacuccguucugguggggcccgucccugccggaagacacauguucguguuucaggcggaugcucccaacccuggccucauccccgacgccgaugccguuggggugacagucgugcugauuacguguaccuaucggggacaggaguucauccgcgugggcuacuaugucaauaacgaauacacagaaaccgagcuuagagagaauccuccgguuaagcccgacuuuucuaaacugcaacggaacauccucgcuagcaauccucgcgugacaagauuccauauuaacugggaagauaauaccgagaagcuggaagacgccgaguccucuaaccccaaucugcagagccuccuguccacagaugcccuuccuagcgcuucuaaagggugguccaccagcgaaaacucucugaaugugaugcucgagucccacauggacugcauguga

SEQ ID NO: 66125 - RNA, 609 nt, Artificial Sequence
  derived and/or modified sequence opt5 from ASF1B__Homo_sapiens__NP_060624
auggccaaggugagcguccugaacguugcugugcucgagaaucccuccccuuuccacucuccguuuagauucgaaaucagcuuugagugcuccgaagcccuggcggacgaucuugaguggaaaauuaucuacgugggcucugcugaaagcgaggaguucgaccagauucuggauuccguccucguggggcccguuccugccggacggcauauguuuguguuccaagccgacgcucccaacccuucucugauccccgaaaccgaugccgucggcgugacaguugugcuuauuacguguaccuaucacgggcaggaguuuauccgcgucggauacuaugugaauaacgaauaccugaauccugagcucagagagaacccgcccaugaagccugacuucagccagcugcagcggaauauccuggcuuccaacccccgcgugacaagauuucauauuaauugggauaacaauauggaccggcucgaagccaucgagacccaagauccuagccugggcugcgggcuuccccugaacuguacaccgauuaaaggacucggccugccuggcugcauccccgggcuucugccugaaaauucuauggacuguauuuga

SEQ ID NO: 66126 - RNA, 8895 nt, Artificial Sequence
  derived and/or modified sequence opt5 from ASH1L__Homo_sapiens__XP_006711513
auggaucccagaaacaccgcuaugcugggacucgggagcgauuccgagggauucucucggaaguccccuuccgcuaucucuacaggcacgcuggugagcaagcgcgaagucgagcuugaaaagaacaccaaggaggaagaggaccugagaaagcggaaccgcgagagaaauauugaagccgggaaagaugacggacucacagaugcgcagcaacaguuuuccguuaaggagaccaacuucucugaaggcaaucugaaacuuaagaucgggcugcaggcuaagcggaccaagaagccucccaaaaaccucgagaauuacgugugccgccccgccauuaagaccacaaucaagcaccccagaaaagcccucaagagcggaaaaaugaccgacgagaagaacgaacacuguccuuccaaacgggaucccagcaagcuguauaaaaaggcugacgauguggccgcuauugagugccagucugaagaggucauccgccuccacucccaaggcgaaaauaacccucugagcaagaaacuuucuccggugcauuccgagauggccgacuacaucaaugcgacgcccagcacccugcucggcucuagagauccugaccugaaggaucgggcccuucugaacgggggaacauccguuaccgagaaacucgcucagcugauugccacaugucccccuagcaaguccucuaaaaccaagcccaagaaacugggcacggggacaaccgcuggacucgugagcaaggaccugauccgcaaagccggcgucggguccguggcgggaauuauccacaaggaccuuauuaaaaagcccacaaucagcaccgccguuggccuggugaccaaggauccuggcaaaaagcccgucuuuaaugcugccguggggcucgugaacaaagacucugucaagaaacugggaacaggcacgaccgcuguuuucauuaauaagaaccuugggaagaaaccuggaacaaucaccacagugggccugcucuccaaggauagcgggaaaaagcugggaaucggcauugugcccggccugguccauaaagaaucugggaagaaacucggacugggcaccgugguugggcuugugaacaaggaccugggaaagaaacucggcagcacggucgggcugguggccaaggauugcgccaaaaagaucguugcuuccucugcgaugggccuugugaauaaagacauuggaaagaagcugaugagcuguccccucgccggccugaucuccaaagaugcuauuaaccugaaggccgaggcccuccugccuacacaggaaccgcuuaaagcuagcugcucuaccaauaucaacaaucaggagucccaagaacugagcgagucucucaaggacuccgccaccagcaaaacauuugagaagaacgucgugagacagaauaaggaauccauccuggagaaauucucuguccggaaggaaauuaucaaccuggagaaagaaauguuuaaugaggggaccuguauucagcaggauagcuucuccucuagcgagaagggauccuaugaaacaagcaaacacgagaagcaacccccuguguacugcacgucucccgacuuuaagaugggcggggcguccgauguuagcaccgcuaaaucuccuuucuccgccgugggagaaagcaaccuucccucuccgagcccuacagucuccgugaauccccucacccgcagcccucccgagacaucuucccagcuggccccuaacccccugcuccugagcuccaccacggagcuuaucgaagagauuucugaaagcguuggcaagaaucaguuuaccuccgagucuacacaccugaacguggggcauagaagcgucggccacuccaucucuaucgaauguaaaggaauugacaaggaggugaaugacagcaaaaccacacauaucgauauuccgcggaucuccagcucucucggcaagaaaccuucccugaccagcgagucuuccauucacacgaucacacccagcgugguuaacuucaccucucuguuuuccaacaagcccuuccuuaagcucggggcugucagcgccuccgacaaacacugccaaguggcugaaagccugucuacaagccugcaguccaagccucucaaaaagagaaaaggacgcaagccgcgguggaccaagguggucgccagaucuaccugucgcagccccaaaggccuggagcuugaacgguccgagcuguucaagaaugugucuugcagcucccucucuaacagcaauuccgaaccugcgaaauuuaugaagaacauugggcccccuagcuucguugaucaugacuuucugaaaagacgccugcccaaacuuucuaaguccacagccccuagccucgcucugcuggccgauucugagaaacccucccacaagagcuucgcuacgcauaaacucuccucuagcaugugcguguccagcgaccugcuuucugauaucuauaagccgaaacggggaagaccuaaguccaaggagaugccccagcuggaaggcccucccaaacgcacccucaagaucccggccagcaaagucuuuucucugcagagcaaggaggaacaagagccucccauucugcagccugaaaucgagauucccuccuucaaacaggggcuuucugugagccccuuuccuaagaagcggggcagaccgaaacgccagaugcggucccccguuaagaugaaaccucccgugcucucugucgcgccuuucguggccacagagagccccuccaagcuggaaagcgagucugacaaucacagauccagcuccgacuuuuucgaaucugaggaccaacugcaggauccugacgaucucgacgacagccaucggccguccguuuguucuaugagcgaucuggagauggaacccgacaaaaagaucaccaaacgcaacaauggacagcuuaugaagacaauuaucagaaagaucaacaaaaugaagacccugaaacggaagaaacuccugaaucagauucuguccagcucuguggaguccagcaacaagggcaagguccaaucuaaacuucacaauacgguguccagccuggcugccacauuugggucuaagcucggacagcagaucaacgugagcaaaaagggcaccauuuacaucgggaaaagacgcggacggaagccuaagaccguccugaauggcauucucuccgggucucccacaagccuggcuguucuugaacagaccgcccaacaggccgcuggcuccgcgcugggacagauccucccuccccugcugccgagcuccgccucuagcuccgagauccuuccuucucccauuugcagccaauccucuggcacaagcgggggacagucccccgugagcucugaugcuggcuucguggaaccuuccagcguccccuaucugcaccuccauucuagacagggguccaugauccagacgcuggccaugaaaaaggccagcaaaggacgcagacggcucucuccuccgacccugcuucccaacuccccuagccaccuguccgagcucacaagccugaaggaggcuacccccucuccuauuagcgaaucccauucugacgagacaauccccagcgauuccggcauuggcaccgacaauaacucuacgagcgaucgcgccgaaaaauuuugugggcaaaagaagagacggcacuccuucgagcacgugucucugaucccgccugaaaccagcacaguucuuuccagccugaaagagaagcauaaacacaagugcaaacgcagaaaccaugacuaccucucuuacgauaagaugaaacggcagaagcgcaagcgcaagaagaaauauccccagcugcggaaucgccaggacccugauuucaucgcggagcucgaggaacugauuuccagacuuagcgaaauccggauuacccacagaucucaucacuuuaucccccgcgaccugcugccuacaauuuuccggaucaacuuuaauuccuucuacacccaccccagcuuuccgcucgauccucugcauuauauuagaaagcccgaccuuaaaaagaagcgcggacggcccccuaaaaugagagaggcuauggccgaaaugccguucaugcacucccugucuuuuccccucagcuccacaggcuucuacccuagcuaugggaugcccuacucuccuagcccccugaccgccgcuccuaucggacucggcuauuacgggcgcuacccgcccacgcuguauccucccccucccagcccgucuuuuacaaccccucuuccgcccccuagcuacaugcaugccggacaucugcugcucaaccccgcgaaguaucauaaaaagaaacacaagcugcuucggcaagaggcuuuccugaccacauccagaaccccucuccugucuaugagcacguacccguccgugcccccugagauggccuauggcuggauggucgaacacaagcaucgccaccggcauaaacacagagagcaccggucuagcgaacagccccagguguccauggacacaggcagcucucgcuccguucucgagagccugaagagauaccgguuugggaaagaugccgugggagagcgcuauaagcauaaagaaaagcacagaugucauauguccugcccucaccuuucucccagcaagucccugaucaaucgggaggaacaguggguccauagagagccgucugaaagcuccccucuggcucucggccugcaaacaccccuucagauugacuguagcgagucuuccccuagccugucucucgggggauucacacccaacuccgagccugccagcucugaugaacacaccaaucuguuuacauccgcuaucggcagcugccgcgugucuaaccccaauagcuccgggcggaaaaagcucaccgacagcccgggacuguucuccgcccaggauacgucucuuaacagacugcaccgcaaagagagccugccuuccaaugaacgggcgguucaaacccucgccggcucucagcccacaagcgacaagcccucccagagaccuucugagagcaccaacuguuccccgacacgcaaacgguccucuagcgaaagcaccucuuccacggugaauggcguccccagcagaucuccucgccugguggcuuccggggaugacagcguggauucucuucugcagagaaugguccaaaacgaggaccaggagcccauggaaaaguccauugaugccguuaucgcuacagccagcgccccucccagcuccucuccuggacggagccauuccaaagaccgcacccucggcaagcccgacucucugcuggugccggcugugacaagcgauuccugcaauaacucuauuagccuccuuuccgagaagcugaccagcucuuguuccccucaccauaucaaaagaagcgucguggaagcgaugcagcggcaggcccgcaagaugugcaacuacgacaaaauccuggcuaccaagaaaaaucucgaucacguuaacaagauucugaaggccaagaaacuucaaagacaggcccggacagggaauaacuucgugaaaagacgccccggacggccuagaaaaugcccccugcaggcugucgugucuaugcaggccuuucaagcggcucaguucguuaauccggagcucaaccgcgacgaagagggcgccgcccugcaccuguccccugauacggugaccgacgucaucgaggcugugguccagagcgugaaucucaaccccgaacauaaaaaggggcuuaagcggaaaggauggcugcuggaggaacagacaagaaagaaacaaaagccccucccugaggaggaggaacaggaaaauaacaaauccuuuaaugaggcccccguugaaauuccuucuccgagcgagacccccgcgaagccuuccgagcccgaaucuacacugcagccugugcuuagccugaucccccgggagaagaaaccuccgagacccccuaagaaaaaguaccaaaaagcuggccucuauuccgaugucuacaagaccacggaccccaagagcagacugauucagcugaaaaaggaaaaacucgaguauacaccuggcgaacacgaguacgggcuuuuccccgccccgauccaugugggaaaguaucugcggcagaaacgcaucgauuuucagcugccuuacgacauucucuggcaauggaagcacaaccagcuguauaaaaagcccgauguuccccuuuacaagaaaaucagaucuaauguguacgucgacgugaagccucuguccggcuaugaggccaccaccuguaacugcaaaaagcccgaugacgacacacggaaaggguguguggaugacugccucaaucgcaugauuuucgcugaauguagcccuaauaccugcccguguggagagcagugcuguaaucagagaauccaacggcaugaauggguucagugccuggagcgcuuuagagccgaagagaagggcugggggauucggacaaaggagccccugaaagcuggacaguucaucauugaauaccucggcgaggucgugucugaacaggaguuuagaaaccgcaugaucgagcaauaucacaaccacagcgaucauuacugucuuaaucuggacuccggcauggugaucgauucuuaucggauggggaacgaagccagauucauuaaucacagcugcgacccuaacugcgagaugcagaagugguccgucaauggaguguaccgcaucggccuguaugcgcucaaagauaugcccgccgggacggaacugaccuacgacuacaacuuucauagcuucaauguugagaagcagcaacuuuguaaaugcggauucgaaaagugucggggcauuaucgggggaaagucucagagagugaacggccugacauccagcaaaaauucccagccuauggcuacccacaagaaaucuggccgcagcaaggagaaacggaaguccaagcacaaacucaagaaaagacgcgggcaucugucugaggaacccagcgagaacauuaauacaccgacccggcugacgccucagcuccaaaugaagcccauguccaacagagaacgcaauuuuguccuuaaacaccauguguuccugguucggaacugggagaagaucagacagaaacaggaagaggugaagcacaccucugauaauauccauagcgccucccuguauacacgcuggaacggaauuugcagagacgauggcaacaucaagagcgacgucuuuaugacccaguucucugcucuccaaacagcccgguccgugcgcaccagacggcuggccgcugcggaggaaaauauugagguugccagagcugcccggcuugcccagaucuuuaaagaaauuugugaugggaucaucagcuacaaggacucuucccgccaggcucuggccgcgccucuccugaaccugcccccgaaaaagaaaaaugcugacuauuacgagaagauuagcgauccucucgaccuuaucacaauugaaaagcagauccugacgggauauuacaaaaccguggaggccuucgaugccgacaugcugaaggucuuuagaaacgcugagaaauauuacggccggaagucucccguggggcgcgaugugugcagacuccggaaagccuacuauaaugcgcgccacgaagccagcgcucaaauugacgagaucgucggagaaacagccuccgaggcugauagcuccgagaccucuguuagcgaaaaggagaacggccacgaaaaggacgaugacgugauuagauguaucugcggccuguacaaagaugaggggcuuaugauccagugugacaagugcaugguguggcagcauugugacugcaugggagucaauuccgauguggaacacuaucugugcgagcagugugacccccggccuguugaucgcgaggugcccaugauuccuagaccgcauuacgcccaacccggcugcgucuauuucaucugucuccugcgggacgaucugcuccuucgccagggggacugcguguaccugaugagagauucucggcgcaccccugacggacaccccguuagacagagcuaucggcugcucucccauauuaacagagauaaacuggacaucuuucgcauugaaaaacuuuggaaaaaugagaaggaggaacgguucgcuuuuggccaccacuacuucagaccucaugaaacacaccauucucccagccgccgguuuuaccacaacgagcuguucagagugccucucuaugagaucaucccgcuggaagccgucguggggacguguugcguccuggaucucuacaccuauuguaagggccgccccaaaggagugaaggagcaagacguuuacauuugcgauuaucggcuugacaaauccgcgcaccuguucuacaagauccauagaaaucgcuauccuguguguacaaaacccuacgccuuugaccacuucccuaagaaacugacccccaagaaggauuuuagcccgcauuacgugccugacaacuauaaacggaauggcgggagaucuuccuggaaaagcgaacgcucuaaaccgccccugaaggaucugggacaggaggacgaugcccuuccucugauugaagagguccucgccucccaggagcaggcugccaacgaaauccccagccuggaggaaccugagcgggagggcgccacagcuaauguuucugaaggggagaaaaagaccgaagaguccagccaagaaccgcagucuacgugcacacccgaggagagacggcacaaccagagagaacgccugaaccagauucuccuuaaucugcuggagaagaucccuggcaagaacgcgaucgacgugaccuaccuccuggaagagggcuccgggcggaaacuuagacgcagaacccuguucauucccgaaaauagcuuucggaaauga

SEQ ID NO: 66127 - RNA, 1605 nt, Artificial Sequence
  derived and/or modified sequence opt5 from ASH2L__Homo_sapiens__NP_001098684
auggacacccaggccggcagcguggaugaggaaaacgggagacaacugggagaggucgaacuccagugcggcaucuguacaaagugguucacggcugacaccuuugggauugauacauccucuugccugcccuucaugaccaauuacagcuuucacuguaacguuugccaucacuccggaaauacauauuuccuucggaaacaggccaaccugaaggagaugugucucucugcgcuggcuaaucuuaccuggcagagccgcacacaagacgaacauccuaaaaccauguuuuccaaggauaaagacaucauuccguucaucgauaaguacugggagugcaugacgaccagacagcggcccggcaagaugacauggccuaacaauauugugaaaaccaugucuaaggagcgcgacguguuucuggucaaagaacaccccgauccugggagcaaggaccccgaggaagauuauccuaaauucggacuccuggaccaggaucuguccaacaucggcccggccuacgacaaucagaagcaaagcucugccguguccacaagcggcaaccucaaugggggaaucgcugccggcuccuccgggaagggaagaggcgcuaaacggaagcagcaggacgggggaaccacgggcacaaccaaaaaggcccgcagcgauccccuguuuucugcgcagagacuuccuccccauggcuauccucuggagcaccccuucaacaaagacggguaccgguauauucucgccgagccggauccucacgcucccgacccugaaaagcuggagcuugauuguugggccggaaaacccauccccggcgaccuguaccgcgcuugccucuacgaaagaguucugcuggcccuccaugaucgggcgccucaacugaagauuuccgacgaucgccuuacaguggucggggagaagggauauagcauggugagagccucccacggcguucggaaaggggcuugguacuuugaaaucaccguggacgagaugccgcccgauaccgccgcucgccugggauggucucagccucucggcaaucugcaggcuccccuuggcuaugacaaguucagcuacuccuggagaagcaaaaaggggacaaaauuucaucaaucuauuggaaagcacuauuccagcggcuacgggcagggagacguccugggcuucuauaucaaccucccugaggauacggaaaccgccaagucucugcccgacacauacaaagauaaggcccugauuaaauucaagagcuaccucuauuuugaggaaaaagacuucguggauaaggcggagaagucccugaaacagaccccgcacucugaaaucaucuuuuacaagaauggggugaaccagggcgucgccuauaaagacauuuucgagggaguuuacuuuccugcuaucagccuuuauaaguccuguacagugagcauuaacuucggccccugcuuuaaauacccucccaaggaucugaccuaucggccuaugucugacaugggguggggagccguggucgagcauacgcucgccgaugugcuguaccacguugaaacagagguggacggcagacgcucucccccgugggaaccuuga

SEQ ID NO: 66128 - RNA, 1587 nt, Artificial Sequence
  derived and/or modified sequence opt5 from ASIC1__Homo_sapiens__NP_001086
auggagcugaaggccgaagaggaagaggugggcgggguccagcccguuagcauccaggcuuucgccuccucuagcacccuccacggacuggcgcauauuuucuccuacgaaagacuuucucugaaacgggcucucugggcccugugcuuccuuggcagccuggccgugcuccugugugugugcacagagcgcguccaauauuacuuucacuaucaucacgugacgaagcuggacgagguugcugccucccagcucaccuucccugcugugacacuguguaaccuuaaugaauuuagauucucucaggucagcaaaaacgaucuguaccaugccggggagcuccuggcgcuucugaauaaccgguaugaaaucccggacacccaaauggccgaugagaagcagcucgagauucugcaggacaaagcuaauuuucgcuccuucaagcccaagccuuuuaacaugagagaauuuuacgaucgggccggacacgacauccgcgauaugcugcucagcugccacuuuagaggcgagguguguucugcugaagacuucaaaguuguguuuacacgguaugggaagugcuacaccuucaauuccggacgcgauggcagaccccggcugaaaacaaugaagggcgggaccggaaacggccuugagauuaugcuggacauccagcaagaugaauaccucccugucuggggcgagacggacgagaccagcuucgaagccggaaucaaagugcagauucauucucaggaugagcccccuuuuaucgaccagcugggcuucgggguggcgccgggauuucaaacauucgucgccugucaggaacagcgccuuauuuaucugcccccucccugggggaccugcaaggcuguuacaauggacuccgaucucgacuuuuucgauagcuacucuaucaccgccuguagaauugacugcgagacgcgguaucugguggaaaauuguaacugccgcauggugcacaugccuggcgaugcucccuacugcacaccggagcaauauaaggagugugccgacccugcccuggauuuucucgucgaaaaagaccaggaguacugcgugugugaaaugcccugcaaucugaccagauaugggaaggagcuuuccaugguuaaaaucccuagcaaggcuuccgcgaaauaccuggccaagaaauucaacaagucugaacaguacauuggagagaauauccucgugcuggauaucuuuuucgagguccuuaacuaugaaacaauugagcagaagaaggcuuacgaaaucgccggccugcucggggacauuggaggccaaauggggcuguuuaucggagccagcauucugaccgugcucgagcuguucgauuaugcuuacgagguuaucaaacauaaacuuugucggagaggcaagugccagaaagaagccaagcgcuccagcgcggacaagggcguggcucugucucucgacgaugucaaacggcacaaucccugugagucccugagagggcaccccgccggaaugaccuaugccgcuaacauccugccucaucacccggcccgcggcacauuugaagacuucacgugcuga

SEQ ID NO: 66129 - RNA, 1539 nt, Artificial Sequence
  derived and/or modified sequence opt5 from ASIC2__Homo_sapiens__NP_001085
auggaccugaaggagagccccuccgaaggcucucuccagccuagcuccauccaaauuuucgccaacaccucuacacugcacgggaucagacauauuuuuguguacggaccgcuuacgauccggcgcguccugugggcuguugccuucgugggcagccucgggcugcuucugguggaguccucugaaagagucagcuauuacuuuuccuaucagcacgugaccaaaguugaugagguggucgcgcagagccucguguuccccgcuguuacacugugcaaucugaacggauuucgguucucucgccucaccacaaaugaccuguaccaugccggcgaacuucuggcccuccuggaugugaaccuucagauuccugacccccaccuggcugauccuuccguccucgaggcccugagacaaaaggcuaauuuuaaacauuauaagcccaaacaguucagcaugcuggaguuucuccaccggguggggcacgaccugaaggauaugaugcuuuacuguaaguucaaaggacaggaaugcggccaucaggacuuuaccacaguguucaccaaguauggcaaauguuacauguuuaacucuggggaggauggaaagccucugcucacgaccgucaaaggcgggacaggaaauggccuggaaaucaugcuugacauccaacaggaugaguaccugccgauuuggggagagaccgaagagacaaccuucgaagccgggguuaaggugcagauccacucccagagcgagcccccuuucauucaagaacucggcuuuggcguggcgcccggguuccagacguuugucgccacacaggagcaacgccugaccuaucugccucccccguggggagagugcagaucuuccgaaaugggccucgacuucuuuccuguguacagcaucacagcuugucggauugauugcgagacccgcuauaucguugaaaacuguaauugcagaauggugcauaugcccggggacgccccuuucuguacccccgagcagcacaaggaaugcgcugagcccgcccugggacuucuggcggagaaagacuccaacuacugucucugccggacaccuugcaaucugacgcgcuauaacaaggaacuuucuauggucaaaauuccgagcaagaccuccgccaaauaccuggagaagaaauuuaauaagagcgaaaaguauaucucugagaacauccucgugcuggauauuuucuuugaagcucugaauuacgagacaaucgagcagaaaaaggccuacgaaguugcugcccuccugggcgacauugggggacagaugggccuuuucaucggcgccuccauucugaccauccucgagcuguuugauuauaucuacgaacugauuaaagagaaacuucucgaccugcuggggaaggaggaagaugagggaagccacgacgaaaacgugucuacaugugauaccaugcccaaccauagcgagacgaucucccacacagucaaugugccucuccaaaccacccugggcacacuugaagagauugcuugcuga

SEQ ID NO: 66130 - RNA, 1596 nt, Artificial Sequence
  derived and/or modified sequence opt5 from ASIC3__Homo_sapiens__NP_004760
augaagcccaccagcggcccugaggaagccagacggccggcuuccgacauccgcguguucgccucuaacugcagcaugcacgggcugggacaugucuuuggccccgggucccucucucugagacggggaaugugggcggcugccguugugcuuagcguggccacauuccuguaccaggucgcugagcgcgugagauauuaccgggaauuucaccaucaaacggcccucgaugagcgcgaaucccacagacugauuuucccugcuguuacccuuuguaauaucaacccccugcggcgcucuagacucacaccuaaugaccugcauugggccggcagcgcgcugcucgggcuggaucccgccgagcacgcugccuuucuucgggcucugggacgcccuccggcgcccccuggcuucaugcccuccccuaccuuugacauggcccagcucuaugccagagcuggccacagccuggaugacaugcuucuggauugccgguuccgcgggcagcccuguggaccggagaacuuuacaaccauuuucacaagaaugggcaaaugcuacaccuuuaauucuggggccgacggagcugaacuccugacgaccacacggggcgggaugggaaacggccuggauaucaugcucgacgugcagcaagaggaauaucugccugucuggagagauaaugaggagacccccuucgaagugggcauucgcguucagauccauucccaggaggaaccucccaucauugaccagcuugggcugggagugagccccggcuaccaaacauuugucucuugucagcagcagcaacucuccuuccugccuccgcccuggggagauugcagcucugccucccuuaacccuaauuaugagcccgaaccuagcgacccccugggguccccgucuccuagccccuccccucccuacacccucaugggcugucggcuggccugcgagacgagauacguggcucgcaagugugggugccggaugguguauaugccuggagacguccccguuuguagcccgcagcaguacaaaaacugcgcgcacccugccaucgaugcuaugcugagaaaggacucuugcgccugucccaaucccugcgccuccacacgcuaugcuaaagagcucagcauggugcggauuccuucuagagccgcggcucgcuuccuggcccggaaacuuaacagaagcgaagccuacaucgcugagaaugugcuggcccucgauaucuuuuucgaagcucugaacuaugagaccgucgaacaaaagaaggccuacgagauguccgagcuucugggcgacauuggcgggcagaugggacucuuuauuggcgcgucucugcugacaauccucgaaauccuggauuaucuuugugagguguuccgcgacaagguucugggguacuuuuggaaucggcagcauagccagagacacuccagcaccaaccuccugcaagaaggacugggcucucaccggacccaggugccgcaucuuucccucgggccccgcccucccacaccucccugcgccgucacgaaaacccugagcgcuucucacagaacauguuaccuggugacccagcucuga

SEQ ID NO: 66131 - RNA, 1944 nt, Artificial Sequence
  derived and/or modified sequence opt5 from ASIC4__Homo_sapiens__NP_878267
augcugagcggcgccgcuggggccgcgagacggggaggcgcugcccucgcccccucccugacccgcucucuugcugggacacacgccggagcugacagcugcgccggcgcggauaaggggucccauaaagagacgaucgaagagagagacaagcggcagcaacgccagcagagacagcggcaacaccagggauguggcgccgcuggcucugggagcgauuccccuaccucuggaccgcaucccgugccuguccuguucccccucgcccugagccuugaagaacagccucugcccccucucccgcugggccgcgcucccgggcugcucgccagagaaggacagggccgggaggcgcuggccuccccuagcucucgcgggcaaaugcccauugagaucguuugcaaaauuaaguuugcugaagaggacgccaaaccuaaggaaaaggaggcuggagaugagcagucccuucugggcgccguggcccccggcgcugcgccgagagaccucgccacauucgcuagcaccucuacacugcacgggcuuggacgggccuguggcccugggccccauggacugcgcagaacccucugggcccuggcucugcucacaucccuggccgcguuucuuuaccaggcugccggccuggcccggggguaucucacccgcccucaccugguggcuauggaucccgccgcucccgccccugucgcgggauucccggccgugacgcuuugcaacaucaauagauuucggcacagcgcucugucugacgccgauauuuuccaucucgcuaaccugaccggccugcccccuaaagacagagauggccaccgcgccgcggggcuccgguaccccgaaccugacaugguugauauccugaauagaacaggacaucagcuugccgacaugcugaaguccuguaacuuuagcggccaccacugcuccgcuucuaauuucagcguggucuauacccgcuacgggaaauguuauacauuuaacgccgacccccgguccagccucccgucuagagcuggaggcaugggguccggccuggagaucaugcuugauauucaacaggaagaguaccugccuaucuggcgcgaaaccaaugagacgagcuucgaggccgggauucgggugcagauccauucucaagaggagcccccuuauauucaccagcucggcuuugggguuagccccggauuccagacauuuguguccugccaggaacaaagacugaccuaccugccucagcccuggggcaacugucgcgccgagucugaacuccgggagccggagcugcagggguacagcgcuuauuccgucagcgcgugcagacuucgcugugaaaaggaggccgugcugcagcggugccauugcagaauggugcacaugccugacucucucggaggcgggcccgaaggccccuguuucugcccuacaccguguaaucugacccgguacggaaaagagaucuccaugguccgcauucccaacagaggcagcgcucgguaucuggccagaaaguacaaucgcaacgaaaccuauauccgggagaauuuccuuguucucgauguguuuuucgaggcccugacaucugaagcuauggagcaaagagccgcguacgggcuguccgcucuccugggagaccuuggcgggcagaugggacuguuuaucggcgccagcauucucacgcugcuggaaauccuugauuauauuuacgagguguccugggaccgccucaagagagucuggcggcgcccuaaaacaccccugagaaccucuaccgggggcaucagcacacugggacuccaggagcugaaggaacaguccccuugccccucucggggccgcguggagggaggaggcguuagcucccuucugccuaaccaucaccacccccaugggccgccuggaggccucuucgaagauuuugccuguuga

SEQ ID NO: 66132 - RNA, 1518 nt, Artificial Sequence
  derived and/or modified sequence opt5 from ASIC5__Homo_sapiens__NP_059115
auggagcagaccgaaaagagcaaaguguacgccgagaacggccugcucgaaaagaucaaacugugccuuuccaagaaaccccugcccucuccgacagagagaaagaaguucgaccacgauuuugcuauuagcacguccuuccaugggauccacaauauuguccaaaaccggucuaaaauccgcagaguucucuggcugguggugguccuuggaagcgugucccugguuaccuggcagauuuauauccggcuccugaauuacuuuacauggcccaccacaaccucuaucgaagugcaguaugucgagaagauggaguucccugccgugacauuuuguaaccugaaucgcuuccagaccgacgcgguugcuaaauuuggcgugauuuucuuucucuggcauaucgucagcaaggugcugcaccuucaagaaauuacggccaacuccaccgggagcagagaggccacagauuucgcugccucucaucagaauuuuuccaucguggaauuuauucggaacaaaggauuuuaccugaauaacagcacccuccuggacugcgaguucuucggcaagcccuguucuccuaaggauuuugcucacgucuucacagaguaugggaauugcuuuaccuucaaccacggagaaacgcuucaggccaaacgcaagguuuccgugagcggcagaggccugucucuccuguuuaaugugaaccaggaggcguucacagacaaucccgcccugggguuugucgaugcuggaaucauuuucgugauccauuccccuaaaaagguuccgcaauuugacggccucgggcugcuuagccccgugggaaugcacgcccgggucaccauccgccaggugaaaacaguucaucaggaauacccuuggggcgaguguaaccccaacauuaagcugcagaauuucuccucuuauagcaccuccgggugccucaaagaauguaaggcucaacacaucaagaaacagugcggaugugugccuuuucugcuucccggcuacggcauugagugcgaucugcagaaguacuucagcugugucucuccggugcucgaccacaucgaguuuaaagaucugugcaccgucgggacacauaacuccagcugcccugugucuugugaagagauugaauaucccgccacgaucagcuacuccucuuucccuagccaaaaggcgcugaaauaucucuccaagaagcugaaucagagcagaaaauacauccgggagaaccuuguuaagauugaaaucaauuauucugaccugaacuacaaaauuacccagcagcaaaaggccguguccgucagcgagcuccuggcugaucuuggaggccagcugggacucuucugcggggccucucugaucacaauuaucgagaucauugaauaucuguuuaccaauuucuacuggaucuguauuuucuuccuccugaaaaucuccgagaugacacaguggaccccuccuccccagaaccaccuuggcaauaagaaccgcauugaagagugcuga

SEQ ID NO: 66133 - RNA, 411 nt, Artificial Sequence
  derived and/or modified sequence opt5 from ASIP__Homo_sapiens__XP_005260469
augcccccuggcauggacgugaccagacugcuccuggccacacuucuggucuuccucugcuuuuucacggcuaacagccaccuuccgcccgaggaaaagcugcgggaugaccgcucccugagaucuaauagcuccguuaaccuccuggaugugccuucugugagcaucgucgcccugaauaaaaaguccaaacagauugggcggaaggcggcugagaaaaagcgcucuagcaagaaagaagccuccaugaagaaagugguuagaccccggaccccucucagcgcccccuguguggcuacacgcaacucuugcaagccuccggcccccgcuuguugcgacccuugugccuccugccaauguagauuuuuccggagcgcgugcucuugucgcguccugucccuuaauugcuga

SEQ ID NO: 66134 - RNA, 1395 nt, Artificial Sequence
  derived and/or modified sequence opt5 from ASL__Homo_sapiens__NP_000039
auggccagcgaguccggcaagcuguggggagggagauucgugggcgcugucgaccccaucauggaaaaauuuaacgccucuauugcguacgaucggcaccucugggagguugacgugcaggggagcaaggcuuauucccgcggacuggaaaaagccggccuucugaccaaggccgagauggaucaaauccuccaugggcuggacaaaguggcugaagagugggcccagggaacauucaaacuuaauucuaacgaugaggacauucacacggcuaaugaaagacggcugaaggagcucaucggcgccaccgcgggcaagcugcauacagggcgcagcagaaacgaucaggucgugaccgaccugcggcucuggaugcgccagacaugcuccacccugucuggacuucugugggaacucauuagaacaaugguugaucgggccgaggcugagcgcgacgugcuguuuccuggcuacacccaccuucaaagagcccagccgauccgguggagccauuggauccugucccacgcugucgcccucacgcgcgauagcgaaagacugcuggaggugcggaagcgcauuaauguucucccccuggggucuggagcgaucgccggcaacccucuugggguggacagagaacugcuccgggcugagcugaauuucggagccauuacccuuaacuccauggaugcuacaagcgaaagagacuuugucgccgaguuccuguuuugggccucucucuguaugacccaccugucccgcauggcugaggaccugauccucuauugcacaaaagaguucagcuuugugcagcugucugaugcguacuccaccggcagcucccuuaugccccagaagaaaaauccugacucucuggaacucauucggagcaaggccggcagaguguucgggcgcugugcuggacugcuuaugacgcugaagggccuccccuccacauauaacaaagaucugcaagaagacaaggaggccgucuuugaaguuagcgauaccaugucugccgugcuccagguggcuacaggggucaucuccacccugcagauucaucaggagaauaugggacaagcccugagcccugacaugcuugcgaccgaucuggcuuacuaucucgugcggaaaggcaugccguucagacaggcccacgaggccucugggaaggcuguuuuuauggccgaaacaaaaggaguggcucugaaccagcugagccuucaagagcuccagacgaucucuccccuguucuccggcgacgucaucugcgugugggauuacggccauagcguugaacaguacggggcccugggaggcaccgcgcgcuccagcguggacuggcagauucggcaagucagagcccuccugcaggcucagcaggccuga

SEQ ID NO: 66135 - RNA, 897 nt, Artificial Sequence
  derived and/or modified sequence opt5 from ASMT__Homo_sapiens__NP_001164510
augggcagcuccgaggaccaggccuacagacugcucaacgauuaugcuaauggguucauggugucucaaguccuguuugccgcgugcgaacuuggaguuuucgaccugcucgcugaggcccccggcccucuggauguggccgcuguggccgcugggguccgggccagcgcgcacggaaccgaacuucugcucgacaucugugugucccugaagcugcucaaaguugagacacgcggcgggaaggccuuuuacagaaacacggaacugucuagcgauuaucuuaccacaguguccccgaccucucagugcagcaugcugaaauacaugggacggacauccuaucgcuguuggggccaucucgcugacgccgucagagagggccggaaucaguaccuggagaccuucggggugcccgcugaggaacuuuuuacagccauuuaucgcagcgaaggagagagacugcaguucaugcaagcgcuccaggagguuuggucugugaacggccgguccguccugaccgccuuugaucugagcguguucccucucaugugcgaccuugggggagacuuuuucaaggauccccugccugaagcugaucuguacauccucgcccgcgugcugcacgacugggcugauggcaaauguucucaucuucuggagagaauuuaccacacgugcaagcccgggggaggcauccucgucauugaaucccugcuggacgaggaccggcgcggcccucuccugacccagcuuuauagccugaauaugcucguucagacagaagggcaagagagaaccccgacacauuaccacaugcugcuuucuuccgccggauuucgggauuuccaguuuaagaaaaccggcgccaucuaugacgcuauccuggcgcgcaaguga

SEQ ID NO: 66136 - RNA, 1818 nt, Artificial Sequence
  derived and/or modified sequence opt5 from ASMTL__Homo_sapiens__NP_001166945
auggugcugugccccgucaucggcaagcuccugcacaaaagaguugugcuugccagcgcuuccccucggcgccaggagauucugucuaacgccgggcucagauucgaaguggucccgagcaaguuuaaagagaagcuggacaaagcguccuucgcuacccccuacggauaugccauggaaacagccaagcaaaaggcucuugagguggccaaucggcuguaccagacgguuggcgggcucauccuggaaaaaccuguggauaagcaggacgcuuaucgcaugcugucuagacucagcggacgggagcauuccgucuuuaccggcguggccauuguucacuguucuagcaaagaucaucagcuggacacacgcguguccgaguucuacgaagagaccaaggucaaauuuagcgaacuuucugaggagcugcucugggaauaugugcacuccggggagcccauggauaaggcgggaggcuacggcauccaagcccuugggggaaugcuuguggaaagcguccauggcgacuuccugaacguugugggguuuccucucaaucacuucugcaagcagcuggugaaacuguauuaucccccuagaccggaggaucuccggcgcucugucaagcacgacuccauucccgcugccgauacauuugaagaccugagcgauguggagggaggcgggucugagccuacccagagagacgcuggaucccgggaugaaaaagccgaggcgggcgaagccggccaggcuacagccgaggcugaaugucaucgcaccagagagacgcuucccccuuuccccacccggcugcucgagcugaucgaaggguuuaugcuuagcaagggacugcucacagccugcaaacugaagguuuucgaccugcucaaagacgaggccccgcaaaaggcugcggauaucgccuccaagguggacgcuucugccuguggcauggaacgccugcuugauauuugcgccgcuauggggcugcucgagaaaaccgaacagggauacagcaacacagagaccgccaaugucuaccuggcguccgacggcgaguacagccuucacggguuuaucaugcauaacaaugaucugacguggaaccucuucacauaucuggaguucgcuauuagagaaggaaccaaucagcaccaccgggcccugggcaagaaagccgaagaccucuuucaggaugcuuacuaucaaucuccugagacaagacugcgcuucaugcgggccaugcauggcaugaccaagcugaccgcuugucagguggccacagcguuuaaccuguccagauucagcucugccugcgacguugggggauguacgggcgcucucgcccgcgagcuggcucgggaauaccccagaaugcaagugaccgucuuugaucugccugacaucauugagcuugccgcgcacuuccagccucccgggccccaggccgugcagauccauuuugcugccggagauuucuuucgcgacccgcuccccagcgcugaacuguauguccugugccggauucuccacgacuggccugaugacaaagugcauaagcugcuuuccagaguugccgagucuuguaagcccggcgccgggcugcuccugguggaaacacugcuugaugaggagaaacgcgucgcucagcgggcgcucaugcaaagccugaauaugcuggugcagaccgaaggcaaggagagaucccucggagaauaccagugccugcuugagcugcacggcuuccaccagguucaagugguccaucucgggggagugcuggacgccauccuggcuacaaaaguggccccuuga

SEQ ID NO: 66137 - RNA, 1047 nt, Artificial Sequence
  derived and/or modified sequence opt5 from ASNA1__Homo_sapiens__NP_004308
auggccgcuggcguggccggguggggagucgaggcggaagaguucgaagacgcucccgauguugagccccuggaaccgacccucagcaacaucauugagcagagaucccugaaguggaucuuugugggcgggaaaggaggcguggggaagacaacgugcucuuguagccuugccguccaacuguccaaaggacgggagucugugcucauuaucagcaccgaccccgcccacaauauuuccgaugcuuucgaccagaaguuuucuaaaguuccuacaaaggugaagggcuacgauaaccuguucgccauggaaaucgaccccagccuuggcgucgcugagcugccugaugaauuuuucgaggaggacaauaugcucuccauggggaaaaagaugaugcaggaagccaugagcgcguuucccggaaucgaugaggccaugucuuaugcugaagugaugcgccugguuaaaggcaugaacuucuccguggucguguuugacaccgccccuacagggcauacccugagacuccugaauuucccgacaauuguggagcggggacuuggccgccugaugcagaucaagaaccaaauuagccccuuuaucucucagaugugcaauaugcucgggcugggagauaugaacgcugaccagcuugccuccaaacuggaagagacccucccugucauuagaagcguuucugagcaguucaaggaucccgaacaaacgaccuuuaucugugugugcauugcggaguuccugucccuguacgaaacagagcggcucauccaggaacuggccaaguguaaaaucgacacccacaauauuaucgugaaccagcuugucuucccugaccccgagaagccgugcaaaaugugugaggcucgccauaagauucaggccaaauaucuggaucaaauggaagaccucuacgaggauuuucacaucgugaagcugccucuucugccccaugaaguuagaggcgcugacaaagugaauacauucagcgcccuccugcuggagccuuauaagccucccuccgcccaguga

SEQ ID NO: 66138 - RNA, 1623 nt, Artificial Sequence
  derived and/or modified sequence opt5 from ASNS__Homo_sapiens__NP_001171546
augaagaucgcccacagaggccccgacgcuuuccgguuugagaacgugaauggguacaccaacugcuguuucggauuucaucgccuggccgucguugauccucucuucggcaugcagccgauuagagugaaaaaguaucccuaccuguggcuuugcuauaauggggaaaucuacaaccacaaaaagaugcaacagcauuuugaguucgaauaucagacaaaaguggacggagagauuauccugcaccucuacgauaagggcgggauugaacagacgaucuguaugcuggacggagucuuugcguucgugcuucuggauaccgcuaauaagaaaguuuuucucggccgggacacauauggcgugcgcccucuguucaaggccaugaccgaggauggguuucuggccgucugcagcgaggcuaaaggacucgugacacugaagcauuccgccacccccuuccuuaaaguugaaccuuuucugcccggccacuacgaggugcucgaccugaagccuaacgggaaggucgcuucuguggaaauggugaaauaccaccauuguagagaugucccgcuucacgcccuguaugacaauguugagaagcucuuucccggauucgagaucgaaacagugaaaaacaaucugcggauucuguuuaacaaugcggugaagaaacgccucaugaccgauagacggaucggcugccugcuuagcgggggacuggacuccucucucgucgccgcuacgcugcuuaagcaacugaaagaggcccaggugcaguacccucuccagaccuucgcuauuggcauggaagauagccccgaccugcuggccgcgcgcaagguugccgaccauaucggcuccgagcacuaugaagugcucuuuaacucugaggaggggauucaagcucuggaugaagucaucuucagccuugagacauacgacauuaccacagugagagccuccguuggaauguaucugaucagcaaguacauccggaaaaauaccgauucuguggucauuuucuccggcgaagggagcgacgagcucacgcagggauauaucuacuuccacaaggcuccuucucccgaaaaagccgaggaggaauccgagcgccugcuuagagaacuguaccucuuugaugugcugcgggccgaccgcacaaccgcugcgcauggccuggagcucagagucccguuccuggaucaccgguuuagcucuuauuaccuuucccugccucccgaaaugcgcauuccuaagaacgggaucgagaaacaucuccugagagagacauucgaagacagcaaucugauucccaaggagauccuuuggcggcccaaggaagccuuuuccgauggaaucaccucugugaaaaacagcugguucaagauucuccaggaguauguugagcaccagguggacgaugcuaugauggccaacgccgcucaaaaauuuccuuucaauaccccgaagacaaaagaaggcuacuauuacagacaggucuucgagcgccauuaucccggccgggccgacuggcugucccacuacuggaugccuaaguggaucaacgcgacggaccccagcgcuagaacccugacacacuacaagucugccgugaaagccuga

SEQ ID NO: 66139 - RNA, 942 nt, Artificial Sequence
  derived and/or modified sequence opt5 from ASPA__Homo_sapiens__XP_006721590
augaccagcugccacaucgccgaggaacauauucagaagguggcuaucuucggcgggacacacggaaacgagcugacgggcgucuuucucguuaaacauuggcuggaaaauggggccgagauucaaagaaccggacuugaagugaagcccuucaucacaaacccucgggcggugaaaaaguguacccgcuacauugacugcgaucugaauagaaucuuugaccucgagaaccugggcaaaaagauguccgaggaucuuccguaugaaguccggcgcgcucaggagaucaaucaccuguucgggcccaaggacucugaagauagcuacgacauuaucuuugaucuccauaacacaaccuccaauaugggauguacacugauucuggaggacucuagaaacaauuuccucauccagauguuucacuauauuaaaaccagccuggccccucuucccugcuacguguaucugaucgagcacccuucccucaaguacgccacgacccggucuauugcuaaauaucccguuggcaucgaagugggcccucagccgcaagggguccugcgcgccgauauccuugaccagaugagaaagaugauuaaacaugcucuggauuucauccaccauuuuaacgagggaaaggaauuucccccuugugccauugagguguacaagaucauugaaaaaguugacuacccccgggaugagaauggcgagaucgcggccaucauucacccuaaccuccaggaccaggacuggaagccccugcacccgggggauccuauguuccugacacucgacggaaaaaccaucccccugggcggggauugcacaguguauccugucuucgugaaugaagcugccuacuaugagaagaaagaagcguuugccaagaccacgaaacuuacacugaacgcuaagagcauucgcuguugccuccauuga

SEQ ID NO: 66140 - RNA, 1722 nt, Artificial Sequence
  derived and/or modified sequence opt5 from ASPG__Homo_sapiens__NP_001073933
auggccagagcugugggccccgagcggcgccugcucgccgucuacaccgggggaacaaucggcaugagaagcgaacuggggguucuugugccuggaacgggccuggcggcuauucuccggacccugccgauguuccacgacgaggaacaugcccgcgccagagggcuuuccgaggauacacuggugcugcccccugcuucucggaaccagcgcauccuguauaccguccuggaaugccaaccccucuuugacagcuccgauaugacaauugccgagugggugugucuggcucagaccaucaagagacacuacgagcaguaucauggauucguugugauucacggcacagacaccauggccuuugcggccucuaugcuuagcuucaugcuggaaaaucuccagaaaacggucauccugaccggcgcucaagugccuauccaugcccuuugguccgaugggcgggagaaccugcucggagcucugcugauggccggccaguacguuauucccgaagugugccucuuuuuccagaaucagcuguuucgcgggaacagagcgacaaaggucgacgcccggcgcuucgcugccuuuuguucuccuaaucuucugccgcucgcuaccgugggagccgauaucacaauuaacagagagcuggugcggaaagucgacggcaaggccgggcuuguugugcacagcuccauggagcaagaugugggacugcuccgccuguaucccggcaucccugcugcgcuggucagagccuuccuccagcccccucugaaaggcgugguuauggaaaccuuugggagcggaaauggccccacgaagccggaccuucugcaggagcuccggguggcuacagaaagagggcuggucauugugaacugcacccacugucuucagggagccguuacaaccgauuacgccgcuggcauggccauggcgggggcuggagugaucucuggcuucgacaugaccuccgaggccgcccuggcuaagcucagcuauguccugggccaaccugggcugucucucgaugugcgcaaagaacugcuuacaaaggaccugcggggagagaugacgcccccuuccgucgaggaaagacgccccagccuccagggcaauacccucgggggaggcgugucuuggcugcuuucccucagcgggucccaggaggccgacgcucugcggaacgcccugguucccucucucgcgugcgccgcugcccaugcuggcgauguggaagcccugcaagcgcuugucgagcugggaagcgaccucggccugguggauuuuaaugggcagacaccucugcacgccgcugccagaggaggccauaccgaagcuguuacaaugcuucuccagcgcgggguggacgucaacacccgggauacggacggauucuccccgcugcugcucgccgugagaggccgccaccccggggugauuggccugcuucgggaggccggagcuagccugucuacacaggagcucgaagaggcgggcaccgaacuguguagacuggccuaccgcgcugaucuugaggggcuccaaguuugguggcaggccggagccgaccugggccagccuggguacgauggacacuccgcucugcaugucgccgaagcggcuggcaaucucgccgugguggccuuccugcagagccuugagggggcugucggcgcccaagcgcccugcccugaggugcugcccggaguuuga

SEQ ID NO: 66141 - RNA, 2190 nt, Artificial Sequence
  derived and/or modified sequence opt5 from ASPH__Homo_sapiens__NP_001158222
auggccgaggacaaggaaaccaaacacggcgggcauaagaacggaagaaaaggcgggcugagcggaacauccuucuuuacgugguucauggugaucgcucuccugggcgucuggaccucuguugccguggugugguuugaucuugucgacuacgaggaagugcuggggaagcucggaauuuaugaugcggacggcgauggcgacuucgauguugacgaugcuaaagugcugcuugggcugaaggagcggagcacauccgaacccgccgucccuccggaggaggccgaaccccacaccgagccugaagaacaggugcccguugaggcugagccucaaaauaucgaggacgaagccaaggagcagauucagucucuccugcaugaaauggugcacgcugagcaugucgagggagaagaucugcagcaagaggacggccccacaggggaaccucagcaggaggaugacgaauuucucauggccaccgacguggaugaccgcuucgagacacuggagccggaagugagccacgaggaaaccgagcacuccuaccaugucgaagagacgguuucucaggauugcaaccaagacauggaggaaaugaugagcgagcaggaaaaucccgauuccagcgagccugugguggaggacgaaagacuucaccaugauaccgacgaugucacauaucagguguacgaggaacaggcgguuuaugagccccuggaaaacgagggaaucgagauuaccgaagugacagccccucccgaggacaauccggucgaagauucucaagugaucguugaggaaguguccaucuuuccugucgaggagcagcaggaagugcccccugagaccaaccggaaaacggacgaccccgaacaaaaggcuaaagucaagaaaaagaagcccaaacuccugaauaaguucgauaaaacaauuaaggccgagcuugacgcugccgaaaaacugcgcaagagaggcaaaaucgaggaggcggugaacgccuuuaaggaacucguucggaaguacccucagagcccgcgcgcuagauaugggaaagcccagugugaggaugaccuggcugaaaagcggcgcucuaaugaggugcugagaggagccauugagaccuaccaggaagucgccucccuccccgaugugccugcugaccugcuuaaacugagccucaagcggcgcucugauagacaacaguuccugggccacaugcggggcucccuucugacacuccagcgccugguucagcuguuucccaacgacaccagccucaaaaaugaucugggggugggauaccuucugaucggcgacaacgauaaugcgaagaaggucuaugaggaagugcucuccgugaccccuaacgacggguucgccaaaguucacuacggauuuauucugaaggcucaaaauaaaaucgccgagucuauucccuaucuuaaggaaggcaucgagagcggggauccgggaacagacgacggcagauucuacuuccaucugggcgaugccaugcagcgggucgggaacaaagaggcuuauaagugguacgaacucggacacaagagaggccauuuugccuccguguggcagcgcagccuguauaacgugaaugggcugaaagcgcagccuugguggacgcccaaggagaccggauacacagaacucgucaaaucucuggagcggaacuggaagcucaucagagacgaaggccuggcugugauggauaaagccaaggggcuuuuccugccugaggacgagaaucugcgcgaaaagggcgauuggucccaauuuacccuuuggcagcagggacggagaaacgagaaugccugcaaaggcgcucccaagacauguacccuccuggaaaaauucccugagacgacagggugccgccggggacagauuaaguacagcaucaugcaccccggcacccauguuuggccgcacaccgggccuacaaacuguagacugcgcaugcaccucggacuggugauucccaaagaaggcugcaagauccggugugccaaugagaccaaaacaugggaggaagggaagguccuuauuuuugacgauucuuucgagcaugaaguguggcaagacgcuagcuccuuuagacugaucuucaucguugauguguggcaccccgagcucacgccucagcagcgccggucucugccggccauuuga

SEQ ID NO: 66142 - RNA, 5679 nt, Artificial Sequence
  derived and/or modified sequence opt5 from ASPM__Homo_sapiens__NP_001193775
auggccaacagacgggugggccgcgggugcugggaggucagccccaccgaaagacggccuccggcuggacugcgcggccccgccgcggaggaagaggcuuccucuccucccguucucagccugucccacuucuguagaucuccuuuucuuugcuucggggacgugcugcucggagccagccggacacugucccuugcccuggauaaucccaacgaagagguggcugaggucaagaucucucauuuuccugccgcugaccucggcuucagcgugucccagcgcuguuuuguucugcaaccgaaagaaaagauugugaucagcgucaauuggacgccccugaaagaggggagagugcgggaaauuaugaccuuccucguuaacgaugugcugaagcaccaggccauccuucugggaaaugcggaggagcagaaaaagaagaaacgcucucucugggacacaauuaagaaaaagaaaaucuccgccagcaccucucauaacagacgggucuccaauauccagaacgugaauaagacauuuagcgugucucaaaaggucgaucgcguuagauccccucugcaggcuugcgaaaaccuugccaugaaugagggcggccccccuaccgaaaacaauagccugauucucgaggaaaacaaaauccccauuuccccgaucucuccugcuuucaaugagugucacggggccacaugccugccccugagcgugcggcgcuccaccacguacagcucucuccaugcguccgagaacagagaacugcuuaacgugcacagcgccaaugucucuaaggugagcuuuaacgagaaagcuguuaccgaaacauccuucaauucugugaacgucaauggacagcggggcgagaacagcaagcugucccucaccccuaauuguagcucuacacugaacauuacccagucccaaauccacuuucuuagccccgacucuuucgugaauaacucccauggggccaauaacgaacuggagcucguuacgugccugagcuccgauauguuuaugaaagacaauucucagcccgugcaccuggagagcacaauugcucaugaaaucuaucagaagauccucuccccugauucuuucauuaaagacaacuacggacugaaucaggaucuugagagcgaauccgucaacccgauccugagccccaaccaauuccucaaggacaauauggccuauauguguaccucucagcagacaugcaaggugccucuguccaacgagaauagccaagucccccagucuccugaagauuggagaaaauccgaggugagcccccgcauuccggagugucagggcucuaagagcccuaaagccaucuuugaagagcuuguugaaaugaaguccaacuacuauagcuucauuaaacagaauaaccccaaguuuucugcugugcaagacaucuccagccacucccacaauaagcagccuaaacggagacccauccugucugcgaccgucaccaagcgcaaagccacaugcacgcgggagaaccagaccgagauuaauaagccuaaagcuaagagaugccucaacagcgccgugggggaacaugagaagguuaucaauaaccagaaagaaaaggaggacuuccacuccuaccugcccauuaucgauccgauucugucuaaaagcaaguccuauaaaaaugaagugacaccuucuagcaccacagccuccgucgcucgcaagcggaagagcgacggaucuauggaggaugccaacgugagaguggcgaucaccgagcauacggaaguucgcgagaucaaacggauucacuuuucccccagcgaacccaagacaucugcugucaaaaagaccaaaaaugugaccacaccuaucuccaagagaauuagcaaccgcgagaaacucaaccugaagaagaaaaccgaccuuucuaucuuccggacaccgauuuccaagacgaauaaaagaaccaagcccaucauugccguggcccaaagcucccugacauuuaucaaaccucucaagaccgauaucccccggcauccuaugcccuucgcugccaagaacauguuuuacgacgaacgcuggaaagagaagcaggagcagggcuucacaugguggcugaauuuuauucugaccccugaugacuucacggucaaaaccaacaucagcgaagugaaugcugccacacuucuccugggcauugagaaccagcacaagaucucuguucccagagcgccgaccaaagaagagaugagccugcgggccuacacagcuagaugucgccucaaucggcugagacgcgccgcuugcagacuuuuuaccuccgaaaagauggugaaggccauuaaaaagcuggagaucgagaucgaagcgcggcgccucauugucagaaaagaucggcaccuguggaaggacgugggggagcgccaaaaaguucugaacuggcuucucucuuauaauccucuguggcugagaaucggacucgaaacgacauacggcgagcugauuagccuugaggauaacuccgacgugaccgggcuggccauguucauccucaaucggcugcuguggaaccccgacauugcugccgaauaucgccauccuacagucccccaccuuuacagagauggacaugaggaagcucucucuaaguucacccugaagaaacugcuccugcuuguguguuuucuggacuaugccaagaucagccggcucaucgaucacgacccgugccuguucuguaaagaugccgaguuuaaggcuuccaaagaaauucugcuugcguucucucgcgacuuucucagcggcgagggggaucuguccagacaccugggacuccugggccuuccuguuaaucaugugcagacccccuucgacgaguuugauuucgccgucacaaaccuggcuguggaccuccagugcggcgugcggcuggucagaacgauggaacugcuuacccagaauugggaucugagcaagaaacuccgcaucccugccauuucucggcugcaaaagaugcacaacguugacaucgugcuccaggugcugaaguccagagggauugagcuuagcgaugaacauggaaacacaauccugucuaaagacaucgucgaccgccaccgggagaagacccucagacugcuguggaaaauugccuuugcuuuccagguggauaucucccuuaaucuggaccaacucaaggaagagauugccuuucugaaacauacaaagagcaucaagaaaaccauuucccuccugucuugucacagcgaugaccuuaucaacaagaaaaagggcaaacgcgauuccgggagcuucgagcaguacucugaaaauauuaagcugcucauggacuggguuaacgcggugugcgcuuuuuauaauaagaaagucgagaacuucacgguguccuucagcgauggacggguucuguguuaccugauccaccauuaccaccccugcuaugugcccuuugacgccaucugucagagaacaacccagaccgucgaaugcacacaaaccggcucugugguucuuaauagcuccucugagagcgaugacuccucucuggauaugagccucaaggccuucgaccaugaaaacacauccgagcuguacaaagagcuccuggaaaaugagaagaaaaacuuucaccuugugcgcagcgcuguccgggaucuggggggcauuccugccaugaucaaucauucugacauguccaacacgauuccggacgaaaagguggugaucaccuaucugagcuuccucugcgcgagacugcuugaucugcggaaggagauucgcgcugccagacucauccagacaaccuggcggaaauacaagcugaaaacagaccucaagcgccaccaggagagagaaaaagccgcucggaucauucagcuggccgucaucaauuuucuugcuaagcaaagacugcgcaagcggguuaacgccgcgcuggugauucagaaauauuggagacgcgugcucgcccagcggaagcugcuuaugcugaaaaaggagaaacucgaaaagguccagaauaaagcugccucccugauccaagcuauguggagacgcuaccgggccaagaaguaucucuguaaagugaaggccgcuugcaaaauucaggcgugguacagauguuggcgcgcccacaaggaguaccuggcuauccuuaaagccguuaagaucauucagggaugcuucuauaccaagcuggaaagaacgcgguuucugaacgugcgcgccucugcuaucauuauccaaagaaaauggcgggccauucuccccgcgaagaucgcucaugagcacuuccugaugauuaaacgccauagagccgccugucuuauccaggcucacuaccggggcuauaaggggagacaggucuuucugcgccagaaaagcgccgcgcucaucauucaaaaguacauccgggcuagagaggccggaaagcacgaacgcauuaaauauaucgaguucaagaaauccaccgugauucugcaggcccucguucggggcuggcuggugagaaagcgguuucuugaacagcgcgcuaaaaucagacugcugcauuucacagccgcugccuacuaucaccucaaugcgguccggauccagcgcgccuacaagcuguaccuugcugugaagaacgccaacaaacaagucaauucugugauuugcauccagagaugguuccgggcucgccugcaggagaagagauuuauucagaaauaucauagcaucaagaaaauugaacacgaggggcaagagugucucucccagcggaaccgcgccgccagcguuauccagaaggcugugagacauuuccugcugcggaaaaagcaggaaaaguuuaccucuggaaucauuaaaauccaagcgcucuggagaggcuacuccuggcgcaagaaaaaugauugcacaaagauuaaagccauccggcuuagccugcaggucgugaacagagagauucgcgaagagaauaagcuguauaagcggaccgcucucgcccugcacuaccuucugacauauaaacaccucucugccauccuggaagcucugaagcaucucgagguugugaccagacuuuccccucuguguugcgagaacauggcccagagcggggcgauuucuaaaaucuucguccugauccgcagcuguaaucgguccauucccugcauggaagugaucagauacgcugugcaaguucuccugaacgucucuaaguaugagaaaacgacaagcgccguguacgacguggaaaauugcauugauauccuucuggagcuccugcagauuuaccgcgagaagccuggcaacaaggucgccgacaaaggaggcuccaucuuuaccaagaccuguugccugcucgcuauccuucugaaaacaaccaaucgggccagcgaugugagaucccgcucuaagguuguggaccggauuuauagccuguacaaacucacggcgcacaagcauaagaugaacacagaaagaauccuguauaaacagaagaaaaauuccucuauuagcauccccuucauuccugagaccccgguccgcacaagaaucgugucccggcuuaagcccgauuggguucugcgcagagacaacauggaagagaucaccaauccucuccaggccauucaaauggugauggauacacuggggauccccuacuga

SEQ ID NO: 66143 - RNA, 729 nt, Artificial Sequence
  derived and/or modified sequence opt5 from ASPN__Homo_sapiens__NP_001180264
augaaggaguacgugcugcuccuguuccuugcccugugcagcgcuaaacccuuuuucuccccuucucacaucgcccucaagaacaugaugcugaaagacauggaagauaccgacgaugacgaugacgaugacgaugacgaugacgaugacgaggacaauagccuuuuuccgacaagagaaccccggucccauuucuuuccuuucgaucuguuucccauguguccuuucggcugccaguguuauucucgcgucguucacugcagcgaccucgggcugacguccgugcccaccaacauuccuuuugauacaagaaugcuggaccuccaaaauaacaagaucaaagagauuaaggaaaaugauuucaagggacugaccucucuuuacggccugauccucaacaauaacaaacugacaaagauucauccgaaagcguuucuuaccacaaagaaacugcggcgccucuaucugagccacaaucagcuguccgagaucccccucaaccugccuaagagccuugcugagcugagaauccaugaaaauaaggugaaaaagauucagaaagacaccuucaaggggaugaacgcccuccacguccuggagaugucugccaauccccuugauaacaauggaaucgaaccuggcgcuuuugagggggugacgguuuuccacauucggaucgccgaggcuaaacugaccuccgugcccaaggacaaccucccgagcuucuga

SEQ ID NO: 66144 - RNA, 1032 nt, Artificial Sequence
  derived and/or modified sequence opt5 from ASPRV1__Homo_sapiens__NP_690005
augggcagccccggggccucccugggaaucaagaaagcucuccagucugagcaagccaccgcgcugccugcuagcgccccggccgugucccagcccacagcuccugcccccucuugccuuccuaaggcuggccaggucauucccacgcugcucagagaagccccuuucagcuccguuaucgcgccgacccugcuuuguggguuucuguuccucgccuggguggcugccgaggugcccgaagagucuagccggauggcuggauccggcgcccgcagcgaagaggggagacggcagcacgcguuugucccugagcccuucgacggagccaacgugguuccuaaucuguggcugcauucuuuugaagugauuaacgaucucaaucacugggaccauaucacaaaacugcgcuuccuuaaggagucccugagaggcgaagcucucggcgucuacaaccggcugagcccccaagaucagggggacuauggaaccgugaaagaggcccuucugaaggcuuuuggcguuccgggggccgccccuucucaccuccccaaggagauuguguucgcuaauuccaugggaaaaggcuacuaucugaaggggaaaaucggaaaggucccugugcgcuuucugguggauagcggcgcgcaggucucuguugugcaucccaaccucugggaagaggugacagacggcgaucuggacacccuucagcccuucgaaaaugucgugaaaguugccaacggggcugagaugaagauccugggagugugggauacagccgucucccucggcaagcugaaacuuaaggcccaauuucugguggcuaaugccagcgcggaagaggcuauuaucgggaccgacguucuccaggaucacaacgccauucuggacuucgagcacagaacgugcacccugaaaggaaagaaauuucggcuccugccugugggcgggucccuugaagaugaguucgaccuggaacucaucgaggaagacccgucuagcgaggagggacgccaggaacugucccauuga

SEQ ID NO: 66145 - RNA, 1944 nt, Artificial Sequence
  derived and/or modified sequence opt5 from ASPSCR1__Homo_sapiens__NP_001238817
auggccgcucccgccggcgggggaggcagcgcgguguccguccuggcuccuaacgggagacggcacaccguuaaggugacaccgucuacggugcuccugcagguccuugaggauaccugccgcagacaagacuucaaucccugugaauacgaccugaaauuucagcggagcgugcucgaucugucccuucaguggcgcuucgccaaccugccuaauaacgccaagcucgagaugguucccgcuucuagaagccgggaaggaccugagaauauggugcgcaucgcccugcagcuggacgauggcuccagacuccaagacucuuuuugcagcgggcagacacugugggaacuucugucccauuucccccagauucgggagugucuccagcacccuggaggcgcuaccccggucugcguguauacacgcgaugagguuaccggcgaagccgcgcugagagggacaacccuucaaagccugggacucacgggcgggucugccaccauccgguuugugaugaaauguuacgaccccgucggaaagacaccuggcucccuggggagcucugcuuccgccggacaggcugccgcgagcgcuccccugccucucgagucuggcgaacugucccgcggcgaucuuagcagacccgaggacgccgauaccuccgggccgugcugugagcauacacaggaaaaacagucuacccgggccccugcugccgcccccuucgugccuuuuagcggaggcgggcaacgccugggaggcccucccgggcccacgagaccgcucacauccagcucugcuaagcugcccaagucccuuagcucuccuggaggccccagcaaaccuaagaaauccaagucuggccaggacccccagcaagagcaggaacaggagcgggaaagagauccgcagcaagagcaggagcgcgaacggccuguggacagagagcccgucgaccgcgaaccuguugugugccaccccgaucuggaggaacggcuccaggcguggccugccgagcugcccgacgaguucuuugaacugaccguggaugacgucagacgccggcucgcucagcugaaaagcgagagaaagcgccuugaagaggccccgcuggugacaaaggccuuccgggaagcucaaauuaaagagaagcucgagagauauccuaaaguugcccugcgcgugcuuuuucccgaucgguacguccugcagggguucuuuagacccuccgaaaccgugggagaccuccgggauuucguucgcagccaucugggcaacccugagcugucuuucuaucucuuuaucaccccgcccaagacagugcuggacgaucacacgcagacccuuuuccagccucaacugggggacagagucgcgcccuuuacacucggaccuucccugaaacggugucugggccccgaacagagaacccgccuuccuguggucggggauggcggagacguggacagcggccggcuccuguucugggggcccucuagaggacgcgcuuccccgagcacaggccagccucccugccacccuguuuguagacccuccucuccgccuagcccccggccuuccucuggggaucccagccgcgugaaggccggacauaaacacgucggcaccgggagagccaaucuguuucccgcugcccucgugcaucugggcgcugaggagccugccggaguuuaccuugaaccgggccugcucgagcacgcgauuucccccagcgccgcugacgugcuggucgcccgguauaugucucgcgcugccggguccccuagcccccugccugcgcccgauccugccccgaagucugaacccgcugccgaggaaggagcucuugugccucccgagccuauccccggcacggcccagccggugaagagaucccucgggaaaguuccuaaguggcugaaacugcccgccagcaagcgguga

SEQ ID NO: 66146 - RNA, 927 nt, Artificial Sequence
  derived and/or modified sequence opt5 from ASRGL1__Homo_sapiens__NP_001077395
augaaccccaucguggucguucacggcgggggagccggcccuauuagcaaggacagaaaagagcgggugcaucaggggauggugcgcgcugccaccgucggauacggcauccugagagaagggggauccgcgguggaugcuguugagggcgccguggucgcccucgaagacgauccggaguucaaugcuggcugcgggucugugcugaacacaaauggagaaguugagauggacgccagcauuauggauggcaaggaccuuuccgcuggggccgugucugcgguccaauguaucgccaaccccauuaaacuggcucggcucgugauggagaagacgccucacugcuuucugaccgaucagggagccgcucaguucgccgcggccaugggcgugcccgaaaucccuggggagaaacuugucacagaacgcaauaagaagagacuggagaaagagaagcaugaaaaaggagcucagaagaccgacugucagaaaaaccucggcacaguuggcgccguggcucuggauugcaaggggaauguggccuaugccaccagcacaggaggcaucgucaacaagaugguggggcggguuggagacucccccugucugggcgcugggggauacgcggauaaugacauuggcgccgugucuaccacgggccacggggagagcauccucaaagucaaccuggcucgccuuacccuguuucauauugaacaaggaaagacaguggaggaagccgccgaucucucccugggcuauaugaaaagcagaguuaaggggcuuggaggccugaucguggucucuaaaaccggggacuggguggcuaaguggacauccaccagcaugccuugggccgcggcuaaagacggcaagcuccacuucggaauugauccggacgauacgacaaucaccgaccugcccuga

SEQ ID NO: 66147 - RNA, 1239 nt, Artificial Sequence
  derived and/or modified sequence opt5 from ASS1__Homo_sapiens__XP_005272257
augagcuccaagggcucugugguccuggccuacagcgggggacucgacaccuccugcauccugguuuggcuuaaagagcagggcuaugaugugauugcuuaccuggccaacaucgggcaaaaggaagacuucgaggaagcgagaaagaaggcucucaaacugggagccaagaagguguuuauugaggaugucucucgggaguucguggaggaguuuaucuggcccgccauucagagcuccgcucuuuaugaagaccgcuaccugcucggcacaucucuggccagaccuuguaucgcucggaaacagguugagaucgcccagcgcgaaggggcgaaguaugugagccacggagccacgggcaaaggcaaugaucaagucagauucgagcuguccugcuacagccucgcuccgcagauuaaggugaucgcccccuggcggaugccugaguuuuauaaccgcuucaaagggagaaaugaccugauggaauacgcuaagcagcauggcauucccaucccuguuacccccaagaacccuuggucuauggaugagaaucuuaugcacauuuccuacgaagccggaauccuggagaacccgaaaaaucaggcgcccccugggcucuauacaaagacccaagaccccgccaaagcuccuaacacacccgauauucuggaaaucgaguuuaagaaaggagugccggucaaggugaccaaugugaaagacggcacaacccaucagacgagccuugagcuguucauguaccucaacgaagucgccgggaagcacggaguuggccggaucgauauuguggagaaucgcuuuaucggcaugaagucuagagggauuuaugaaaccccugcuggaacaauccuguaccaugcccaccuggacauugaggccuucaccauggaucgggaagugcgcaaaaucaagcagggccucgggcugaaauuugcugagcuugucuauacaggauucuggcacucccccgagugugaauuugugagacauugcaucgcgaaaagccaggagcggguugaaggcaaagugcaagucucugugcugaaggggcagguuuacauucucggacgcgaguccccucugagccuuuauaacgaagaacugguguccaugaauguccagggcgacuacgagcccaccgacgccacgggcuucaucaacauuaauucucucagacugaaggaauaccaccggcugcaaagcaaagugacagcuaaguga

SEQ ID NO: 66148 - RNA, 1128 nt, Artificial Sequence
  derived and/or modified sequence opt5 from ASTN2__Homo_sapiens__NP_001171663
augcccuucaucaccuaccugagcggccuccugacagcccagaugcuuuccgacgaucaacugauuucugggguggagaucagaugcgaagagaagggacgguguccuagcacgugccaccucugucgcagaccgggcaaagaacagcugucccccaccccuguccuucuggagauuaaccggguugugccccucuauacacugauccaggacaaugggaccaaggaggcuuuuaaaucugcccugaugagcuccuacuggugcucuggaaagggcgaugugauugacgauuggugucgcugcgaccucagcgcguucgaugcuaacgggcugccuaauuguagcccccuucugcagccuguccucagacuguccccgacaguggaacccucuuccaccguugugagccuugagugggucgacgugcaaccugccaucggaacaaaaguuucugauuauauccugcagcauaagaagguggacgaauacaccgauacggaccucuauaccggcgaguuucuguccuucgccgaugaccugcucagcggccuggggacaucuugcgucgcugccggacggucccacggcgaagugcccgaggugagcauuuacuccgucaucuuuaaaugucuugagccugacgggcuguauaaguucacccucuacgcuguugauacacgcggaagacauucugaacugagcaccgugacgcuucggacagccugcccccugguggacgauaacaaagcggaggaaauugccgacaagaucuacaaucucuauaacggcuacaccuccgggaaagagcagcagauggcuuauaauacacugauggaagucagcgccucuaugcuguuucgcgugcaacaccauuacaacucccacuaugagaaguucggagauuuuguuuggagaagcgaggacgaacucggcccgcggaaggcucaccugauucuucgcagacuggagcgggugucuagccauuguuccucucuccugcgcagcgccuacauccaguccagagucgaaaccgugccuuaucuuuucugccggagcgaggaaguuagacccgcgggcauggugugguacucuauucugaaagauaccaagaucacauacaucauuuga

SEQ ID NO: 66149 - RNA, 2121 nt, Artificial Sequence
  derived and/or modified sequence opt5 from ASUN__Homo_sapiens__NP_060634
augaaaaucuucagcgagucccacaaaaccguguuugucguugaccauugccccuacauggccgaaucuuguagacagcacguggaguucgauaugcuggugaagaaccggacacaaggcauuaucccucucgcuccgauuagcaaaucccuguggacgugcucugucgaaagcuccauggaguauugucgcaucauguacgacauuuuucccuucaagaaacuugugaauuuuaucguuucugauagcggggcccaugugcugaacuccuggacccaggaagaccagaaucuccaggagcugauggcggcucuugccgccgucggaccucccaacccuagagcugaucccgagugcuguagcauccugcacggccucguggccgcuguugaaacacugugcaagauuaccgaguaucaacaugaagcccggacacugcucauggagaaugcggagcgcguggggaacagaggacggaucauuuguaucaccaaugccaagucugacucccacguccgcaugcuggaagauugcgugcaggagacaauucacgaacauaacaaacuugcugccaauagcgaccaccugaugcagauccagaagugugagcucgugcugauucauaccuacccugucggcgaagauucucuuguuuccgacagaagcaaaaaggagcugucuccggugcucacguccgaggugcacagcguccgggcugggcgccaccuggccaccaaacugaacauccucgugcaacagcauuucgaucuggcguccacaaccaucacaaauauucccaugaaggaagaacagcacgccaacaccucugcuaauuaugacguugaacuucugcaucacaaggaugcccauguggacuuucucaaaagcggagacucccaccugggcggcgggagcagagagggaucuuucaaggaaacgaucacacuuaaauggugcaccccucggacaaacaauauugagcugcacuacuguaccggcgcuuaucgcaucucccccgucgaugugaacagcagaccuucuagcugccucaccaacuuucugcugaaugggcgguccguucuccuggagcagccccgcaagucuggaagcaaagugauuucccauaugcuuagcucucacggcggggaaaucuuccugcauguccucuccagcucuagauccauccuggaggacccgccuagcauuuccgaaggaugcggcggccgggugacagauuacagaaucacggacuuuggggaguucaugcgcgaaaaccggcuuacccccuuucuggauccuagauacaagauugacggaucucucgaggucccccuggagcgcgccaaagaucaacuggaaaagcacacacgguauuggcccaugaucauuagccagaccacaaucuucaauaugcaggccgugguuccucucgcuuccgugaucgucaaggagucucugaccgaagaggacgugcuuaacugucagaaaacgauuuacaaucugguugauauggagagaaagaacgacccgcuccccaucagcacagugggcacccgcgggaaaggaccuaagcgggaugaacaauauagaauuauguggaaugagcuggaaacccugguccgcgcgcacaucaacaauuccgagaaacaucagcgggugcuugaaugccucauggccuguagaagcaagcccccugaggaggaggagcgcaagaaacggggcagaaagcgggaagacaaagaggacaagucugaaaaagcugugaaggauuacgagcaggagaaguccuggcaagacagcgaacgccugaaagggauucuggagagaggaaaggaggaacucgccgaagccgagaucauuaaagauucucccgacuccccggagccucccaacaagaaaccucugguugaaauggaugagacaccccaggucgaaaagagcaagggcccugugucucuucugagccucugguccaaucggaucaacaccgcuaauagcagaaaacaccaggaguucgccggccgccugaacucugugaauaaccgggcggagcuguaucagcaucuuaaggaagagaacgggauggaaacaacggagaauggaaaggcuuccagacaauga

SEQ ID NO: 66150 - RNA, 258 nt, Artificial Sequence
  derived and/or modified sequence opt5 from ASXL1__Homo_sapiens__NP_001158075
augaaggacaaacagaagaaaaagaaagagagaaccugggccgaagcugcccggcuggugcucgagaacuacagcgaugcgcccaugacaccuaagcaaauccugcaggucauugaagcugagggccuuaaggaaaugcgcuccgggacgucuccgcuggccugccucaaugccaugcugcacagcaacuccagaggaggcgaggggcuuuucuauaaacugcccggacggaucucucucuuuacccugaagguuuga

SEQ ID NO: 66151 - RNA, 4308 nt, Artificial Sequence
  derived and/or modified sequence opt5 from ASXL2__Homo_sapiens__NP_060733
augagagagaagggccggcgcaaaaaggggagaaccugggccgaagcugccaaaacagugcuggagaaguaccccaacacgccuaugagccacaaagaaauccuccaggucauucaacgggagggacugaaggaaauccgcuccggcaccucuccgcuugcgugccugaaugcuaugcuccauacaaacagcagaggggaggagggaauuuucuauaagguucccggccggauggggguguacacccugaaaaaggacgugccugauggagucaaagaacuuuccgagggcucugaagagagcuccgacggccagucugauagccaguccagcgaaaauucuuccucuagcuccgacgggggaagcaacaaggaaggcaaaaagucucgcuggaagagaaaaguguccagcuccucuccccagagcggguguccuucccccacaaucccugccggaaagguuauuagcccgucucaaaaacacuccaagaaagcccugaagcaggcucucaaacagcagcaacagaagaagcagcagcaacagugccggcccagcaucucuaucagcuccaaucagcaucugucucugaaaaccgugaaggccgcuagcgauuccgucccugccaaacccgcgacaugggagggcaagcaaagcgacgggcagaccggaucuccucagaacuccaauagcucuuuuuccagcuccgugaaaguugaaaacacgcuccugggccuuggcaagaagucuuuccagcgcagcgagagacugcacacccggcaaaugaaacgcacaaagugugccgauauugacguggaaacccccgauuccauccucgucaauacaaaccugagagcucuuauuaauaaacauaccuuuucugugcugccgggggacugccagcagcggcuccugcugcuccugccugagguggaucgccaggucggacccgacggccuuaugaagcugaacgggagcgcccucaauaacgaguucuuuacguccgcugcccaaggauggaaagaaagacugagcgagggcgaguucacaccugagaugcagguucggaucagacaggaaauugagaaggagaagaaaguggaacccuggaaggagcaguuuuucgaaucuuauuacgggcaauccagcggacuuucucuggaggauuccaaaaagcucaccgcgagccccucugacccuaaagugaagaagacaccggccgaacagcccaaaagcaugccugucuccgaggcuagccugauccgcauugugcccguugugucucaguccgaguguaaggaagaggcccugcagaugagcuccccuggccggaaagaagagugcgagucucaaggcgaaguccagcccaauuuuagcaccuccucugagccgcuccugagcuccgcucuuaacacccacgaacugucuagcauccucccuaucaagugucccaaagacgaggaucugcuugaacagaagccugugacauccgccgagcaagagagcgaaaagaaccaccugacgaccgccucuaauuauaacaaguccgagagccaggaaucucucguuacaucccccagcaagccuaaaucucccgggguggagaagccgauugucaaaccuaccgcuggagcgggcccccaggaaacaaauaugaaggagccccuggccacccugguggaccaguccccugagagccucaaaagaaaguccagccugacgcaagaagaggcuccggucucuugggaaaagcgcccccgggugacagagaacagacagcaucagcagccuuuccaaguuagcccccagccuuuucuuaaucgcggggaucggauccaggugagaaaagugcccccucugaagauucccgucucccgcaucucuccgaugccuuuccaccccagccagguuuccccucgggccagauuucccgugucuauuaccagcccgaaccgcaccggagcccggacacucgcugacaucaaagccaaggcgcaacuggucaaagcucagagagccgccgcugccgcugccgcggccgcugccgcugccgcguccgugggcgggaccaucccuggccccggaccuggcgggggacagggccccggggaaggaggcgaggggcaaacagcccggggcggaucucccggcagcgaucgcguguccgagacggggaagggaccuacccuggaacuugcuggcacagggagcagaggaggcacccgggagcuccugccgugcgggcccgaaacacagccucagucugagaccaagacgacccccucccaggcccaaccucauagcguuucuggcgcucagcugcagcagacacccccugucccgcccaccccugccguguccggagccuguacaagcgugcccuccccugcucacauugagaaacucgacaaugaaaagcugaaccccaccagagcgacggccacagucgcuucugugagccacccgcaaggcccuuccagcugccgccaggagaaagcccccucucccaccgggccugcccuuaucuccggagcuagccccguucauugugccgcggauggcacaguggaacugaaggcugggccuucuaaaaauauuccgaaccccagcgccuccucuaagaccgacgccagcgucccuguggcuguuacccccuccccucucacaucucugcugacgaccgccacacuugagaagcuccccgugccgcaggucagcgcgaccacagcuccugccggauccgcucccccuagcucuacccugcccgccgccuccagccugaaaacgccuggcacaucccucaauaugaacgggcccacccugcggccgaccucuagcaucccugcuaauaacccccuugugacacagcugcuccaaggcaaggauguucccauggaacagauucugccuaaaccgcugaccaagguggagaugaaaacagucccccuuacggccaaggaggaaagaggaaugggcgcgcucaucgccaccaauacaaccgagaacuccacacgcgaagaggugaacgaaagacagucucacccugcuacccagcaacagcuggggaaaacgcugcagagcaagcaacucccccaggugccucggccccugcagcuuuucuccgccaaggagcugcgcgacagcucuaucgauacccaucaguaccacgagggacucuccaaagcuacacaagaccagauucugcagacccugauccagagaguccggcgccaaaaucuucucagcguugugccuccgucucaguucaacuuugcccauuccggcuuccagcuggaagacauuagcacaucucagagauuuaugcugggguucgccggacggcgcaccagcaagcccgcuauggcgggccacuaucuccugaauaucuccacauacggcagagggucugagagcuuucggcgcacccacuccgugaacccugaagauagauucugccuuagcucccccacggaggcccugaaaaugggauacacagacugcaagaaugcuaccggcgaaucuagcuccucuaaagaggaugacaccgaugaggaaagcacaggggacgagcaagaauccgucaccgugaaggaggagccucagguuucucagagcgccggaaagggcgauacguccagcgggccccauucucgggaaacacucuccaccagcgacugucuggccucuaaaaacgugaaggcugagauuccgcugaaugaacaaacaacccuuuccaaagagaacuaucuguuuacaagaggacagaccuucgaugaaaagacgcucgcccgcgaccugauccaggcggcucagaaacaaauggcccacgccguccggggcaaggcuauuagaagcucuccugagcucuuuuccagcaccgugcugccccuucccgccgauuccccuacacaucagccccugcuccugccuccgcugcagacccccaaacuuuacggcagcccuacacagaucgggcccucuuaucgcggaaugaucaauguuagcaccuccucugacauggaucacaacagcgcggugccuggcucccaagucucuagcaaugugggggacguuauguccuucucugugacggucacaaccauucccgcuagccaggccaugaacccguccagccacggacagacaaucccugugcaggccuuuucugaggaaaauuccauugagggcacccccagcaaaugcuacugucggcugaaggcuaugaucaugugcaaaggguguggagccuucugccaugacgauuguauuggcccuucuaagcucugcguguccugucuggucguuagauga

SEQ ID NO: 66152 - RNA, 6747 nt, Artificial Sequence
  derived and/or modified sequence opt5 from ASXL3__Homo_sapiens__NP_085135
augaaggacaagagaaagaagaaggaucggaccugggccgaagcugcccgccuggcccucgaaaagcaccccaacagcccuaugacagcuaagcagauccuggaggugauucaaaaggaaggccuuaaggagacguccgggaccucuccccuggccugccucaaugccaugcugcauacaaacaccagaaucggagacggcacauucuuuaagauucccgggaaaagcggacuuuacgcucugaagaaagaagaguccucuuguccugccgauggcacccucgaccuggucugcgagagcgaacuggaugggacagacauggcugaggccaaugcgcacggagaagagaacggcguuuguuccaagcaggucaccgaugaggccucuagcacgcgggacuccagccucaccaauacagcugugcagucuaagcuggucuccagcuuccagcaacauaccaaaaaggcccuuaaacaggcucugcgccagcagcaaaagagacggaacggcgugucuaugaugguuaauaaaacagugccccgcgucgugcucaccccucugaagguuuccgaugaacagagcgacucucccuccgggagcgaguccaaaaacggagaagccgauucuagcgacaaggagaugaagcacggccagaaauccccuacggggaagcagacaagccaacaucuuaaaagacugaagaaaucuggacucggccaccugaaguggaccaaggcggaagauaucgacauugagacaccgggguccauccuggugaauaccaaccuccgggcccugaucaauaaacacaccuuugcuagccuuccccagcauuuccagcaauaucugcuccugcuucugccugaggucgaccgccagaugggaucugauggcauucucagacugagcacauccgcccugaacaaugaauuuuucgcuuacgccgcccagggcuggaagcagcggcucgcugagggggaauuuacgcccgagaugcaacugcgcaucagacaggaaauugagaaagagaagaaaaccgaaccuuggaaggagaaguucuuugaacgguucuauggagagaaacuuggcaugucucgcgaagagagcgugaagcugacaaccgggcccaacaaugcgggagcccaguccagcucuagcugcggcacaagcgggcucccggugucugcucagaccgcccuggccgagcaacagccuaaauccaugaaaagccccgcuuccccugaacccggauuuugugccacgcuuugccccauggucgagaucccuccgaaagacauuauggcggaacuggagucugaggauauccucauucccgaagagagcguuauccaggaagagaucgcugaagagguggagacauccauuugugaaugccaggacgagaaccacaagaccaucccugaguucucugaggaagccgagagccugaccaacucccaugaggaaccccaaauugccccucccgaggauaaucuggaaagcugugugaugaugaacgacguccucgagacacugccgcacaucgaagugaagauugagggcaaaucugaguccccucaggaagagaugaccguugugaucgaucagcuugaagucugcgacagccugauccccucuacauccagcaugacgcacgugucugauaccgagcauaaggagagcgaaacagcuguugagaccuccacaccuaaaauuaagaccggcuccucuagccucgaagggcaguuucccaaugagggaaucgccauugacauggaacugcaaagcgauccugaggagcagcuguccgaaaacgcuuguaucucugagacgagcuucuccucugaaagccccgagggcgccugcaccucccuuccgucuccugggggagaaacacagagcaccuccgaggagagcugcacacccgcgucucucgaaaccacguucuguuccgaggugagcucuacagaaaauaccgacaaauacaaccaaagaaauuccacagacgagaacuuucacgccagccugaugucugaaauuucccccaucagcaccuccccugagaucagcgaggcuucucugaugagcaaucucccgcugaccuccgaagccucucccgucagcaaccuuccucugacauccgagacgucucccaugagcgaucucccucugaccuccgaaacaucuagcguguccagcaugcugcuuaccucugagacaaccuucgucuccagccucccccugccuucugagacgucccccauuagcaauuccucuaucaacgaacggauggcucaucagcagagaaagagcccguccgugagcgaggaaccucugucuccccagaaagacgaguccagcgccacagcgaagccucucggcgaaaaucugaccucucaacagaagaaccuuagcaauacccccgagccgauuaucauguccucuagcuccauugccccugaggcuuuucccucugaagaucugcacaacaaaacacucagccagcagaccugcaagucccauguugacacagagaaaccuuaucccgccagcauccccgaacuggcuucuacggagaugauuaaggugaaaaaccacuccguccugcaacgcaccgaaaagaaggugcuuccuagcccgcucgagcuguccguuuucucugaggggacagauaauaaaggcaacgaacugcccagcgccaagcuccaggacaaacaguacaucuccucuguggauaaggccccuuuuagcgagggaucccggaauaaaacccacaagcagggcagcacacaaucuagacuggaaaccucccauacgagcaagucuuccgagcccagcaaaucuccugacgggauccgcaacgaaagccgggauuccgagauuucuaagagaaaaaccgcugagcagcacagcuucggaaucuguaaggaaaaacgcgcgcggauugaggacgaucaguccacaagaaauaucagcuccucuucucccccugaaaaggagcaaccgccccgcgaggaaccucgggugcccccucuuaagauucagcuguccaaaaucggacccccguuuaucauuaagucccagccugugagcaaacccgaguccagagccucuaccagcacauccgugagcgggggacgcaacaccggcgcucggacacucgccgacaucaaggccagagcucagcaagcccgggcgcagcgcgaagcugccgccgcugccgcgguugcugccgccgcuucuauugucuccggggccaugggcagccccggagagggcgggaaaaccagaacgcuggcucauaucaaggaacagacaaaagccaagcuguucgcgaagcaccaggcccgggcucaccuuuuucaaaccucuaaagagaccagacucccucccccucuguccagcaaggagggaccgcccaaucuggaagugucuuccacaccugagaccaaaauggaaggcagcacgggggugauuaucgucaaccccaauugccgcuccccuagcaacaagucugcccaucuccgggagacaaccacagugcugcagcagagccuuaaucccuccaaacugccggaaaccgcuacagaucucucuguucacagcuccgacgagaacaucccugugucucaucugagcgagaagauugucuccucuaccagcuccgaaaauagcucugugcccaugcuguucaacaaaaauagcguuccugugagcgucuguucuacggccaucuccggagccauuaaagagcaccccuuugugagcuccguugacaagucuagcgugcuuauguccgucgauagcgcuaacaccacaaucucugcgugcaacauuuccaugcugaaaaccauccagggcacagacaccccuuguaucgccauuauccccaagugcauugaaagcacgccgaucucugcuacaaccgaggggagcuccauuucuagcuccauggaugacaaacaacuccugaucucuagcuccagcgccucuaaucucguguccacacaguauaccagcgugccuacccccuccauuggcaacaaucugcccaaccuuucuacaagcuccguccugaucccuccgaugggaaucaauaacagauuccccucugaaaagauugccaucccuggcagcgaggagcaggcuacgguuuccauggggaccacagugcgcgccgcgcucagcuguucugauuccguggcugucaccgacagccugguggcccaucccacaguugccauguuuaccggaaauaugcugacgauuaacucuuacgauuccccucccaaacuuagcgcugaaucucuggacaaaaauuccggcccuagaaaccgggccgauaauagcgggaagccgcagcaacccccuggaggcuucgcgcccgcugccaucaaccgcucuauuccuugcaaagugaucgucgaccacagcacaacccucaccuccagccugucccucacagugucuguugagagcuccgaagccucucuggaucuucaggggagacccgugcggaccgaggcuagcguccagccgguggccuguccucaaguuuccgugaucucucgccccgagcccgucgcuaaugaaggcauugaccacagcuccacauucaucgccgcgagcgccgcuaagcaggauucuaaaacgcugccugcuaccugcacaucccucagagagcugccccuggugccugacaaacuuaacgaaccgaccgcucccagccauaauuuugccgagcaggcccggggaccugcucccuucaagucugaagcggacacaaccugcuccaaccaguacaacccuagcaaucgcauuuguuggaacgaugacggcaugagaucuacggggcaaccccuggugacccacuccggaagcucuaaacagaaggaguaucucgagcaguccugcccgaaagccaucaagacagaacaugcuaauuaccugaacgucagcgagcuccacccucggaaucugguuaccaacguggcccuucccgugaaaagcgaacugcaugaggccgauaagggcuuucgcauggacacagaagauuucccugggcccgagcugccucccccggcugccgagggagcguccucuguccagcaaacccagaauaugaaggcuagcacauccucuccuauggaagaggccauuagccucgccacggacgcucugaaaagagugcccggcgccggcuccucugggugucggcuuagcuccguugaagcgaacaauccccuggugacccagcuccugcagggaaaccucccucuggagaagguccuuccgcaacccagacugggcgccaaacuggaaaucaaucgccucccucugccccuucagacaaccagcguggggaagaccgcuccugagcggaacguugagauucccccuucuucccccaauccggauggaaaaggcuaucuggccgggacacucgcuccucugcagaugagaaagcgcgaaaaccaccccaaaaagcggguggccagaacggucggagagcacacccaagugaagugcgaaccuggcaaacuccuggucgagcccgacgugaagggcguuccgugugugauuagcucugggaucucccagcuuggacauagccagccuuuuaaacaggaguggcugaauaagcacuccaugcaaaaccgcauuguccauucucccgaagugaaacagcagaagcggcugcuccccagcugcuccuuccagcaaaaucuguuucacguugauaagaacggcggguuccacacagacgcuggaaccucucauagacagcaguuuuaccagaugccuguggccgcgcgcggccccaucccuacagccgcccuucugcaagccagcuccaaaaccccggucggguguaacgcuuucgccuuuaaucggcaccucgagcagaagggacugggcgaagugagccucucuuccgcgccccaucagcugagacuugcuaacaugcugagcccuaauaugcccaugaaagagggcgaugaaguugggggcacggcgcacacaaugccuaacaaggcccuggugcaucccccuccgcccccucccccucccccgccuccgccccucgcucugccucccccuccgcccccucccccuccccuuccgccuccccugccuaaugccgagguccccucugaccagaaacaaccgccugugaccauggagaccacaaagcggcucagcuggccccaguccaccggcauuugcucuaacaucaagagcgaaccccuguccuucgaggaagggcuguccucuuccugugagcucggaaugaaacaggugagcuaugaccaaaaugaaaugaaggagcagcuuaaagccuuugcucugaaguccgccgauuucucuagcuaccugcucuccgagccucagaaacccuucacacagcuggcggcccaaaagaugcagguccagcagcaacagcagcuuugcggcaacuauccuaccauucacuuugggucuacgagcuucaagcgcgcugccuccgcuaucgaaaaaucuaucggaauccugggcagcggcuccaauccggccacagggcucagcggacagaacgcgcaaaugcccgugcagaauuuugccgacucuuccaacgcugaugagcuggaacugaaguguagcugcagacucaaagccaugaucguuugcaagggcuguggggcuuucugccacgacgauuguauuggaccuucuaaacuuugcguggccugucuggucgugcgguga

SEQ ID NO: 66153 - RNA, 1428 nt, Artificial Sequence
  derived and/or modified sequence opt5 from ASZ1__Homo_sapiens__NP_570124
auggccgcuagcgcccugagaggccuccccguggcugggggaggcgaguccucugaaagcgaggacgaugggugggaaaucggauaccuggaccggaccucccagaagcugaaacgccugcucccuauugaggaaaagaaagagaaguucaaaaaggcgaugacaaucggcgaugucucucugguucaagagcuucuggacagcgggauuuccguggauucuaacuuucaguauggauggacgccgcucauguacgccgccagcguggcuaaugccgaacuggucagagugcugcucgaccggggcgcuaacgccuccuucgagaaggauaaacagagcauccugauuaccgcgugcucugcccacggcuccgaagaacagauccuuaaguguguugagcugcuccugagccgcaaugcugaccccaacguggccugcagacggcuuaugacaccuaucauguaugcugcccgcgaugggcauacccaagucguggcgcugcucguugcccacggagcugaagugaauacacaggacgagaacggcuacaccgcccugacaugggcugccagacaggggcauaaaaauauuguccugaagcuccuggaacuuggagccaacaaaaugcugcagaccaaggauggcaagaugcccucugagaucgcuaaacggaauaagcaccaugaaauuuuuaaccuccuguccuucacgcuuaauccucuggaggggaaacuccaacagcugaccaaggaggacacaaucuguaaaauucugaccacagauagcgaccgcgaaaaggaccacaucuuuucuuccuauaccgcguucggagaucucgagguguuucugcacggccuuggccuggaacauaugacggaccuccugaaagagagagauauuacacuucggcaccuucucaccaugcgcgaagacgaguucacaaagaacgggaucaccagcaaggaucagcagaaaauccuggccgcucugaaggagcuccaaguggaagagauucaguuuggagaacuguccgaggaaaccaaacuugagaucucuggcgacgaguuccugaauuuucuccugaagcugaacaaacagugcgggcaucuuauuacagccguccaaaauguuaucacggaacuccccgugaacagccagaagauuacccuggagugggccuccccucagaacuucacaagcgugugugaggagcuggucaauaacguggaggaucucucugaaaagguuugcaaacugaaggaccuuauccagaaacugcaaaaugagagagaaaacgauccgacccacauccagcuccgggaggaaguguccacauggaauagccgcauucugaagagaaccgcuaucacgauuuguggauuuggcuuccugcuuuucaucugcaaacucacauuucagcggaaguga

SEQ ID NO: 66154 - RNA, 4173 nt, Artificial Sequence
  derived and/or modified sequence opt5 from ATAD2__Homo_sapiens__NP_054828
auggugguccugagaagcucccucgagcugcacaaccauucugccgcuagcgccaccggcucccuugaccugucuagcgauuuccucucccuggaacacaucgggcggcgcagacuucggucugcgggagcugcccagaagaaacccgccgcuacaacggccaaggcuggcgacgggagcuccguuaaagagguggaaaccuaccaucgcacaagagcccugcggagccuccgcaaggaugcgcaaaauucuuccgacagcucuuuugagaaaaacguggaaauuaccgagcagcuggccaauggaagacacuucacacggcagcuggcucgccagcaagccgauaagaagaaagaggaacauagagaggacaaggucaucccugugacccggucccuccgcgcuagaaacauuguucagagcacagaacaucugcacgaggauaauggcgacguggagguccggcgcucuugcagaauccgguccagauauagcggggugaaccaguccaugcuuuuugauaaacugauuaccaauacggccgaagcgguucuccagaagauggacgauaugaaaaagaugcgccggcaaagaaugcgcgagcuggaagaccuuggaguguucaacgagaccgaagagucuaaucugaacauguacacacggggcaagcagaaagauauccagagaaccgacgaggaaacaaccgacaaucaggagggcagcgucgaauccagcgaggaaggggaggaucaagagcacgaagacgauggagaggacgaagaugacgaggaugacgaugacgaugacgacgaugacgaugacgaugacgaugaagacgaugaggacgaggaagauggcgaggaagagaaccagaagcgcuauuaccuccggcagagaaaagccacgguguauuaccaagcuccgcuggagaagccccgccaccagcggaaaccuaauaucuuuuauucugggcccgccuccccugcuagaccccgcuaccggcugagcucugccggaccuagaagcccguacuguaagcggaugaaccgcagacggcaugccauucacuccucugacagcacauccagcagcuccagcgaagaugagcagcacuucgaaagacgccggaaaagaucucgcaauagagcuaucaaccggugccucccccugaacuuucgcaaggacgagcuuaagggcauuuauaaagacagaaugaagaucggggcgucccuggccgauguggacccuaugcagcucgauagcuccguccgguucgacucuguuggaggccugagcaaucauauugcugcccuuaaagaaauggugguguuuccccugcucuacccugaggucuucgagaaguuuaaaauccaacccccgcgcggcugucuguucuaugggccucccggaaccggcaagacacugguggccagagcucucgccaacgaaugcucccagggggauaagcggguugcguuuuucaugcgcaaaggagcugacugucugucuaagugggugggcgagagcgaaagacagcuucggcuucucuucgaucaggccuaccaaaugcgcccuuccauuaucuuuuucgacgagaucgaugggcuggcccccgucagaagcucucggcaggaccagauucacuccagcaucgugucuacccuucuggcucucauggauggacuggacuccagaggcgaaauuguugugaucggcgccaccaaucgccuggauagcauugaccccgcucuccggagaccugggcgcuuugaccgggaguuccuguuuucucuuccggauaaagaggccagaaaggaaauccugaaaauccauacacgcgacuggaaccccaagccucucgauacguuccuggaggaacuggcggagaauugcgucggauauuguggcgccgacauuaagagcaucugcgcugaagccgcucuuugugcccuccggagacgcuacccccagauuuauaccacauccgagaaacugcaacuggaucucagcucuaucaacauuuccgcgaaggacuuugagguggccaugcagaaaaugaucccugcuagccagcgggccgucaccucccccgggcaggcucugucuacagugguuaagccgcuucugcaaaauaccguggauaaaauccucgaagcccugcagagagucuucccucacgccgaguuucggacgaacaagacacuggacagcgauauuuccugcccccuucucgaaucugaccuggcuuacagcgaugacgacgugccuuccguuuacgagaauggacugucucagaagucuucccauaaagcgaaggauaacuucaauuuucuccaccugaaccgcaaugccuguuaucaacccaugagcuucagaccucggauccuuauugugggcgagcccggguuuggccagggaucucaccuggcuccggccgucauccaugcccucgaaaaauucaccguguacacccuggacauuccugugcuguucggcguuuccacaaccagccccgaggaaacaugcgcucaggucauccgcgaggccaagagaacggcgcccucuauuguguaugugccucacauccaugucuggugggaaaucguggggccgacccuuaaagcuacauuuaccacacuccugcagaacauucccuccuucgccccuguucugcuccuggccaccagcgauaagccccacucugcucugccugaggaggugcaagaacuguuuauccgggacuacggagagauuuucaauguccagcuccccgauaaagaagagagaacgaaguuuuucgaagaccugauccugaagcaggccgcgaaaccucccauuuccaagaaaaaggcugugcuucaggcccucgagguucugccgguggccccucccccugagccccgcagccugaccgcugaagaggucaaacggcucgaggaacaagaagaggauacauuuagagagcugcgcaucuuccuucggaacgugacccacagacuggccaucgacaagcgcuuucggguuuucacaaagccgguggauccugacgaaguccccgauuaugugaccgugauuaaacagccuauggaccucuccagcgucaucucuaagauugaucugcauaaauaccugacgguuaaggacuaucuuagagacaucgaucugauuugcagcaacgcucucgaguacaaucccgaccgcgaucccggcgacagacugauccggcaccgcgccugugcgcucagagauacagccuacgcuaucauuaaagaggaacuggacgaggauuuugaacagcuuugcgaggaaauccaggagucccggaagaagcgcggguguucuagcuccaaauaugccccuucuuacuaucaugugaugccgaagcaaaacagcacccuggugggagacaaaagauccgaucccgaacagaaugagaagcucaaaacaccuucuacccccgucgcuugcagcaccccugcccagcugaagcggaagauuagaaagaaguccaacugguaccugggcacaaucaaaaagcgccggaaaauuagccaagccaaggacgauucucagaaugcuaucgaccacaaaaucgaguccgauacggaagagacccaggacacaagcguggaccauaacgaaaccgggaauacaggcgagucuuccguugaagagaacgagaagcagcaaaaugcgagcgaauccaaacuugagcugagaaacaauucuaacaccuguaauauugaaaacgagcucgaagauagccgcaaaacgacagccugcaccgagcugcgggacaagaucgcuuguaauggagaugccuccagcucucagauuauccacauuuccgacgagaacgaaggcaaagagaugugcgugcucagaaugacccgggcccgcagaagccaggucgaacagcaacagcugaucacaguggagaaggcucuugccauucugucucagcccaccccuagccucguuguggaucacgagcggcugaaaaaccugcuuaagacagucgugaagaaaucccagaauuauaacaucuuccaacuggaaaaucucuacgcgguuaucucucaguguauuuaucgccauagaaaggaccacgauaaaacgagccugauccagaagauggagcaggaaguggagaacuuuuccugcucucgguga

SEQ ID NO: 66155 - RNA, 1443 nt, Artificial Sequence
  derived and/or modified sequence opt5 from ATAD3B__Homo_sapiens__XP_011540545
augagacgggccaccguggagcgcgaaauggagcugagacacaagaacgaaaugcuccgggucgagacagaagcucgcgccagagcgaaagcugagcgggagaaugccgacaucauucgcgaacagaucagacugaaggccagcgagcaucggcaaacgguucuugaauccauucgcaccgcuggcacacuguucggggagggauuuagagccuucgugaccgaucgggacaaagugacagcuaccgucgccggccucacacugcuugcgguggggguuuacucugccaagaacgcuaccgccgugacgggacgcuuuaucgaggcuagacugggcaaacccagccucguccgggaaaccucccgcauuacagugcuggaggcccugagacacccuauccagguuucucggagacuccugagccgcccgcaggaugugcuugaaggggucgugcugucccccucucucgaggcgcgggugagagacaucgccauugcuacccgcaauacaaagaagaaccggggacuguauagacauauccuucuguacggcccucccggcaccgggaaaacacucuucgccaagaaacuggcucugcacagcggaauggauuaugccauuaugacgggcggggacgucgccccuaugggacgcgaaggcguuaccgcuaugcauaagcucuuugauugggcgaauacaucccggagagggcugcuucuguucauggacgaggccgaugcuuuucuccgcaaacgggccaccgaggaaaucagcaaggaccugagagccacccuuaacgcuuuccuguaccacaugggacagcacucuaauaaguuuaugcucgugcuggccuccaaccugcccgagcaauucgauugcgcgauuaauagccgcaucgacgugaugguccauuuugaucucccucagcaggaggaacgggaaagacuggugcggcuucacuucgacaacuguguucugaaaccggcuacagagggcaagcgcagacucaaacuggcccaguuugacuauggccggaagugcucugagguggccagacuuacggaagggauguccggacgcgagauugcucaacuggccgucagcuggcaggcuaccgccuacgcgucuaaagauggcgugcucacagaagccaugauggacgcuuguguucaggaugccgugcagcaauaucggcagaagaugagauggcugaaagcugaggggcccggacgcggcgucgaacauccucuguccggggugcagggagagacccucacaagcuggucccuggccaccgaccccucuuacccuugccuugcgggccccuguacguucagaaucugcagcuggaugggcacagggcuguguccgggaccucucagcccccggauguccugcggcgggggacgcccuuucuguccucccggccacccccugcuguga

SEQ ID NO: 66156 - RNA, 1290 nt, Artificial Sequence
  derived and/or modified sequence opt5 from ATAD3C__Homo_sapiens__XP_011539310
augcagagagcccaccggcgcgcugaccccagcgagcugcaaugccucgaagccauguccaaggaugcgcugaaccuugcucagaugcaggagcagacccugcaacucgaacagcagucuaaacugaagcagcuugugaaugaggaccugagaaaacaagaagagagcguccagaagcaucaccagacauuccucgaguccauccgggccgccggcacgcuguuuggggaaggauuccgcgcuuuuguuaccgauagagacaaagugacagccaccguggcuggccugacacuccuggccgucgggguguacucugcgaagaacgccaccgcuguuacaggacgguauauugaggcccgccuuggcaagccuagccuggugagagaaaccucccggaucacgguccucgaggcucugcgccauccgauucagcaagugucuagacggcuucugagccgcccccaggauguucucgagggggugguccuguccccuagccuggaagccagagugcgggacaucgcgauuaugacccgcaauaucaaaaagaacagaggacucuaccggcacauccugcuuuaugggcccccuggcacaggcaaaacccuguucgccaagaaacucgcucugcauucuggaauggauuacgccauuaugacaggcggggacguggcucccaugggaagagagggcgucaccgccaugcacaaacuuuuugauugggccaauacgucccgccgggggcugcuccuguucguugacgaagcugaugcguuucugagaaagcgcgccacagagaagaucagcgaagaccuccgggcuacccugaacgccuuccuuuauagaacaggacagcacucuaauaaguuuaugcugauucucgccuccugucauccugagcaauucgauugggcuaucaacgccugcauugacgugauggugcacuuugaccugccgggccaggaggaacgcgcgcggcuugucagaauguaccugaaugaguaugugcucaaacccgcuaccgaaggcaagcgccggcugaaacuggcccaguucgauuacgggagaaagugucucgagaucgcccgccugaccgaaggaaugagcugccggaaaauugcucagcuugccguuucuuggcaagcuacagccuacgcguccaaggacggcgugcugacggaggccaugauggaugcuuguguccaggacuuugugcagcagcaucaacagaugaugagauggcucaagggggagcggccuggacccgaagaugagcagccuagcuccuga

SEQ ID NO: 66157 - RNA, 5535 nt, Artificial Sequence
  derived and/or modified sequence opt5 from ATAD5__Homo_sapiens__NP_079133
auggugggcguccuggcuauggcugccgccgcugcgcccccucccguuaaggacugcgagaucgaacccuguaaaaagcggaaaaaggaugacgauaccagcacaugcaaaacgauuaccaaguaccucuccccucuggggaagacgagagaccgcguguucgcgcccccuaaacccucuaacauccuugauuauuuuagaaagacaagcccuacaaaugagaaaacccagcugggaaaggaauguaaaauuaaguccccggagucugugcccgucgacagcaacaaggauugcacaaccccucucgaaauguucuccaauguggaguuuaaaaagaaacggaagcgcguuaaccugucucaccaacuuaauaacaucaaaacggagaaugaagcucccaucgagaucagcuccgacgauagcaaggaagacuacucucugaacaaugauuucguggaguccagcaccucuguccucagauauaagaaacagguggagguucuggccgaaaacauccaggacacaaaaucccagccuaauaccaugacaagccugcaaaacucuaaaaaggugaaucccaaacagggcaccacgaagaacgauuuuaaaaagcuccggaagcgcaaauguagagacgucguggaccuguccgagagccuuccgcuggcugaggaacugaaucugcuuaagaaagaugggaaggacacaaaacagauggaaaacaccacaucccaugccaacucucgggauaaugugaccgaggccgcccagcugaacgacagcauuaucaccgucuccuacgaggaguuccucaagagccacaaggagaauaaaguugaagagauuccugauucuacaauguccaucugcgugcccagcgaaacgguggacgagauugucaagucuggauauaucagcgaguccgaaaacucugagauuagccaacaggugcgcuuuaaaaccguuacagugcuggcucagguccauccuauuccgcccaagaaaaccggcaagaucccuagaauuuuccugaagcagaaacaauuugaaauggaaaauucccucagcgauccggaaaacgagcagacagugcagaagcggaaaucuaauguugugauccaagaggaagaacuggaacuugccguccuggaggcuggguccagcgaggccgugaagcccaaauguacccucgaagaacgccagcaguucaugaaggccuuuagacagccugccucugacgcucugaaaaacggagucaagaaguccagcgauaaacaaaaggaccuuaaugaaaaaugccuguacgaggugggccgggaugacaacuccaagaaaauuauggaaaauucuggcauccagaugguuagcaagaacgggaaucuccagcugcacacggacaagggauccuuccugaaagagaagaacaaaaagcucaaaaagaagaauaaaaagacacuggauaccggcgccauucccgggaaaaaccgcgagggaaacacccagaagaaagaaacaaccuuuuuccuuaaggagaagcaauaucagaauagaaugucucugcggcagagaaaaacagaguucuuuaagagcuccacacucuucaacaaugagagccugguguacgaagacaucgcuaacgaugaccuucugaaagucucuucccucuguaauaacaauaagcugagccgcaaaaccucuaucccugugaaggauauuaaacugacacaguccaaggccgagagcgaggccucucuccugaacguuagcacccccaaguccacacggagaagcggccgcaucucuuccaccccgacgaccgaaacaauucgggggaucgacagcgaugacgugcaagauaauucccagcuuaaggcuucuacccagaaggcggccaaccugagcgagaaacauucccucuacacagcugaacugauuaccgucccuuuugacucugagagccccaucagaaugaaguucacgcgcaucuccacaccuaaaaagucuaagaaaaagagcaauaaacgguccgaaaagagcgaggccaccgauggaggcuuuacaucucagauuagaaaagccuccaacaccagcaagaauaucucuaaggcuaaacaacugauugagaaggccaaagcgcuucacaucucccgcagcaaggugaccgaagagauugcuaucccccuccggagaucuucccgccaccagacacugccugaacggaaaaagcugagcgagacggaggacuccgugauuaucaucgauagcucucccaccgcccucaagcauccggagaaaaaccagaagaaacugcaaugccuuaaugacguucugggcaagaaacucaacacaagcaccaagaacgucccugggaagaugaaaguggcgccccuguuccuggugagaaaggcucagaaagccgcugaccccgucccuuccuuugaugagucuagccaggacacauccgaaaagucucaggauugugacgugcaaugcaaagccaagcgggauuuccuuaugagcggacucccggaccugcugaaacgccagauugcgaagaaggccgcugcccucgauguuuauaaugcuguguccaccucuuuucagagagucgugcacguucagcaaaaagacgauggcugcugucuguggcaucuuaagcccccuagcugcccccugcucacgaaauucaaggagcugaacacaaaagugaucgaccuguccaagugugggauugcccuuggagaauuuagcacccucaauucuaagcugaaauccggcaacagcgcggccgucuucaugcggaccagaaaggaguuuacagaggaagugcgcaaucugcuccuggaggaaauccgguggucuaacccugaguucucccuuaaaaaguacuucccccugcuccugaaaaagcagauugaacaccagguucugagcuccgagugccacucuaagcaggagcuugaagcugaugugagccauaaagagaccaagagaaaacucgucgaagccgaaaauuccaagagcaaacgcaagaagccuaacgaauauucuaaaaaucuggagaagacaaacagaaaauccgaggaacugagcaagcggaauaacucuagcgggaucaaacucgacuccucuaaggauagcggaacggaggacaugcuguggaccgaaaaauaccaaccccagacagcuuccgagcuuaucggcaaugagcuggccauuaagaagcuccacucuuggcugaaagacuggaagcgcagagccgaacuggaggaacggcagaaccuuaaaggcaagcgcgaugagaaacaugaagacuuuagcgggggaaucgauuucaagggcuccagcgacgaugaggaggaaucuagacuguguaauaccgugcucauuacagggccgaccggagugggcaagacggcugcggucuaugccugcgcucaagagcugggguuuaaaaucuucgaaguuaacgccuccagccagcgguccggccgccagauucucucucagcugaaggaggccacccaaagccaccagguggacaaacagggagugaacucccagaagccuugcuuuuucaauucuuacuauaucggcaaaagccccaagaagaucuccagcccuaaaaaggucgugacaucucccagaaaaguuccgccucccuccccuaagagcucugggcccaaacgggcccuucccccuaagacccuggccaacuacuuuaagguguccccgaaacccaagaauaacgaagagauuggaaugcuccuggagaauaacaaaggcaucaagaauagcuucgaacaaaaacagauuacacagaccaagucuacaaacgcgaccaauagcaacgucaaagaugugggggcugaggaaccuucccgcaagaaugccacgucucugauccuuuuugaggaaguugacgugauuuucgaugaggacgccggauuucugaacgcuaucaagacauucauggccaccaccaaaagacccgucauccucacaaccagcgauccuacguuuucccugauguucgacggcuguuucgaggaaauuaaguuuagcacacccucccuccugaauguggcgucuuaccuucagaugaucugucugaccgagaacuuccggacagacguuaaagauuuugugacccuccugacagcuaauaccugcgacauuagaaagagcauccuguaucuucaauucuggauucgcuccgggggcggaguccuggaagaacggccucucacgcuguacagaggcaacucucgcaaugugcagcucguguguagcgagcaugggcuggauaacaaaaucuauccgaagaacaccaagaaaaagcgggucgaccuucccaaaugcgauuccggaugcgccgaaacacuguuuggccugaagaauauuuucucuccuagcgaggaccucuuuuccuuccugaaacacaagaucaccaugaaggaagaguggcacaaauuuauccagcuucugacagaguuccagaugagaaacguugauuuucucuacagcaaucuggaguucauucucccccugccuguggacaccauccccgagacgaagaacuucugugggccgucugugacagucgaugccuccgcugccaccaaaagcaugaauugccuugcucgcaagcauucugaacgggagcaaccucugaaaaagucccagaagaaaaagcagaaaaagacacuggugauucucgacgauagcgaccuguuugauaccgaccuugacuuccccgaucaaucuaucucccugagcuccguuagcucuagcuccaacgccgaagagucuaaaaccggagacgaagagagcaaggcgagagauaagggcaauaaccccgagaccaagaaauccauuccuugucccccuaaaacgaccgccgggaagaaaugcucugcucucgugagccacugucucaauucccucucugaauuuauggacaacaugagcuuccuggaugcccuucugacagacguccgcgagcagaauaaguauggccggaacgauuuuuccuggaccaauggaaaagugacaagcggccugugcgacgaguucucucucgaguccaacgauggguggaccagccagucuuccggagaacugaaggcugccgccgaggcucuuagcuuuacgaaguguuccucugcgaucagcaaagcccuggagacacucaauuccugcaagaaacugggcagagacccgaccaacgaucucaccuucuacguuagccagaagcggaacaauguguauuuuucucaauccgcugccaaccuggacaaugccuggaaacgcaucagcgucauuaagucuguguucagcuccagaucucuucuguacgucgggaaccggcaggcuagcaucauugaauaccugcccacacuccgcaauaucuguaagaccgagaaacugaaggaacagggaaaauccaagagacgguuucuucauuauuucgagggcauucaccuggauaucccuaaagagacagugaacacgcucgccgcggacuuucccuga

SEQ ID NO: 66158 - RNA, 1230 nt, Artificial Sequence
  derived and/or modified sequence opt5 from ATAT1__Homo_sapiens__NP_001026892
auguggcugaccuggcccuucugcuuucucacaaucacgcugagagaggaaggcgugugucaccuugagagcgucgaccugcagcaacagauuaugaccaucauugaugaacucgggaaggccuccgcuaaagcccagaaccugucugcgccuaucacaagcgcuucccggaugcagucuaaucgccauguuguguacauucuuaaggacagcuccgccagaccggccggaaaaggcgcuaucaucggguucauuaaggugggauauaaaaagcuguuuguccucgaugaccgggaggcccacaacgaaguggagccccugugcauccuggauuucuacauucaugagucuguucaacgccacggccaugggagagaacucuuucaguauaugcugcagaaggagcggguggaaccucaccagcuugcuaucgaccgccccagccaaaaacugcucaaguuccugaauaaacacuacaaccuugagaccacagucccucaggugaauaacuuuguuauuuucgagggauuuuucgcccaucagcacagacccccugcgccgucccugcgggccacccgccauagcagagcugccgcuguggaucccaccccugccgcgcccgcccggaagcucccucccaaacgcgcugaaggcgacaucaagccguauucuuccagcgauagagaguuucugaaggucgccguggaaccucccuggccucugaaucgggcuccccgcagagccacacccccugcccacccgcccccucggucuuccagccucggcaacucucccgagagagggccucugcgccccuucgugccggaacaggagcuucugcggucccucagacuguguccuccccacccuacggcucgccuucugcucgcggccgaccccggaggcagcccugcucaacggagacgcacccgggggacacccccgggacuggucgcccaguccugcuguuacucuagacauggcgggguuaauagcuccagcccuaacaccggaaaucaggauucuaaacaaggcgagcaggaaacaaagaaccgcuccgccagcgaggaacaggcucugucucaggacggcagcggggagaaacccaugcacaccgcgcccccucaagccccggcucccccugcccaguccuggacggugggaggcgauauucucaaugcccgguuuaucagaaaccugcaggaacgccggucuacaagacccugguga

SEQ ID NO: 66159 - RNA, 1116 nt, Artificial Sequence
  derived and/or modified sequence opt5 from ATCAY__Homo_sapiens__NP_149053
augggcaccacagaggccacgcugagaauggaaaacguggacgucaaggaggaauggcaggaugaggaccucccccggccucugccggaagagaccgggguugagcuucugggaagccccguggaagauacauccucuccucccaauacccucaacuucaauggcgcucaccgcaaaagaaagacacugguggccccugagaucaacauuagccuugaccaauccgaagggucucugcucagcgaugacuuucuggauacccccgacgaucuggacaucaaugucgaugacauugagacaccugaugagaccgacucccucgaguuccugggaaacggcaaugaacuugaaugggaggacgauacgccgguggcgaccgcuaaaaacaugcccggggacucugccgaucuguuuggagacggcacaaccgaagauggcagcgccgcuaaugggcggcucuggcgcacaguuaucauuggagagcaggagcauagaaucgaccugcacaugauccggccuuacaugaagguggucacccauggcggguauuacggagaaggccuuaacgccauuaucguguucgcugccugcuuucugcccgauuccagccucccugacuaucacuacauuauggagaaucuguuccuguauguuaucucuucccucgaacugcuuguggcggaggauuacaugauugucuaucugaacggggccacgccccgcagacggaugccgggaaucggcuggcucaaaaaguguuaccagaugauugaccgcagacugcggaagaaucuuaaaagccugaucaucgugcauccuucuugguuuauucgcacagugcucgcuaucuccagacccuucauuagcgucaaguuuaucaacaaaauucaguacguucacucucuggaagaucuggagcaacucaucccuauggagcacgugcagauccccgacugcgugcugcaguaugaagaggaacggcuuaaggcccgcagagaguccgcucggccccagccugaguucguccugccgagaagcgaagagaaacccgaaguggccccuguugagaaucgcuccgcgcucgugucugaagaccaagagaccagcauguccuga

SEQ ID NO: 66160 - RNA, 1557 nt, Artificial Sequence
  derived and/or modified sequence opt5 from ATE1__Homo_sapiens__NP_001001976
auggccuucugggcuggcgggagccccuccguggucgacuacuuuccuucugaggauuucuauagaugcggauacuguaagaacgaaagcggcucccggucuaaugggaugugggcccacagcaugaccguucaggacuaucaagaucugaucgaccgcggauggagacgguccggcaaauacguguauaagccggugaugaaccagacaugcuguccccaguacacgauucgcugcagaccucuccaguuucaacccucuaaaagccauaagaaaguccugaagaagaugcuuaaauuccuggcgaagggggaggugccuaaaggauccugugaagaugagcccauggacagcaccauggaugacgcuguugccggcgauuuugcccucaucaauaagcuggacauucagugcgaucuuaaaacacugucugacgauaucaaggaaucccucgagagcgagggcaagaacucuaaaaaggaggaaccucaggaacugcugcagucccaagacuucgugggggagaaacucggaagcggcgagccgucucacuccgucaaggugcauaccguucccaaaccugggaagggagcugaccugagcaaacccccuugucggaaggccaaggaaauucgcaaagagagaaagcggcuuaaacugaugcagcagaaucccgcuggcgaacucgagggguuucaggcccaaggacacccgccuucccuguuucccccuaaggcgaaaucuaaccagcccaagagccuugaagaucugaucuucgagucccuccccgagaaugccagccauaagcuggaagugcgcgucgugagaucuuccccuccgagcucucaguucaaagcuacacugcucgagagcuaucaaguguacaagcgguaccagauggucauccacaaaaaucccccugacacccccacagaaucccaguuuacccgcuuccugugcucuagcccucuugaggccgaaacgcccccgaacggcccugauuguggcuauggguccuuucaccagcaauacuggcuggacggaaagauuaucgcuguuggcgugauugauauccuccccaacugcgugagcucugucuaucuguacuaugacccugauuacuccuuccuuagccuggggguguauucugcccucagagagauugcguucacccggcagcugcaugagaaaacaucccagcugagcuacuacuauaugggauuuuacauccacuccugucccaagaugaaguauaaaggccaguaccgcccuucugaccuccugugccccgaaaccuauguuugggugccgauugagcaaugccuuccuagccuggaaaauuccaaguacuguagauucaaccaggaucccgaggccgucgacgaagaucggucuacagagcccgacagacuccagguguuucauaaacgcgcuaucaugccuuaugggguuuacaagaaacagcaaaaggacccgagcgaggaagccgcugugcugcaguacgccucccuugucggacagaagugcagcgagcggaugcuccuguucagaaauuga

SEQ ID NO: 66161 - RNA, 816 nt, Artificial Sequence
  derived and/or modified sequence opt5 from ATF1__Homo_sapiens__XP_011536689
auggaggacagccacaaguccaccacaucugaaacggcuccccagccuggcagcgccgugcaaggggcccauaucucccacauugcgcagcaggucucuagccuguccgagucugaagagagccaggauuccagcgacucuaucggauccagccaaaaagcucauggcauucucgccagacggccgucuuaccgcaagauccugaaagaucuuuccagcgaagacaccagagggcggaagggagauggcgagaacucugggguuuccgccgcugugacaagcauguccgugcccaccccuauuuaucagacaucuagcggacaguacaucgccaucgcucccaauggcgcccugcagcucgcguccccuggcaccgacgggguccaaggacugcagacacuuaccaugacgaacagcggcucuacccagcaggggacaaccauucugcaauaugcccagacauccgauggacagcaaauccucgugcccagcaaucagguugugguccagaccgcuucuggcgacaugcagacguaccaaauucgcacaaccccuagcgccacaucccugccgcagaccgugguuaugaccucucccgugacacugacgagccagaccacaaaaaccgaugacccucagcucaagagagagauccggcugaugaagaaccgcgaagcugccagagagugccggcgcaaaaagaaagaauaugucaagugucuugagaauagaguggcggugcuggagaaccaaaauaaaacacucauugaggaacugaagacccuuaaggaucuguacuccaacaaaagcgucuga

SEQ ID NO: 66162 - RNA, 1518 nt, Artificial Sequence
  derived and/or modified sequence opt5 from ATF2__Homo_sapiens__NP_001243019
augaaguucaaacugcacgugaacagcgccagacaguacaaggaccucuggaauauguccgaugacaaacccuuucugugcaccgcuccuggcugugggcaacgguucacaaacgaggaucaucuugccguccacaagcauaaacacgaaaugacgcugaaguuuggaccggcgcgcaaugacucuguuaucguggcugaucagacccccacaccuaccagauuccucaagaacugcgaggaagugggccuguuuaaugagcuugccagccccuucgaaaacgaguuuaaaaaggccuccgaggacgauauuaaaaagaugccucuggaccucucuccccuggcuacaccuaucauucggagcaaaaucgaggaaccguccgucguggaaaccacacaucaggauucuccccugccucaccccgagagcaccacguccgacgagaaggaaguuccucucgcccagaccgcucaacccacaagcgccauugugcgcccggcgucucugcaggucccuaaugugcuucugaccuccagcgauucuuccguuaucauccagcaggccgugcccagcccuacaucuuccaccgucauuacgcaagcucccagcuccaacagacccaucgugccugugccggggcccuucccucuccugcuucaucugcccaauggacagacaaugccugucgccauucccgcuucuaucaccagcuccaacguucacgugccggccgcggugccucucguccggcccgugacaaugguuccuagcgugcccggcauuccugggcccucuuccccgcagccuguccagagcgaggccaagaugcgccugaaagcugcccugacccaacagcacccucccgugaccaauggagacacaguuaagggccauggcucugggcucgugagaacgcagagcgaagagucccggccccaaucucugcagcagccggcuaccagcacaaccgaaacacccgccuccccugcccacaccacgccccagacacaaagcaccucuggacgcagacggcgcgcugcgaacgaggauccugacgagaaaagacggaaguuucuugaacgcaauagagccgcugccucccgguguagacagaaacgcaaggucugggugcagagccuggagaaaaaggccgaagaccucucuucccugaacggccagcuucaaagcgaggucacccugcuccggaaugaaguggcucagcugaagcagcugcuccuggcccacaaagauugccccguuacagcgaugcagaagaaauccggguaucauaccgcugacaaggaugacucuagcgaggauaucuccgugccuucuagcccccacacagaggccauucaacauuccagcgucucuacguccaacggagugagcucuaccuccaaagccgaagcuguugccacaagcgugcuuacccagauggcugaccagucuacagagccggcccugagccagaucgucauggcgccuuccagccaaucucagcccuccggcagcuga

SEQ ID NO: 66163 - RNA, 408 nt, Artificial Sequence
  derived and/or modified sequence opt5 from ATF3__Homo_sapiens__NP_001035709
augaugcugcagcaccccggccaagugagcgccuccgaggucucugcuagcgccaucguuccuugccucuccccgcccgggucucugguguucgaagacuuugcgaaccuuaccccuuucgugaaggaggaacugagauuugcuauucagaauaaacaucucugucaccggaugagcuccgcccuggagucugucacagugagcgaucgcccccuuggaguuuccaucacgaaggccgaaguggcuccugaggaggacgaacggaaaaagagacgcagagagcggaacaaaauugccgcugccaagugccgcaauaagaaaaaggagaaaaccgaaugucugcagaagcuccccagaccuuucuggguccagaaaacaugcaucugggcgguggauagcuguaaguga

SEQ ID NO: 66164 - RNA, 1056 nt, Artificial Sequence
  derived and/or modified sequence opt5 from ATF4__Homo_sapiens__NP_001666
augaccgagaugagcuuccuguccucugaagugcucgucggcgaccugaugagccccuuugaucaguccgggcuuggagccgaggaaucucugggccuccuggacgauuaccuugagguugcuaagcacuucaaaccucauggguuuagcuccgacaaggccaaagcgggaucuagcgaauggcuggcuguggauggccucguguccccgagcaacaauucuaaggaggacgccuucuccgggacagauuggaugcuggagaaaauggaccugaaggaauuugaucucgacgcccugcuuggaaucgaugaccuggagacgaugcccgaugaccuccugaccacacuugacgauaccugcgaccuguucgcuccucucguccaagaaacaaacaagcagcccccucagaccgugaaucccauuggccaucugccugagagccugacaaaaccggaucagguugcccccuuuaccuuccuccaaccucugccccuuucuccuggcgugcuguccagcacgcccgaccacucuuuuucccucgagcuggggagcgaagucgauaucaccgagggagacagaaagccggauuauacagcuuacguggccaugauuccucaguguaucaaagaagaggacacccccuccgauaacgacucuggcauuugcaugagcccugaauccuaucuugggagcccccagcacucucccuccacacggggaagcccuaaucgcucucugccgagccccggcguucucuguggguccgcgagaccuaagcccuacgauccucccggagagaaaaugguggccgcuaaggucaagggcgagaaacuggacaagaaacugaagaaaauggaacagaacaagaccgccgcuacgcgguaucgccagaaaaagagagccgagcaagaagcgcucacaggcgagugcaaggaacuggagaaaaagaaugaggcccuuaaagaacgggcugacucucuggccaaggagauccaguaccucaaagaucugaucgaagaggugcgcaaggcuagagggaagaaacgggugccguga

SEQ ID NO: 66165 - RNA, 849 nt, Artificial Sequence
  derived and/or modified sequence opt5 from ATF5__Homo_sapiens__NP_001277675
augagccugcucgccacccugggccuugagcuggacagagcucuccugcccgccuccgggcuuggauggcugguggauuacggcaagcucccuccggcgcccgcuccucuggcccccuaugaaguccucgggggagcccucgagggcgggcugccuguuggaggcgaaccccuugcuggcgacggguucucugauuggaugacagagcggguggacuuuacggcccugcucccucuggaaccgccccuuccucccggaacccugccucagcccagcccgacaccucccgaucucgaggcuauggccucccugcugaaaaaggagcucgaacaaauggaggacuucuuucuggaugcgccuccccuucccccuccgucucccccuccccugccucccccgccucugcccccugcccccagccugccucuuucccugcccucuuucgaccucccgcagccucccgugcuggauacccuggaccuccuggcuaucuacugccgcaacgaagccggccaggaggaggucgggaugcccccucuuccgcccccucagcaacccccucccccuagcccgccccagccuuccagacuggcucccuauccucaccccgccacaacccggggagaucgcaaacagaagaaaagagaccagaauaagagcgcggcccuccgguaccgccaaagaaagcgggcugaaggcgaggcccuggaaggggagugucagggacuugaagcucgcaacagagagcugaaagagcgggccgaaucuguggagcgcgaaauucaguauguuaaggaucuccugaucgagguguacaaagccagaucccagcggacacgcagcugcuga

SEQ ID NO: 66166 - RNA, 2103 nt, Artificial Sequence
  derived and/or modified sequence opt5 from ATF6B__Homo_sapiens__NP_001129625
auggccgagcugaugcuccugagcgaaaucgcugaccccaccagauucuuuacagauaaccuucuguccccugaggacugggauucuacgcucuacagcggccuggacgaaguggccgaggaacagacccaacuuuuccggugcccggagcaggauguccccuuugacggguccucucuggauguuggaauggacgugagcccuuccgagcccccuugggaacuccugcccauuuucccugaucugcaggucaagucugagccgagcucccccuguuccucuuccagccucucuuccgaaagcucucgccuguccacagagccuagcuccgaggcgcuuggcgucggggaagugcugcacguuaaaaccgagucucucgcucccccucugugccuucugggagacgaucccacaagcuccuuugaaaccgugcagaucaaugucauuccgacaagcgacgauucuuccgacgugcaaaccaagaucgagccuguuagccccuguucuagcgugaacuccgaagccucucuccugagcgccgacuccagcucucaggcuuucauuggcgaggagguccuggaagugaaaacggagucccucagcccuucugggugccugcuuugggaugugcccgcccccucccugggagcuguccagaucagcaugggcccuucccucgacggcucuagcgggaaggcccugccgaccagaaaacccccucuucagcccaagccuguugugcugacaaccgugcccaugccgucccgggcggucccucccucuacaaccgugcuccugcaaagccugguucagccucccccugugucccccgucgugcucauccagggagccauucgcguucagccggaaggcccugcucccagccugcccagaccugagcggaagucuaucgugccggcccccaugccugggaauagcugucccccugaagucgaugcuaaacuucugaagcgccaacagagaaugauuaaaaaccgggagagcgccugccagucucgcagaaagaaaaaggaguaucuccaaggacuggaagcgcggcuucaggccgugcuggcugacaaucagcagcuccgcagagagaacgccgcucugcggcgcagacuggaagcccuccuggccgaaaauuccgagcuuaagcugggcagcgggaaccggaaagucguguguaucaugguuuuucuccuguucauugcuuuuaauuucggacccgugucuaucagcgagccucccuccgcgccgauuagcccuagaaugaacaagggcgagccccaaccucgccggcaucugcuuggcuuuucugaacaggagcccguccaggggguggaaccgcuccagggauccagccaaggcccuaaagagccccagccuucccccacggaucagcccucuuucagcaaucugacagccuuuccugggggagcuaaggagcugcuccugagagaccuugaucagcuguuccucuccucugacugccgccacuucaaccggaccgaaagccugagacuggccgaugagcuuuccggcuggguucaacgccaucagcgggggagacgcaaaaucccgcagcgggcccaggaaagacaaaagucucagccccgcaaaaagagcccucccgugaaggcugucccuauccagcccccuggaccgcccgagcgggacuccgugggccaacuccagcuguacagacacccugaucggagccagcccgccuuucuggacgcgauugaccgcagagaagauacauucuaugugguuucuuuucggagagaccaucuccugcuuccugcuaucucccacaauaaaaccagccgccccaagaugucucuggucaugccggccauggccccuaacgagacccucuccggcagaggggcucccggagauuacgaggaaaugaugcagauugagugugaagugauggacacacgggugauccacauuaaaacgagcaccgugcccccuucucugcgcaagcaacccuccccuacaccgggcaaugccaccgggggaccccugccugugagcgcugccucccaggcgcaucaggccagccaccagccccuuuaucucaaccauccuuga

SEQ ID NO: 66167 - RNA, 2013 nt, Artificial Sequence
  derived and/or modified sequence opt5 from ATF6__Homo_sapiens__NP_031374
augggcgagcccgccgggguggcuggaaccauggaaagcccuuucuccccgggccuguuucacagacucgacgaggauugggacucugcccuguucgcggaacuuggguacuuuacagauacggacgagcugcagcucgaagcugccaacgagaccuaugagaauaacuucgauaaucuggacuuugaucuugaccugaugcccugggaaagcgauaucugggacauuaacaaucaaaucugcacagucaaggauauuaaagccgagccucagccccucuccccugcuucuagcuccuacucuguuagcagcccccgguccguggacucuuauuccagcacccagcaugugccugaggaacuggaucugucuuccagcucucagauguccccgcucagccuguacggagagaacuccaauucucuuagcuccgccgaaccccugaaggaggacaaaccugucacaggcccccgcaacaagaccgaaaaugggcucacaccuaaaaagaagauccaagugaacagcaaacccucuauucagccgaagccucugcuucugcccgcugccccuaaaacccagaccaauuccagcguucccgcgaagacgaucaucauucagacagugcccacccucaugccucuggccaaacaacagccgaucauuucucugcagcccgcuccuacaaagggacagaccguccuccugagccaacccacggugguucagcuucaggccccuggcgugcugcccuccgcucaaccgguccucgccguggcgggcggggugacacagcugccuaaccacgucguuaauguggugcccgccccuucugcuaacagccccgucaauggaaaacuuuccgugaccaagccuguucugcagagcacaaugagaaacgugggcucugacaucgccguccuccggcgccagcaaagaaugauuaagaaccgggaguccgcuugucagagccgcaaaaagaaaaaggaauauaugcuggggcuggaggccagacucaaagccgcucugucugagaaugaacagcuuaagaaggagaacggaacccugaaacggcagcucgaugaagugguuuccgagaaucaacgccugaaggugcccagcccgaaaagacgggucgugugcgucaugaucgugcuugcguucauuauccugaacuacggcccuauguccaugcucgaacaggacucucgcagaaugaaucccagcguuucccccgccaaccagcggcgccaucugcugggguuuucugcuaaggaggcccaggauaccagcgacggaaucauucagaaaaauuccuauagauacgaucacagcgugucuaacgacaaggcccucaugguccugacagaggaaccucuucuguacaucccgcccccucccugucaaccucucauuaauacgaccgagucccugcggcugaaccaugaacuuagaggcugggugcaccgccacgagguugaacggacaaagagcagacgcaugaccaauaaccagcagaaaacacggauccuccaaggcgcucuggagcaggggucuaauucccagcugauggccgugcaauauaccgagacgacaagcucuauuagcagaaacuccggaagcgaacuccaggucuacuaugcgucuccccgcuccuaccaggauuucuuugaggcuauccggagacgcggcgacaccuucuauguggugagcuuucggagagaucaucugcuucugccugccaccacacacaauaagaccacacgccccaaaauguccaucguucucccggccauuaacaucaacgaaaaugucauuaacgggcaggacuacgaggugaugaugcaaaucgauugccaggugauggacacgcggauucugcauaucaagucuagcuccgucccucccuaucugagagaccagcagcggaaucaaaccaacacauucuuuggaucuccucccgcugccaccgaggcuacacacgugguuagcaccaucccggaaucccuucaguga

SEQ ID NO: 66168 - RNA, 1389 nt, Artificial Sequence
  derived and/or modified sequence opt5 from ATF7__Homo_sapiens__NP_001123532
augggcgacgauagacccuucgugugcaacgccccuggguguggacagcgguuuaccaaugaggaccaccuggcuguccauaagcacaaacaugaaaugacacucaaguucggcccggcccgcacggauagcguuaucauugcggaccaaacccccacaccuaccagauuucugaaaaacugcgaggaaguggggcuuuucaaugagcuggcuuccucuuuugaacacgaguucaagaaagccgccgaugaggacgaaaagaaggcugccgcuggaccccucgauaugagccugccuuccacacccgacaucaaaauuaaggaggaagaaccuguggaggaagucaccccgaaacccgugcuuaucucuacaccuacccccacgauuguucggccuggcagccugccccuccaucugggguacgauccgcugcacccuacccuccccuccccuacaucugugaucacccaggccccucccagcaaccgccagaugggaucccccacaggcagccugccgcuugucaugcaccuggcgaauggccagaccaugcccgugcucccugggcccccuguucaaaugcccucugugaucucccuggccagaccggucagcauggugccuaacauucccggaaucccugggcccccugucaauucuuccggcagcauuucucccuccggacauccgaucccuagcgaggcuaagaugcggcuuaaagccacgcugacacaccagguguccucuauuaacggcggguguggaaugguugugggcaccgcuagcacaauggugaccgcccgccccgaacagucccagauccucauucaacaucccgacgcgccuagcccggcccagccccaggucucuccugcucagcccaccccuuccacaggcgggagacggcgcagaacgguggaugaggaccccgaugaacggcgccaaagauuucuggagcggaaucgcgccgcugccagcagaugccggcagaagagaaagcuguggguuucuagccucgagaaaaaggccgaggagcugaccucccagaacauccaacuuucuaaugaagugacacugcuccgcaacgaggucgcucagcugaaacagcuucugcucgcgcacaaggacuguccugugaccgcccugcagaaaaagacacaaggauaucuggaaagccccaaagaguccagcgagccgaccggcucuccugcucccguuauccagcacuccagcgccacggccccuucuaaugggcucuccgugcggagcgcugccgaagcggucgcuacauccgugcugacccagauggccucucagagaaccgagcuuagcaugcccauucaaucccaugucaucaugacaccgcagucucagagcgccggacgcuga

SEQ ID NO: 66169 - RNA, 3318 nt, Artificial Sequence
  derived and/or modified sequence opt5 from ATF7IP__Homo_sapiens__NP_001273444
auggacagccuggaggaaccccagaagaaaguguucaaggccagaaaaaccaugcgggucuccgaucgccaacagcucgaggcuguuuacaaggugaaagaggaacugcuuaagacagacgugaagcugcucaacggcaaucacgaaaacggggaucuggacccuacgucuccgcuugagaauauggauuauaucaaagacaaggaggaagucaacggaauugaggaaaucugcuuugaucccgagggcagcaaagccgaguggaaggaaaccccuuguauucuguccgugaauguuaaaaacaagcaggacgaugaccucaauugcgagccccugucuccucauaacaucacacccgaaccugugagcaagcugccggcggagcccgucuccggggauccugcucccggagaccucgaugccggcgacccugccucuggggugcuggcuagcggagacuccaccagcggcgaucccacaucuuccgaaccgucuagcuccgacgccgcuagcggcgaugccaccucuggggacgcgccuuccggagauguuagccccggcgacgccacauccggggaugcuaccgccgacgaucuuucuagcggagacccuacguccagcgaucccauucccggcgagccugugccggucgagcccaucucuggggacugugcugccgacgauaucgcguccagcgaaauuaccucuguggaccuggccagcggagcuccugccuccacagaucccgcuucugacgaucucgccagcggcgaccuguccagcucugagcuugccuccgaugaccuggcuaccggcgaacucgcgagcgaugagcugacaucugaauccaccuucgacagaacguuugagccuaaaagcgugcccgucugcgagccgguuccugaaaucgauaauauugagcccuccucuaacaaggacgaugacuuccuggaaaagaauggggccgacgagaagcucgaacagauccaaagcaaagauucccuggacgagaagaacaaagcugauaauaacauugacgccaaugaggaaacacuugagaccgaugacacaaccaucuguucugaucggccucccgaaaacgagaagaagguggaggaagacauuaucaccgagcuggcccucggagaagaugcuaucagcuccagcauggagauugaccagggcgagaaaaacgaagaugagacaucugccgaccugguggaaacgaucaaugagaacgucauugaagauaauaaguccgagaacauccuugaaaauaccgacagcauggagacagacgagauuaucccuauccuggaaaaacucgcgcccucugaggaugaacugaccugcuuuuccaagacaagccugcucccgauugacgagaccaacccugaucuggaagagaaaauggagucuagcuucgggucccccagcaagcaggaaucuuccgagagccuucccaaggaggcuuuucuggugcucuccgacgaagaggauaucucuggagaaaaagacgagagcgaaguuauuucccagaaugagacguguucuccugaaguggagagcaacgagaaggauaauaaaccggaagaggaggaacaagucauccacgaagacgaugagcgccccuccgagaagaacgaguucucuagacggaaacgcagcaaguccgaagacauggauaaugugcagagcaagagacggcgcuacauggaagaggaauaugaggccgaguuucagguuaaaauuacagccaagggcgacaucaaccagaaacugcaaaaggugauccaguggcuucuggaagagaaacucugcgcucugcagugugccgucuucgacaagacccuggcugaacucaagaccagaguggagaaaauugagugcaauaagcggcauaaaacaguccugaccgaacuucaagccaagaucgcgcgccugacaaaaagauuugaggccgcuaaggaagaucucaaaaagcggcacgagcauccucccaacccucccgugucuccugggaagacgguuaaugacgugaacuccaacaauaacaugagcuaccgcaaugccggaaccgucagacagaugcuggaaucuaaacggaacguguccgagagcgcucccccgucuuuccagacaccuguuaauaccguguccagcacaaaccuggucacacccccugccgugguguccagccagcccaaacuucaaacgccgguuaccucuggcagccucacagcgaccuccguccugccugcccccaauacagcuaccgugguggccacgacacaggucccuucuggcaacccccagcccaccauuagccugcagccucucccggugauccugcacguucccguggcugucuccucucaaccucagcuucugcagagccaccccgggacacucgugaccaaucagccuuccggaaacguugaguuuauuucugugcaaagcccucccaccgucuccggccugaccaaaaauccggugagccugcccucucuuccuaaccccacgaagccuaauaacguucccuccgugccgagcccuucuauccagagaaaucccaccgccuccgccgcuccccucgggacaacccuggcgguccaggccgugccuacagcucauagcauugugcaggccacccgcacgucccugcccacagucggaccuucuggccucuauagcccguccaccaaccgggggcccauccaaaugaaaaucccuauuagcgccuucucuaccuccagcgcugccgaacagaacucuaauacaacccccagaaucgagaaccagacaaauaagacgauugaugcgagcguuuccaagaaagcugccgacucuaccagccaauguggcaaggccacaggauccgauucuagcggcgugaucgaccugaccauggaugacgaagaguccggggcuagccaggauccuaaaaagcugaaccacacacccgugucuaccauguccagcucccagccggucucucgcccucuucagcccauucaaccugcgcccccucuccagcccagcggagugccgacguccggcccuucucagaccacaauccaucugcugcccaccgcccccacaaccguuaaugugacacaccggccugucacccaggugacgacaagacuuccgguuccccgcgcuccugccaaccaccaaguggucuacaccacccuccccgccccucccgcucaggccccucugcgggggacagugaugcaggcuccggccguuagacaggugaauccccaaaacagcaaacgcuucuuucuguauauggcgccucgguacauguga

SEQ ID NO: 66170 - RNA, 663 nt, Artificial Sequence
  derived and/or modified sequence opt5 from ATG10__Homo_sapiens__XP_005248667
auggaggaagacgaguucaucggcgaaaagaccuuucagagauacugcgccgaguucauuaaacacagccaacagaucggggauuccugggaauggcggcccucuaaggacuguagcgauggauauaugugcaaaauucauuuucagaucaagaacggcuccgugaugucucaccugggggcuagcacacauggacagacgugucucccuauggaggaggccuucgaacugccgcuugacgauugcgaggucauugaaaccgcggcugccuccgagguuaucaaauacgaguaucacgugcuguacucuuguagcuaucaagugcccguccucuacuuucgcgccuccuuccuggacggcagaccucuuacacugaaggauaucugggaaggggugcaugagugcuauaagaugcggcuccugcagggacccugggacaccauuacacagcaggaacacccuauccugggccaacccuuuuucguucuccacccuuguaaaaccaaugaguuuaugacaccggugcugaagaacagccagaaaauuaauaagaacgucaauuacaucaccucuuggcuuuccauugugggccccguuguggggcugaaccucccucugagcuacgcuaaagccacgucucaggaugaacgcaauguccccuga

SEQ ID NO: 66171 - RNA, 225 nt, Artificial Sequence
  derived and/or modified sequence opt5 from ATG12__Homo_sapiens__NP_001264712
auggccgaggaaccccagagcgugcugcaacucccuaccuccaucgcugccggcggggagggacugacagacgucucuccggaaacgaccacacccgagccucccagcuccgcggcuguuucuccuggcaccgaggaacccgccggggauacaaagaaaaagauuuaccuuugcgagagcgugcuguguuccuucccuagaccgcggucuuggaacagccucuga

SEQ ID NO: 66172 - RNA, 1767 nt, Artificial Sequence
  derived and/or modified sequence opt5 from ATG16L1__Homo_sapiens__NP_060444
augagcuccggccugagagccgcugacuucccccgguggaagcgccacaucucugagcagcucagacggcgcgauagacugcaacggcaggccuuugaagagauuauccuucaguacaacaaacugcucgaaaagagcgaccugcauuccgugcuugcgcagaaacugcaagcugagaagcacgaugucccuaaucgccaugaaauuucuccggggcacgacggaaccuggaacgauaaucagcuccaggagauggcccagcugagaaucaaacaucaagaggaacugacagagcuccacaagaagcggggcgaacuggcccagcuuguuauugaccugaacaaucagaugcagcgcaaagauagagagaugcaaaugaacgaggcuaagaucgccgaaugccuccagacgaucagcgaccuggagaccgaaugucuugaucugcggacaaaacucugcgaccuggagcgcgcuaaucagacccugaaggaugaauaugacgcccuccaaauuacauucaccgcgcuggaggggaaacuuagaaagacaaccgaggaaaaccaggagcuggugacgcgguggauggccgaaaaggcucaggaggccaaucgccucaacgcugaaaaugagaaagauuccagacggagacaggcccgccugcaaaaggagcuugcggaagccgcuaaagagccccugccuguggaacaggacgacgauaucgaggucauuguggacgaaaccucugaucacacagaggagaccagccccguucgggccaucuccagagcugccacacgccggagcgugucuuccuuuccugucccccaggacaacguggauacccauccuggaagcggcaaggaaguuagagugccggccacggcucucugugucuucgacgcgcacgauggggaggugaaugccgugcaguuuucucccggaucccgccugcuggcuacaggcggcauggaccggagagucaaacucugggaaguuuucggggagaagugcgaguuuaaaggaagccugucuggcuccaacgccgggauuaccagcaucgaguucgauuccgccggaucuuaccuucuggcugccagcaaugacuuugcgucccgcauuuggacaguggaugacuaucggcucagacauacccugaccggccacagcgggaaggugcuuucugcuaaguuccugcucgacaacgcccgcaucgucuccggaagccacgaucggacacugaaacugugggaccucagaucuaagguguguaucaaaacgguuuuugccggcagcuccugcaacgauauuguguguaccgaacaaugcgucaugucuggccauuucgacaagaaaauccgguuuugggauauucgcagcgaauccaucgugagagagauggaacugcuugggaagauuacagcucuggaccucaauccugagcggaccgagcugcugagcuguucuagagaugaccuucucaagguuaucgaucugcgcacaaacgccaucaaacagaccuucuccgcucccggauucaagugcggcagcgacuggacgcggguggucuuuucuccugauggguccuacguggccgcgggaagcgccgaaggcucccuguauauuuggucuguccucacagggaaaguggagaagguucugagcaaacagcacuccucuagcaucaaugcuguggccuggucccccagcggaucucaugucguguccguugacaagggcuguaaggcugugcuuugggcccaguacuga

SEQ ID NO: 66173 - RNA, 6237 nt, Artificial Sequence
  derived and/or modified sequence opt5 from ATG2B__Homo_sapiens__NP_060506
augcccuggccuuucagcgaauccaucaagaaacgcgcuugccgguaccugcuccagcgcuaucugggccacuuucuucaagaaaagcugucucucgaacagcugagccuugaccuguaccaggggaccggaucccucgcucaggucccgcuggauaaauggugucugaacgaaauucucgagucugccgacgcgccccuggaagucaccgagggcuucauccaaagcauuucccuuucuguuccuugggggagccugcuccaggauaacugcgcucuggaggugagaggacuugaaaugguguuucggccccgcccuagacccgccacgggcuccgagccuauguauuggagcucuuucaugaccuccagcaugcagcuggccaaggaaugucucucucagaaacugacagacgagcaaggggagggaucccagccguuugaaggccuggagaaguucgcugaaaccaucgagacaguccuccggcgcgugaagguuaccuuuauugauacagugcugagaaucgaacacguccccgagaacagcaaaaccggcacggcccuugagauccggauugaacgcaccguguacugcgacgagacagcugaugaaucuuccgggaucaauguucaccagccuaccgccuucgcgcauaagcugcuccagcugagcggagugucccucuuuugggacgaguucucugccagcgcuaaauccagccccgucuguucuacagccccuguggaaaccgagcccaagcuguccccgagcuggaacccuaaaauuaucuaugagccccacccucaacucacgagaaaucugcccgaaauugcucccucugauccugugcagaucggccggcugauugggcgccucgagcugagccuuacacugaagcagaacgaaguccucccgggagccaagcuggacguugauggccaaaucgacuccauccaucuucugcucucucccagacaggugcaucugcugcucgauaugcuggcggccauugcugggccugagaauagcuccaaaaucggacuugccaacaaggaccggaaaaaucgccccaugcagcaggaagacgaguaccgcauucaaauggagcugaaccgguauuaccucagaaaggauagccugucugugggcgucuccagcgaacagucuuuuuacgagaccgaaacagcucgcaccccuuccagccgggaggaggaaguguucuuuuccauggccgacauggauaugucucacagccuguccucucuucccccgcucggcgacccucccaauauggaucuggagcugagccucaccuccacauauacgaacaccccugccgggagcccccugucugcuacaguucuucagccuaccuggggagaguuccuggaccaucacaaagagcagcccgugagaggcuccacauucccgagcaaucucguccauccuacaccccugcaaaagacgucucugcccucccgcagcgugucuguugaugaaagccggccugagcuuaucuuuagacucgcgguggggacauucuccauuagcguccugcacaucgacccgcugucucccccugagaccucccagaaccucaauccccugaccccuauggccguggccuuuuucacaugcaucgagaaaauugaucccgcccgcuuuagcaccgaggacuucaaguccuuucgggccgucuucgcugaagccuguucucacgaucaucuuagauuuaucggaacaggcauuaaggugagcuacgagcagcgccagcgguccgcgucuagauauuucagcacggacauguccaucgggcaaauggaauuucuggagugccucuucccuaccgacuuucacucuguucccccgcauuacacagagcugcugaccuuccacagcaaagaagagacaggaucccauagcccugugugucuucagcuccacuauaagcacucugaaaaccgcggcccccagggcaaccaggcucggcuguccagcgucccucauaaagccgagcugcaaauuaagcucaaucccgugugcugugaacuggauaucucuaucguugacagacuuaacucccugcuccagccgcagaaacuggccaccguggagaugauggcuagccacauguacacgucuuauaauaagcauauuucccugcacaaggccuucaccgaggucuuucuugaugacagccacuccccugcuaacugccggaucagcgugcaaguggccacacccgcgcucaaucugucuguucgcuucccuauucccgaucugagaagcgaccaggaacgggggcccugguuuaaaaagucccuccagaaagagauccuguaccuugccuucaccgaucuggaauuuaagacagaguucauuggaggcucuaccccugagcagaucaaacucgaacugacguuuagagagcugauugggagcuuccaagaagagaagggagacccguccaucaaguuuuuccaugucucuagcggcguggauggggacacaaccuccucugaugacuuugauuggccccgcaucgugcuuaaaauuaacccucccgcuaugcacagcauccuggaacggauugccgcugaggaggaagaggaaaaugacggccauuaccaggaggaagaggagggaggcgcccacucccucaaggacgucugcgaucugagacgcccugcgcccagcccuuucucuuccagacgggugauguuugaaaacgagcagaugguuaugccgggggaccccguggaaaugacagaguuccaggauaaagccaucagcaauucucauuauguccucgaacugacccuuccuaacauuuacgugacccugcccaauaaguccuucuaugagaaacucuacaaccgcaucuuuaaugaccugcugcuuugggagccuacagcucccagcccgguugaaacguucgagaacaucuccuauggaauuggccugucuguggccagccaacucaucaauaccuuuaacaaggauuccuucagcgcuuuuaagucugccguccacuacgacgaagaguccgggagcgaggaagagacacugcaguauuucucuaccguggauccuaacuacagaagccggcgcaaaaagaaacucgacucccagaauaagaacucucagagcuuucuguccguucuucugaauauuaaccacggacucaucgccguguucacagaugucaaacaagacaauggcgaucugcuggaaaacaagcauggggaguuuuggcuugaguucaauucuggcagccuguuuugugugaccaaauacgaaggauucgacgauaagcacuauauuugccuccauuccagcucuuucucccuguaccacaagggcaucgugaacggggucauccuccccacggagacaagacugcccagcuccacccggccucauuggcuugaacccaccauuuauucuagcgaggaagacggacuguccaaaacaucuagcgacggcguugggggagauucccugaauaugcucagcguggcugugaagauccugucugacaaauccgagagcaacaccaaggaauuucuuauugcggucggccugaaaggggccacacuccagcaccgcaugcugccuucuggccucuccuggcacgagcagauccuguacuuccuuaauauugcugaugagccggugcugggauauaaucccccuacgagcuuuaccacauuccauguucaccuguggucuugugcccucgacuacagaccccuguaucuuccuauccggagccugcucaccguggaaacauuuuccgucucuagcuccguggcccuggauaagagcuccucuacccuccgcaucauucuggacgaggcugcccuucaucugagcgauaagugcaauacgguuaccaucaaccuguccagagacuacgugcgggucauggauaugggccuccuggaacuuacaauuaccgcggugaaaucugacagcgauggggagcaaacagaacccagauucgagcugcacuguuccucugacguugugcacaucagaaccugcagcgacuccugugcugcccucaugaaucugauucaguacaucgccagcuauggagaucuccagacaccgaacaaggcugacaugaaaccuggcgccuuucagcggagaucuaaggucgauuccagcgggagaucuuccagccggggacccgugcugccugaggcggaccaacagaugcuuagagaucugaugucugacgcuauggaagagauugauaugcagcagggcaccuccagcgugaaaccccaagccaacgggguccuggacgaaaagucccagauccaggagccuugcuguagcgaucucuuccuguuucccgacgagucuggcaauguuagccaggaauccggaccgacguacgccucuuucagccaucacuuuaucuccgaugcuaugacaggcgugccuaccgagaacgacgauuucugcauucuuuuugcccccaaggcugccaugcaagaaaaagaggaagaacccgugaucaagauuauggucgacgacgcgaucgugauucgcgauaauuauuucucucugccuguuaacaaaaccgacacaagcaaggccccgcuccauuuccccaucccugugauccgguacgucgugaaagagguuucccugguguggcaccuguaugggggaaaggauuuuggcaccgugcccccuacgucucccgcuaagagcuacauuuccccucauagcucuccgucccacacacccaccagacacgggcgcaauacaguguguggaggcaaaggccggaaccaugacuuccucauggaaauccagcuuagcaaggucaaauuucagcacgagguguauccucccugcaagccugauugcgacucuucccugagcgaacaucccguuuccagacagguguucauuguccaagaucuggagauccgggaccgccucgccaccucucagaugaauaaauuucuguaccuuuacuguagcaaggaaaugccgagaaaagcucacuccaacaugcugacagugaaggcccuccacguuugcccugagagcgggcggucuccccaggaguguugccugcgcgugucccugaugccccucagacuuaauauugaucaagacgcccuguucuuucugaaggauuucuuuaccagccucucugcugaagucgagcugcagaugacgccugaccccgaagugaaaaagagcccuggagcggaugugaccuguucccuuccgcggcaucugucuacaagcaaagagcccaaccucguuaucuccuucucuggcccuaagcagcccagccagaaugacuccgccaacagcgucgaaguggugaaugggauggaggagaaaaacuuuucugcugaagaggccuccuucagagaccaaccugucuuuuuccgcgaguuccgguuuaccagcgaggugcccaucagacuggauuaucacggaaagcauguuuccauggaccagggcacacuggccgggauucucaucggacuugcucagcugaauugcucugagcugaagcucaaacgccugagcuaccggcacggccuucugggcguggauaaacuuuucuccuaugccauuaccgaauggcugaacgacaucaagaagaaccagcugccggggauucucggaggcgucgggccuaugcauucucuugugcaacugguucagggacugaaagaucucguguggcugcccaucgagcaguacagaaaggacggccgcauuguccggggguuucagagaggagcggcuagcuucggcacguccacagccauggccgcucuugaacugaccaaucgcauggugcaaacaauccaggccgcggcugagaccgccuaugauaugguuagcccuggcacccucucuaucgaacccaagaaaacaaagagauuuccucaccaccggcuggcccaucagcccguggaccugcgcgagggggucgcuaaagccuacuccguggugaaggagggaauuacggauaccgcucaaacaaucuaugaaaccgccgcgagagagcacgaaagccggggcgucacaggggccguuggagaggugcuccgccagauuccgccugcuguggucaaaccccuuaucguggccaccgaagcuacgucuaacguucugggcgggaugagaaaucagauucggcccgacgugagacaggaugagucccaaaaguggcgccauggagacgacuga

SEQ ID NO: 66174 - RNA, 945 nt, Artificial Sequence
  derived and/or modified sequence opt5 from ATG3__Homo_sapiens__NP_071933
augcagaacgugaucaauaccgucaagggcaaagcccuggagguugcugaauaccucacacccgugcugaaggagagcaaauucaaggaaacgggggugauuaccccugaggaauuugucgccgcgggagaccaccuugugcaucacugcccgacauggcaaugggcuaccggcgaggagcugaaaguuaaggccuaucuccccacagggaagcaguuccuggugaccaaaaacgucccuuguuacaagagaugcaaacagauggaauauuccgaugagcuugaagccaucauugaggaggacgauggagacggcggguggguggauacauaccauaauaccggaaucacgggcauuaccgaagcuguuaaggagaucacacuggaaaacaaagacaauauccggcuccaggauuguucugcccugugcgaggaagaggaggacgaagaugagggcgaagcugccgacauggaggaauaugaggagagcgggcugcucgaaaccgaugaggcgacacuggacacccgcaagauuguggaagccuguaaggcuaaaacggaugccggaggcgaggacgcuauccuucaaacaagaaccuacgaccuguauauuacauacgauaaguacuaucagacaccccggcucuggcuguuuggguacgacgaacagcgccagccucuuaccgucgagcacauguaugaggauaucucccaagaccaugugaaaaagaccgugacgauugaaaaccacccccaucugccuccgcccccuaugugcucuguccaccccuguagacacgccgagguuaugaaaaagaucauugaaaccguggcggagggaggcggggagcucggagugcauauguaccugcugaucuuccucaaauuuguccaggccgugaucccuacaauugaauaugauuacacccggcacuucacaauguga

SEQ ID NO: 66175 - RNA, 1197 nt, Artificial Sequence
  derived and/or modified sequence opt5 from ATG4A__Homo_sapiens__NP_443168
auggagagcgugcuguccaaguacgaagaccagaucaccauuuucacagauuaucucgaggaauaccccgacacggaugagcuggucuggauccuuggcaaacaacaucugcucaagaccgaaaaaucuaagcugcuuagcgacauuuccgccagacugugguuuacauaucggcgcaaauucucuccuaucgggggaaccggcccgagcuccgaugcuggguggggaugcaugcucagauguggccagaugaugcuggcccaggcgcugauuugccggcaccucgggcgcgacuggucuugggagaagcagaaggagcaacccaaagaauaccagagaauccugcaguguuuucuugaucggaaggacugcuguuauagcauccaccagauggcucaaaugggaguuggcgagggcaaauccauuggggaaugguucggaccuaacacaguggcccaggugcugaagaaacucgcccuguuugaugaguggaauagccuugcugucuacgugucuauggacaacaccguugugaucgaggauauuaagaagaugugccgcguccugccccucuccgccgacacagcuggcgauagaccucccgacagccugaccgccucuaaucaguccaaagggacgagcgcguauuguucugccuggaagccucugcuccugaucgugccgcuucggcugggaauuaaccagaucaaucccguuuacguggacgcuuucaaagaaugcuuuaagaugccucaaucccucggcgcccuugggggaaaacccaacaaugcuuacuauuucauuggcuuucugggcgaugagcugaucuuccucgacccucauaccacacagaccuuugucgauacagaagagaacgggaccgugaaugaccagacguuccacugucugcaaagcccccagcgcaugaacauccugaaucucgauccguccguggcccugggauuuuucugcaaggaagagaaagacuucgauaacugguguucucuuguccagaaggagauucugaaggaaaaucucagaauguuugagcugguucagaaacauccuagccacuggcccccuuucgugccucccgcgaagcccgaagugacaaccacaggcgccgaguuuaucgacuccaccgaacaacuugaggaguucgaucuggaagaggacuuugaaauucucagcgucuga

SEQ ID NO: 66176 - RNA, 1182 nt, Artificial Sequence
  derived and/or modified sequence opt5 from ATG4B__Homo_sapiens__NP_037457
auggacgccgcuacccugacauacgauacgcucagauucgccgaguuugaagacuuccccgagaccagcgaaccuguguggauccugggccggaaguauuccauuuuuacagagaaagaugaaauccuuucugacgucgcgagccgccugugguucaccuacagaaagaacuuuccggcuauugggggaacaggccccaccuccgauacaggguggggaugcaugcuccgguguggccagaugaucuucgcccaagcccugguuugccgccaccuugggagagacuggcgguggacccagcgcaaaagacagccugauucuuauuuuagcgugcugaaugcuuucauugaccggaaggauuccuacuauucuauccaucagaucgcccaaaugggagugggcgagggcaaaagcauugggcagugguacggacccaacacggucgcucaggugcucaagaagcuggccguuuuugacaccugguccagccuggcggugcacaucgccauggauaauacagucgugauggaggaaauucgcagacucugucggaccucuguuccuugcgcuggcgccacagcuuuccccgccgacuccgaucgccauuguaacggguuuccugcgggagccgaggugaccaauagaccgagccccuggcggccucugguccuucugaucccccuccgccugggccuuacggacauuaacgaggcuuauguggaaacacugaaacacugcuucaugaugccucagucucucggggugaucggaggcaagcccaauuccgcccauuacuuuauuggcuacgucggggaggaacugaucuaucuggacccgcacaccacacaaccugcuguugagcccaccgauggauguuucaucccugacgagagcuuccacugccagcauccucccuguagaaugucuauugccgaacucgaucccuccaucgccgugggcuuuuucugcaaaaccgaagacgauuuuaacgacuggugucaacaggugaagaaacugagccuucucgggggagcucugccgauguucgagcuggucgagcuucagcccucccaccuggcgugcccugaugugcucaaucugucucuggacagcuccgauguugaacggcucgagagauuuuucgacagcgaagaugaggacuuugaaauucugucucuuuga

SEQ ID NO: 66177 - RNA, 1272 nt, Artificial Sequence
  derived and/or modified sequence opt5 from ATG4C__Homo_sapiens__XP_011540615
auggaggccaccggcacagacgaaguggauaagcugaaaacgaaguucaucagcgcuuggaacaauaugaaauacuccuggguccucaagaccaaaacauauuuuucuagaaacagccccguucugcuucuggggaagugcuaccacuucaaguaugaggacgaagauaaaacccucccugccgaguccggauguacaauugaagaccaugugaucgcgggcaauguggaggaguuucggaaggauuucauuucucgcaucuggcugaccuacagagaagaguuuccgcagauugaagggagcgcucuuacaaccgacugcggauggggcuguacgcugcggaccgggcaaaugcuccuggcccagggacugauccuccacuuccugggccgcgccuggacauggcccgaugcucuuaacaucgaaaauuccgacucugagagcuggaccucccauacagucaaaaaguuuaccgccagcuucgaggcuucucuguccggcgagagagaauuuaaaacgccuacaauuagccucaaggagaccaucgggaaguauucugaugaccacgaaaugcggaacgagguguaccaucgcaaaauuaucuccugguucggagauagcccccuggcccuuuuuggccugcaccagcucauugaguaugggaagaaaucuggaaagaaagcgggcgacugguacgggccugccguuguggcucacauccugagaaaggccgucgaagaggcucggcaucccgaucugcagggaauuacaaucuacguggcccaagacugcaccguuuauaauuccgacgugaucgauaaacagagcgcguccaugaccucugacaacgccgaugacaaggcugucauuauccucgugccugugcgccugggcggcgaaagaacaaauacggauuaccuugaguucgucaaggggauucugagccucgaauauuguguuggaaucauuggcgggaaaccgaagcaguccuacuauuuugccggauuccaggacgauagccugaucuacauggacccccacuauugccaaucuuucguggauguguccaucaaagacuuuccucuugagaccuuccauugucccagcccuaagaaaaugucuuuucggaagauggaucccagcugcacaauuggcuucuacugucgcaacguccaggacuuuaagagagcuuccgaggaaaucaccaaaaaucagauuaugaucaaggccgccauuaucaacauccacgugcaggacuucauguggacauga

SEQ ID NO: 66178 - RNA, 828 nt, Artificial Sequence
  derived and/or modified sequence opt5 from ATG5__Homo_sapiens__NP_001273035
augaccgacgauaaggacgugcugagagaugucugguucggccggauccccacaugcuuuacgcucuaccaggacgagauuaccgaacgcgaggccgaaccuuauuaccugcuucugccgagaguuagcuaucucacacuggugaccgauaaagugaagaaacacuuccaaaaggucaugcggcaggaggacaucuccgaaauuugguuugaguacgaggggacaccccuuaaauggcauuauccuaucggacuccuguucgaucugcuggcuucuagcuccgcccuccccuggaacauuaccgugcacuuuaagucuuucccugaaaaggaccugcuucauugucccagcaaagaugcgaucgaggcucacuuuauguccugcaugaaggaagccgacgcccugaaacauaagucucagguuaucaaugagaugcagaaaaaggaucacaagcaacucuggaugggccugcagaacgaccgcuucgaucaguuuugggcuauuaauagaaaacuuauggaguacccugccgaagagaacggguuccgguauaucccguuucgcauuuaccagacaaccacggaaagacccuucauccaaaagcuguuucggccuguggcugccgacggacagcuccacacccugggcgaccugcucaaagaggucugucccagcgcgauugauccugaagacggggagaagaaaaaucaggugaugauccauggaauugagcccaugcuggaaacaccgcuucaguggcuguccgagcaccucagcuacccugauaacuuccugcauaucucuaucauuccccaaccuaccgacuga

SEQ ID NO: 66179 - RNA, 2031 nt, Artificial Sequence
  derived and/or modified sequence opt5 from ATG7__Homo_sapiens__NP_001129503
auggccgcugccaccggcgaccccgggcugagcaagcuccaguucgcgccuuuuuccucugcucuggaugugggauucuggcacgagcuuacacagaaaaagcugaacgaauacagacucgacgaggccccgaaagauaucaagggcuauuacuauaauggggacagcgccggacugcccgcucggcuuacgcuggaauuuuccgccuucgauaugucugcuccuacccccgcccgcugcuguccugcgauuggcacacucuacaacaccaauacacuggagagcuuuaaaaccgccgacaagaagcugcuccuggaacaagcugccaacgagaucugggaguccauuaaaucugggacagcucuugaaaaucccguccugcucaacaaguuccugcuucugaccuuugccgaucucaaaaaguaucauuucuacuauugguuuugcuacccugcgcugugucugccggagagccucccccugauccagggaccuguuggccuugaccagagauucucccugaaacaaauugaagcccucgagugcgcuuacgauaaucugugucagacggagggcgugaccgcccuucccuauuuucugaucaaguacgacgaaaacauggugcucgucagccugcugaagcacuauucugauuucuuucaggggcagcggacaaaaaucaccauuggaguguacgacccuugcaaucucgcucaauaucccggcuggccgcugcgcaacuuccuuguucuggccgcccauagaugguccagcucuuuccaguccguggaggucguguguuuucgggaucgcacaaugcagggggcuagagacguugcgcacagcaucauuuucgaagugaagcucccugagauggccuuuucucccgacugcccuaaagcugucggaugggaaaagaaucagaaaggcgggaugggaccccggauggugaaccuguccgaguguauggaucccaagcgccuugccgagagcuccguggaccugaaucucaaacugaugugcuggagacuggucccuacccucgaucuggacaagguugugucugugaagugucuucugcucggcgccggcacgcuggggugcaacgucgcucggacacugaugggauggggcgugcgccauaucaccuucguugauaaugccaaaauuagcuacuccaacccggugagacaaccccuuuaugaauuugaggacugccucgggggaggcaagccuaaagcgcuggcugccgccgaucggcugcagaagaucuuccccggggucaacgcucgcggauuuaauaugagcauuccuaugcccggccacccggugaacuucucuuccguuacacucgaacaggccagacgggacguggagcaacuggaacagcuuaucgagagccacgaugucguguuucugcucauggacaccagagagucucgcuggcugccugcugucaucgccgcgagcaaacggaagcuggugauuaaugccgcucuuggcuucgauaccuuuguugugaugagacaugggcucaagaaacccaagcagcagggagccggcgaccuguguccuaaccaccccgucgcuuccgccgaccugcucgggucuagccuguucgcgaauaucccuggauacaaacuuggcugcuacuuuuguaacgaugugguugcccccggggacuccacacgcgaucggacgcuggaccaacagugcaccgugagcagaccgggccucgcugucauugccggagcucuggccguggaacugauggugucuguucuucagcauccugagggcggguaugccaucgcuuccagcucugaugaccgcaugaaugaaccucccacaucccucggacuggucccccaccaggugcuggaucaauacgagcgggaaggcuucaacuuccucgcgaagguguuuaauagcucccacucuuuccuggaggaccuuaccgggcugacacuccugcaucaggagacccaggccgcugaaauuugggauaugagcgacgaugagacgaucuga

SEQ ID NO: 66180 - RNA, 2520 nt, Artificial Sequence
  derived and/or modified sequence opt5 from ATG9A__Homo_sapiens__NP_001070666
auggcccaguucgacaccgaguaccaaagacuggaagcuagcuauuccgauucucccccuggcgaggaagaccuccuggugcacgucgccgaggggagcaaguccccguggcaucacaucgaaaaccuugaucuguuuuucucucggguuuacaaucuccaucagaaaaacggauuuacaugcaugcugauuggcgagaucuucgagcuuaugcaguuucuguucgugguggcguuuacgaccuuccucgucagcuguguggacuaugauauucuguuugcuaauaagaugguuaaccacucccugcaucccacagaaccugugaaagucacccuccccgacgccuuccugccugcccaggugugcucugcucgcauccaagagaaugggagccuuauuacaauccugguuaucgccggaguguuuuggauucacagacucaucaaguucauuuacaacaucuguugcuauugggaaauucacuccuuuuaccugcaugcccuucggauccccaugagcgcucugccuuauuguaccuggcaggagguccaggcgcgcauugugcagacacaaaaagagcaccagaucugcauccauaagagagaacucaccgagcuggauauuuaccaccggauccugcgcuuccagaauuacaugguggcccucgucaacaagucucugcuuccgcugagauuccggcuccccggccugggggaagcuguguuuuucacgcgcggacuuaaauauaauuuugagcugauucucuucuggggcccuggcucccuguuucugaacgaauggagccucaaggccgaguacaaaagagggggacagcggcuggagcuugcucaacgccugucuaauagaauccucuggauuggcaucgccaacuuccugcuuuguccccugauccucauuuggcagauccuguaugcguuuuucuccuacgccgaaguucugaagcgggagccuggggcucucggagcccgcugcuggagccuguauggcagauguuaccuucggcacuuuaaugaacuggagcaugaacuccagucuagacugaaccgcggguauaaacccgcuuccaaguacaugaauugcuuccugagcccgcuucucacccugcuggccaagaacggagccuuuuucgcuggcuccauucucgcggugcugaucgcccuuacaauuuacgacgaggauguccuggcuguggagcacguucucaccacagugacccugcugggcgucacggugacaguuugucggucuuuuaucccugaccaacauaugguguucugccccgaacagcuucucagagucauccuggcccacauucauuauaugccugaucacuggcaggggaacgcccaccgcagccagacccgggacgaguucgcucaacuguuucaguacaaagccguguucauccucgaggagcugcuuucccccauugucacaccccugauccucaucuuuugccugagaccucgcgcgcuggaaauuauugauuucuuucggaauuucaccguggagguugugggagucggcgacaccuguagcuuugcucagauggacgugagacagcaugggcacccgcaauggcuuucugccggacagacagaggccuccguuuaucagcaggcugaagauggcaagacggagcucagccugaugcauuucgccaucaccaaccccggguggcaaccuccccgcgaaucuacagcuuuucugggauuccucaaagaacaggugcagcgggacggcgccgcggccagccuggcucagggcgggcuucugccugagaaugcccucuuuaccuccauccaaucucugcagagcgaauccgagccccugagccuuauugcuaacgucguggccggaucuuccugcagaggcccgccucucccccgcgaucugcaggggagccggcacagagcggaaguggccucugcucugcgguccuucagcccucuccaacccggacaggccccuacaggccgcgcucacuccaccaugacggggucuggcguugacgccagaacagccagcuccggaucuagcgucugggagggccagcugcagucccuugugcugagcgaauacgcuucuaccgagaugucccuccaugcgcuguauaugcaccaacugcauaagcagcaggcccaggcugagcccgaacggcacguguggcauagacgcgagagcgaugaaucuggggaguccgccccggacgaaggaggcgagggggcccgggcuccucaaagcauccccagaucugccagcuaccccugugcggcuccucgcccgggagcccccgagaccacagcccuucacggcggguuucagagacgguauggcggaauuaccgauccuggcacagucccccgcgugccuucccacuucagcagacugccccucgggggaugggcugaagacggccagucugccucccggcauccugagcccguuccggaagaggggagcgaagaugagcugccuccccaggugcacaaagucuga

SEQ ID NO: 66181 - RNA, 1779 nt, Artificial Sequence
  derived and/or modified sequence opt5 from ATIC__Homo_sapiens__NP_004035
auggcccccggccagcuggcucucuucagcguguccgacaagaccgggcuggucgaguuugccagaaaccuuacagcgcugggacucaaucugguugcuucuggcgggacggccaaagcccuucgggaugcuggacuggccgugcgcgacgugagcgaacucaccggcuucccugagaugcuugggggaagagucaagacacugcacccggcugugcaugccggcauccucgcgcggaacauucccgaagauaaugccgacauggcucgccuggauuuuaaccuuaucagaguuguggccugcaaucuguacccuuucgucaaaaccguggcuucccccggcguuacaguggaggaagccgucgagcaaauugacaucgggggagugacccuccugcgggcggccgcuaagaaccacgcccgcgugacagucguuugugagccugaagauuaugugguggucucuaccgagaugcagagcuccgaaucuaaagacacgagccuugagaccagacggcagcuggcucucaaggccuuuacacauaccgcccaguacgaugaggcuauuuccgacuauuuccgcaagcaauacagcaaaggcgugucucagaugccccugagauaugggaugaauccucaccagacaccggcgcagcuguacacccuccaacccaagcugccuaucacgguucuuaacggagcccccggcuuuaucaaucugugcgaugcucucaacgccuggcagcuggugaaagaacuuaaggaggcccuggggauuccugcugccgcguccuucaaacaugucagccccgcuggagccgccgugggcaucccgcucucugaagacgaggcuaagguuuguaugguguaugaucuguacaagacacugaccccuauuuccgccgcuuacgcccgggcgcgcggcgccgacagaaugagcucuuuuggggacuucgucgcucucuccgaugugugcgacguccccacagccaaaaucauuagccgggaaguguccgauggaaucauugcuccuggcuaugaggaggaagcccugaccauccuuucuaagaaaaagaaugggaacuacuguguucugcagauggaccagagcuauaaacccgaugagaaugaagugcgcacccucuuuggacugcaccuuucccaaaagagaaacaauggcgucguggacaaaagccuguucucuaacguugugacaaagaacaaggaucuccccgaguccgcgcugcgggaccugaucgucgccacgauugcugugaaauacacccagagcaauucugugugcuaugccaagaacgggcagguuaucggaauuggcgcuggccaacagagcagaauccacuguacacgccucgccggggauaaagccaauuacugguggcugcggcaucacccucagguccuuuccaugaaguuuaaaaccggagugaagagagcugaaauuucuaacgcgaucgaccaguaugugacaggcaccaucggggaggaugaggaccugauuaaguggaaagcccucuucgaagaggucccggaacugcugacggaggcugaaaagaaagaguggguggagaagcugacagaaguuagcaucuccagcgacgccuucuuucccuuccgcgauaauguggaccgggccaaaagaucuggagucgcuuacauugccgcgccuuccggcagcgcugccgauaaggugguuaucgaggccugcgacgaacucgggauuauccuggcucauaccaaccugcgccucuuucaccacuga

SEQ ID NO: 66182 - RNA, 1662 nt, Artificial Sequence
  derived and/or modified sequence opt5 from ATL1__Homo_sapiens__NP_001121185
auggccaagaacagacgggaccgcaauagcuggggcggguucuccgagaaaaccuacgaauggucuagcgaggaagaggaacccgugaagaaagcuggaccuguccagguucugaucgugaaggaugaccacuccuuugagcucgaugagacagcccugaaccggauucuucugucugaagcggugcgggacaaagaggucguggcuguuagcguggccggcgccuuccgcaaggggaaguccuuucucauggauuucaugcugagauauauguacaaucaagaaucugucgacugggugggagauuauaacgagccgcuuacgggcuuuagcuggagagggggauccgagcgcgaaaccacaggcauccagauuuggagcgagaucuuccugauuaauaaacccgacggcaagaaaguugcugugcuccugauggauacccaggggacauuugacucucaguccacccugagagauagcgccacagucuucgcucucucuaccaugaucuccagcauccaaguguacaaccugucucagaaugugcaggaagacgaucuucagcaucugcaacucuuuacggaguauggacggcuggccauggaagagaccuuccuuaagccuuuucagucccugauuuuccucguccgcgacuggagcuuucccuacgaguucuccuauggcgcggacgggggagccaaauuccuggaaaagagacugaagguuucuggcaaccagcacgaggaacuccagaaugugcggaaacauauccacagcugcuuuacaaacauuuccuguuuccugcuuccucaucccgggcugaagguggcuaccaauccuaacuuugauggaaaacucaaggagaucgacgaugaguucauuaaaaaucugaagauccuuauuccguggcugcucagccccgaaucucuggacaucaaagagaucaacggcaauaagauuacaugccgcggccuggucgaauacuuuaaggccuacaucaaaauuuaucaaggggaggaacucccucaccccaaguccaugcugcaggcuaccgccgaggcgaacaaccuugccgcuguggccacggcuaaagauacauacaauaagaaaauggaagagaucuguggaggcgacaagccuuuccuggcccccaacgaucuccagaccaagcaucugcaacuuaaagaggaaagcguuaagcuguuuagaggggugaaaaagaugggaggcgaggaguucucucggcgcuaucuccagcagcuggaaagcgagauugacgaacuguacauccaguauaucaaacacaaugauuccaagaacauuuuucacgccgcuagaacaccggcgacccucuucgucgugaucuuuauuaccuacguuaucgccggggugacaggauucauuggccuggacaucaucgcuucucuuugcaauaugauuaugggccugacgcucaucacccuguguacaugggccuauauucgguacagcggggaguacagagaacugggagccgucaucgaucaaguggcugccgcgcuuugggaccaggcucucuauaagcuguacuccgccgccgcuacccaucgccaccuguaucaccaggccuuuccuacacccaaaagcgagucuaccgaacaguccgagaagaaaaagauguga

SEQ ID NO: 66183 - RNA, 1752 nt, Artificial Sequence
  derived and/or modified sequence opt5 from ATL2__Homo_sapiens__NP_001129145
auggccgagggcgacgaagcugccagagggcagcaaccccaccagggacuguggcggcgcagacggaccagcgauccuuccgcggcugugaaccaugucucuagcacaacgucccucggcgagaauuacgaagacgaugaccugguuaacucugaugaggugaugaagaaaccgugccccgugcagaucguccuugcccacgaagacgaucauaauuucgagcuggacgaggaagcccucgagcagauucugcuucaagaacacauccgcgaucugaacauugugguugugagcgucgcuggggccuuuagaaagggaaaauccuuccuccuggacuuuaugcugcgguauauguacaauaaggauucucagagcuggaucggcgggaacaaugagccucucaccggauucacauggcgcggcggcugugagagagaaaccacagggauucagguguggaacgagguuuuugugaucgaccggcccaauggaaccaaagucgcugugcugcuuauggauacacagggcgccuucgacucccaaagcaccaucaaggacugcgcgacgguguuugcccugucuaccaugacauccagcguccagguuuauaaccucucucagaauauucaggaagaugaccugcaacaucuucagcuguucaccgaguacgggcgccucgcuauggaagagaucuaucagaagccuuuucaaacacugauguuccugauuagagauugguccuaccccuaugagcacagcuacggacucgaaggcgggaaacaguuucuggagaagcggcuucaggugaaacagaaccaacacgaagaacugcagaaugugcgcaagcauauccacaacuguuucucuaaucucggaugcuuucugcuuccucauccgggccugaaagucgccaccaaccccuccuucgacggcagacucaaggauauugacgaagauuucaagcgggagcugcgcaaccuggugccucuccugcuugcucccgagaaucugguugaaaaagagaucagcggguccaaggugacguguagagaccucgucgaauacuuuaaagccuauauuaagaucuaccagggagaggaacugccucaccccaaaucuaugcuucaggcgacagccgaggcuaacaaucuggccgcuguggccggcgcccgggauaccuauugcaagagcauggagcaaguuugugggggagacaaaccguacaucgcuccuuccgaucucgaaagaaagcaccuggaccugaaggagguggcgauuaaacaguuccgcagcgucaagaaaaugggcggggacgaauuuugccggagauaucaggaucagcucgaggccgagaucgaagagacauacgcuaacuucauuaagcauaaugacggcaaaaacaucuuuuaugccgcccgcacccccgcuacccuguucgccgugauguuugcgauguacauuaucucuggacuuacaggcuucaucgggcucaauuccauugcuguccuguguaaccuggugaugggacuggcccuuaucuuucucugcacgugggccuacguuaaguauagcggcgaguuccgggagauugggaccgugaucgaucaaauugcugaaacacugugggagcagguccugaagccucucggagacaaucugauggaggaaaacaucagacagucugugaccaauagcaucaaagccggccuuacagaucagguuucccaccaugcucgccugaagaccgacuga

SEQ ID NO: 66184 - RNA, 1572 nt, Artificial Sequence
  derived and/or modified sequence opt5 from ATL3__Homo_sapiens__NP_001276977
auggagagcuccaagcccggcccugugcaggucguucuggugcaaaaagaccagcacucuuucgaacucgaugagaaggcccuggcuagcauccuucugcaggaccauauuagagaucucgacguggucgugguuuccguggccggggcguuucggaaaggaaagucuuucauccuggauuuuaugcuucgcuaccuguauagccagaaagaauccggccacucuaacuggcucggggacccggaggaaccccugaccggauucagcuggagaggcggguccgauccugagacaacggggauucaaaucuggagcgaggucuuuaccguggaaaagcccggcggcaagaaaguugcugugguccugauggacacacagggggccuucgauucucaguccaccgugaaggacugcgccacaauuuuugcucucagcaccaugacaucuuccgugcagaucuacaaucugagccaaaacauccaggaggaugaccuucagcagcugcaacucuucaccgaauauggacggcuggccauggaugagauuuuucagaaaccuuuccagacgcuuauguuucugguccgcgacuggucuuuccccuacgaguauuccuacggccuccaagggggaauggcuuuucuggacaagagacugcagguuaaagaacaucagcacgaggaaauccagaaugugcggaaccauauucacagcuguuucuccgaugugaccugcuuccuccugccucacccgggccuucaagucgccacaucucccgacuuugaugggaagcugaaggacaucgcgggagaguucaaagaacagcuccaggcccugauuccuuaugugcuuaaucccagcaagcugauggagaaagagaucaacggcuccaagguuaccugucgcggccuccuggaauacuuuaaggcuuacauuaaaaucuaucagggggaggaucugccucaucccaaaagcaugcuccaagccacagcugaagccaauaaccuggcggccgcugccucugcuaaggacaucuacuauaauaacauggaggaagugugcggaggcgagaagccguaccuuuccccugauauucuggaggaaaaacacugugaguucaagcagcucgcccuggaccauuuuaaaaagaccaaaaagaugggaggaaaggauuucagcuuuagauaucagcaggaacuugaggaagagaucaaagagcuguacgaaaauuucugcaagcacaacggcucuaaaaaugucuuuagcacguuccggacacccgccgugcucuuuaccgggauuguugcucuguauaucgcguccggacugacaggcuucauuggccucgagguggucgcccaacuguuuaacuguaugguggggcuucugcucaucgcucugcugaccuggggauacauccgcuacucuggccaguauagagaacuugggggagccauugacuucggcgccgcuuacguccucgagcaggccagcucccacaucgggaauagcacccaggcgacagugcgggaugcuguugugggccgcccuucuauggacaagaaagcccaauga

SEQ ID NO: 66185 - RNA, 9171 nt, Artificial Sequence
  derived and/or modified sequence opt5 from ATM__Homo_sapiens__XP_006718906
augagccuggugcucaaugaccugcuuaucugcugucggcagcuggagcacgaucgggccaccgaaagaaagaaagaggucgaaaaguucaaaagacucauucgggaccccgagacaaucaagcaucuggaucgccacuccgacucuaaacaaggcaaguaccuuaauugggaugcuguuuuuagauuccugcagaaguauauucagaaagaaacggagugccuccggaucgccaagccuaacgugagcgcguccacccaggcuucucgccagaagaaaaugcaggagauuagcucccuggugaaauacuuuaucaagugugccaauagacgggccccgcgccugaagugccaggaacuccugaacuauaucauggacacagucaaagauucuagcaauggggcuauuuacggagccgacuguuccaacauccuucugaaggauauucucagcgugagaaaauauuggugcgagaucucucagcaacaguggcuggaacuuuucuccguuuacuuucggcuguaucucaagcccagccaggacgugcaucgcguccugguggcuagaauuauccacgccguuaccaaaggcuguugcucucagacagaugggcucaauuccaaguuccucgacuuuuucagcaaagcgauucaaugugcccggcaggagaagucuuccagcggacugaaccauauccuugcugcccugaccaucuuucucaagacacuggcugugaauuuccgcauuagagucugcgagcuuggcgaugaaauccugccuacccuccuguacauuuggacgcagcaccggcugaacgacucccucaaagaggugaucauugaacuguuucaacuucagaucuacauccaccaucccaagggggccaaaacccaggagaagggagcguaugaaucuacaaaauggagaagcauucuguacaaucucuaugaccugcuugugaacgagaucucccacauuggcagccgcggcaaguacucuuccggguuccggaauaucgccgucaaggagaaccugauugaacucauggcugauaucugucaucagguuuuuaaugaggacaccagaagccuggaaaucucucaaagcuauacaaccacgcagcgcgaguccucugauuacagcgugccuugcaaacggaagaaaauugaacugggaugggaggugaucaaggaccaccuccagaaaucccagaacgauuucgaccugguccccuggcuucaaauugccacacagcugaucagcaaguauccugcuucucucccgaacugcgagcugagcccccugcuuaugauucucagccagcugcugccucagcaaagacacggcgaacgcacccccuacgugcuccggugucugacagagguugcccuuugccaggauaagagaucuaaucuggaauccagccagaaauccgaccuccugaagcuguggaacaaaaucugguguauuaccuuccgcgggaucucuagcgagcagauccaagccgaaaauuuuggacuucucggcgcuauuauccaggggucccugguggaggucgaucgggaguucuggaagcuguuuaccggaucugcgugcagaccuagcugucccgccgugugcugucucacacuggcucuuacgaccuccauuguuccgggcacagugaaaaugggcaucgaacagaacaugugcgaggucaaucgcagcuucucucugaaggaauccauuaugaaguggcuccuguuuuaccaacuggagggggaccuugagaacagcaccgaagugccucccauccuccauucuaauuucccucaccugguccuggagaaaauccucgugucccugacaaugaagaacuguaaagccgccaugaacuuuuuccagagcguucccgaaugcgagcaucaccagaaggauaaagaagaacuuucuuuuagcgagguggaagaacuguuccuccagaccacguuugacaagauggacuuccugacaauuguccgggaauguggaaucgagaaacaucaauccagcauuggcuuuucugugcaccagaaccugaaggaaucccuugauagaugccuccuggggcugagcgagcagcuccugaauaacuauuccucugagaucaccaauagcgaaacccuuguucggugcucccgccugcucgugggaguccugggcuguuacugcuauaugggggugauugcugaggaagaggccuacaagucugaacuguuccagaaagcgaagucccuuaugcaaugugcuggagaguccaucacacuguucaaaaacaagaccaaugaggaauuuagaaucggcucucuccggaacaugaugcagcugugcacaagaugucucagcaacugcacgaaaaagucccccaauaagauugccagcggcuucuuucugcgccuucugaccucuaaacucaugaacgacaucgccgauauuuguaagucccuggcuagcuucaucaaaaagccuuuugacagaggggaaguggaaucuauggaggaugacacaaauggaaaccugauggagguugaagaucaguccagcaugaaucuuuucaacgacuauccggauucuuccgucagcgacgccaaugagcccggcgaaucccagagcaccauuggggcuaucaacccucuggccgaggaauaccucucuaaacaagaucugcucuuucuggacaugcuuaaguuccugugccucugugugacaaccgcgcagacgaauaccgugagcuuuagagccgcugauauccgcagaaagcugcugaugcuuauugacuccucuacacuggagcccaccaaaagccuccaucugcacauguaucucaugcugcuuaaggagcugccuggagaagaguacccccugccgauggaagacguccucgagcugcuuaaaccucuguccaacgugugcucucucuaccggcgcgaucaggacguuuguaagacaauccugaaucacgugcuccaugucgugaaaaaccugggccaaagcaauauggauuccgaaaacaccagagacgcccaggggcaguuccuuacgguuauuggcgcuuuuuggcaccugacaaaggagcggaaguauaucuucucugugcgcauggcccuggucaauugccucaaaacccugcuugaggcggaucccuacagcaagugggccauucugaacgugaugggaaaagacuuuccuguuaacgaaguguucacacaguuccucgcugauaaucaccaucaagucagaaugcuggccgcugaguccaucaaccggcucuuucaggacaccaagggcgauagcucucgccugcuuaaagcccugccccugaagcuccagcagaccgccuucgaaaaugcuuaucugaaagcgcaagaggggaugagagaaaugucccacagcgccgagaacccugagacacuugacgaaauuuacaaucggaagucugugcugcucacgcugaucgcugugguccucuccugcagccccaucugugagaagcaggcccuguuugcccuuugcaaauccguuaaggaaaacggacuggagccgcaucuggugaaaaaggugcucgagaaagucucugaaaccuucggcuaucgcagacuggaggauuuuauggcuagccaccuugacuaccuggugcucgaauggcugaaucugcaggauacagaguauaaccucuccagcuucccuuuuauucuucugaauuacaccaacaucgaagacuucuaccggucuuguuauaagguucugauuccccaucucgugaucagaucccacuuugacgaggucaagagcauugccaaucagauccaagaggauuggaaaucucugcuuacagacugcuuccccaagauccuggugaacauucucccuuacuuugcguaugaagggacccgcgauagcggaauggcucagcagcgggagacggccacaaaaguuuacgacaugcugaaguccgaaaaucugcucggcaaacagaucgaucaccuuuucauuucuaaccugccggagaucguggucgaacugcucaugacccugcaugagcccgccaauagcuccgcuucucaaagcaccgaccuuugugauuucuccggggaccuggauccugcccccaacccuccccacuuuccuagccaugugauuaaggcgacauucgcuuauaucucuaacugccacaagaccaaacucaaguccauccuggagauucugagcaaaucccccgacucuuaccagaagauccuccuugccauuugugaacaggccgcugagacaaauaacguuuauaaaaagcauagaauccugaagauuuaccaccuguuugugagccuccugcuuaaagauaucaaguccggccugggaggcgccugggcuuucguccuccgcgacgugauuuacacgcugauccacuauaucaaucaacggccgucuugcauuauggacgugagccugagauccuuuagccucuguugcgaucuucugucucaggucugucagaccgccguuacauacugcaaagacgcgcuggaaaaccaucuccacgugaucguggggacccugauuccucuugucuaugagcaaguggaaguucaaaagcaagugcuggaucuccugaaauaccuggucaucgacaauaaggauaacgagaaucucuauauuacaaucaaacuucuggaccccuucccugaucaugugguuuuuaaagaccugcgcaucacccagcagaagauuaaauacucccggggacccuucagccuccuggaggaaaucaaccacuuucuuucuguguccgucuaugaugcccugccgcucacgagacuggagggccugaaggaccuccgccggcaacuugaacugcacaaagaucagaugguggacauuaugagagcuagccaggauaauccucaggacgggaucauggucaagcuggugguuaaccuccugcaacuuucuaaaauggccauuaaucauaccggagagaaggaggugcuggaagcugucggcagcugccucggggaggugggccccaucgacuucuccacaaucgccauucagcacucuaaggaugccagcuacaccaaagcucugaagcuguuugaagacaaagagcuccaguggacauucaucaugcuuaccuaccugaacaauacacugguugaagauugugugaagguccgguccgcggccgugaccugccucaaaaacauucuggcuacgaagacaggacauagcuuuugggagaucuauaagaugaccaccgacccuaugcuugccuaccugcaacccuuccgcacaucccgcaagaaguuccucgaggugccccgguuugauaaagaaaauccuuucgagggccuggacgauauuaaccuguggaucccgcucucugaaaaucacgacauuuggaucaagacccuuacgugugccuuucuggauagcgggggaacaaaaugcgagauccugcagcuccugaagcccaugugugaaguuaagaccgacuucugccagacaguccuuccuuaucugauucaugauauccuccugcaggacaccaacgaguccuggcgcaaccugcucucuacacacgugcaaggcuuuuucaccagcugucuuagacacuuuucccagacgucucggagcaccacacccgcuaaucuggauuccgagagcgaacauuucuuuagaugcugucuggacaaaaagucucagcgcaccaugcucgccguggucgacuacaugcggagacagaaacgcccuuccagcgggacaauuuucaacgaugcguuuuggcuggaccuuaauuaucuggagguggcuaagguugcccaaucuugcgccgcucacuucaccgcccuccuguacgcggaaaucuaugcugauaaaaaguccauggacgaucaggagaagcggagccuggccuuugaagagggaucucaguccacgacaauuagcucccucagcgagaaaucuaaggaagagaccggcaucagccugcaggaccuucugcucgaaaucuacagauccauuggggagcccgauucucuguacggcuguggaggcgggaaaaugcuucaaccuaucacacgccugcggaccuaugagcaugaagccauguggggaaaggcucucgugaccuacgaccuggagacagccauuccgagcuccacgagacaggcuggcaucauucaggcccugcagaaccucgggcugugccacauccuuucugucuaucugaaaggacucgauuacgaaaauaaggacuggugccccgagcuggaggagcuucacuaucaagcggccuggcgcaacaugcagugggaucauuguaccagcguguccaaagagguugaaggcacaucuuaccacgagagccuguauaaugcucuccagucccugagagaccgggaguucagcaccuucuacgagucucugaaguacgcccgcgugaaggaagucgaggagaugugcaaaagaucccucgaaagcguguauucucuguacccuacacuuucccggcugcaagcuaucggcgagcucgaaagcauuggggagcuguuuucccgcucuguuacccauagacagcuuagcgaaguguauaucaaguggcagaaacacucccagcugcucaaggacagcgauuucucuuuucaagagcccauuauggcccugcggacggucauccuggagauucucauggaaaaagagauggacaacucccagagagaauguaucaaggauauucugacaaagcaucuuguggagcugagcauccucgcccgcaccuucaaaaauacccagcugccugagcgggcuaucuuucagauuaagcaauacaacucugugagcugcggagucuccgaauggcagcuugaggaagcgcagguuuucugggccaaaaaggagcagucucuggcucucagcauccugaaacaaaugauuaagaagcuggacgccuccugugccgcuaauaaccccucucucaaacugacauauaccgaaugccuuagaguguguggcaauuggcuggccgagacaugccucgagaacccggcggugaucaugcagacguaccuggaaaaggcugucgagguggccgggaauuaugauggagaaagcuccgacgagcuucgcaacggcaaaaugaaggccuuucugagccucgcucgguucucugauacccaguaccaaagaauugaaaacuacaugaaauccagcgaguuugagaauaagcaggcccugcugaagcgggcgaaagaagagguugggcuccugcgcgaacacaagauccagacaaacagauauaccgugaaaguccagcgggagcuugaacuggacgagcucgcccugcgcgcucuuaaggaggauagaaaacgguuccuguguaaggccguggaaaauuacaucaacugccuccuguccggagaggaacacgacauguggguuuuucgccuguguucucucuggcuggagaauagcggcguguccgaggucaacggcaugaugaaaagagaugggaugaagauuccuacauauaaguuccuuccccugauguaccaacucgcugcccggaugggaaccaaaaugaugggcgggcugggauuucaugaagugcuuaauaaccugaucucucgcauuagcauggaccacccccaucacacgcuguucaucauucuggcucuggccaaugcgaacagagaugaguuccuuaccaagccugaagucgcccggagaucccgcaucaccaagaaugugcccaagcagagcucucagcuggacgaggaccggaccgaagcugccaacagaaucauuugcacaauccgcucccggagaccucagaugguucgcagcguggaggcucucugcgaugccuauauuauccuggccaaucucgacgcuacccaauggaaaacacagcggaagggcauuaacaucccggcggaucagcccauuacgaagcugaaaaaucuugaggacguggucguuccuaccauggaaaucaagguggaucacacaggggaguacggaaaccuggugaccauccagucuuuuaaagccgaguucagacuggcuggcggcgucaaccuccccaagauuaucgacugugugggguccgauggaaaagagcgccggcaacugguuaagggcagagacgaucuucgccaggacgccgugaugcagcaagucuuucagaugugcaauacccugcuccagcggaacacagaaacgagaaagcgcaaacugaccauuuguacauauaagguggucccucucagccagagaucuggggugcuggaguggugcaccggaacaguucccaucggcgaguuccuggugaauaacgaagauggggcccauaaacgguaccgcccgaaugacuuuuccgcuuuccaaugucagaagaaaaugauggagguccagaaaaagagcuuugaagagaaauacgaaguguucauggacguuugccagaacuuucaaccuguguucagauauuuuuguauggagaaguuccuugaucccgccauuugguuugagaaacggcuggcguacaccagaucugucgccacgagcuccaucgugggauauauccucggccugggcgaccggcacgugcagaauauucuuaucaacgaacagagcgcugagcugguucauauugaucucggggucgccuucgaacagggaaagauccugccuacacccgagaccgugccuuuccgccucaccagagacauuguggauggcauggggaucacaggagucgagggcguuuuucggcgcugcugugagaaaacaauggaagugaugagaaauucccaagaaacacugcugaccaucguggagguccuucuguacgacccccucuucgauuggacgaugaacccgcugaaggcucuuuaucugcagcagcggccugaagacgagacagagcuccaccccacccugaaugccgaugaccaggaaugcaagcgcaaccugucugauauugaccagagcuuuaauaaaguggcggagagaguucucaugcggcugcaggaaaaacuuaaagggguggaggaaggaacaguccuguccgugggcggccagguuaaccuccugauccaacaggccauugaucccaagaaucuuucucgccuguucccuggguggaaggcuuggguguga

SEQ ID NO: 66186 - RNA, 3573 nt, Artificial Sequence
  derived and/or modified sequence opt5 from ATN1__Homo_sapiens__NP_001007027
augaagaccagacagaacaaagacagcauguccaugcggucuggccgcaagaaagaggcccccgggccuagagaagagcugcggagccgcggaagagcuuccccgggcggggugucuacaagcuccucugauggaaaggccgaaaaaagccggcaaacggcgaagaaggcucgcgucgaggaagccuccacccccaaaguuaauaagcagggcagaagcgaggagaucucugaauccgagagcgaagagacaaacgccccuaaaaagaccaaaacagagcaggaacucccccggccucagucucccuccgaccuggauagccuugacgggcgcucucugaaugaugacggauccagcgauccuagagacauugaucaagacaaccgguccaccucuccgagcaucuacucccccggcagcguggagaaugauucugacuccagcucuggccucagccaggggccugcucgccccuaucacccucccccgcuguucccucccuccccucagccccccgauucuacaccuagacagccggaagccagcuuugagccccauccuuccgugacccccacgggauaccacgcuccuauggaacccccgaccagccggauguuccaagccccucccggcgcgccucccccucauccccagcuuuauccggggggaacaggcgggguccugucuggaccucccaugggccccaagggcgggggagccgcuuccagcgugggcgggccuaacggaggcaagcagcacccgcccccuaccacacccauuucuguuuccagcuccggggccucuggagcuccucccaccaaaccucccacgacaccggugggcggcgggaaucucccuagcgcccccccucccgcgaacuuuccgcaugucaccccuaaucugcccccuccccccgcccugcgcccucucaacaaugcuuccgccucuccgcccggacugggcgcucagccucuucccgggcaccugccuagcccccacgccaugggacaaggcauggggggccucccuccgggacccgagaagggcccuacacuggcccccuccccucauagccuucccccggcuucuuccagcgcgccugccccccccaugagauucccuuacucuuccagcucuagcuccagcgcugccgccucuuccagcuccucuagcuccucuagcuccgcuucucccuuuccugccagccaggcgcugccguccuauccccacagcuucccucccccuaccucucucuccgugagcaaccagcccccgaaauacacccaaccuucucugcccucccaggcuguuuggagccaggggccucccccucccccgccuuauggacggcugcucgccaauucuaacgcccaucccggccccuuuccuccguccacaggggcucagagcacggcccaccccccuguguccacccaccaucaccaucaccaacagcagcagcaacagcagcagcaacagcagcagcaacagcagcaacagcagcagcaucacggaaauagcggccccccucccccuggggcuuucccgcacccccuggagggcggaucuagccaucacgcccauccuuacgcgaugucccccucucuuggcagccugagaccuuaccccccggggccugcccaccucccccccccucacucccaagucucuuauagccaggcuggacccaacggcccuccgguguccucuagcuccaacagcucuuccagcacaucucagggguccuaccccugcagccauccuucccccucucagggaccucaaggcgcccccuauccguuuccucccgugccuaccgucacaaccagcuccgcuacgcugagcacaguuaucgccaccguggcgucuucccccgccggguacaagaccgcuagcccucccggcccgccucccuauggaaaacgcgcccccucuccuggcgcuuacaagacagccaccccgcccggguauaaaccuggaagccccccuuccuuccggacaggcacgcccccuggguacagaggaaccucucccccggccggcccugggacauuuaagcccggcagcccuaccgugggacccggcccgcuuccucccgcugggcccuccggacugccuucucuccccccuccgcccgcggccccugcuagcggccccccucuguccgccacacagauuaagcaggaacccgccgaggaauacgagaccccugaaagcccgguccccccugcucgcucucccuccccucccccgaaagugguugacgugccuagccacgccucccagucugcgcgguucaauaagcaucuggacagaggguuuaacagcugugcucgcuccgaucucuauuucgucccccuggagggaucuaaacuugccaagaaacgggccgaccugguggagaagguuagacgcgaagcugagcaacgggccagagaagagaaggaacgcgagcgggagagagaacgggagaaagaacgcgagagagagaaggaacgggagcucgaaagaagcgugaaacuggcgcaggagggccgcgcucccgucgaaugcccuucccuuggccccgugccucaccggccgcccuucgagccugggagcgccgucgccacggugcccccuuaccugggacccgauaccccggcucucagaacacugucugaguaugcccgcccucauguuaugucccccggcaauagaaaccacccuuuuuacgugccccugggggcugucgacccgggacuccugggcuauaaugugccugcccuuuacagcucugaucccgcggcccgggaacgcgagagagaagcucgggagcgcgaccugagagaucggcucaagcccggguucgaaguuaaaccuuccgagcuggagccccugcacggagugccuggcccgggccuugaccccuuuccucgccaugggggacucgcccugcagcccggcccucccgggcugcacccuuucccguuucaucccagccucggaccucuggaaagagagcggcuugcucuggccgccggccccgcucuccgcccugauaugucuuaugcggaaagacuggccgcugagcggcaacacgccgaaagagucgccgcucuggggaacgacccccuugcccgccuccagaugcugaaugugaccccgcaucaccaccagcauagccacauccauucccaccugcaccuccaucagcaagaugcgauccacgcugccucugccagcgugcauccucugauugacccccuugcuuccggaagccaccugacacggauccccuacccugccggcacccuccccaacccucugcugccgcauccccuucacgagaaugagguucucagacaccagcuguucgcggcuccuuaccgcgaccugcccgccucccucucugccccuaugagcgcugcccaucagcugcaggcuaugcacgcccaauccgcggaacuucagcggcuggcccucgagcagcagcaauggcugcaugcucaccacccccugcauucugucccgcuuccugcccaggaagauuauuacagccaccucaagaaggaguccgacaaaccccuguga

SEQ ID NO: 66187 - RNA, 1065 nt, Artificial Sequence
  derived and/or modified sequence opt5 from ATOH1__Homo_sapiens__NP_005163
augagcagacugcuccacgccgaggaaugggcugaggugaaggaacugggcgaccaucaccggcagccccaaccucaucaccuuccgcagcccccucccccuccccagccuccggccacccugcaggcgcgcgagcaucccgucuacccucccgaacucucccugcuugauucuacagacccuagagcuuggcuggcccccacgcuccaagggaucugcaccgcccgggcugcccaguaucugcugcacagcccggagcucggagcuuccgaggccgcggccccucgcgaugaaguugacggcagaggggagcuggugcggcgcucuagcggaggcgcuuccucuagcaaaucccccgggccugugaaggucagagaacagcuuuguaaacugaagggaggcgugguuguggaugagcucggcugcagccggcagcgcgcccccucuuccaaacaagucaacggggugcagaagcagagacggcuggcugccaaugcgcgcgagagacggcgcaugcacggacuuaaccaugccuucgaccagcugagaaauguuauucccagcuuuaacaaugauaagaaacucucuaaguacgaaacacugcaaauggcucagaucuauauuaacgcccuguccgagcuccugcagaccccuagcggcggggaacaaccgcccccucccccugcuucuuguaaauccgaccaccaucaccuucggacagccgccagcuacgagggaggcgcugggaaugcgaccgccgcuggagcccagcaggccuccggcggcucucagagacccacaccgccugggagcugccgcacccgguucuccgcucccgccagcgcgggaggcuauucugugcaacuggaugcucuccacuuuuccacguucgaagacagcgcccugaccgccaugauggcucagaagaaccuuucuccuagccugcccggguccauccuccagccuguccaggaggaaaauucuaaaacaagccccagaucccaucgcagcgauggagaguuuucuccgcacucccauuacagcgacucugaugaggccuccuga

SEQ ID NO: 66188 - RNA, 459 nt, Artificial Sequence
  derived and/or modified sequence opt5 from ATOH7__Homo_sapiens__NP_660161
augaaaagcugcaagcccuccggcccuccggccggggcuagaguggcgcccccuugugccggaggcaccgagugcgcugggacaugugccggagccggccggcuggaaucugcugcccgcagacggcucgcugccaacgcgcgcgagagacggcgcaugcaggggcugaauacggccuucgacagacuucggcgcgucguuccccaauggggacaggauaagaaacugagcaaguacgaaacccuccagauggcucuguccuauaucauggcccuuacacggauucuggcugaggccgaaagauuuggcucugagcgcgacugggugggccuccacugcgagcauuucgggagagaucacuaccugccuuuucccggagcgaaacugccuggcgaaagcgagcucuauucccagcggcuguucggguuucaaccggaacccuuccagauggccaccuga

SEQ ID NO: 66189 - RNA, 207 nt, Artificial Sequence
  derived and/or modified sequence opt5 from ATOX1__Homo_sapiens__NP_004036
augcccaagcacgaguucagcguggacaugaccugcggcgggugugccgaagcugucuccagaguucugaacaaacucggaggcgugaaguacgauaucgaccugccuaauaaaaaggugugcauugagucugaacauagcauggauacacuucuggccacgcucaaaaagaccgggaagacagucuccuaucugggacuugaguga

SEQ ID NO: 66190 - RNA, 4500 nt, Artificial Sequence
  derived and/or modified sequence opt5 from ATP10A__Homo_sapiens__NP_077816
auggagagagaacccgccggcaccgaggaaccugggccgcccggacggcgcagacggcgcgagggcagaacacggacggugcgcagcaaccugcucccucccccuggggcugaagaccccgccgcgggagcugccaagggcgagagacggcgcagacgggggugcgcccagcaccuggcugauaaucgccuuaaaaccacaaaguacacccugcucuccuuccugccuaaaaaccuuuuugagcaauuccauagaccggccaaugucuauuuuguuuucaucgcucugcucaacuuugugcccgccgugaaugcguuccagccuggacuggcccuggcucccguccucuuuauucuggccaucacagcuuuccgggaccuuugggaagauuacucucgccacagaagcgaccauaagauuaaccaccugggcugucucguguuuucccgggaggaaaagaaguauguuaauagauucuggaaggagauccaugugggcgauuuuguccgccugcggugcaacgagauuuucccugccgacauccuucugcucucuagcuccgaucccgacgggcugugucacaucgaaaccgcgaaucuggauggagagacaaaccucaaaagacgccaggugguucggggcuuuucugaacuggugagcgaguucaauccgcuuaccuucacguccgucauugaaugcgagaagccuaacaaugaccugagcagauuucgcggguguaucauucacgauaacggcaaaaaggccggccucuacaaagagaaucugcuucugcgggggugcacccucagaaacacagacgcuguggugggaaucgucauuuaugccggccaugaaaccaaggcucugcugaacaauucuggcccccgcuacaagcgguccaaacucgagagacagaugaacugugauguucuguggugcgugcuucugcucguguguaugagccuguucucugccgucgggcacggacuuuggaucuggcgcuaucaagaaaagaaaucccuguuuuacgugccuaagagcgacggaucuucccucagccccguuacagccgcuguguacuccuuccugaccaugauuaucguccuccaggugcugauccccauuucucuguauguuagcaucgagauugugaaagcgugccaggucuacuuuaucaaucaggacaugcaacuuuaugaugaagagacggacucccagcugcagugucgggcccucaacauuacagaggaucuggggcagauccaauacaucuucagcgacaagaccggaacacugaccgaaaauaaaaugguguuuagacggugcaccgucucuggcguggaguauucccaugaugcuaacgcccagcgccuugccagauaccaggaagcugacagcgaggaagaggagguugugccuagagggggaucugucagccaacggggcuccauuggcucucaccagagcgugcgcguugugcaccggacacaguccaccaagagccauagacgcacggggucuagagccgaagcgaagcgggcuuccaugcucagcaaacacacagccuucucuuccccgauggagaaggauaucacccccgacccuaaacugcuggaaaaggucagcgagugcgauaaaucccucgccguggcucgccaucaggagcaucugcuugcccaccugucucccgaacucagcgacguguuugauuucuuuauugcucugacaaucuguaauaccguugucgugacguccccugaccaacccagaacaaaggugcggguccgcuucgagcugaagucuccggugaaaaccauugaagacuuucuuagacgguucaccccuagcugccucacauccggauguagcucuaucggcucccuggccgcgaacaagagcucucacaaacugggguccagcuuccccucuaccccuagcuccgauggaaugcuccugcgccuugaggaaagacugggccagcccacaagcgccaucgcuucuaauggguauuccagccaggccgacaacugggcuuccgagcucgcccaggagcaagaaucugagcgggaacugcgcuacgaggcggaaagcccugaugaggccgcucugguuuacgccgcuagagccuauaauugcgugcuugucgagcggcuccacgaccagguguccguugaacugccccaucugggcagacucacguuugagcugcuucacacccugggauucgauucugugcgcaagcggaugagcgucgugauuagacauccgcucacagacgaaaucaacguuuacaccaaaggcgccgauuccguggucauggaccugcugcagccuuguucuagcguggaugcucgcgggcggcaccagaagaagauuagauccaaaacacaaaauuaucuuaacguguacgcggccgagggacuccgcacccugugcaucgcuaagcggguccugagcaaagaagaguaugccuguuggcuccagucucaccuggaggccgaauccagccuugaaaauucugaggagcugcucuuucaguccgcuauuagacuggagacgaaccugcaucuucugggcgccaccgggaucgaagaccgccuccaggauggaguucccgagacaauuagcaagcugcggcaagcgggccuccagaucugggugcugaccggggacaaacaggaaacagcugugaacaucgccuacgccugcaaacuucuggaucacgacgaggaagucauuacccucaaugcuacgucucaagaggccugugcggcucugcuggaccagugccuuuguuaugugcaguccagaggccugcagcgggcccccgagaagacaaaaggaaagguuagcaugcgcuucuccagccucugcccuccgucuaccagcacagccuccggcagacggcccucucuggugaucgaugggcgcagccucgcuuacgcccuggagaaaaaccuugaagacaaguuucuguuccucgcuaaacaaugcagauccguccuguguugccggucuaccccucugcaaaagagcauggugguuaaacuugugagauccaagcugaaggccaugacccucgcgauuggagauggcgccaaugacgucucuaugauccagguggcugauguuggggugggaauuagcggccaggaagggaugcaggccgucauggcuuccgacuuugccgugcccaaauuccgcuaccuggagcggcuccugauccuucauggccacugguguuauagcagacuggccaacauggugcuguacuuuuucuauaagaauacaauguuugucggacuccuguucugguuucaguucuucugcggcuuuucugcuuccacgaugaucgaucagugguaccuuauuuucuuuaaccuccuguucagcucucugccuccccucguuaccggggugcuggaccgcgaugugccugcgaauguccuucugacaaacccccagcuguauaaauccggacaaaauauggaagaguaccggccgagaaccuuuugguucaacauggccgacgcugccuuucagagccucguguguuucuccaucccuuaucuggccuacuacgauucuaauguugaccuuuuuacauggggcacccccauugugacgaucgcucugcucacauuccugcuccaucuggggauugagaccaagaccuggacauggcuuaacuggauuaccugcggauuuagcguccugcuguucuucacaguggcccucaucuauaaugcguccugugcuacgugcuacccucccagcaacccguauuggaccaugcaggcccugcuuggcgauccuguguuuuaccugacaugucucaugacccccguugccgcucugcucccucgccuguucuuucggucucuucaagggagagucuuccccacacagcugcagcuggcccgccagcucaccagaaaaagcccccggcgcugcuccgcgccuaaggaaacguuugcucaaggcagacugccgaaggacucuggaaccgagcacagcuccggccggacagugaaaaccucugucccccuuagccagccuuccuggcacacacagcagcccguguguucucuggaagccagcggggagccuuccaccguugacaugagcaugcccgugcgcgaacauacacuccuggagggacugucugccccugcuccgauguccagcgcccccggcgaggcuguccucagauccccugggggaugccccgaagagucuaaggugcgggccgcgagcaccggcagaguuacgccucuuuccucucuguucagccugcccacauuuucccuccugaauuggaucagcucuuggucccuugugagccgccugggcucuguccuccaauucucccggaccgaacagcuggccgaugggcaggcuggaagaggccugccggugcagccucacagcgggcgcucuggacuccaaggccccgaccaucggcuucugaucggggccagcuccagacggucucaguga

SEQ ID NO: 66191 - RNA, 4386 nt, Artificial Sequence
  derived and/or modified sequence opt5 from ATP10B__Homo_sapiens__NP_079429
auggcccugagcguggacuccucuuggcacagauggcaguggcggguccgcgauggcuucccccauugcccuagcgagaccacaccgcuccugucccccgaaaaggggagacaaucuuacaaccuuacgcagcagcggguuguguuuccuaacaacagcaucuuccaccaggacugggaggaagugucccgcagauaucccggaaaucggaccuguacaaccaaauacacacuguuuaccuuccucccucgcaaccuguuugagcaauuccauagaugggcuaaucuuuauuuucuguuccucgucauucugaacuggaugcccucuauggaaguguuucaccgggagaucacaaugcugccucucgccauuguucuguucgugaucaugauuaaggauggcauggaggacuuuaaacgccauagauucgauaaggcgaucaauugcagcaacauccggauuuacgaacgcaaagagcagaccuauguccagaaguguuggaaggacgugagaguuggggauuuuauccagaugaaaugcaaugaaauugugccggcugacauccuucugcucuuuuccagcgaucccaacggaauuugucaccuggagacggccucucuugacggcgagaccaaucugaagcaacggugcgucgugaaaggguucucccagcaggaagugcaguuugagccugaacucuuccacaacacaaucgucugugagaagcccaauaaccaucugaauaaauuuaagggauacauggaacacccugaucaaacccgcacaggcuucggcugcgagagccugcuccugagaggguguaccauucggaacacggagauggccguuggaaucgugaucuaugcuggccaugaaacaaaggccaugcuuaacaauucugggcccagauacaaacgcuccaagauugagcggagaaugaacaucgacauuuucuucugcaucggcauucugauccucaugugucugaucggagcuguggggcacagcauuuggaauggaaccuuugaggaacacccgccuuucgauguccccgacgccaacggcucuuuucuuccuuccgcgcugggcggguucuacauguuucucacaaugaucauucugcuucaggugcucauccccauuagccuguauguuuccaucgaacuugugaaacugggacaggucuucuuucucucuaaugaccuggaucuuuacgacgaggagaccgaucugagcauccaaugccgcgcccucaacauugcugaagaccugggccagauccaguauauuuucuccgauaagaccgggacacugacggagaauaaaaugguguuccggagaugcaccaucaugggaagcgaauacucucaucaggagaacgccaagcgccucgaaacacccaaagagcuggacuccgauggcgaggaauggacccaauaucagugucuuagcuuuucugcucggugggcccaggacccugcgacaaugagaagccagaagggggcccaaccgcugcgccggucccagucugcuagaguucccauucagggacacuaccgccagcggagcaugggccauagagaguccagccaaccucccguggccuucucuuccagcaucgaaaaggaugucaccccugacaaaaaucuccugacgaaggugcgggaugcugcccuguggcuugagacacucucugacucccgccccgccaaagcuagccuguccaccaccucuagcauugcggacuuuuuccuggcccucacaaucugcaacuccgucauggugucuaccacaacggagccgagacagcggguuaccaucaagccuagcuccaaagcucugggcacaagccuugaaaagauucagcagcuguuucaaaagcucaaacugcugucucuuucccagagcuucucuuccaccgcccccagcgauacagaccucggggagucucugggagccaauguggcuaccacggauagcgacgaaagagaugacgccuccgucuguagcggcggggauucuaccgacgauggaggcuaucgcuccagcaugugggaccagggggauauccuggaguccggcucuggaacaagccucgaagaggcgcuggaggcuccugccaccgaccuugcccggcccgaauuuugcuacgaggcugaauccccugaugaggccgcucuggugcacgccgcgcaugccuacucuuucacacucguuagcagaacccccgaacaagugacgguccgccugccgcagggcacaugucugaccuuuucccuucucugcacacugggguucgacucugugagaaagcggaugagcgugguuguccgccacccucugaccggagagauugugguguauaccaaaggcgcugacuccgucaucauggaucuccuggaggaccccgccugugugcccgauauuaacauggaaaagaaacuuagaaagauccgggcucgcacacagaagcaccuggaccucuacgccagagaugggcugcggacgcugugcaucgcgaaaaagguugugagcgaggaagacuuucgcagaugggccucuuuccggcgcgaggcugaagccucccuugauaauagagacgagcuccugauggagaccgcucagcaucuggaaaaccaacucacacugcuuggagccaccggcauugaggaucggcugcaggaaggggucccugacacaaucgccacccucagagaggcuggcauucagcugugggugcugacgggagauaaacaggagacagcgguuaauaucgcccacagcugucgccuucugaaccaaaccgacaccguguauacaauuaacaccgaaaaucaggagacaugcgaaucuauccucaacugugcucuggaggaacucaagcaguuucgggagcugcagaaaccggauagaaagcuguucggcuuccgccugcccuccaagacgccuagcaucaccucugaggccgucgugcccgaagccgggcucguuauugacggaaaaacacugaaugcuaucuuucaaggcaagcuggagaaaaaguuccuugaacugacccaguacugccgguccgugcucugcuguagaagcacaccucugcagaaauccaugauugucaagcucgugcgcgacaaacugcgggugaugacccuuagcaucggggauggagccaacgacgucucuaugauucaagcggcugauaucggcaucgggauuagcggccaggagggaaugcaggccguuauguccucugacuuugccaucacgagauucaagcaucugaagaaacuccugcuggugcacggccacuggugcuauagccgccuugcucggaugguggucuacuaucuguacaagaauguguguuacguuaaccuccuguuuugguaucaguucuuuugcggguucuccucuagcaccaugauugauuacuggcaaaugaucuuuuucaaucucuuuuucacaucccugcccccucuuguguucggaguccuggacaaagauauuucugccgaaacccugcucgcgcugcccgagcuuuauaagagcggccagaacuccgaguguuacaaucugagcacauuuuggaucucuaugguggacgcuuucuaucagucccucauuugcuuuuucaucccguaccuggccuauaaagggagcgauaucgacguuuuuaccuucggaacaccuauuaacaccaucucucucacgacaauucugcuucaucaggccauggaaaugaagaccuggaccaucuuucacggcgugguccugcugggguccuuccucauguacuuucuggugagccuucuguacaaugcuacauguguuauuugcaacucccccaccaauccuuauugggugauggagggccaacucucuaaccccacguucuaccuggucuguuuucucacaccggugguggcccugcuuccuagauauuucuuucugagccugcagggaaccugcggcaagucccucaucagcaaagcucagaagaucgauaaacugcccccugacaagcggaaucuugaaauucagucuuggcgcuccagacaacggcccgcccccgucccugagguugcgcgcccgacacaucaccccgugagcucuaucaccgggcaggacuucagcgccuccacaccuaaaucuagcaaucccccuaagagaaagcauguggaagaguccguccugcacgagcagcgguguggaaccgaaugcaugagagaugacucuugcagcggcgauuccagcgcucagcucucuuccggggagcaucugcucggacccaaccgcauuauggccuacagccggggccaaacggacauguguagaugcuccaaacgcucuagccaccggagaucccagucuagccugaccaucuga

SEQ ID NO: 66192 - RNA, 4281 nt, Artificial Sequence
  derived and/or modified sequence opt5 from ATP10D__Homo_sapiens__NP_065186
augaccgaggcccugcagugggcuagauaccacuggcggcgccucaucagaggcgccacacgggacgaugacagcgggcccuauaacuacuccucucugcuugcgugcggacgcaagagcucccaaacgccuaaacugucuggcagacaucggauuguggucccgcacauccagcccuucaaggaugaauaugagaaauuuagcggggcuuacguuaauaaccgcauuagaaccacaaaguauacccuccugaauuucgugccucggaaccuuuuugaacaguuccaucgcgccgccaaucuguacuuucucuuccuggugguccugaacugggugccccucguugaggcuuuucagaaagaaaucacaaugcugccucuuguggucgugcugaccauuaucgccaucaaggacggacucgaggauuauagaaaguacaaaauugacaagcaaaucaauaaccugauuacaaaaguuuacucccggaaggagaaaaaguauaucgaucgcuguuggaaggacgugaccgucggcgauuucauuagacuuucuugcaaugaagugauccccgcugacauggugcugcucuuuagcacggauccugacgggauuugucacaucgagaccuccggacuggauggcgaaagcaaccugaaacagcggcaggucguucgcggcuacgccgagcaggacucugagguggacccggaaaaguucuccagcagaaucgagugcgaaucucccaauaacgaucucucccgguuuagaggguuccuggagcauagcaauaaagaacgcgugggacuuucuaaggagaaccugcuccugcggggcuguacaauuagaaauaccgaggcggucguggggaucguuguguaugccggacacgaaacaaaagcuaugcuuaacaacuccggcccucgcuacaagcggagcaaacuggagagacgcgccaauaccgacguccucuggugcgugaugcugcugguuauuaugugucucacgggggcugugggacacggcaucuggcugucccgguaugaaaagaugcacuuuuucaacguccccgagccugauggccacauuaucucuccccuucuggccggguucuacauguuuuggacaaugaucauucuccugcaagugcuuaucccgauuagccuguaugucuccaucgaaauugugaagcucggacagaucuacuucauccagagcgacguugauuuuuacaaugagaaaauggacucuauugugcagugcagagcgcugaacaucgccgaggaucugggccaaauucaguaucucuucuccgacaagaccgggacacugaccgaaaauaaaauggucuuucgccgguguagcguggcuggauucgauuacugccaugaggaaaacgccagacgccuugagucuuaucaggaagcuguuagcgaggacgaggauuuuaucgacaccguguccggcucucugagcaauauggccaagccucgggcccccuccuguagaacaguccacaacgggccucucggaaauaaacccagcaaccaccuggcuggcagcuccuucacgcugggcagcggggaaggagcgucugaggugccccauucccggcaagccgcuuuuagcuccccuauugaaaccgacgugguuccggauacacgccuucucgacaaguucucucagaucacccccagacuguuuaugccucuggaugagacaauucagaaucccccuauggagacccucuacaucaucgacuucuuuauugcccuggccaucugcaacacggucguggugagcgcucccaaucagccgcggcaaaagauuagacacccuucccuuggcgggcugcccaucaaaucucucgaagagauuaagagccuguuccagcgcugguccguccggagaucuucuuccccuagccugaacucuggaaaagaacccuccagcggcgugccuaaugccuucguuucucgccuuccccucuuuagcagaaugaagccggcguccccuguggaggaagaggucagccaggugugcgagucuccccaguguuccagcuccucugcuugcuguacagaaaccgagaaacaacauggggaugccggccugcugaacggaaaggccgaaagccuccccggccagccucuggcuugcaaccuuuguuaugaggccgaauccccggacgaggcugcccugguuuacgcggcccgggcuuaucagugcacccuccgcucuagaacacccgaacaggugauggucgauuucgccgcucuggggccucugaccuuucaacuucuccacauccugcccuucgacagcgugcggaagcgcauguccguuguggucagacauccucugucuaaucaggugguggucuacacaaaaggagccgauagcguuaucauggaacuccuguccguggcgagccccgacggcgccucucuugagaagcagcagaugauugugcgggagaaaacgcaaaagcaccuggaugacuacgcuaaacaggggcuccgcacccuguguaucgccaagaaggucauguccgauacagaguaugcugaauggcugagaaaccacuuucuugccgagaccagcauugacaaucgggaggaacuccugcuggagucugccaugcgccucgaaaacaaacugacacuucugggagcuaccggcaucgaggacagacuccaggagggggugccugaauccauugaggcgcugcauaaggccggcaucaaaaucuggaugcugacgggagauaagcaagaaaccgcuguuaauauugccuacgccugcaaacuucuggagcccgacgauaaacucuucauccugaacacacagagcaaggacgcuuguggcaugcucaugucuaccauucugaaggaacuucagaagaaaacacaggcccugccggagcaagugucccucagcgaggaucugcugcagccucccgucccucgggacuccgggcuuagagcgggacugaucauuaccggcaagacgcucgaauuugcucugcaggagagccuccagaaacaauuccuggaacuuacaucuuggugccaggccgugguuuguugccgcgccacaccccugcaaaagagcgagguggucaaacucgugcggucccaucugcagguuaugacccuggcuaucggggauggagccaaugacgugucuaugauccaggucgcggauauuggcaucggggugagcggccaggaaggaaugcaggcugugauggccuccgacuuugccgucucucaauucaagcaucuuagcaagcugcuccugguucacggccacuggugcuauaccagacucuccaacaugauucuguacuuuuucuauaaaaauguggcuuacgugaaccuucuguuuugguaucaguucuucuguggguuuucuggaaccagcaugacagauuacuggguccugaucuucuuuaaucuccuguucacguccgccccgccugugauuuacggcguucuugagaaggacgugagcgcugagacccugaugcagcuccccgaacuguaucgcucugggcagaaauccgaggccuaccucccucauacauuuuggaucacccugcuugaugcguucuaucaaagccuggucugcuuuuucgugcccuacuuuacauaucagggaucugacaccgacauuuucgccuuuggcaacccccugaauacggcugcccucuucaucguucugcuucaccuggugaucgaauccaagagccucacauggauucaucugcucgucaucauuggguccauccugucuuacuuccuuuuugcuauuguguucggcgccaugugugugaccugcaacccuccgagcaaucccuauuggaucaugcaggagcacaugcuggauccugucuuuuaccugguuuguauccucaccacauccauugcccugcuuccccgguucguguacagaguccugcagggaagccucuuuccuucucccauccugcgcgcuaaacauuucgaccggcucaccccugaagagagaacaaaggcgcugaagaaauggcgcggcgccgggaagaugaaccaagugacguccaaauaugcuaaccagagcgccggaaagucuggccggagaccgaugcccgggccuagcgccguuuuugcuaugaaauccgccucuagcugcgcgauugagcagggaaaucuuucccugugugaaaccgcucuggaucagggcuacucugagacaaaggccuucgaaauggccggccccagcaaggggaaagaguccuga

SEQ ID NO: 66193 - RNA, 3405 nt, Artificial Sequence
  derived and/or modified sequence opt5 from ATP11A__Homo_sapiens__NP_056020
auggacugcagccuggugagaacccucguccaccgguacugugccggcgaggaaaacuggguugauucccgcacaaucuauguggggcauagagagcccccuccgggagcugaagccuacauuccccagcgguauccugacaaucgcaucgugucuagcaaguacacguucuggaacuuuauucccaaaaaucuguucgagcaauuuagacgggucgcgaacuucuauuuucuuaucauuuuccuggugcagcucaucaucgauaccccuacaucccccguuaccucuggccugccucucuuuuucgugauuacagucaccgcuaucaagcagggguacgaagacuggcugcgccacaaagccgauaaugccaugaaccagugcccggugcauuuuauucaacacggaaagcucguuagaaaacagagccggaagcugcgcgugggcgacaucgucauggugaaggaggaugagacauuccccugugaccugauuuuucucuccucuaauagaggggauggaaccugccaugugacgaccgcuagccuggacggcgaauccagccacaaaacacacuaugccguccaggauaccaagggcuuccauacagaggaagacaucgggggacuucacgcuaccauugagugugagcagccucaacccgaucuguacaaauuuguuggccggaucaacguguacucugaccucaaugacccugugguccgcccccugggguccgaaaaccuucugcucagaggagccacgcugaagaauacagagaaaaucuucggcguggcgauuuauaccgggauggaaacaaagauggcccugaacuaccagagcaagucucagaaacgguccgcuguugaaaagagcaugaaugccuuccucaucguguaucugugcauucuuaucucuaaagcucugauuaacaccguccucaaguacauguggcaguccgaaccguuucgcgaugagccuugguauaaucaaaagaccgagagcgaaagacagcggaaccuguuccuuaaggccuuuacagacuuccuggcguuuauggugcuuuucaacuacaucauccccguuuccauguaugugacggucgagaugcagaaauuucugggaucuuacuucauuaccugggaugaagacauguuugaugaggaaacaggcgagggcccucuggugaauaccagcgaccucaacgaggaacuggggcaagucgaguacaucuucacagauaagaccggaacgcuuacagaaaauaacauggaguuuaaggaauguugcauugagggccauguguauguuccccacgugaucuguaaugggcagguccugcccgaguccagcggaauugacaugaucgauucuuccccuagcgugaacggcagagaacgcgaggaacucuucuuucgggcccugugccuuugucacaccguucaggugaaagacgaugacucugucgacgggccgagaaagagccccgauggaggcaaauccugcguguacaucucuagcuccccugacgagguggcucugguugagggcguccagcgccucggguucaccuaucugcggcugaaggauaauuacauggaaauucucaacagagagaaucauaucgaacgcuucgagcugcuugaaauucugagcuuugacucugugcggagacgcauguccgugaucgucaaaagcgccacaggagagauuuaucucuucugcaagggcgcugauucuuccaucuuuccccgggugauugaggggaagguugaccaaaucagagcccgcguggaacggaacgccgucgagggacugagaacccuguguguggcuuacaaacggcuuauccaggaagaguaugaaggcauuugcaagcuccugcaggcggccaaaguugcucugcaggaucgcgagaagaaacucgccgaggccuacgaacaaaucgagaaggaccugacacuucugggggcuacggccguggaagauagacuccaggagaaggcggcugacaccauugaagcccugcagaaagccggcaucaaggucugggugcugacaggagauaaaauggagaccgcugccgcuacauguuacgccugcaaacuuuuccggagaaauacccagcuccuggagcugacgaccaaacgcauugaggagcaaagccuccacgacguucuguuugaacuuuccaagacagugcugcggcauucuggcagccucaccagagauaaccuguccgggcugucugcggacaugcaggacuauggacuuaucaucgauggcgccgcucucagccugauuaugaagccucgcgaggacggguccagcggaaauuacagagagcuguuccucgaaaucugucggucuugcuccgccguccuguguugccgcauggcuccccuucagaaagcccagauugugaagcugaucaaauuuagcaaggagcacccgauuacacucgcgaucggcgauggggccaacgacgugucuaugauccuggaagcucaugucggcauuggaguuaucggcaaagaggggagacaagccgcucgcaauuccgauuaugccauuccuaaguucaaacaccugaagaagaugcuucucgugcacggacauuuuuacuauauccggauuagcgaacuggugcaguacuucuuuuauaaaaacgucuguuucaucuuuccccaguuccuguaccaauucuuuugcggcuucucucagcagacccucuacgacacggccuaucugacacuuuacaacaucagcuuuaccucccugccuauucuccuguauagccugauggagcagcacguggggaucgauguucuuaagagagaccccacacuguaccgggauguggcuaaaaaugcgcuccugcgcuggagagucuucauuuauuggacccuccugggacuuuuugacgcccugguguucuuuuucggcgcuuacuuuguuuucgagaacaccacagugacgucuaaugggcaaaucuuuggcaacuggaccuucggaacacucgucuucaccgugaugguuuuuacagugacccugaagcuggcccuugauacgcauuauuggacauggauuaaucacuucgucaucuggggcucccugcucuuuuacgugguguucagccugcucuggggaggggucauuuggccuuuucugaacuaccagcggauguauuacguuuucauccagaugcuuuccucuggccccgccuggcuggcuaucgugcuccuggugaccauuagccugcuuccggacguccugaaaaaggugcucugucgccagcuguggccuaccgccacagaaagaguucaaaccaagucccagugccucucuguggagcagagcacaaucuuuaugcugucccagacgucuagcucccuuagcuucuga

SEQ ID NO: 66194 - RNA, 366 nt, Artificial Sequence
  derived and/or modified sequence opt5 from ATP11AUN__Homo_sapiens__NP_997323
augaacagccccgaggccagacugugcguggcucagugucgggacuccuacccuggcugccaaccgcucaaggauacccgcgccugggcgucuagccugaaaauggaccccgcugggcuugaaggaggcccuagagaugagucccgggacgaacccccuauccgcgcccaggccgcuucuugggaucagccccaggggugucugacauauaagggaagacggagcgccuccggcacgcaaaaacagcuccagcugccugacacccuuucuagccugcucugcuggcgcggggcuauuauggucuacaucaagguuacagugcagaccgaugacuccaauaaacugcugagccuccuguauagauga

SEQ ID NO: 66195 - RNA, 3534 nt, Artificial Sequence
  derived and/or modified sequence opt5 from ATP11B__Homo_sapiens__NP_055431
auguggagauggauccggcagcaacugggcuucgaucccccucaccagagcgacacccgcacaauuuacguggccaacagauuuccgcagaaugggcucuauacgccccagaaguucaucgacaaccggauuaucuccucuaaauacaccgucuggaauuuuguuccuaagaaccuguucgagcaauuucgcagaguggcuaauuucuauuuucuuauuaucuuccuggugcagcucaugaucgauacacccaccagcccugucacauccggacugccccuguuuuucgugauuaccguuacagccaucaaacagggcuacgaagacuggcuucggcauaacucugauaaugaggugaacggggcgccugucuaugugguucgcagcggaggccucgugaagaccagauccaaaaauauucgggucggggacaucgugcgcauugcuaaggaugaaaucuuuccggccgaccuggugcugcucucuagcgauagacuggacggauccugccacgucacgaccgccagccuugauggcgagacaaaccugaagacccauguugcugugcccgaaacagcccuccugcagaccguggcuaaucuugacacgcuggucgccgugauugagugucaacagccugaggcggaucucuaccgguucaugggccgcaugaucaucacacagcagauggaagagauuguuagaccccuggggccugaaucucugcuccugcggggagcccgccuuaaaaacaccaaggagaucuuuggcguggcugucuauacagggauggagaccaaaauggcccugaauuacaaguccaaaagccaaaagagaucugcuguggaaaaguccaugaacaccuuccucauuaucuaccugguuauucuuaucagcgaggccgugaucucuacaauucugaaauauacguggcaggcggaagagaagugggacgaacccugguacaaucagaaaaccgagcaccaacggaacuccagcaagauccucagauucauuuccgacuuucuggccuuccugguccucuauaacuuuaucauuccgaucucucuguacgugacagucgagaugcagaaauuccuuggcagcuuuuucaucggaugggaucuggaccucuaucaugaagaguccgaucagaaggcucaggugaauaccagcgaccugaacgaggaacuugggcaaguugaauacguguuuacagauaaaaccggaacgcugacagagaaugagaugcaguuccgcgaaugcucuauuaacggcaugaaguaucaggagaucaauggccggcucgucccugaagggcccaccccugacuccagcgagggaaaccugucuuaccugagcucccucucucaccugaauaaccuuagccaccugaccacauccagcucuuuuagaaccucccccgaaaaugagacagagcucauuaaggaacaugaucuguucuuuaaagccgugagccugugucacacgguucagaucucuaacgugcaaaccgacugcacaggcgaugggcccuggcaguccaaucuugcuccuagccagcucgaguacuaugccuccucuccggacgaaaaggcccuggucgaggcugcggcccgcauuggaaucguguucauuggcaacagcgaggaaaccauggaggugaaaacacuggggaagcucgaacgguacaaacugcuucauauccuggaguuugauuccgacagacgccggaugucuguuaucguccaggcucccagcggagaaaagcuccuguucgccaagggcgccgaguccagcauucugccuaaauguaucggcggggagauugaaaagaccagaauccacguggacgaguucgcucuuaaaggacuccgcacgcugugcauugccuaucggaaguuuaccucuaaagaauacgaggaaaucgauaagagaaucuucgaggcgcgcacagcucugcaacagcgggaggaaaagcucgccgccguguuucaguucauugagaaagaccugauccuucugggcgcuaccgccgucgaagauagacuccaggacaaggugcgggagacaauugaagcucugcgcauggccgggaucaaaguuugggugcugaccggagauaagcacgagacggcggucuccgugagccuuucuuguggccauuuucacagaacaaugaauauucucgagcugaucaaccaaaaauccgacagcgaaugcgccgagcagcugcggcagcucgcuagacgcaucaccgaagaucauguuauucaacacgggcugguggucgacggcacaucucuuagccuggcccuccgggagcaugagaagcuguucauggaaguguguagaaauugcuccgcuguucuguguugccgcauggcgccccuucagaaggccaaagugaucagacucauuaagaucagcccugagaaacccauuacccuggccgucggagauggcgcuaacgacgugucuaugauccaggaagcccacguggggaucggaauuaugggcaaggaggggcggcaggcugcccgcaacuccgauuaugccaucgcuagauuuaaauuccugagcaagcuccuguuuguccacggacauuucuacuauauucggaucgcgacccuuguucaauacuuuuucuacaaaaaugugugcuuuauuacaccgcaguuccuguaucaguucuacugucucuuuucccagcaaacgcuguaugacucuguguaccugacccuuuauaacaucugcuucacaagccugccuauucucaucuacucccugcucgaacagcacgucgauccccaugugcugcagaauaagccuacccuuuaucgcgacaucucuaagaacagacugcucagcauuaaaacauuucuguacuggaccauccugggcuucucccacgccuuuauuuucuuuuucgggucuuaccuucugaucggcaaggacacgagccuccugggaaauggccagauguuugggaacuggacauucggaacccucguuuuuaccgugauggucauuacagugaccguuaaaauggcucuggagacacacuucuggacguggaucaaucaucuugugaccuggggcuccaucauuuucuauuuugucuucagccuguuuuacgggggaauccucuggcccuuccugggcucucaaaacauguauuuuguguucauucagcugcuuuccagcgggucugccugguuugccaucauucugaugguugugacaugucucuuccuggauaucaucaagaaagucuuugaccggcaccuccauccuaccuccacagagaaggcucagcugaccgaaacgaaugccggcauuaagugccuugauagcauguguugcuuccccgagggagaagcggcuugugccucugugggccgcaugcuggagagagugaucgggcggugcuccccgacccacauuagccgcuccuggagcgccucugacccuuuuuacacaaacgauagaagcauccugacccucuccacaauggacucuagcaccuguuga

SEQ ID NO: 66196 - RNA, 3138 nt, Artificial Sequence
  derived and/or modified sequence opt5 from ATP12A__Homo_sapiens__NP_001172014
augcaccagaagacccccgagaucuacagcguggaacuguccggcacaaaagacauugucaagacggauaaaggggacggaaaggagaaauauagaggccucaagaacaauugccuggaacuuaagaaaaagaaccauaaagaggaguuccaaaaggaacugcaccucgaugaccauaaacugucuaaucgggagcuugaagagaaguacgggaccgauaucauuaugggacugagcuccacacgcgccgcugaacuccuggccagagacggcccuaacucucugaccccgcccaagcagacaccugagaucguuaaauuucucaagcagauggucgggggauucagcauucugcuuugggugggcgcguuucuguguuggaucgcuuauggcauccaguacuccucugauaaaagcgccucccucaauaacguguaucuggggugcgugcuuggacugguugugauucucaccggcaucuucgccuacuaucaagaggcuaagagcacaaauauuaugucuuccuuuaacaaaaugaucccccagcaggcccuggucauucgggacagcgaaaagaaaaccaucccuucugagcagcuggugguuggggauauuguggaagucaagggaggcgaccaaauccccgcugauauccgcgugcucuccagccagggguguagaguggacaauucuucccugacgggagagagcgaaccucagccgcgguccucugaguucacccacgagaacccccuugaaacaaagaauauuugcuuuuacagcaccacaugucuggaggccuccaccagcccugucggcacgguuacaggcauggugaucaacaccggggaucgcacaauuaucggacauauugcgucucucgccuccggcguggggaaugaaaagacccccaucgcuaucgagauugaacacuucguccacaucguggccggaguugcugugagcauuggcauccuguuuuucauuaucgccgucucucuuaaguaccaggugcuggacagcaucauuuuucucaucgggauuaucguugcgaacgugccugagggacugcuggccaccgucacagugacgcucucccugaccgcuaaaagaauggccaagaaaaauugccuugucaagaaccuggaggcuguggaaacacucggcucuaccagcauuaucuguuccgacaagacaggcacccugacgcaaaaccggaugacaguugcccaucuuugguucgauaaucagauuuuuguggccgacaccagcgaggaucacucuaaccaggucuucgaccaauccagccgcaccugggcuucucuguccaaaaucaucacacucugcaauagagcggaguucaagcccgggcaggaaaacgugccgauuaugaaaaaggccguuaucggagaugcuagcgaaaccgcccugcugaaauuuuccgaggugauucucggcgacgucauggagauccggaagcgcaauagaaagguggccgaaauuccuuucaacucuacaaauaaauuucagcugagcauccaugagauggaugacccccacgggaagcgguuccuuauggugaugaaaggagcuccugaacgcauccuggagaaguguuccacgauuaugaucaacggcgaggaacacccccucgauaaaucuaccgccaagacauuucauaccgcguauauggagcuugggggccugggagaaagaguucugggcuucugccaccucuaccugcccgcugacgaguuuccugaaacauauagcuucgauauugacgccaugaauuuuccgaccuccaaccuguguuucgucgggcuccugagcaugaucgaucccccucggucuacggugcccgacgccgugaccaagugcagauccgcuggaauuaaagucaucauggugacaggcgaccauccuaucaccgccaaggcuauugccaaaagcguugggaucauuucugccaauuccgagacaguggaggauaucgcgcaccgccuuaacauugcugucgaacaggugaauaagcgggacgccaaagcugccguugugaccggaauggagcugaaggauaugagcucugaacaacucgacgagauccuggcgaacuaccaggaaaucgucuuugccagaacgagcccccagcagaaacugauuaucguggagggcugccaacgccaggaugcuguuguggccgucacaggggacggcgugaaugauuccccggcucuuaagaaggccgacauuggaaucgccaugggcauugcugggagcgaugcggccaaaaacgcugccgacauggugcuccuggaugacaacuucgccucuaucgucaccggaguugaggaaggccggcugauuuuugacaaucucaagaaaacaaucgcuuauucccugaccaagaacaucgccgagcuuuguccuuuccugauuuacaucauuguggggcucccccugccuaucggaaccauuacaauccuguucaucgaucuuggcacggacauuauccccagcauugcgcucgcuuaugaaaaagccgaguccgauaucaugaauagaaagccucgccauaagaacaaagaccggcuggugaaucagccccuggccgucuacucuuaccuccacauugggcugaugcaggcucuuggcgccuuucugguguauuucaccguuuacgcgcaagaaggauuucucccgagaacacugaucaaccugcgcguggagugggagaaggauuaugucaaugaccuuaaagauagcuacggccaggaauggacccgguaucagagagaguaccucgaauggacaggguauaccgcuuucuuugugggaauccugguucagcaaauugccgaccugaucauucgcaagacgcggagaaacuccaucuuccagcagggccucuuucggaauaaagugauuugggucgggaucacaucucaaauuaucaucggacugauucuuagcuacggccugggguccgugaccgcccucucuuucaccaugcugcgcgcucaguacugguuuguugccgugccucacgcuauccugauuugggucuaugaugaggugagaaaacuuuucauccggcuguaccccggcagcuggugggacaagaacauguauuacuga

SEQ ID NO: 66197 - RNA, 3681 nt, Artificial Sequence
  derived and/or modified sequence opt5 from ATP13A3__Homo_sapiens__NP_078800
auggacagagaggaacggaagaccaucaaccagggccaagaggaugaaauggagauuuacggguauaaucugagccgcuggaaacucgccaucgugucccugggagucauuugcucuggcggguuccuucugcuccugcuuuacuggaugcccgaauggagaguuaaggcuacaugugugcgggccgcgaucaaagacugcgaggugguccugcuccgcacgaccgaugaguuuaagaugugguucugugcuaaaauuagagugcugagccuggaaacauauccuguuuccucucccaagagcauguccaacaagcucucuaauggacacgccgugugccugaucgagaacccgaccgaagagaaucggcaucgcaucagcaaauacucccagacagagagccagcagauuagauauuuuacccaccauucugucaaguacuucuggaacgacacaauccacaauuuugauuuccuuaaaggccuggacgaagggguguccuguaccagcauuuaugagaagcauucugccggacucacgaaaggcaugcacgcuuaccggaagcugcuuuacggcguuaacgaaaucgccgugaaggucccuuccguguuuaaacugcucauuaaggaggugcugaaucccuucuauaucuuucaacuguucagcgucauucucuggucuaccgaugaauacuauuacuaugcucuggccaucguugugauguccaucgugagcauugucuccucucuuuacagcauccgcaaacaguaugugaugcugcacgacaugguugcgacacauuccaccgugagagucagcgugugccggguuaacgaggagauugaagagaucuuuucuacagaucucgugccuggggacgucauggugauuccccugaauggaaccaucaugccuugugaugccguccuuaucaacggcacgugcauugugaaugaauccaugcugacaggggagagcguuccggugaccaagacaaaccuccccaauccuucugucgacgugaaaggaaucggcgaugaacuguacaaccccgagacccacaagcgccauacccuguucugugggacaacgguuauucagaccagauuuuacacaggagagcucgugaaagcuaucgucgugcggaccggcuucagcacauccaagggccagcuggugcgcucuauucuuuauccuaagcccaccgacuucaaacuguacagagacgccuaucucuuucugcuuugccugguugcugucgccgggaucggauucaucuacacgauuaucaacagcauucucaaugaagugcaagugggcgucaucauuaucgagucccuggauauuaucacaaucaccgugccgccugcgcugcccgccgcuaugaccgccgggauuguuuaugcucagcggagacucaagaaaaucggaaucuuuuguauuagcccucagcgcauuaacaucugcggccagcugaaucuugugugcuucgacaagacagggacccugacagaagauggacucgaccuguggggcauccaacgggucgagaacgccagauuucugucucccgaagagaauguguguaacgagaugcuuguuaaaucccaguucguggccugcauggcuacgugucacagccucaccaagauugaaggcguccugucuggggauccccuggaccucaagauguuugaggcgaucggauggauucuggaagaggccacagaggaagagaccgcucugcacaaucgcaucaugccuacagugguucggccgcccaaacagcugcucccugaauccacccccgccggcaaccaagagauggaacuguucgagcugccugccacguacgagauugggaucgugagacaguuucccuucagcuccgcccuucagcgcaugucugucguggcucgggugcucggagauagaaagauggacgcguauaugaaaggcgcuccggaagccaucgccgggcugugcaagccugagaccguccccguugauuuucagaaugugcuggaagacuucacaaaacaaggcuuucgcgugauugcucucgcccaucggaagcuggagagcaaacuuaccuggcacaaaguccagaacaucuccagagaugcuauugaaaauaacauggacuucaugggacugaucauuaugcagaauaagcucaaacaggagaccccugccgugcuggaggaccugcauaaggcgaacauccgcacaguuauggugacgggcgauucuaugcuuacagccgucagcguggcucgggacugugggaugauccucccccaagauaaaguuauuaucgccgaagcucugccucccaaggacggaaagguggccaaaauuaauuggcacuacgcggauucccugacccagugcagccauccgucugccaucgacccugaggcuauucccgucaagcucgugcacgauucccuggaagaccuucagaugacaagauaccacuucgccaugaacggcaagagcuuuucuguuauccuggagcauuuccaggaucucgugcccaagcugaugcugcacgggaccgucuuugcucggauggccccugaccagaaaacccaacuuauugaagcccuccagaacguggauuauuucgugggaauguguggcgacggggcuaaugauugcggcgcgcugaagcgcgcccauggaggcaucucccugagcgagcucgaggcuucugucgccagcccguuuacauccaaaacgcccagcaucucuuguguuccuaaccugauuagagaagggcgggccgcucuuaucaccuccuucugcguguuuaaguucauggcccuguacagcauuauccaguauuuuuccgugacacuccuguacucuauucugagcaaucuuggagacuuccaauuucuguucaucgaccucgcgaucauucuggucgugguuuuuaccaugucccucaaccccgcuuggaaggagcugguggcccagagaccucccucuggccuuaucagcggggcccuucucuucuccguccugucucagauuaucauuuguaucggauuccaaagccugggcuuuuucugggugaaacagcagccuugguaugaaguuuggcaccccaaguccgaugcuugcaauacaaccgggagcggcuuuuggaacucuucccacguggacaaugagacggagcuugaugaacauaacauccagaauuacgagaacacaaccgucuucuuuauuagcucuuuccaauaucugaucguggccauugcguuuuccaaaggaaagccguuccgccagccuugcuacaaaaauuacuuuuucgucuuuagcgugaucuuccucuauauuuucauccuguuuauuaugcucuaccccguugcuucuguggaccagguccugcagaucguguguguuccuuaucaauggcgggugaccaugcuuaucauuguccuggugaacgccuucguguccaucacaguugaagagagcgucgauagauggggcaagugcugucuccccugggcccuggggugccgcaagaaaaccccgaaggcuaaauacauguaucuggcccaggaacuucugguggacccugaguggcccccuaagccccagacaacgaccgaggcuaaagcccucgugaaggaaaauggauccugucagauuaucacaauuaccuga

SEQ ID NO: 66198 - RNA, 3591 nt, Artificial Sequence
  derived and/or modified sequence opt5 from ATP13A4__Homo_sapiens__NP_115655
augggccacuucgagaaggggcagcaugcccugcucaacgaaggagaggaaaaugagauggaaaucuuuggcuacagaacccaagggugccggaaaagccugugucuugcuggauccauuuucucuuuuggcauccugccccucguguucuauuggcgcccugccuggcacgucugggcgcauugcguuccguguagccugcaggaggcugacacagugcuucugagaacgaccgaugaguuucagauuuacuccuggaagaaagugaucuggauuuaucucucugcccugaacagcgccuucgggcugacacccgaccacccucucaugaccgaugaagaguacaucaucaaucgggcuauucgcaagcccgaccugaaagucagaugcaucaaggugcagaagauucgguauguuuggaacuaccuugaaggacaauuucagaaaaucggcucccuggaggauuggcucucuagcgccaagauucaucagaaauucggcuccgggcugacacgcgaggaacaggagaucagacggcuuauuuguggaccuaauaccaucgacguggaagucacacccaucuggaagcugcucauuaaagaggugcugaacccuuuuuauaucuuccaacuguuuagcguuugccucugguucucugaagauuacaaggaguacgcuuuugccauuaucauuauguccaucaucagcauuucucugaccguguaugaccuucgcgagcaguccgucaagcugcaccaccucguggaaagccauaauucuaucacgguguccgucuguggcagaaaagcggggguucaggagcuggaaagccgggugcuugugccgggagaucugcucauucugaccggcaacaagguccugaugcccugcgacgccgugcucaucgagggguccuguguuguggaugaaggaaugcugacaggcgagucuauuccugucaccaaaacaccccuuccuaagauggacagcuccgugcccuggaaaacccagagcgaggcugauuacaagcgccacguucuguucugcggcacggaagugauccaagccaaagcugccuguucugggacagucagagcggugguccuccagaccggauucaauacagccaagggcgaccuggugcgguccauccuuuauccgaagccuguuaacuuucagcuguaccgcgacgcuauuagauuccuccugugccugguggggaccgccaccaucggaaugauuuauacacucugcgucuacgugcugagcggcgagcccccugaagagguugugcggaaagcucuugaugucaucacgauugccgugccucccgcccugcccgcugcgcucaccacagggaucauuuaugcccaaagacgccugaagaaacggggaaucuuuuguaucucuccgcagagaauuaaugugugcggccagcugaaccuuguuuguuucgacaagaccggcacacucacccgcgaugggcuggaccuguggggagucgugagcugcgaucggaauggcuuucaggaagugcauuccuucgcuucugggcaagcccuccccuggggaccucugugugccgcuauggccagcugccacucccuuauccugcucgacggcacgauucagggggauccccuggaccugaaaauguuugaggcgacaaccugggagauggcuuucagcggcgaugacuuucacaucaagggagucccugcccaugccauggugguuaagcccuguagaaccgcuucucaggugccggucgaaggcauugccauccuucaccaguucccuuuuuccagcgcucuccaacgcaugacagugaucguucaggagaugggaggggaucggcuggccuucaugaaaggcgcgcccgaaagaguggccucuuuuugccagccugagaccguccccacauccuucgugagcgagcugcagauuuacacgacccaaggguuccgcguuaucgcucucgccuacaagaaacuggaaaacgaccaucacgcuacaacccuuacacgggagaccguggaauccgaccugauuuuucucggacugcugauccuugagaauagacucaaggaagagacgaaaccuguccuggaggaacugauuucugcccgcauccggaccgugaugaucacaggcgauaaccuccagaccgcgauuacaguggccagaaagagcgggauggucuccgagucucagaagguuauccugauugaagcuaacgagaccacgggcagcuccagcgccucuaucuccuggacacuuguggaagagaaaaagcauauuauguauggaaaucaggacaacuacaucaauauccgggaugaggugagcgacaaaggccgcgaagggucuuaucacuucgcucugaccggaaaguccuuucacgucauuagccaacauuucucuagccuccugcccaaaauccugauuaacggcacaaucuuugccagaauguccccggggcaaaagagcucucuuguggaggaguuccagaagcucgauuacuuuguuggaauguguggcgacggggccaaugauugcggcgcucugaaaauggcgcacgugggaauuucccugagcgaacaggaagccuccgucgcuucuccuuucaccagcaagacccccaacaucgagugugugccccaucucauuaaagagggccgggccgcccugguuacauccuuuugcauguucaaguauauggcucuuuacucuaugauccaguauguggggguccugcuccuguacugggaaacgaauagccuguccaacuaccaguuucuuuuccaggaccuggccaucaccacacucauuggagugaccaugaaucugaacggcgcguauccuaaacucguuccguuuagacccgcugggcgccugaucucuccuccccuucugcucagcgugauuuucaauauccugcugucccuugccaugcacauugccggauucauccugguccaacggcagccuugguacagcguggagauccacucugcuugcacagugcagaacgaauccauuagcgagcucaccaugucucccacggccccugagaagauggaauccaauagcacauuuaccucuuucgagaacaccacagucugguuucugggcaccaucaauuguauuacaguugcgcucguguucuccaaagggaagcccuuuagacagccgacguauaccaacuacaucuucgugcugguccuuauuauccaacugggcgugugccucuuuauccuguucgcugauauuccugaacuguaucgcagacuugaccugcucuguacacccguucuguggcgggccagcaucgugauuaugcucucccugaacuuuaucgucagccuuguggccgaggaagcuguuauugagaaucgcgcccuguggaugaugaucaagagaugcuucggauaccagucuaaaagccaguaucggauuuggcagcgcgaucuggcuaacgacccuuccuggcccccgcucaaucaaaccucucauagcgauaugccugaguguggcagagggguguccuacucuaaccccgucuuugaaagcaaugaggaacagcuguga

SEQ ID NO: 66199 - RNA, 3063 nt, Artificial Sequence
  derived and/or modified sequence opt5 from ATP1A2__Homo_sapiens__NP_000693
augggcagaggggccggacgggaguacagccccgcugccaccacagcggaaaacggcgggggaaagaaaaagcagaaagagaaggaacuggacgagcucaaaaaggaaguggcuauggaugaccacaagcugucccuugaugagcugggccgcaaauaucaagucgaccucucuaaggggcugacgaaucagagagcccaggauguucuugcccgggacggaccuaacgcucugaccccgcccccuacaacccccgagugggugaaauucugccgccagcucuuuggcggcuucagcauccugcuguggauuggggccauccucuguuuucuggcuuacggcauucaagccgcgauggaagaugagccuuccaaugacaaccuuuaucugggagugguccucgccgcugugguuaucgugacagggugcuucucuuacuaucaggaagccaagagcuccaaaauuauggauucuuuuaagaauauggucccccagcaggcucuggugaucagagagggagagaagaugcaaaucaacgccgaagagguuguggucggcgaccuuguggaagugaaagggggagaucgggucccugcggaccugcgcauuaucagcucccauggcuguaagguugauaauagcucucucaccggcgaguccgaaccgcagacaagaagccccgaguucacccacgagaacccucuggaaacgcggaauauuugcuuuuucucuaccaacuguguggaggggacagcccgcggaaucgugauugcuaccggcgacagaacagucauggggcggaucgccacccuggcuuccggacucgaagugggccgcacgcccauugccauggagaucgaacauuuuauccagcugauuacagggguugccguguuccuuggagucagcuuuuucgugcugucucucauccugggcuacuccuggcuugaggcuguuauuuuucugaucggcauuaucguggcgaaugucccugaggggcuccuggccaccgugacagucugccugacccucaccgcuaaaagaauggcccggaagaacugucuggugaaaaaucuugaagccguugagacacugggaagcacguccaccaucugcucugacaagacaggcacccucacacagaaccgcaugaccguggcucacaugugguucgauaaucaaauucaugaagccgacacgacagaggaucagagcggggcgaccuucgacaaaagaucccccaccuggacagcucugagccggaucgccggacuuuguaacagagccgucuuuaaggcuggccaggaaaacauuucuguguccaagcgcgauaccgccggggacgcuagcgagucugcccugcucaaaugcaucgagcugagcuguggcuccguucggaagaugagagaucgcaauccgaaaguggcggaaauuccuuucaacucuacaaauaaguaucaacugagcauccacgagcgggaagacagcccccagucccacguccucgugaugaaaggagccccugagagaauccuggaucgcugcucuacgauucuugugcagggcaaggagaucccccuggacaaggaaaugcaggaugcuuuucaaaacgccuacauggagcucgggggacugggcgaacggguucugggguucugccagcuuaaucuccccuccggaaaauuuccuagaggcuucaaguuugacaccgacgagcugaacuucccgacagaaaaacuguguuuugucgggcucaugagcaugauugaucccccucgcgcugccgugcccgacgcggugggcaagugccggucugccggaaucaaagucauuauggugaccggcgaucauccuaucacagcuaaggccauugcuaaggggguuggaaucaucuccgagggcaaugagaccguggaagacauugccgccagacugaacauccccaugagccaggucaauccgcgcgaggcuaaagcgugugugguucacggguccgaucuuaaggacaugacgucugaacagcuggaugagauucucaaaaaccauaccgaaaucguguucgcccggacaagcccucaacagaagcugauuaucgucgagggaugccagagacagggcgcuaucguggccguuaccggggacggcgugaaugauucccccgcccugaaaaaggcugacauuggaaucgccaugggcauuucugggagcgaugucuccaagcaagcggcugacaugauccuucucgaugacaacuuugccagcauugugacaggaguggaggaaggccggcugaucuucgacaaucugaaaaagucuaucgccuacacccucacguccaacauuccugagaucacacccuuucugcuuuucauuaucgcuaauauuccucugccccucgggaccgucacaauccuguguaucgaucugggaaccgacaugguuccggccauuagccuugcguaugaagcugccgagucugauaucaugaaacgccagccuagaaacucccagaccgacaagcucgugaacgaacggcugauuagcauggccuacggccagaucgggaugauucaagcucugggcggauucuuuacauauuucgugauccucgccgagaauggcuuucugcccucuagacuucuggggauucgccucgauugggacgaucggacgaugaacgaccuggaggauagcuacggacaggaauggaccuaugagcagagaaaagucguggaauuuacaugccacaccgcuuucuucgccuccaucguugugguccaaugggcggaccugaucauuuguaagacacgcagaaauagcguguuucagcagggcaugaaaaacaagauccuuauuuucgggcuccuggaggagaccgcccuggcugccuuucucucuuacugccccggaaugggcguugcucugcggauguauccucuuaaggugacguggugguucugugccuuuccguacucccugcucaucuucauuuacgaugaaguccgcaaacugauccugagacgguaucccggcggguggguggagaaggaaacauacuauuga

SEQ ID NO: 66200 - RNA, 3075 nt, Artificial Sequence
  derived and/or modified sequence opt5 from ATP1A3__Homo_sapiens__NP_001243142
augggcgggugggaggaagagagaaaccggcgcgccaccgacaagaaagaugacaaggauagccccaaaaagaauaaaggaaaggaaagacgggaccuggaugaccucaagaaagagguggcuaugacagaacacaagauguccgucgaggagguuugccgcaaauacaacacggauugugugcagggccugacccauucuaaggcccaagaaauccuugcgagagacgggccuaaugcucugacaccgcccccuaccacacccgagugggugaaauucugccggcagcucuuuggaggcuucagcauucugcuuuggaucggggccauucuguguuuucucgccuauggaauccaggcuggcaccgaagaugacccuuccggcgauaaccuguaccuggggauuguccucgccgcugugguuaucaucacaggaugcuucucuuauuaccaggaggccaagagcuccaagauuauggagucuuuuaaaaauauggugccccaacaggcgcuggucauccgcgaaggcgagaagaugcaagugaacgccgaagagguuguggucggggaccuuguggaaauuaaaggaggcgauagagugccugcugaccugcggaucauuagcgcccacggguguaaggucgacaauuccagccucaccggagagucugagccgcagacgcgcucccccgauugcacccaugacaacccucuggaaacaagaaauaucaccuucuuuagcacaaacuguguugagggcaccgcucggggcgugguggucgccacgggggaucgcacagugaugggaagaauugcgacccuugccucuggccuggaaguugggaaaacacccaucgcuaucgagauugaacacuucauccagcucauuaccggaguggccgucuuucugggcguguccuucuuuauccugagccucauucugggguauaccuggcuugaggcuguuaucuuccugaucggaauuaucguggccaaugucccugagggccuccuggccacagugacggucugccuuacccugacagcuaagcggauggcgcgcaaaaacugucucgugaagaaucuggaagccguugagacccugggcucuacauccaccauuugcagcgacaagacggggacacucacccagaacagaaugaccguggcucauaugugguuugauaaucagauccacgaagccgacacaaccgaggaucaguccggaacaucuuucgacaaaagcucccacacgugggucgcccugagccauauugcuggccuuuguaaccgggccguguucaaagggggacaagauaacauccccguucugaaaagagacguggcgggcgaugcuucugaauccgcccuccugaagugcaucgagcuuagcucugggagcgucaaacugaugcgcgagcggaauaagaagguggccgaaauuccguuuaacuccaccaauaaauaccagcucucuauccacgagacagaagacccuaacgacaauagauaucugcuggugaugaagggcgcucccgagcgcauucucgaucggugcagcaccauccugcuucagggaaaagagcaaccucuggacgaagagaugaaggaagccuuccagaacgcuuaccucgagcugggcgggcugggagaaagaguucuuggcuuuugucauuacuaucuccccgaggagcaguuccccaaaggguuugccuucgauugcgacgaugucaauuuuacaaccgacaaccuguguuucgugggacugauguccaugauugauccuccgcgcgcggccgugcccgacgcugucggcaagugccggagcgccgggaucaaggugauuaugguuacgggcgaucacccuaucaccgcuaaagccaucgcgaagggagugggcauuaucucugaagggaaugagacagucgaagacauugccgcuagacucaacauccccgugucccagguuaauccucgcgaugccaaggcuugugugauucacggaaccgaccugaaggauuuuacaagcgagcaaaucgacgaaauccuucagaaccauaccgagauugucuucgcccggacgucuccccagcagaaacugaucauuguggagggcugccaaagacagggggccaucguugcugugacaggagacggcgucaaugauuccccggcgcucaagaaggccgacauugggguggcuaugggcaucgccggaagcgauguguccaaacaggccgcugacaugauccugcuggaugacaacuuugccucuauugucaccggcguugaagaggggcgccuuaucuucgauaaucucaagaaaagcauugcguacacacugaccuccaacaucccugaaauuacccccuuucuccuguucaucauggcuaacaucccucugccccuuggaacaauuacgauccuguguauugaccucggcaccgauauggugccugccaucucucuggccuaugaggcugccgaaagcgacauuaugaagcggcagcccagaaauccgcggacagauaaacuggugaacgagcgccuuaucuccauggcguacgggcaaauuggaaugauccaggcucucggcggguucuuuagcuauuucgucauccuggccgagaauggcuuucugccuggaaaccucgugggcauuagacugaauugggacgaucggaccguuaacgaccuugaagacucuuacgggcagcaguggacauaugagcaaagaaagguggucgaauuuaccugccacacggccuucuucguguccaucguugugguccagugggcugaucugauuaucuguaaaacacgccggaauagcguguuucagcaaggaaugaagaacaagauucucaucuucggccuguuugaggagaccgcccuggcugccuuccuuucuuacugccccgggauggacguugcgcucagaauguacccccugaaaccuuccuggugguuuugugccuucccguauagcuuucugaucuucguguacgaugaaauucgcaagcucauccugagacggaaucccggaggcugggucgagaaagaaaccuauuacuga

SEQ ID NO: 66201 - RNA, 498 nt, Artificial Sequence
  derived and/or modified sequence opt5 from ATP1A4__Homo_sapiens__NP_001001734
augauccaggcccuggcuggcuucuuuaccuacuucgugauucucgccgagaacggguuuagacccgucgaccugcuuggaauccggcugcacugggaagauaaguaucucaaugaccuggaggauagcuacggccaacaguggacauaugaacagcgcaaaguuguggaguucacgugccagaccgcguuuuucgugacaauugucgugguucaaugggcugaccuuaucauuuccaagaccagacggaacucucuguuucagcaggggaugcgcaauaaagugcucaucuucggaauccuggaagagacacugcucgccgccuuucugagcuacaccccuggcauggaugucgcucuuagaauguauccgcugaagauuacaugguggcucugugccauccccuacuccauucugaucuucguguaugacgagauucggaaacuucugauccgccagcauccugauggguggguugaaagagagaccuacuacuga

SEQ ID NO: 66202 - RNA, 912 nt, Artificial Sequence
  derived and/or modified sequence opt5 from ATP1B1__Homo_sapiens__NP_001668
auggccagaggcaaggcuaaagaggaagggagcuggaagaaauucaucuggaacuccgagaagaaagaauuucugggacggaccggcgggucuugguucaagauucuccuguuuuacgugaucuucuauggaugccuugccggcauuuuuaucgggacaauucaggucaugcugcucacgaucagcgaguucaagcccaccuaccaagaccgcguugcgccuccgggacugacacagaucccccagauucagaaaaccgaaaucuccuuuagaccuaaugaucccaagucuuaugaggcuuacgugcuuaacauugugcgguuccuggagaaauauaaggacagcgcccaacgcgaugacaugaucuuugaagauuguggcgacgucccuuccgagcccaaagaaagaggcgauuucaaucacgagcgcggggagcggaaggugugcagauuuaagcucgaauggcugggaaacuguucuggccugaaugacgagacauacggguauaaagaaggaaagccuugcauuaucauuaaacucaaccggguucugggcuucaagccgaaacccccuaagaaugagagccuugaaaccuaccccgugaugaaauacaacccuaauguccugcccgugcaguguacagggaagcgcgaugaggacaaggauaaaguuggaaacguggaguauuuuggccucggcaauuccccgggguucccucugcaguacuaucccuacuauggaaaacuucugcagccuaaguaccuccaaccccugcuggccguccaguucaccaaccucacgauggacaccgaaaucagaaucgagugcaaggcuuauggcgaaaauauuggguacagcgagaaagaucgguuucagggacgcuucgacgugaagaucgaagugaagucuuga

SEQ ID NO: 66203 - RNA, 873 nt, Artificial Sequence
  derived and/or modified sequence opt5 from ATP1B2__Homo_sapiens__NP_001669
auggugauccagaaggagaaaaagagcugcggccaagucguugaagaguggaaagaguucguguggaaccccagaacccaccaguuuauggggcggacaggaacguccugggccuucauucugcucuuuuaccugguguucuauggcuuucuuaccgcuauguucacacugaccaugugggucaugcuccagacagugucugaccauaccccuaaguaccaggaucgccuggccacaccggggcuuaugaucagacccaaaaccgaaaaucuggacguuauugugaacgucagcgauacggaauccugggaccaacacgugcagaagcucaauaaguuucuggagccuuauaacgauucuauccaggcgcagaaaaaugacguuugucggcccggacgcuacuaugagcaaccugauaacggcgugcugaauuaccccaagagagcuugccaguucaaccggacccagcucgggaauuguagcggaauuggcgacuccacacauuauggcuacucuaccgggcagccuugcgucuuuaucaaaaugaaccgcgugaucaauuucuacgccggagccaaccaaagcaugaaugugacaugugcuggcaagagagaugaagacgccgagaaccuggggaauuuugucauguucccggcuaacggaaacauugaucuuauguauuuucccuacuauggcaaaaaguuccacguuaauuacacccagccucugguggccgugaaguuccucaacgucacgcccaauguggaaguuaacguggagugccggaucaaugcggccaacauugcuacagacgaugagcgcgacaaauuugccgggagagucgcuuucaagcugcggaucaauaaaaccuga

SEQ ID NO: 66204 - RNA, 2610 nt, Artificial Sequence
  derived and/or modified sequence opt5 from ATP2A1__Homo_sapiens__NP_001273004
augggcaagguguacagagccgaccggaaaagcguccagcgcaucaaggcuagagauauuguucccggggacaucguggagguggccgucggagauaaagugccugcggacauucggauccuggcuauuaaguccaccacacuccgcguugaucaaucuauccugacgggcgaaagcguguccgucaucaaacacaccgagccggugcccgacccuagagccguuaaccaggauaagaagaauaugcuuuucucugggacaaacauugccgcuggaaaagcccugggcaucguggcuaccacaggggucggaaccgaaauuggcaagauccgggaccagauggccgcgacagagcaggauaaaacgccccuccaacagaagcuggacgaauuuggcgagcagcuuagcaaagugauuucccugaucugcguggccgucuggcucauuaauaucgggcauuucaacgauccuguucacggaggcucuugguuucgcggggcuaucuauuacuucaagauugccguggcucuggccguggcggccauccccgagggacugccugcugucauuaccaccugucucgcccugggcacaagacggauggcuaagaaaaaugccaucgugcgcagccuuccguccguugaaacccuggggugcacaagcgugauuuguucugacaagaccggaacgcucacaaccaaccagauguccgucugcaaaauguuuaucaucgauaagguggacggcgacauuugucugcuuaaugaguucagcaucacaggcucuaccuaugcccccgaaggggagguucugaaaaacgauaagccugugagacccggacaauacgacggccucgucgagcuggcuaccauuugcgcgcuguguaaugauuccagccucgacuuuaacgaagccaaagggguguaugagaaggucggagaagcuacagagacggcccugaccacacuuguggaaaagaugaauguuuucaacaccgaugugcggucucuguccaaagucgagcgcgccaaugcuugcaacagcgugaucagacagcucaugaagaaagaguuuacacuggaguucucccgggaccgcaagucuaugagcguuuacuguuccccugccaaaagcucuagagcggcugugggcaauaagauguuugucaagggggcccccgaaggagugauugaucggugcaacuaugugagaguuggcaccacgcgcgucccgcuuacaggcccugugaaagaaaagaucauggccgugaucaaagagugggggaccggacgggacacccugagaugucucgcucuggccacacgcgauacacccccuaagcgggaagagaugguccuggacgauuccgcuagauuccucgaguacgaaaccgaccugacguuugugggcguuguggggaugcuugacccuccccgcaaagaggucaccggaagcauucagcugugccgggaugccggcaucagagugauuaugaucacaggggacaacaagggcaccgcgauugccaucugccgccggauuggaaucuucggcgaaaaugaggaaguugcugauagagccuacacagggcgcgaguucgacgaucucccccuggcugagcagcgggaagccuguagacgggcgugcuguuuugcccgcguggagccgucucauaagagcaaaaucgucgaauaucuucaauccuacgacgagauuaccgcuaugacgggagauggcgugaacgacgcccccgcucugaagaaagccgagaucgggauugccaugggaucuggcaccgcuguugcgaagacagccagcgaaauggugcucgcugaugacaauuucuccaccaucgucgccgccguggaggaagggagagcuauuuauaacaauaugaaacaguuuauccgguaccugaucagcucuaacgugggcgaggucguuugcauuuuccugacagccgcgcucggacugccugaagcucuuauccccgugcagcugcucugggugaaucuggucaccgauggccugccugccacggcccuuggguuuaaucccccggaccucgauauuauggacagaccuccccgcuccccuaaggagccccugaucagcggauggcuguucuuucgguauauggcuauuggcggguacgugggagccgcgacaguuggcgcugccgccuggugguuccucuaugcugaggacgggccucacgugaacuacucucaacugacccauuuuaugcaguguacagaagauaacacccacuucgagggcaucgacugcgaagucuuugaggcccccgaaccgaugaccauggcucuuuccgugcugguuacaaucgagauguguaaugcccucaacagccuguccgagaaucagucucugcuuagaaugccucccugggugaacauuuggcuccugggaagcaucugccuguccaugucucuccacuuccugauucuuuacgucgauccccugccuaugaucuuuaagcuccgcgcgcuggaccugacgcaguggcuuauggugcucaaaauuagccugccgguuaucggccuggaugaaauccucaaguucguggccagaaauuaucuggagggguga

SEQ ID NO: 66205 - RNA, 2994 nt, Artificial Sequence
  derived and/or modified sequence opt5 from ATP2A2__Homo_sapiens__NP_001672
auggagaacgcccacaccaagacaguggaagagguccugggccauuucgggguuaaugaaagcacgggacucucccuggaacaggugaaaaagcugaaagagagauggggcucuaacgagcuucccgcugaggaagggaagacccuccuggagcuugugaucgaacaauuugaggaccugcucguccggauucugcugcucgccgcgugcaucagcuucgugcuggcuugguuugaggaaggagaggaaacaauuaccgccuucguugagccuuuugugauccuucugauucucgucgccaaugcuaucgugggcguuuggcaggaacgcaacgccgagaaugcuaucgaggcccugaaagaauacgagccggaaauggggaagguguauagacaggaucggaaguccguccagcgcauuaaagcgaaggacaucgugcccggagauauuguggagaucgccgucggcgacaaaguuccugcugauauuagacuuacaucuaucaagagcaccacacugcggguggaccaauccauucucaccggcgaaucugugagcgucaucaaacacacggaucccgugccugacccccgcgccguuaaccaggauaagaagaauaugcuguucuccgggaccaacaucgcugccggaaaagcgaugggcguggucguggccacagggguuaauaccgagauuggaaagaucagagacgagaugguggcuacagaacaggagcggaccccucugcagcaaaaacucgaugaauuuggcgagcagcugagcaaggucauuucucuuaucuguauugccguguggaucaucaacauugggcauuucaaugacccgguccacggaggcuccuggauccgcggcgcuauuuacuauuuuaaaaucgccguggcccuggcuguugcggccauucccgaagggcucccugcugugaucacgacaugccuggcccuuggaaccagacggauggccaagaaaaacgcuaucguccgcagccugcccucuguggagacacucggcuguaccuccguuauuugcagcgauaagaccgggacacugacgaccaaucagaugucuguguguagaauguucauccuggaccgggucgagggagacacaugcucccucaacgaauuuaccauuacaggcagcaccuacgccccuaucggggaggugcauaaggaugacaaacccgugaauugucaccaguaugauggacugguugaacuugcgacgauuugcgcucuguguaacgacuccgcccucgauuacaacgaggccaagggcgucuaugagaaagugggcgaagcuacagagaccgcccugaccugccuuguggaaaagaugaaugucuucgacacagagcugaaagggcucucuaagaucgaacgcgcuaacgccuguaauagcgugauuaagcaacugaugaaaaaggaguuuacccuggaguucuccagagaucggaaaagcaugucuguuuacugcacaccgaacaagccuuccagaacgagcaugucuaaaauguucgugaagggagcgcccgaaggcgucaucgaccgcugcacccacauccggguggggagcacaaagguuccuaugaccuccggagugaaacagaagauuaugucugucaucagagaguggggcagcggguccgauacacuccgcugucuggcccuugcuacccaugacaauccccugcggagagaagagaugcaccucgaagauagcgccaacuuuauuaaauacgagacgaaucugaccuucgugggcugcguuggaaugcuggaucccccucgcaucgagguggcuucuuccgucaaacuuugucggcaggccggcauuagagugaucaugaucacaggggacaacaagggaaccgcgguggccauuugccgccggaucggcauuuuugggcaagacgaagacgucacaagcaaggcuuucaccggaagagaguuugaugaacucaauccgucugcccagcgcgacgcuugucugaacgcccggugcuucgccagaguugagcccucccauaagagcaaaaucguggaauuucugcaguccuucgaugagauuacggcuaugacaggcgacggggugaaugaugcgccugcccucaagaaagcugagaucggcaucgccaugggaucuggcaccgccgucgcuaagacagccagcgaaauggugcuggcggacgauaacuuuuccaccauuguugcugccguggaggaagggcgggccaucuauaauaacaugaaacaguucauucgcuaccuuaucucuagcaaugucggagaggugguuuguauuuuucugaccgcugcccucggcuuccccgaggcgcugaucccugugcaacugcuuugggucaaccucgugacagacgggcugcccgcuacggcccugggauuuaacccgccugaucucgacaucaugaauaagcccccuagaaaccccaaagaaccucugauuuccggcuggcuuuucuuccgguaucuggccaucgggugcuacguuggcgcugccaccgugggagcugccgcguggugguuuauugccgcugauggcgggcccagagucagcuucuaucagcucucucacuuucugcaguguaaggaggacaauccggacuucgaaggaguggauugcgccaucuuugaguccccuuaccccaugacaauggcucugagcgugcuugucaccauugaaauguguaacgcccucaauucucuguccgagaaccagagccugcuccgcaugcccccuugggagaauaucuggcugguuggcucuauuugccuuagcaugucccugcacuuccucauccuguauguggaaccgcugccccuuaucuuucaaauuacaccucucaacgugacccaguggcugaugguccugaagaucagccuccccgugauucugauggacgagacgcuuaaauucguugcccggaauuaccuggaaccugcuauccucgaguga

SEQ ID NO: 66206 - RNA, 3159 nt, Artificial Sequence
  derived and/or modified sequence opt5 from ATP2A3__Homo_sapiens__NP_777613
auggaggccgcucaucugcuccccgccgcggacgugcugagacacuucagcgucaccgcugaaggcgggcuuuccccugcccagguuacaggagcccgggagcgcuacggcccgaacgaacugcccucugaggaagggaaaagccucugggagcuggugcuugagcaauuugaagaucugcucgugagaauccugcugcucgcugcccuggucuccuucgugcuugcuugguuugaggaaggagaggagacgaccacagccuucguugaaccucuggugauuaugcucauccuggucgcgaaugccauugugggcguuuggcaggagcggaacgcugaaucugccaucgaggcucuuaaagaauaugagcccgagauggggaaggugauucgcagcgacagaaaaggaguccagcggauccgcgccagagauaucgugccuggcgacauuguggaagucgcgguuggcgauaaggugcccgccgaccugcggcucaucgagauuaaauccaccacacugcgcguggaucagucuauccugaccggggaaagcgucuccgugacaaagcacaccgaggcuauuccugacccgagagccguuaaucaagauaagaaaaacaugcucuuuagcggaacgaauaucaccucuggcaaggcugugggggucgccguggccacaggacugcauaccgaacuuggcaaaauucggucccagauggcugcgguugagcccgagcgcacaccucugcagagaaagcucgacgaguucgggcggcagcugagccacgccaucucugugaucugcgucgcugugugggucauuaacaucggacauuuugccgaucccgcccacggcggcuccuggcuucgcggggcuguguacuauuucaaaauugccguugcgcuggcuguggccgccaucccugaaggacuccccgcugucauuaccacgugucuggcccugggcacaagacggauggcuagaaagaaugccaucgugcgcagccucccgucuguugaaacccuggggugcacauccgugaucuguagcgacaagaccggaacccuuacaacgaaccaaauguccgucugccggauguuugugguggcggaggccgaugcuggcucuugucugcuccacgaguucaccauuagcgggacaaccuacacaccugaaggagagguuagacagggcgaccagcccguccgcugcggccaguuugacgggcugguggaacuugccaccaucugugcucugugcaaugauuccgcccucgacuauaacgaggcgaaaggaguguacgaaaaggucggcgaggccacggagacagcucugaccugucugguggaaaagaugaauguuuucgauaccgaccuccaagcccugagccggguggagagagcuggggccugcaacacagucauuaagcagcuuaugcgcaaagaauuuacccuggaguucucucgggauagaaaguccaugagcguguauuguacaccuacgcgcccccaucccaccggacagggcucuaaaauguucguuaagggggccccugaaagcgugaucgagcggugcuccucugucagagugggcagccgcacagcuccgcucacccccacaucccgggagcaaauucuggcgaagaucagagacuggggaagcggcucugauacccugcggugccuugcccucgcuacgcgcgacgccccucccagaaaagaagauauggagcuggacgauuguuccaaguuuguucaguacgaaaccgaccugacauucguggggugcgucggaaugcucgacccuccccggccggagguggccgcuuguaucaccagaugcuaccaggccggcauucgcguggucaugaucacaggggauaauaaaggaaccgcgguugcuauuugucggagacugggcaucuuuggggacacggaagauguggccggcaaggccuauacaggacgcgaguucgacgaucuuagcccugagcagcaaagacaggcuugccggaccgcccgcuguuuugcgagaguggaacccgcucacaaaucucggauugucgagaaccugcaguccuucaaugaaaucacagccaugaccggcgacggggugaacgaugccccugcucucaagaaggccgagauuggaaucgcuaugggcagcgggaccgccguugcgaaauccgccgcugaaauggugcugucugacgauaacuuugccagcaucgucgcugccguggaggagggacgcgccauuuacuccaauaugaagcaguucaucagauaucugauuucuagcaacguuggcgaaguggucugcaucuuucuuacagcuauucucgggcugcccgaggcgcugaucccugugcaacuccuguggguuaaucuugugacggacggccugcccgccaccgcucucggauucaacccgccugaucuggacaucauggaaaaacugccccggagcccccgcgaggcccuuauuuccggcuggcucuuuuucagauaccuggccaucggggucuaugugggacuggcuacaguggccgcggcuaccuggugguuugucuacgaugccgagggcccucauauuaauuucuaucagcuccggaacuuccugaaguguucugaagacaauccgcuuuuugccgggaucgacugcgagguuuucgaaucccgcuuucccacaaccauggcucugagcgugcucgugacgauugagauguguaacgcccuuaauucugucuccgaaaaccagagccugcugagaaugccucccuggaugaauccuuggcuccugguggcgguugcuaugucuauggcccugcacuuccucauccugcuugugcccccucugccccucaucuuucaggucacaccgcugagcggacggcaaugggugguugugcugcagauuucccuuccugucauccugcucgaugaggcccugaaauaccucagcagaaaccacaugcaugcuugccuguaccccggccuucugcgcaccgugucucaggccuggucccggcagccucucaccacaagcuggacccccgaccacacagggcuggcuucccugggccaaggacauucuauugucagccuuuccgagcugcucagagaaggcgggucucgcgaggaaaugagccagaaguga

SEQ ID NO: 66207 - RNA, 3663 nt, Artificial Sequence
  derived and/or modified sequence opt5 from ATP2B1__Homo_sapiens__XP_011536710
augggcgacauggccaacaauagcguggcuuacuccggggucaagaacucucugaaagaggccaaucacgauggagacuucggcaucacccucgcggaacugagagcucuuauggagcugcggagcacagaugcccuccgcaagauucaggaauccuauggggacguuuacggaaucugcacgaaacugaagaccucucccaacgagggccuuagcgggaauccugccgaucuggaaagacgggaggcuguguuuggaaagaacuucauuccgcccaagaagccuaaaacauuucuccaacuggugugggaggcccugcaggacgucacccucaucauucuggaaaucgcugccaucgugucccuuggccugucuuucuaucagcccccugagggcgauaaugcgcucuguggggaaguuagcgugggagaggaggaaggcgagggggaaacaggauggauugagggcgccgcuauccugcuuuccgucgugugcguugugcuggucaccgccuuuaacgacuggagcaaggaaaaacaguuccgcgggcuccaaucuagaauugagcaggagcagaaguuuacagugauccggggaggccaggugauucaaauccccgucgcugauauuaccguuggcgacaucgcccaggugaaauacggggaucugcugccugcggacggaauccucauucagggcaaugaucugaagaucgacgaauccagccuuacgggggagucugaccaugugaagaaaucccuggauaaggacccgcuccugcuuagcggaacccacgucauggaaggcucugggcgcauggugguuacagccgugggagucaacucccagaccggcauuaucuucacacugcucggcgcugggggagaggaagaggagaaaaaggaugaaaagaagaaagagaagaagaauaaaaagcaagacggcgccauugaaaacagaaauaaagcuaaggcccaggauggggccgcuauggagaugcagccccugaaaagcgaagagggaggcgacggggaugagaaggacaagaaaaaggcgaaccugccuaaaaaggaaaaauccgugcuccaaggcaagcugaccaaacuugccguucagaucggaaaagcuggccugcucaugucugccaucacggugauuauccugguccuuuauuuugugauugauacauucuggguccagaagcggcccuggcuggccgaguguaccccuaucuacauucaguauuuugugaaauucuuuaucaucgggguuacagugcucgucguggcuguucccgaaggacugccgcuggccgugaccauuagccucgcguacuccgucaagaaaaugaugaaggacaauaaccuggugcgccaucuugaugcuugcgagaccaugggcaacgccacagccaucuguagcgacaagacggggacccugacaaugaauagaaugaccgugguucaggcuuacauuaacgagaaacacuauaagaaagucccugaacccgaggccaucccucccaauauucucucuuaccuggugacaggaaucuccgugaacugcgcuuauaccagcaagauucugcccccugaaaaagagggcgggcuuccgcggcaugucggcaauaagacggaaugugcccuccugggacugcuccuggaccuuaaacgcgauuaccaagacgugagaaacgagauccccgaggaagcgcuguauaagguuuacacauucaauucugugcgcaagagcauguccaccguccucaaaaacucugauggcagcuaucggaucuucuccaagggggccagcgagauuauccugaaaaagugcuuuaaaauucugucugcuaauggagaagccaagguguucagaccucgggacagagaugacaucguuaagaccgugauugagcccauggcuuccgaaggccuucgcacaaucugucucgccuuucgggauuucccugcgggggagcccgagccggaaugggacaacgagaaugauaucgucaccggacugacaugcauugccgugguuggcaucgaagacccugugagacccgaggucccugaugcuauuaaaaagugucagcgcgccgggaucacggugcggauggugaccggcgacaacauuaauacagcuagagccaucgccaccaaaugcggaauccugcaccccggcgaagauuuucucugccuggaggggaaggacuucaaccgccggauuagaaaugagaaaggagaaaucgagcaggaacgcauugacaagaucuggccuaaacuucggguccuggcuagaagcucucccacagauaaacacacccucguuaagggcauuaucgacuccacggugagcgaucaacgccagguggucgcggugaccggggacggaacaaacgauggcccggcccugaaaaaggcugacguuggguuugccaugggcaucgccggaaccgauguggcuaaagaggccuccgacauuauccugacagaugacaacuucaccucuauugucaaggcggugauguggggccggaauguuuacgauagcaucuccaaguuucuucaguuccagcucacggugaacgucguggcuguuauuguggccuuuacaggggccuguaucacccaagacucuccucugaaagcuguccagaugcugugggugaaucucauuauggauacacuggccagccuugcgcuggcuaccgagccucccaccgaaucccuccugcugagaaagcccuacggacggaacaaaccgcuuaucagccgcacaaugaugaagaauauccucggccaugccuucuaucagcugguggucguuuuuacgcuccuguucgccggggagaaauucuuugacauugacucuggaagaaacgcuccccugcacgccccucccuccgaacauuacaccaucguguucaauacauuugugcuuaugcagcuguucaacgagauuaaugcucggaagauccacggcgaaagaaacgucuuugagggcauuuucaauaacgccaucuuuugcaccaucgugcucgggacauucguugugcaaauuaucauuguccaguuuggaggcaaaccuuucagcuguucugagcuguccaucgaacaguggcuguggagcauuuuucuugggaugggaacccugcucuggggccaacugaucucuacgauccccacaagccgccucaaguuccugaaggaggcggggcacggaacccagaaagaagagauuccugaagaggagcuugccgaagauguggaggaaaucgaccaugcugagcgggaacugagacgcggccagauucucugguuuagaggccugaaucggauccagacccaaauucgcguugugaacgccuucagauccagccuguaugaggggcuugagaagcccgaaucucgguccagcauccacaauuucaugacacauccggaguuucgcauugaagauuccgagccucacaucccccugaucgacgauaccgacgcugaggaugacgccccuacaaaaagaaacucuagcccgcccccuucccccaacaagaauaacaaugccgucgauucuggcauucaucucacgaucgaaaugaacaaaagcgcuaccuccucuagcccuggaagcccccugcacucccucgagacaucucuguga

SEQ ID NO: 66208 - RNA, 3732 nt, Artificial Sequence
  derived and/or modified sequence opt5 from ATP2B2__Homo_sapiens__NP_001001331
augggcgacaugaccaacagcgauuucuacuccaagaaucagagaaacgagucuagccacgggggagaauuuggcugcacaauggaggaacugcggucccucauggagcugcgcgggacggaagccguggucaaaaucaaggagaccuauggagacacagaggcuauuuguagacggcuuaaaaccucucccguugaaggccugccugggacagccccggaucucgagaagcgcaaacaaaucuucggacagaauuuuauucccccuaagaagcccaaaaccuuccugcagcuugugugggaagcgcugcaggacgugacacucaucauucuggagaucgcugccaucauuagccugggccucuccuuuuaccauccucccggcgaggggaacgaaggaugcgccaccgcucaaggcggggccgaggaugaaggagaggcugaagccggcuggaucgagggggcggccauucugcuuucugucaucugugugguucuggugacggcuuucaaugacuggagcaaggagaaacaguuuagaggacuccagucccggauugaacaggagcaaaaguucaccgucgugcgcgccggccagguugugcagaucccugucgcugaaauuguggugggcgauaucgcccaggucaaauauggggaccugcuuccggcggauggacuguuuauccaaggcaacgaccucaagauugaugagagcucucugacaggggaauccgaccagguuagaaagagcguggauaaagaccccaugcugcucucuggaacccacgugauggagggcuccgggcggaugcuggucacagccgugggaguuaauagccagaccggcaucauuuucacgcuucugggcgcugggggagaggaagaggaaaagaaagacaagaaaggcgugaagaaaggggauggacuccaacugccugccgcugacggcgccgccgcuucuaacgcggccgauuccgcuaaugccagccuugucaacgggaagaugcaggacggcaauguggaugccucccagucuaaggcuaaacagcaagacggagccgcggcuauggagaugcagccccucaagagcgccgaaggcggggaugccgacgaucgcaaaaaggcuuccaugcauaaaaaggaaaagagcguucuccagggaaaacugacaaagcuggccgugcagaucggcaaagcugggcucgucaugucugccauuaccgugaucauccugguccuuuacuuuacaguggacaccuucguugugaacaagaaaccuuggcugcccgagugcaccccggucuaugugcaauacuuuguuaaguucuucauuaucggagugacaguccucgugguggcgguuccugagggccugccccuugccgucacgauuucccuggcuuauagcgugaagaaaaugaugaaggauaauaaccucgugagacaccuggacgccugugagaccauggggaaugcuacagccaucugcucugacaaaaccggcacacugaccacgaaccggaugacagucgugcaggcguacguuggagaugugcauuacaaggaaauuccugaccccagcuccaucaacaccaaaaccauggagcuccugaucaaugccauugcuaucaacucugccuauacaaccaagauucuucccccugagaaggaaggcgcucugccgcgccaggucgggaauaaaacagaguguggacuccugggcuuugugcuggaucuuaagcaggacuacgaacccguuagaagccaaaugccugaggaaaaacucuauaagguguacacguucaacuccguccggaaaagcaugucuaccgugaucaagcugcccgaugaguccuuucgcauguauagcaaaggggccucugagauuguucugaagaagugcuguaaaauccucaauggagccggcgaaccuagaguguuccggcccagagaccgcgaugagauggucaagaaagugauugaaccgauggcuugcgacgggcugcggacaaucuguguggcguacagagauuuuccuuccagccccgagccugacugggauaacgaaaaugacauccuuaacgagcugaccugcauuugcgucguuggcaucgaggaucccgugcgcccugaagugcccgaggccauucggaagugucagagagcuggaaucacaguccgcauggugaccggcgacaauauuaacacggcccgggccaucgcuaucaaaugcgggauuauccacccgggagaagacuuccucugucuggagggcaaggaauuuaauagacgcauucggaacgagaagggggagaucgaacaggagagaauugauaaaaucuggccuaagcugcgcguucuugcccgguccucucccaccgacaaacacacacucgugaagggaaucauugauagcacccauacagaacagagacaagucguggcgguuaccggcgacgggacgaaugauggccccgcucugaaaaaggccgacgugggauucgccaugggcaucgcugggacagaugucgccaaggaggcguccgacauuauccugaccgaugacaacuuuucuagcauugugaaagcuguuauguggggacggaauguguaugauuccaucagcaaguuccuccaguuucagcugacagucaacgugguggccgucaucguugccuucaccggcgcuugcauuacccaagacucuccucuuaaagccgugcagaugcugugggugaaccucaucauggauacauuugcuucccuggcccuggcgacggagccgcccaccgaaacacuucuccugcgcaagccuuacgggagaaauaaaccccugauuagccggaccaugaugaagaacauccucggacacgccgucuaccagcuggcucuuauuuucacacugcuguucgugggcgagaagauguuucagaucgacucuggcagaaaugccccucugcauuccccucccagcgaacacuauaccauuaucuucaacacguuuguuaugaugcaacuguucaaugagaucaacgcucgcaaaauucacggggaacggaauguguuugacggaaucuucagaaaccccaucuuuuguacaauuguccuuggcaccuucgccauucagaucgugaucguucaguuugggggaaagccguucucuugcagcccucuccagcuggaucaauggaugugguguauuuuuaucggccugggggagcucguguggggacaggucauugccaccauccccacaucccgccugaaauuccuuaaggaggcuggcagacugacccagaaagaagagauuccugaagaggaacucaaugaggacguggaggaaaucgaucaugcggagcgggaacugcgcagaggccagauccugugguuucgggggcuuaaccgcauucaaacacagaucagagucgugaaggccuuccggagcucucuguacgagggacucgaaaaacccgagucccgcacgagcauucacaauuucauggcucauccggaguuuagaaucgaagacucccagccucacauuccccugaucgaugacaccgaucucgaggaagacgccgcccugaagcaaaacucuagcccucccuccucucuuaauaagaacaauagcgcuauugauuccggcaucaaccugacaaccgacacaucuaaaagcgccaccuccagcucucccggguccccuauccauagccucgagacgucucuguga

SEQ ID NO: 66209 - RNA, 3663 nt, Artificial Sequence
  derived and/or modified sequence opt5 from ATP2B3__Homo_sapiens__XP_005274747
augggcgacauggccaacagcuccaucgaguuccaccccaagccucagcaacagagagaugugccgcaggcugggggauuuggcugcacccuggccgaacuccggacacugauggagcuucgcggggcggaagcucugcagaaaauugaggaagccuacggagacgucucuggccucuguagacggcugaagacgagccccaccgaggggcuugccgauaauacaaacgaccuggagaaacgcagacaaaucuauggacagaauuucauuccucccaagcagccuaaaaccuuucuccagcugguuugggaagcucugcaagaugugacacucaucauucuggagguggccgcuaucgucucccuuggccugucuuucuacgcgcccccuggcgaagagagcgaggccugcgggaacguguccggaggcgccgaagacgagggggaagcugaggccggauggaucgaaggcgcugccauucuccugucuguuaucugugugguccuugugaccgcguuuaaugauuggagcaaggagaagcaguuccgggggcugcagucccgcauugagcaggaacaaaaauuuacaguuaucagaaacggacagcuccuccaggugccggucgccgcucugguggugggcgacauugcccaagucaaguauggcgaucugcugcccgcugacgggguucuuauccaggccaaugaucugaaaauugacgagagcucucucaccggagaauccgaucaugugagaaagagcgccgacaaagacccuaugcugcuuucuggcacgcacgugauggagggguccggacgcauggucgugaccgcuguuggcgugaacagccagacagggaucaucuucacccugcucggagcgggcggcgaagaggaggaaaagaaggauaaaaaggggaaacagcaagacggagccauggagucuucccagacaaaggcuaaaaagcaggauggcgccgucgccauggaaaugcagccccugaaaagcgcugaagggggagaaauggaggagagagaaaagaagaaagccaaugcgccuaagaaagagaaguccgugcugcaaggcaaacucaccaagcuggcuguucagauugggaaggccggccuugugaugucugccaucacggucauuauccuggugcucuacuuugucauugaaacauucgugguugagggacggaccuggcuggcugagugcacacccguguauguccaguacuuugugaaauucuuuaucaucggcguuaccgugcuugucguggccgugccggaagggcugccucucgcuguuaccauuagccuggccuauuccgucaagaaaaugaugaaggacaacaaucuggugcgccaucucgaugcgugugagacaaugggaaacgccacggcuaucugcagcgacaaaaccggcacacugaccacaaauagaaugaccgugguccagucuuaccuuggggauacgcacuacaaggaaauucccgccccuuccgcucugacacccaagauccucgaccugcuggugcaugccauuagcaucaacucugcguauaccaccaaaauccuucccccugagaaggaaggagcccucccgcggcaaguuggcaauaaaacagagugugcucugcugggguucgugcucgaucugaagcgcgacuuccagcccgucagagagcagauuccugaagauaaacuuuacaagguguauaccuuuaacagcguucggaaguccaugucuacagugaucagaaugcccgacggcggauuccgccuguuuagcaaaggcgccuccgagauucuccugaagaaaugcacgaacauccugaauagcaacggggaacuucggggauucagaccucgcgaccgggaugacauggucagaaagauuaucgagcccauggcuugugauggccuccgcaccauuugcaucgccuaccgggacuuuucugccgggcaggaaccggauugggacaaugagaacgaggugguuggagaucugacauguaucgcuguggucggcauugaagacccugugagacccgaggugccugaagcgauccgcaaaugccaacgggccgggauuaccgucagaaugguuacaggcgauaauaucaacaccgcucgcgccauugccgcuaagugcggaaucauccagcccggcgaggacuuccugugucucgaagggaaagaguuuaaucggcggauucggaacgagaagggagaaaucgagcaggaacgccuggauaagguguggccuaaacuuagagugcuggcccgguccagccccacggacaagcacacccucgucaaaggcauuaucgauucuacaaccggggagcaaagacaggugguugcggugacaggagacggcaccaaugacgggccggcucugaagaaagccgaugucggcuucgccaugggaauugcuggcacggacguggccaaggaggcguccgauaucauccugacagacgauaacuuuaccagcauuguuaaggcugugaugugggggcgcaaugucuaugacuccaucucuaaauuccuucaguuucagcucacagugaacguuguggccgucauuguggccuucaccggagcuugcaucacccaagauagcccucugaaggccgugcagaugcugugggucaaucucauuauggacacauuugcuucccuggcccuugcgacggaaccucccaccgagucucugcuccugcggaaacccuacggcagagauaagccgcugaucagccgcacaaugaugaaaaacauccuugggcacgccguuuaucagcucgcuauuaucuucacccugcuguucgugggagaacucuuuuucgacauugauuccggcagaaaugcuccccugcauagcccucccucugagcacuacacaaucauuuuuaacaccuucgugaugaugcagcuuuuuaacgaaaucaaugcccggaagauucauggcgagcgcaacgucuucgacgggaucuuuuccaauccuaucuucuguacgauugugcugggaacauuuggcauccaaauuguuaucgugcaguucgggggaaagcccuuuagcugcucuccucucuccaccgagcaguggcuguggugucuguucgucggcgugggggaacuuguuuggggacaggugauugccaccauccccacaagccaacugaaaugccucaaggaggccggccacggcccggggaaagaugaaaugaccgacgaggaacuggcugagggagaggaagagaucgaccacgcggaaagagagcuccggcgcggccagauucugugguuuagagggcuuaaccggauccagacacaaauucgcgucgugaaggccuucagaucuagccuguacgaaggacucgagaaaccugaguccaagacgagcauccauaauuucauggcuacccccgaauuucugauuaacgauuauacacacaauaucccucugaucgacgauaccgacgucgaugagaacgaggagcggcuucgcgcucccccgccucccucuccuaaucagaacaauaacgccauugacuccggcaucuaccugacaacccaugugaccaagagcgccacguccucuguuuucagcuccucucccgggagcccccuccacuccguggagacaucucuguga

SEQ ID NO: 66210 - RNA, 3513 nt, Artificial Sequence
  derived and/or modified sequence opt5 from ATP2B4__Homo_sapiens__NP_001001396
augaccaaccccagcgacagagugcugccugccaauuccauggcugagucucgggaaggcgauuucgggugcacagucauggagcuccgcaagcugauggaacuuagaagccgggacgcccugacgcagaucaacguucacuacggaggcgugcaaaaucucuguucccgccugaaaaccucuccgguggaggggcuuagcggaaaccccgcggaucuggaaaagagacggcaggucuuuggccauaaugugauuccucccaaaaagccuaaaacauuccucgagcugguuugggaggcucugcaggacgugacccucaucauucuggaaaucgccgccauuaucucccuuguccugucuuuuuaucgccccgcuggggaggaaaacgagcucugcggacagguggccacaaccccugaggaugaaaaugaggcucaagccggcuggaucgaaggcgcggccauucuguucagcguuaucauugugguccuugugacagcuuuuaacgacugguccaaggagaagcaguucagagggcugcagugucggaucgaacaggagcaaaaauuuagcauuauccgcaauggacagcucauucagcugccgguggccgagaucgucguuggcgauaucgcucaggugaaguacggggaccugcuccccgccgauggcauucugauccaaggaaacgaccuuaaaauugaugaaucuucccugaccggggagagcgaccacgugaagaaaucucucgauaaggacccuaugcugcuuuccggaacgcaugucauggaaggcagcggcagaauggugguuaccgcggugggggucaauucucagacaggaaucauucugacccuccugggcgugaacgaggacgaugaaggggagaagaaaaagaaaggaaagaaacagggcguucccgagaaucggaacaaggccaaaacacaagacgggguggcucuggaaauccagccucucaauucccaggagggaaucgauaacgaagagaaggacaagaaagccgucaaggugcccaaaaaggaaaagagcguccugcagggcaaacuuacccgccuggcugugcaaauuggcaaggccgggcuccugauguccgcccuuacgguuuucauccugauucucuauuuugugaucgauaacuucgucauuaauagacggccguggcugccugagugcacacccaucuacauccaguauuuugugaaauucuuuauuaucggaauuaccguucugguggucgcugugccugagggccucccccuggcggugacaaucucucuugccuacagcguuaagaaaaugaugaaggacaacaaucugguccgccaccucgaugcuugugaaaccauggggaacgccaccgccauuugcuccgacaaaacaggaacgcugaccaugaauagaaugacaguggugcaggcuuauaucggcgggauucauuaccggcagauccccagcccugaugucuuccugccgaaggugcuugaccucaucguuaacggcauuucuaucaauuccgccuacaccagcaagauucugcccccugagaaagaaggaggccugcccagacaaguggggaacaagacagagugugcgcuccugggauucgucaccgaucuuaaacaggacuaucaggcugugcgcaaugagguuccugaagagaagcuguacaaaguguauacguuuaacucugucagaaagagcauguccacagugauccggaaucccaacggcggguuccgcauguacucuaagggagccagcgaaauuauccuccggaaaugcaauagaauccuggaccgcaagggcgaggccguuccguuuaaaaacaaggaucgggacgauauggugagaaccgucauugaaccuauggcuugugacgggcugcgcaccaucugcauugccuaucgggauuucgacgauacagagcccuccugggacaaugagaacgaaauccuuaccgagcucacauguauugcuguggugggcaucgaagauccugucagacccgagguuccugacgccaucgcgaaaugcaagcaggccggaauuacggugcgcauggugaccggcgauaacaucaauacagcucgggccauugcuaccaaaugcgggauccugacacccggagacgauuuucugugucucgaaggcaaggaguucaacagacugauucggaaugagaagggggaagucgagcaagaaaaacuugacaagaucuggccgaaacugcgcgugcucgccagaagcucuccuaccgacaagcacacgcugguuaaaggaaucauugauuccaccgugggcgagcaccggcaggucguggcgguuacaggggacggcaccaacgauggacccgcccugaagaaggcugacgugggcuuugccauggggaucgcuggaacagaugucgccaaagaagccagcgacauuauccuuaccgaugacaauuucacgucuauugugaaggcuguuauguggggcagaaacguguacgauuccaucagcaaauuucuccaguuccagcugacagucaaugugguggcggucauuguugccuuuaccggggcuugcaucacacaagacagcccccugaaggccgugcagaugcucugggugaaccugaucauggauaccuucgccucucuugcucuggccaccgagccuccgacagagagccuccugaaacgccggcccuauggaagaaauaagccucugauuucccgcacgaugaugaagaacauccuuggccaugcguuuuaccagcucauugucaucuucauucugguguucgcuggggaaaaauuuuucgacaucgauucuggcagaaaggcuccccugcacagcccucccucccaacauuacaccaucguuuuuaauacauucgugcucaugcagcuguuuaacgagauuaauagccggaaaauccacggagaaaagaacgucuucucuggcauuuaucgcaauaucaucuuuuguuccgugguucuugggaccuucauuugccagaucuuuauuguggaguucggaggcaaaccuuuuagcuguacaucucugucccucagccaguggcuguggugccuguucaucgggauuggagagcuucuguggggccaauuuaucucugccauucccaccagaagccucaaguuccugaaggaagccggccacgggacgacaaaagaggaaaucaccaaggacgccgagggacucgacgaaauugaucaugcggagauggagcugcggcgcggccagauccuuugguucagagggcugaaccggauccagacccagauugacgucaucaacacauuucaaaccggagcuuccuucaaaggcgugcuccgcagacagaauauggggcagcaccuggaugucaagcuggugccguccucuuccuacguugccguggccccugucaaaagcucccccacaacgucugugccugcuguuagcucucccccgaugggaaaccaguccggccaaagcgugccuuga

SEQ ID NO: 66211 - RNA, 2850 nt, Artificial Sequence
  derived and/or modified sequence opt5 from ATP2C1__Homo_sapiens__NP_001001486
augaagguggccagauuccagaaaauccccaacggcgagaaugaaaccaugauuccuguccugacaagcaagaaggcuuccgagcucccgguuucugaaguggccagcauccugcaagcggaccuucagaacgggcugaauaagugcgaggugucccaccggcgcgcuuuucauggauggaacgaguucgauauuucugaggacgagccccucuggaaaaaguacaucagccaguuuaagaauccucugauuaugcuucugcucgccuccgccgucaucucugugcugaugcaccaguucgaugacgcuguuagcaucacgguggccauucugaucgucgugaccguugcuuuugugcaagaauauagauccgagaaaagccucgaagaacugucuaaacuugugcccccugagugucauugcguccgggaaggcaaacuggagcacacacucgcccgcgaucuggugcccggggacaccgucugucuuuccguuggagauagagugccugcggaccugcgccucuucgaagccguggaucugagcauugacgagucuucccugacaggcgaaaccacaccgugcagcaaggucaccgcuccccagccugccgcuacgaacggggaucucgccucucgguccaauaucgcguuuaugggaacccuggugagauguggcaaagccaagggcguugugauugggacaggagagaacagcgaguucggcgaagucuuuaagaugaugcaggcugaggaagcccccaaaaccccucuucagaaguccauggaccugcucgggaaacaacugucuuucuacagcuuuggaaucauuggcaucaucaugcuugugggguggcugcucggaaaggauauucuggagauguucacaaucuccguuagccuggcuguggccgccauucccgaaggccucccgaucgucgugaccgucacgcuggcucuuggcgugaugcggaugguuaaaaagcgcgcgauugugaaaaagcugccuaucgucgagacacucgggugcuguaaugugaucugcucugacaagaccggaacacugaccaaaaacgagaugaccguuacacauauuuuuacguccgacggccuucacgccgaagugaccggggucggauauaaucaguucggcgaggugaucguggauggggacguuguccacggauucuacaaccccgcugugagcagaauuguggaagccggcugugucugcaaugaugccgugauccggaacaauacacugaugggcaagccuaccgagggggcucucauugcccuggcgaugaaaaugggacuggacggccuccagcaggauuauauccgcaaggcugaauaccccuuuucuagcgagcaaaaauggauggccguuaagugugugcauagaacacagcaggaccggcccgagaucugcuucaugaagggggccuaugaacaagucauuaaauacugcaccacguaccaguccaagggacagacacugacccuuacccagcaacagcgcgauguguaucagcaggagaaagcuagaaugggcucugccgggcugcggguucucgcucuggccagcggcccugaacugggacaacuuacauuucucggccugguggggaucauugacccgcccagaaccggagucaaggaggcggugacaacgcugaucgccuccggcguuagcauuaaaaugaucaccggggauucucaggagacagcuguggccauugcuucccgccucggacuguacagcaagaccucucaguccgucagcggcgaagagaucgacgccauggaugugcagcaacuuucccagaucgugccuaaggucgcgguuuucuaucgggccucucccagacacaaaaugaagauuaucaaaagccugcagaagaacggguccgugguggcuaugacaggcgacggagucaacgacgccguggcucucaaagccgccgauauuggcguugcuauggggcagaccggaacggacguguguaaggaagcggccgauaugauccuggucgacgaugacuuucaaaccauuaugucugcuaucgaggaaggcaaggggaucuacaauaacauuaaaaauuucgugcgcuuucagcugagcacauccaucgccgcccuuacccucauuagccuggcuacacugaugaacuucccuaauccccucaacgccaugcagauccuguggauuaauaucaucauggauggaccgccugcgcaaucucuuggcguugagcccguggacaaggaugucauucggaaaccucccagaaacuggaaggacuccauccugaccaaaaaucucauucugaagauccuggugagcucuauuaucaucguuugcgggacgcuuuuuguguucuggcgcgagcuccgggauaacgucauuacaccuagagacaccacaaugaccuuuaccuguuucguguuuuucgauauguucaaugcucuguccagccgcucucagacaaaaagcguguuugaaaucggccugugcuccaaccggauguucuguuaugccguccucggaagcauuaugggccagcugcuuguuaucuacuuucccccgcugcagaagguguuccaaacggagucucucuccauucuggaccugcuuuuucuccuggggcugaccagcuccgugugcaucgucgccgaaauuaucaagaaaguggagagaucucgcgaaaagauccagaaacauguuagcuccacaucuagcuccuuccucgagguguggcugugggagcggucuggacagcagcuugucgaaauucacccucaccuggagaccggccucccccugacagaagacgugagcuguguuuga

SEQ ID NO: 66212 - RNA, 2928 nt, Artificial Sequence
  derived and/or modified sequence opt5 from ATP2C2__Homo_sapiens__NP_001273456
augguggagggcagagucagcgaguuccugaagaaacucggguuuuccggaggcgggcggcaguaccaagcccuggaaaaggacgaagaggaagcucuuaucgaugagcagucugagcugaaagccauugaaaaggagaaaaagguuaccgcgcugcccccuaaggaggcuugcaaaugucagaaggaagaccuggcccgcgccuucugcguggaucuucacacaggacugagcgaguuuuccgugacgcagagacggcucgcucauggcuggaacgaguucgucgccgacaauucugaaccgguguggaaaaaguaucuggaucaauuuaaaaacccccugauccuccugcuucuggggagcgcucucguuuccgugcugaccaaggaauacgaggacgccgucucuauugcgacagccgugcuuguuguggucaccguggcuuucauccaggaauaucgcagcgagaagucccuggaggaacucacaaaacuggugccucccgaguguaauugccugagagaaggaaagcuccagcaucugcuugcccgggagcuggucccuggcgauguugugagccucucuauuggcgaccgcauccccgcugauaucagacugaccgaagugacagaccuucuggucgaugaguccagcuuuaccggggaggccgaaccuuguucuaaaacggacuccccgcucaccggaggcggggaucugacaacccugagcaacauuguguucaugggaacacucguucaguacggccgggggcaaggaguggucaucggcaccggcgagucuucccaguuuggggaaguguucaagaugaugcaggcggaggaaacgcccaaaacaccucugcagaaaagcauggaccgccuuggaaaacaacugacccucuuuuccuucggcauuaucgggcugauuaugcuuaucggauggucucagggcaagcagcugcucagcauguuuacaauugggguuucccuggccguggcugccauccccgagggacugccuaucgucgugauggucacccucgugcugggcguucuuagaauggcuaagaaacgggugauugucaagaaacugcccaucguggagacccucggcugcuguagcguucugugcucugacaagacagggacgcugaccgccaaugaaaugacagugacccaacuugucacauccgauggacuccgcgccgaggugagcggcgugggguaugacggacagggcaccguuugucugcugccgucuaaagaagucauuaaggaguucagcaacguguccguggggaagcucgucgaggcuggcugcguggcgaauaacgccguuaucagaaagaaugcugugaugggacagccuacggaaggcgcccugauggcccuugcuaugaagauggaucugucugacauuaaaaacagcuacauccggaagaaagagauccccuucuccagcgaacagaaguggauggccgucaaguguucucucaaaacagaggaucaagaagacauuuauuuuaugaagggggcgcuggaggaggugauccgcuacugcaccauguacaauaacggaggcauuccucugccccuuacaccccagcagagauccuucugccuccaggaagagaaacggauggggagccugggacugagaguucucgcucuggccucuggcccugaacuugggcgccugaccuuucucggccuggugggaaucauugauccgccccgggucggcgugaaggaggccguucaagugcuguccgaaagcggggucuccgugaaaaugaucaccggagacgcucuugagacagcccucgcuaucggcagaaauauugggcuguguaacggaaagcugcaggccaugucuggcgaggaaguggauagcgucgagaagggggaacucgcggaccgcguuggcaaaguguccguguucuuucggacgucuccuaagcacaaacugaagaucauuaaagcccuucaggagagcggagcuaucgucgccaugaccggcgauggggugaaugacgcuguugcccugaaguccgcggacauuggaaucgccaugggccagacagggaccgaugugagcaaagaagcugccaacaugauucucgucgacgaugacuucucugcuaucaugaacgccguggaggagggaaagggcaucuuuuauaauauuaagaacuucguuagauuucaacuguccacaagcaucucugcccugucccuuauuacccucagcacgguguucaaucugcccucuccucugaacgcuaugcagauccucuggauuaauaucaucauggaugggcccccggcgcagcgcagcucccagaaaaccgaagucugcuguacagccgugcggcugggcguugagggaagaggcgaaagcaccugggcugggcgcgccggacuuggcguggagccugucgacaaggaugccuuucggcaacccccuagaucugugcgcgacacaauucugucccgggcucucauccugaaaauucugaugagcgccgcgaucauuaucuccgggacccuuuucaucuuuuggaaggagaugcccgaagauagagcuucuacgccucggacaaccacaaugaccuuuaccugcuucguguucuucgaccuguuuaacgcccucacaugucgcagccagacgaaacugauuuucgagaucggauuucucagaaaucacauguuccuguacuccguccuuggcucuauucugggccagcucgccguuaucuauauucccccgcugcaacggguguuucagaccgaaaaccugggggcucuugaucuccucuuccugacaggacucgccagcuccguguuuauccugucugagcuucugaagcucugcgaaaaguacuguugcagcccuaaaagaguccagaugcaucccgaggacguguga

SEQ ID NO: 66213 - RNA, 3108 nt, Artificial Sequence
  derived and/or modified sequence opt5 from ATP4A__Homo_sapiens__NP_000695
augggcaaggccgagaacuacgaacuguauagcguggagcucgggcccggaccuggcggggacauggcugccaaaauguccaagaaaaagaaagcgggaggcgggggaggcaagagaaaggaaaaacuggagaauaugaagaaagaaauggagaucaacgaucaccagcuuucugucgcugagcuggaacaaaaguaccagaccagcgccacaaaaggccucuccgccucucuggcugccgagcuucugcuccgggacgggccgaaugcucugagacccccucgcggaacgcccgaauauguuaaguucgcccggcagcuggcgggcgggcuccagugccugauguggguggccgcugccauuugucuuaucgcuuuugccauucaagcgagcgagggagaucugaccacagacgauaaccucuaccuggccaucgcucuuauugccguggucgugguuaccggcugcuucggguauuaccaggaguuuaaguccacaaauaucaucgcuucuuucaaaaaccuggugccucagcaggccaccgucauucgcgacggagauaaguuucaaaucaaugccgaccagcucgugguuggcgaucugguggaaaugaaaggcggggacagaguccccgcugauauucggauccuggcggcccagggauguaagguggacaacagcucccucacaggcgagagcgaaccucagacccgcucuccggagugcacgcaugaaagcccccuggagaccagaaauauugcuuucuuuuccacaaugugucuugaggggaccgugcaaggacuggucguuaacacaggcgaucggaccaucauugggcgcaucgccucucucgccuccggaguggaaaaugagaaaacgccuaucgcuauugaaaucgagcacuucguggacauuaucgccggccuggcgauucuuuuuggcgcuacauucuuuaucgucgccaugugcaucggguauaccuuccugagagccaugguguuuuucauggcuauuguuguggccuacguccccgaaggacuccuggcuacagugaccguuugucugagccucaccgccaagcggcuggcgucuaaaaacugcguggucaagaaucuugaggccguggagacacugggcuccacgagcgucaucuguuccgacaagaccgggacacucacccagaaccgcaugacagugucucaucugugguucgauaaucacauucauaccgcugacacgacagaagaucagagcggacaaaccuuugaccaguccagcgagaccuggagagcccuuugccggguucugacacucuguaaccgcgcugccuucaaaucuggccaggaugcggugccuguccccaagagaaucgugauuggggacgccuccgaaaccgcucugcugaaauuuagcgagcucacacugggcaacgccaugggauaccgggauagauucccgaagguuugcgaaaucccuuuuaauucuacgaacaaauuccagcuuagcauccacacccuggaggacccccgcgauccucggcaccuccuggugaugaagggcgcucccgagagaguccuggaacgcugcuccucuauucuuaucaaggggcaagagcucccccuggacgaacaguggcgggaggccuuucagacagccuaucugagccucggaggccugggggagagagugcuuggauucugucagcuguaccucaaugaaaaagauuauccuccgggcuacgcuuuugacguggaggcgaugaacuuccccuccagcgggcugugcuuugccggccugguuucuaugauugacccuccccgcgcuaccgucccugaugccgugcuuaagugucggacagccggaaucagagugauuauggucaccggcgaccaucccaucacggcuaaagccauugcggcuuccguggggaucaucagcgaaggaucugagaccguugaagauauugccgcccgccuccgggugccggucgaccaagugaauagaaaggaugcucgcgccugcguuaucaacggcaugcagcugaaagacauggauccuuccgagcugguggaggcgcuccggacacaccccgaaauggucuucgcuagaaccagcccucagcagaagcuggugauuguugaguccugucaacggcuuggggccaucguggccgucacaggagacggcgugaaugauucucccgcucugaagaaagccgacauugggguggcuaugggcaucgccggaagcgaugcggccaagaacgcugccgacaugauccuccuggaugacaauuuugcuuccauugucaccggcguugaacaggggcgccugaucuucgacaaccuuaaaaagucuauugccuauacgcucaccaaaaauaucccugagcugacacccuaccugauuuauaucacagugagcgugccgcucccucugggaugcaucaccauucuuuucaucgaacuguguaccgauauuuuucccuccgucagccucgccuacgagaaggcugagucugacaucaugcaucugagaccccggaacccuaagagagaucgccuggugaaugaaccgcuugcggccuacuccuauuuccagauuggcgcuauccagagcuuugccggguucacagacuacuuuacggccauggcucaagagggaugguucccccuccugugcguuggccugcgggcccagugggaagaucaccaccuccaggaccugcaagauucuuaugggcaggaguggaccuuuggccagagacuuuaccagcaauauacauguuacaccguguucuuuaucuccauugaagucugccagaucgcggacgugcugauucgcaaaacaagacggcucagcgcuuuccagcagggauuuuuccgcaacaagauccugguuauugccaucguguuucaagucuguauuggcugcuuccugugcuauuguccugggaugcccaauaucuucaacuuuaugccuaucagauuccagugguggcuugugccccugccuuacggcauucucaucuuuguuuacgaugagauucggaaacugggagugcgcugcugucccgggucuuggugggaccaggagcucuauuacuga

SEQ ID NO: 66214 - RNA, 876 nt, Artificial Sequence
  derived and/or modified sequence opt5 from ATP4B__Homo_sapiens__NP_000696
auggccgcucugcaggagaagaaaaccugcggccaaagaauggaagaguuccagcgguacuguuggaaccccgacacagggcagaugcucggacgcacgcugagcagauggguguggaucucccuuuauuacgucgccuuuuauguugugaugaccggccuguucgcgcucugccuguacgugcuuaugcagacagucgauccuuauaccccggacuaccaagaucagcugcggucucccggggugacacuccgcccugacguuuauggagaaaagggccuggagauuguguacaaugucagcgauaacagaaccugggcugaccugacacagacccuccacgccuuucuggccggguacucccccgcugcccaggaagauucuaucaauuguacgagcgagcaauauuucuuucaggaguccuuccgggcuccuaaccauaccaaauuuucuugcaaguucacagccgacaugcuucagaauuguagcggacuggcggaucccaacuuuggcuucgaagagggcaaaccuugcuuuauuaucaagaugaaucgcauugugaaguuccucccguccaacgggagcgcccccagaguugacugugcuuuucuggaucagccucgggaacuuggacaaccccuccaggugaaauacuauccucccaauggcaccuucucucugcacuacuucccguauuacgggaagaaagcccagccucauuauuccaacccccuggucgcugccaagcugcucaauaucccucgcaacgcggagguggccaucgugugcaaagucauggcugagcacguuacauuuaauaacccccaugaccccuacgaaggaaagguggaguucaagcugaaaauugaaaaguga

SEQ ID NO: 66215 - RNA, 1662 nt, Artificial Sequence
  derived and/or modified sequence opt5 from ATP5A1__Homo_sapiens__NP_001001937
augcugagcgugagagucgccgcugccguugugcgggcgcucccccgcagagcuggccuggugucccggaacgcccuugggucuagcuucaucgccgcucgcaauuuucacgccuccaacacccaucugcagaagacaggaacggcugagaugucuagcauucucgaagagagaauccugggcgccgacaccuccgucgaucuugaagagacagggcgggugcugucuauuggagacggcaucgcgcgcguucacgggcucagaaaugugcaagccgaagagauggucgaguucagcuccggacugaaaggcaugagccugaaccucgaaccugauaaugugggcguuguggucuuugggaacgacaagcugauuaaagagggagauaucgugaagcggaccggcgcuaucguggacgucccgguuggggaggagcuucugggacgcgugguggaugcccucggcaaugcuauugacgggaaaggacccaucggcucuaagacaagacggcgcgucggccugaaggccccugggauuauccccagaauuuccgugcgggagccuaugcagaccggaaucaaagcgguugauagccuugugcccauuggccgcgggcagagagaacugaucaucggagaccggcagacaggcaagaccucuauugccaucgauacgauuaucaaccaaaaacgguucaaugacggguccgaugagaagaaaaagcucuacugcauuuaugucgcuaucggacagaagcgcagcaccguggcccagcugguuaaacggcugacagacgcugacgccaugaaguacaccaucguggucucugccacagcuuccgaugcggccccucuccaguaucuggcuccguacagcggcuguuccaugggcgaauauuuuagagacaacgggaaacaugcccuuauuaucuacgaugaccugucuaagcaagccguggcuuaucgccagaugagccuccugcuucggagacccccuggacgcgaggccuaccccggcgaugucuucuaccugcacucccggcuccuggaaagagcggcuaaaaugaaugacgccuuugggggaggcagccugaccgcccucccugugauugagacgcaggcuggggauguuucugccuauauccccacaaacgugauuuccaucaccgacggccagaucuuccuggagacagaacuguuuuacaagggcauucgcccggcuaucaaugucggacuuagcgugucucggguugggagcgccgcgcaaaccagagccaugaaacagguggcuggaaccaugaagcucgagcuggcccaguaucgcgaagucgcugccuucgcgcaauuuggcuccgaucuugacgccgcuacacagcagcugcucucuagaggggugagacugacggagcugcucaagcagggacaauacagcccuauggccauugaagaacagguggcuguuaucuaugccggcguccggggguaccuggauaaacuugagcccuccaagauuaccaaauucgaaaacgccuuucugagccauguggugucucagcaccaggcucuccugggcacaauccgcgcggacggaaagauuuccgagcaaagcgacgccaaacugaaggaaaucgucaccaauuuccuugcuggcuucgaggccuga

SEQ ID NO: 66216 - RNA, 1590 nt, Artificial Sequence
  derived and/or modified sequence opt5 from ATP5B__Homo_sapiens__NP_001677
augcugggcuucguggggagagucgccgcugcccccgcgagcggagcucuccggcgccugaccccuuccgccucucuuccgcccgcccagcugcuccugagagcugccccuacagcuguucaccccgugcgggacuacgccgcgcaaacgagcccuucccccaaggccggcgcugccaccgggcgcaucguggcugucauuggagccgugguugaugugcaguuugacgagggccuuccuccgauccugaacgcgcucgaaguccaggggagagagacacggcuggugcuggaaguugcccagcaucucggagagucuaccgugcgcacaauugcuauggauggcaccgaaggccuggucagagggcaaaaagugcuugacagcggagcccccaucaagauuccugugggccccgagacacuggggcggaucaugaaugucaucggagagccuauugaugaacgcggccccaucaaaaccaagcaguucgcuccgauucacgccgaggccccugaauuuauggagauguccguugagcaggaaauccucgugacggggauuaaaguggucgaccugcuugcucccuaugcgaagggaggcaagaucggccuguucgggggagccggcguggggaaaaccguucucauuauggagcugaucaacaauguggcuaaggcccauggaggcuacucugucuuugccggggugggagaaagaacacgggagggcaacgaucuguaucacgaaaugaucgagagcggcguuauuaaucucaaagacgcuaccuccaagguggcccuggucuacgggcagaugaacgagccucccggagcgcgcgcuagaguggcccuuacaggccugaccgucgccgaauauuuccgggaucaagaggggcaggacgugcuccuguuuaucgauaauauuuuccgcuuuacgcaggcuggaagcgaaguuucugcccuucugggcagaauccccuccgcugugggguaccagccuacacucgccaccgacaugggcacaaugcaagagcggauuaccaccacaaagaagggaagcaucacgucuguccaggcgaucuaugugccggccgaugaccugaccgaccccgcuccugccacaaccuucgcucaucuggaugccacaaccguucucuccagagcgauugccgaacugggcaucuaccccgcuguggacccucuugauagcacgucucgcauuauggaccccaacaucgucggguccgagcacuacgauguggcccggggagugcagaagauucugcaagacuauaaaagccuccaggauaucaucgcuauucugggcauggacgagcuuuccgaagaggauaagcugacaguuucuagagcccgcaaaauccagcgguuucucagccagccguuccaagucgccgaaguguuuaccgggcacaugggaaagcuggugccucugaaagagaccauuaagggcuuccagcagauccucgcuggggaauacgaccaucugcccgagcaggcguucuauauggucggcccuauugaggaagccguggcuaaagccgauaaacuugccgaggaacacuccagcuga

SEQ ID NO: 66217 - RNA, 897 nt, Artificial Sequence
  derived and/or modified sequence opt5 from ATP5C1__Homo_sapiens__NP_001001973
auguucagcagagccggcguggcugggcuguccgccuggacccuccagccccaauggauccagguccggaacauggcgacacugaaggacauuacgcgcagacuuaaaucuaucaagaauauucagaaaaucaccaagagcaugaaaaugguugcugccgccaaguacgcucgggccgagcgcgaacugaagccugcuagaauuuauggacucggcucccuggcccuuuacgagaaagcggauaucaaggggccggaagacaaaaagaaacaucugcucaucggagugucuagcgaucggggccugugcggggccauucacuccucuaucgcuaagcagaugaaaagcgagguggccacacugaccgcugccggaaaggaagucaugcucgugggcauuggcgacaagauccgcgggauucuguauagaacacacuccgaucaauuucuuguugcguucaaagaggugggacggaagcccccuaccuuuggcgacgccagcgucaucgcucuggagcuccugaacucuggguacgaauuugaugagggauccauuaucuuuaauaaauuccgcagcgugaucucuuauaagacagaagagaaacccauuuucucccuuaacaccguugccagcgcugacucuauguccaucuacgaugacauugaugccgacgugcugcagaauuaucaggaguacaaccucgccaauaucauuuacuauagccugaaggaauccacgaccucugagcagagcgcuagaaugacagcgauggauaacgccuccaagaaugcuagcgaaaugaucgacaaacugacccucacauucaaccggacccgccaagccgucaucacgaaggagcugauugaaaucauuucuggcgccgcugcccuugacuga

SEQ ID NO: 66218 - RNA, 507 nt, Artificial Sequence
  derived and/or modified sequence opt5 from ATP5D__Homo_sapiens__NP_001001975
augcugcccgccgcucuccugagacggccuggccuugggcgccuggugagacacgcccgggcguacgcugaggccgccgcugccccggcugccgcgagcggacccaaccagauguccuucaccuuugccucuccuacacaagucuucuuuaauggcgcuaacguucgccagguggacgugcccacgcucaccggggccuucggaauccuggcugcccaugucccuacacuucaggugcugagacccggccucguugugguccacgcggaagaugggaccacaagcaaguauuuuguguccucuggaagcauugccguuaaugcugacuccucugugcagcugcuggccgaggaagcugucacccucgauaugcuggaccuuggcgccgccaaagcuaaccuggagaaggcgcaagccgaacucgugggcacagcugaugaggccacccgggccgagauccagauucgcaucgaagcuaaugaggcccuggugaaagcgcuugaauga

SEQ ID NO: 66219 - RNA, 156 nt, Artificial Sequence
  derived and/or modified sequence opt5 from ATP5E__Homo_sapiens__NP_008817
augguggccuacuggagacaggcuggccugagcuauauccgguacucccaaauuugcgccaaggcgguccgcgacgcucucaaaaccgaguucaaggccaacgccgagaaaacaucugggagcaauguuaagaucgugaaagugaagaaggaauga

SEQ ID NO: 66220 - RNA, 411 nt, Artificial Sequence
  derived and/or modified sequence opt5 from ATP5G1__Homo_sapiens__NP_005166
augcagaccgccggcgcucuguucaucagccccgcccucauuagaugcuguacacgggggcugauccgcccuguguccgcgucuuuucuuaacagcccggucaauuccucuaagcaacccagcuacuccaacuucccucugcagguugcuagacgggaguuucagacgucuguggugagccgcgacauugauaccgccgccaaauucaucggagcuggcgccgcuacagucgggguggccggauccggcgcggggauuggaaccguuuuuggcagccucaucaucggcuaugccagaaaucccucucugaagcagcaacuuuucuccuacgcuauucugggguuugcccucagcgaagcuaugggacuguucugccugaugguggccuuucucauccuguucgcgauguga

SEQ ID NO: 66221 - RNA, 474 nt, Artificial Sequence
  derived and/or modified sequence opt5 from ATP5G2__Homo_sapiens__NP_001002031
augcccgagcugauccucagcccugccaccgcuccgcacccccugaagauguucgccugcuccaaauuugugucuacaccuagccuugucaaguccacgucucagcugcucagcagaccccuguccgcgguugugcuuaaacggccugaaauucugaccgacgagucucucagcucccuggcugugagcuguccccugacaucucucgucuccagccgcucuuuccaaaccuccgccaucagcagagauauugacacagccgcuaaguuuaucggcgccggggcugccaccgugggaguugcgggcucuggggccggaauuggcacaguguucgggucccugaucaucggauacgcucggaacccuagccuuaaacagcagcuguuuuccuaugccauucucggcuucgcucugucugaagccaugggccuguuuugccuuauggucgcguuccucauccuguuugccauguga

SEQ ID NO: 66222 - RNA, 429 nt, Artificial Sequence
  derived and/or modified sequence opt5 from ATP5G3__Homo_sapiens__NP_001002258
auguucgccugcgcuaagcuggccuguacccccagccucaucagagcgggcucccggguggcuuaccgcccuauuucugccagcguccuguccagaccggaggccucucggacaggggaaggaagcacgguuuuuaacggcgcucagaauggggugucccaacuuauccagcgcgaguuccagaccucugccauuagcagagacaucgauacagcugccaaauuuauuggagcgggcgccgcuaccgugggggucgccggauccggcgcuggcaucgggacaguguucggaagccugaucauuggcuaugcccggaaccccucucucaagcagcaacuguuuuccuacgcgauccuuggguucgcccugagcgaagcuaugggacucuuuugccugaugguugccuuccugauucucuuugcuauguga

SEQ ID NO: 66223 - RNA, 414 nt, Artificial Sequence
  derived and/or modified sequence opt5 from ATP5H__Homo_sapiens__NP_001003785
auggccggcagaaagcuggcucucaaaaccaucgacuggguggccuucgcggagauuaucccccagaaccaaaaggcuauugccagcucccugaaaucuuggaaugaaacacuuacgagccggcuggccgcucucccugagaacccgcccgccaucgauugggcuuacuauaaggccaaugucgcgaaagccgggcugguugacgauuuugaaaagaaggugaaauccugcgcugagugggugucucuuagcaaggcccgcauugucgaauacgagaaagagauggaaaagaugaaaaaccugaucccuuucgaccagaugaccaucgaggaucucaaugaggcuuuucccgaaacaaagcuggacaagaaaaaguauccuuacuggccccaccagccuauugagaaccuguga

SEQ ID NO: 66224 - RNA, 267 nt, Artificial Sequence
  derived and/or modified sequence opt5 from ATP5J2__Homo_sapiens__NP_001003713
auggccagcgugguccccguuaaggacaaaaagcugcucgaggugaaacugggcgaacuuccuuccuggauccugaugagagauuucucuccgagcgggauuuuuggagcuuuccagcggggcuacuaucgcuacuauaacaaguacaucaaugugaaaaagggguccauuucuggaaucaccaugguccucgccugcuaugugcuguuuagcuacuccuucucuuauaagcaccuuaaacaugagagacugcggaaguaccacuga

SEQ ID NO: 66225 - RNA, 327 nt, Artificial Sequence
  derived and/or modified sequence opt5 from ATP5J__Homo_sapiens__NP_001003696
augauccugcagagacucuuccgguuuagcuccgugauucgcucugccgucagcguucaccugagacggaacaucggcgugaccgcuguggccuucaauaaggagcuugaccccauucaaaaacuguuugucgauaagauccgcgaauacaaauccaagagacagacaucugggggaccuguggacgcgagcuccgaguaucagcaggaacucgagcgggaacuguucaaacuuaagcaaauguuuggcaacgcugauaugaauacguucccgaccuuuaaguucgaggaccccaaauuugagguuauugaaaagccucaggccuga

SEQ ID NO: 66226 - RNA, 312 nt, Artificial Sequence
  derived and/or modified sequence opt5 from ATP5L__Homo_sapiens__NP_006467
auggcccaguucgugagaaaccuggucgagaagacccccgcucucguuaaugccgcggugacauacagcaaaccucggcuggcuacguuuugguauuacgccaagguggaacuugucccgcccaccccugccgagaucccccgcgcuauucaaucccugaaaaagaucgugaacucugcccagacaggcagcuucaaacagcucaccguuaaggaagcugugcugaaugggcuugucgccacagaggugcugaugugguuuuauguuggagaaauuaucggcaagagagggauuaucggauacgacguguga

SEQ ID NO: 66227 - RNA, 642 nt, Artificial Sequence
  derived and/or modified sequence opt5 from ATP5O__Homo_sapiens__NP_001688
auggccgcucccgccgugagcggccuguccagacagguccggugcuucucuaccagcguugugcgcccuuuugcgaagcuggugagaccgcccguccaaguguacgggaucgagggacgguaugcuacagcccuguacuccgccgcuucuaaacagaacaagcuggaacagguugagaaagaacugcuccgcguggcccagauucugaaggagccuaaagucgcugccagcgugcuuaaucccuauguuaagagauccaucaaggugaaaucucugaacgacauuacggcgaaggaacgguucagcccucucaccacaaaucugaucaaccugcucgccgagaauggccgccuguccaacacccaaggggucgugagcgcuuuuucuacaaugauguccgugcacagaggagagguccccuguaccguuacaagcgccucuccucuugaagaggcuacccuguccgaacucaaaacggugcuuaagagcuuccuuucucagggccaggugcugaaacucgaggccaagaccgauccguccauucucgggggaaugaucguccggaucggcgagaaguacguggacaugagcguuaaaacaaagauucagaaacugggccgcgcgaugagagaaaucguguga

SEQ ID NO: 66228 - RNA, 1413 nt, Artificial Sequence
  derived and/or modified sequence opt5 from ATP6AP1__Homo_sapiens__NP_001174
augauggccgcuauggccaccgcgagagugcggaugggcccccgcugcgcucaggcccuguggagaaugccuuggcucccggucuuccugagccuugccgcugccgcugccgcggccgcugccgagcaacagguuccccuggugcucugguccucugaccgggaucugugggcuccugccgcggacacacacgaagggcauaucacgagcgaucuucagcuguccaccuaccucgaccccgcccuggagcugggaccucgcaacgugcuccuguuucuucaggauaagcugucuauugaagacuucacagcuuauggcggggucuuuggaaauaaacaagauagcgccuucuccaaccucgagaaugcucuggaccuugcccccucuagccuggugcucccugccguugauugguacgcuguguccacccugacaaccuaucugcaggaaaagcucggcgcgagcccgcugcacgucgaccuugccacacugagagagcucaaacugaacgcuucucuucccgcccugcuccugauccggcugccuuacaccgccuccagcgggcucauggcuccccgcgaggugcugacgggaaaugaugaaguuauuggccaggugcuuucuacccugaaguccgaggacgucccuuauacagccgcgcucaccgcugugagacccagccggguggcccgcgaugucgccguuguggcuggcgggcugggaagacagcuucugcaaaaacagccggugucuccugucauccaucccccuguguccuacaacgacacagcuccccggauucucuuuugggcccagaauuucagcguugccuauaaggaccagugggaagaucugacgccccugaccuuuggcgugcaagagcucaaccugacaggguccuucuggaaugacucuuuugcgcgccuuagccugaccuacgagagacucuucggaacaaccgucaccuuuaaguucauccuggccaaccggcuguacccuguguccgcucgccacugguuuacaauggaaagacuugagguucauagcaauggcucuguggccuauuucaacgcuucccaggucacggggccgagcaucuacucuuuccacugugaauaugugagcucccucucuaaaaagggaagccugcuggucgcccggacccagcccuccccuuggcaaaugaugcuccaggauuuucagauucaggcguucaaugugaugggcgagcaauuuagcuacgccucugacugcgcuuccuucuuuagccccggcaucuggauggggcugcuuacaucucuguucaugcucuuuauuuucaccuauggacugcacaugauccugucccuuaaaacaauggauagauuugacgaucauaagggcccuaccauuagccucacgcagaucguuuga

SEQ ID NO: 66229 - RNA, 675 nt, Artificial Sequence
  derived and/or modified sequence opt5 from ATP6AP1L__Homo_sapiens__XP_011542025
augagacuguggaaggcccgggugcucaaacugguccuuaagaccgcuaaagacagccgccugggccucaacuccaaguggcugucucuuaaacugggggaugccggaaaucccagaagccucgcgauccgguucauucugacaaacuacaauaagcuguccauccagucuugguuuagccuccgcagaguugagauuaucuccaacaauucuauucaagcuguguucaacccuacgggcguguaugccccgagcggguacuccuaucggugccagcgcgucggaagccugcagcaggaccaagcccuucugcuccccucugauaccgacgauggcuccagccugugggaagugacauuuaucgacuuccagauccagggguuugcuauuaagggaggcagauucaccaaagcccaggauugugcuucuuccuuuagcccugccuuccuuaucggccuggcgaugucucucauucugcugcucguucuggccuacgcccuucacaugcugaucuaucuccgguaccuggaccaacaguaugaucuuauugcuucccccgcucauuuuagccagcugaaggcccgcgacacagcggaggaaaaagagcuccugagaucccagggggccgaaugcuacaagcugcggucucaacagaucagcaaaauuuacguguga

SEQ ID NO: 66230 - RNA, 1053 nt, Artificial Sequence
  derived and/or modified sequence opt5 from ATP6AP2__Homo_sapiens__NP_005756
auggccguguucgucguucugcucgcucugguggccggcgugcuugggaacgaguuuagcauccugaagucccccggaucugucguguucagaaauggcaacuggccuauuccgggggaacggauccccgacguugcggcucucagcaugggauuuuccgugaaagaggaucugucuuggccuggccuugccgucgggaaucuguuccaccgccccagagccaccgugaugguuauggugaagggagucaacaaacucgcucugccucccggcagcgugauuuccuacccucuggaaaaugccgugccguuuucucucgacagcgucgcuaacuccauccauagccuguucucugaggaaacacccguugugcuucagcuggccccuuccgaggagcggguguauauggucggcaaggcgaauagcguguuugaagaucucucuguuacgcugcgccaacuuagaaaccggcuguuccaggagaauagcgugcucagcucucugccccugaacucccucagccgcaauaacgaagucgaccugcuuuuucuguccgagcuccaggugcugcacgauauuucuagccuucuguccagacauaaacaccucgccaaggaccauagcccugaucuguacucucuggagcucgcugggcuggacgaaaucggaaagcgguauggcgaggauuccgaacaguuccgcgacgccagcaaaauccuuguugaugcucugcaaaaguuugccgacgauauguacucucucuaugggggaaaugcgguggucgagcuggugaccgucaaauccuucgacacaucccuuauuagaaagacccggacaauccuggaagccaaacaggcuaagaaccccgccucuccguacaaucucgcuuauaaguacaacuuugaguacagcgugguuuucaacauggugcuguggauuaugaucgcccuggcccucgcugucauuaucaccuccuauaauauuuggaacauggacccuggcuacgauagcaucaucuaucgcaugacaaaucagaaaauuagaauggacuga

SEQ ID NO: 66231 - RNA, 2517 nt, Artificial Sequence
  derived and/or modified sequence opt5 from ATP6V0A1__Homo_sapiens__NP_001123492
augggcgagcuguucagaagcgaagagaugacccucgcccagcuguuucuucaauccgaagcugccuacugcugugugucugagcugggggaacucggaaagguccaguuccgggaccugaaccccgauguuaauguguuucagcgcaaauucgugaacgaggucagacggugcgaggaaauggaccgcaagcugagauuuguggagaaagaaauccggaaggcgaauauuccuaucauggauacaggcgagaacccggagguucccuucccucgcgacaugauugaucuggaagcuaauuuugagaaaaucgaaaacgagcucaaggaaauuaauacgaaccaggaggcccugaagagaaauuuccuggagcucaccgaacugaaauuuauccuucggaagacacaacaguucuuugacgaggccgaacugcaccaucagcagauggcugaucccgaccuccuggaggaaagcuccucucuucuggagccuagcgagauggggcgcggaacaccccucagacugggcuucguggccggggucaucaaccgggaacgcauuccuaccuuugagagaaugcuguggcgggugugucgcggaaauguuuuccucagacaagcugaaaucgagaacccgcuggaagaucccgugaccggcgacuauguccacaaauccguguucauuaucuuuuuccagggcgaucagcuuaagaaucgggugaaaaagauuugcgagggguuuagagccucucuguacccuugucccgagacaccucaggaacgcaaggagauggcgagcggagucaacacccggaucgacgaucuccaaaugguucugaaucagacggaagaccauagacagcgcgugcuucaagccgcugccaaaaacauucgggugugguucaucaaggucagaaaaaugaaggcuaucuaucacacccugaaccucugcaauauugacgugacacagaaaugucugaucgccgagguuuggugccccgugaccgaucuggacuccauucaguuugcgcuccgccggggcacagagcauagcgggucuaccgucccguccauccugaacagaaugcagacgaaucaaacaccucccaccuacaacaagacaaauaaauucaccuauggauuucagaacauuguggaugccuacggcaucgggaccuaucgcgaaaucaauccugcucccuacacaauuaucacguuccccuuucuuuucgccguuauguuuggagacuucggccacggcauucugaugacccucuuugcuguguggaugguccugcgggagagcagaauccuuucucagaagaacgaaaaugagauguucuccacaguguucagcgggcgcuacauuauccugcucaugggagucuuuucuauguauaccggccugaucuacaacgauuguuucuccaagagccugaauauuuuuggguccucuuggagcgugcggccuauguucacauauaacuggaccgaagagacgcucagaggaaauccgguucugcagcuuaaccccgcccugccuggcguguuugggggacccuacccuuucggcaucgaccccauuuggaauaucgccacaaacaaacucaccuuucugaacuccuucaagaugaaaaugagcgucauucugggcaucauucacaugcuuuuuggggugucucucucccuguucaaucauaucuauuuuaagaaaccgcugaacaucuacuucggauuuauuccugagaucauuuucaugaccagccucuucggcuaucugguuauccuuaucuuuuacaaguggacagcuuacgaugcgcacaccucugaaaaugcccccagccugcucauucauuucaucaacauguuucuguucuccuauccugagucuggguacagcaugcuguauuccggacaaaagggcauucagugcuuucuuguggucguggcucuccugugugugcccuggaugcuucucuucaaaccucugguucuucggcgccaguaccugagacggaagcaccucgggacacugaauuuuggcggaaucagagucggcaacgggcccacggaagaggacgccgaaauuauccagcacgaucaacugagcacccauucugaggacgccgaugaguucgacuuuggagacacaauggugcaccaggcuauucauaccaucgaauauugccuuggcugcaucuccaauacagccagcuaccuccgccugugggcgcugucucucgcucacgcccagcuguccgaggugcuuuggaccauggucauucauaucgggcugagcgugaaaucccucgccggaggccugguucuguucuuuuucuucacggcuuuugccacccuuacaguggcuauucuccugaucauggaagggcugucugccuuccuccacgcgcugcggcuucacugggucgaguuucagaacaaguucuauagcggcaccggauuuaaauuccugccguuuuccuucgaacauauuagagagggcaaguuugaggaauga

SEQ ID NO: 66232 - RNA, 2571 nt, Artificial Sequence
  derived and/or modified sequence opt5 from ATP6V0A2__Homo_sapiens__NP_036595
augggcagccuguucagauccgagaccaugugccucgcccagcuguuucuucaaucugggacagcuuacgaaugucugagcgcccucggagagaagggccuggugcaguuccgggaccuuaaccagaaugucuccucuuuucagcgcaaauucguuggggaagugaagagaugcgaggaacuggagcggauccucguguaucugguccaagagauuaaccgcgcggauaucccccugccugaaggagaggcuagcccgcccgccccuccccucaaacaggugcuggaaaugcaggagcagcuucaaaagcuggagguugaacucagagaggugacgaaaaauaaggaaaagcugcggaaaaaccuucuggagcucauugaauacacccacaugcugcgcgucacaaagaccuuugugaaaagaaauguugaguucgagccuacauaugaagaguuucccucccuggaaucugacagccuccuggauuacuccuguaugcagcggcuuggcgccaagcugggguucgugagcggacucaucaaccagggcaaagucgaggcuuuugaaaagaugcuguggcgcgugugcaagggcuauaccauugugucuuacgccgagcuugacgagucccuggaagauccugagacaggggaagucaucaaaugguauguuuuccucaucagcuuuuggggagagcagauuggccauaaggugaaaaagaucugugacugcuaccacugucauguguacccguaucccaauaccgcugaagagagacgggagauucaagaagggcugaacacgcgcauccaggaucuguacaccguccuccacaaaacagaggacuaucugagacaggugcuuugcaaggccgcggaaucuguuuacucccgggugauucaagucaaaaagaugaaggccaucuaucauaugcugaauauguguagcuucgaugugaccaacaaaugccucauugcugagguuugguguccugaggccgaccugcaggaucuucgcagagcucuggaagagggaucucgggaauccggcgccacaauccccagcuuuaugaauaucauuccuaccaaggagacgcccccgacaagaauccgcaccaacaaauucacagaaggguuccagaauauuguggacgcguacggagucggcuccuaucgggaggugaacccugcccucuuuaccaucauuaccuuccccuuucuguucgcugucauguuuggcgauuucgggcacggauuugugauguuccuguuugcccuccugcuuguucugaaugagaaccacccuagacucaaccagucucaagaaaucaugcgcauguucuuuaauggccgguacauccugcugcuuauggggcuguucagcguguacacaggacugauuuauaacgacugcuuuuccaagagcgucaaucuguucggcucuggguggaacguguccgcuauguacagcucuagccauccucccgccgagcacaaaaagaugguucucuggaaugacuccguggucagacauaacucuauccugcagcuugaucccagcauuccgggaguguuccgcggccccuauccucugggcaucgaccccauuuggaaucucgccacgaaccggcugaccuuucucaauuccuucaagaugaaaaugagcgugauccuugggaucauucacaugacauuuggaguuauccucggcauuuucaaccaccuccauuuuagaaagaaauucaauaucuaccuggucucuauuccugaacuccuguuuaugcuuugcaucuucggguaucugauuuuuaugaucuucuacaaguggcucguguuuuccgcugagaccagccgcguggcgcccucuauccugauugaguucaucaacauguuucuguucccggccuccaaaacaagcggacuuuauaccggccaggaauacguccagcgggugcuccugguugugacggcucuguccgucccugugcuguuccuggggaagccccuuuuucugcucuggcugcacaauggcagaucuuguuucggaguuaaccgcagcggcuacacacugauucggaaggauuccgaggaagaggugucucuucucgggagccaagacaucgaagagggaaaucaucaggucgaagauggcugcagagagauggccugugaggaauuuaacuucggggagauucugaugacccaggugauccacuccaucgaauauugccugggauguauuagcaacaccgccucuuaccuccggcugugggcucuuucccuggcccaugcgcagcucagcgacguucugugggcuaugcugaugcgcgugggccuuagagucgauacaaccuauggggugcugcuccugcucccugugaucgcccuguuugccguccuuacaauuuucauccugcucauuauggagggccugucugcuuuucugcacgccauccggcuucacuggguugaguuccaaaauaaauuuuacgugggagcuggcacgaaguucgugcccuuuuccuucagccugcucucuagcaaauucaacaaugacgauuccgucgccuga

SEQ ID NO: 66233 - RNA, 2523 nt, Artificial Sequence
  derived and/or modified sequence opt5 from ATP6V0A4__Homo_sapiens__XP_005250451
auggugagcgucuucagauccgaggaaaugugccugucucagcucuuucugcaaguugaggccgcuuacuguugcguggccgaacuuggcgagcuggggcucgugcaguucaaggaccugaacaugaaugucaacagcuuucagcggaaauucgugaaugaaguucgcagaugugagucccuugagcggauccugcgcuuucucgaagaugagaugcagaacgaaauugugguccaacugcuggagaagucuccccucaccccucugccgagagagaugaucacacuugaaacggugcuggagaaacucgaaggagagcugcaggaagcgaaucagaaccagcaagcucuuaagcagagcuuccuggagcucaccgagcugaaauaucugcucaagaagacacaggacuuuuucgaaaccgagacaaaucuggccgaugacuuuuucaccgaagauacauccggccuucuggagcucaaagccguucccgcuuacaugaccgggaagcugggauuuauugccggcgugaucaaccgggaacgcauggcuucuuucgagagacuucuguggcggauuugccgcgggaaugucuaucucaaauuuagcgagauggacgccccucuggaagaucccgugacgaaggaggaaauccagaaaaacaucuucauuaucuucuaccaaggagagcagcugagacagaagauuaagaaaaucugugacggcuuucgggcgaccguguauccuugccccgaaccugccgucgagcgcagagagaugcucgaauccguuaaugugcggcuggaggaucuuauuacagugaucacccaaacagaaagccaccgccagagacugcuccaggaggcugccgcuaacuggcauucuuggcugauuaagguccagaaaaugaaggccguguaccacauccuuaauauguguaacaucgacguuacccaacagugcgugauugcggagaucugguucccggucgccgaugcuacgcggauuaaaagagcccuggaacagggcauggagcucuccgggagcucuauggcucccaucaugacaaccgugcaguccaagacagccccucccaccuuuaaucgcaccaacaaauucacagccggauuucaaaacauuguugacgcuuauggcguggggagcuaccgggaaaucaauccugcgcccuacacgaucauuaccuucccguuucuguucgccgucauguuuggagauuguggccaugggacagugaugcugcucgcugcccuguggaugauccuuaacgagagacgccugcucucucagaagaccgacaaugaaauuuggaacacauucuuucacggacgguaucugauccugcuuaugggcauuuucuccaucuacaccggccucaucuauaaugacugcuuuagcaagucccugaacauuuucgggucuagcugguccguccagccuauguucagaaauggaacguggaacacacaugugauggaggagagccuguaccuccagcuggaucccgccaucccuggcguuuauuuugggaaucccuaccccuucggaauugacccuaucuggaaccuugcuucuaauaaacugaccuuucucaacuccuauaagaugaaaaugagcgugauucugggcaucguccaaaugguguucgggguuauucugucucuuuuuaaucacaucuacuuccgccggacccucaacaucauucugcaguuuaucccggaaaugauuuucauccugugucucuuuggauaccugguguucaugauuaucuuuaaguggugcugcuucgauguccacgugagccagcaugcccccuccauccuuauucacuuuaucaauauguuccuguucaacuauucugacagcuccaacgcgccucucuacaaacaucagcaagaggugcagagcuuuuucguugucauggcucugauuucugugcccuggaugcugcuuaucaagccuuuuauucucagagccucccaccgcaagagccagcugcaagccucucggauccaggaagaugcuacagagaauaucgaaggcgacuccagcucccccucuagcagauccggccagcgcaccucugccgauacacacggggcucuggacgaucauggagaggaguucaacuuuggcgacguguucguccaccaggccauucauacgaucgaauauugucucgggugcauuagcaauaccgcguccuaccugcggcuuugggcccugagccucgcucacgcccaacugucugaggugcuguggacaaugguuaugaacuccggacuucagaccagaggcuggggcgggaucgugggagucuuuauuaucuucgcuguguuugccguucucacaguggcgauccugcugauuauggaaggccucagcgccuuccugcaugcccuucggcugcacugggucgaguuucagaauaaauucuaugugggggauggauacaaguucucuccguuuuccuucaaacacauccucgacggcaccgcugaagaguga

SEQ ID NO: 66234 - RNA, 468 nt, Artificial Sequence
  derived and/or modified sequence opt5 from ATP6V0C__Homo_sapiens__NP_001185498
augagcgaguccaagucuggccccgaauacgccagcuucuuugcugugaugggggccuccgcggcuauggucuucucugcccugggagccgcuuauggcaccgccaaaagcgggacaggaaucgcugccauguccguuaugagaccugagcagauuaugaagucuaucauuccgguggugauggcgggcaucauugccaucuacgggcucgucguggcuguucugaucgccaacagccuuaaugacgauauuucccuguauaagagcuuucuccaacugggagcuggccuuucugugggccuguccgggcucgccgcgggauucgccaucggcauugucggggacgcuggagugcggggcacggcccagcagccccgccuguuuguugggaugauccugauucucaucuucgcugaagugcugggacuuuacggccugauugucgcccucauccugagcaccaaauga

SEQ ID NO: 66235 - RNA, 1056 nt, Artificial Sequence
  derived and/or modified sequence opt5 from ATP6V0D1__Homo_sapiens__NP_004682
augagcuucuuucccgagcuguacuucaacguggacaauggcuaucucgaagggcuggucagaggacuuaaggccggcguucugucccaggcugauuaccucaaccuggugcaaugcgagacccuugaagaccugaaacuccaucugcagucuacagauuaugggaauuuucuggccaacgaggcgagcccucucacgguguccgucauugacgaucggcugaaggaaaagauggugguugaguuccgccacaugagaaaucacgcuuacgagccgcuugccucuuuucuggacuucauuaccuauagcuacaugaucgauaacgugauucuccugaucacaggaacccuucaucagcgguccauugccgaacugguccccaaaugucacccucucggcucuuuugagcagauggaagcugugaauaucgcccaaacacccgcugagcuguauaacgccauccugguugacaccccucucgcggccuucuuucaggauugcauuagcgagcaggaccuggaugaaaugaauaucgagauuauccgcaacacacuuuacaaggcuuaccuggaauccuucuauaaauuuuguacccuccuugggggaacgaccgccgacgcuaugugccccauucuggaguucgaagccgauagacgggcguuuaucauuacaaucaauagcuucggcaccgagcugucuaaggaggaccgcgccaaacucuucccucauuguggcagacuguacccggaagggcuggcucagcucgcccgggcugacgauuaugagcaagugaagaacgucgccgacuacuaucccgaauacaaacugcuuuuugagggagccggcuccaauccuggggauaagacacuggaagaccgcuucuuugagcacgaggugaaacucaacaagcuggcuuuccuuaaucaguuucacuucggaguguuuuaugcguucgucaagcugaaagaacaggagugcagaaacaucguuuggauugccgaauguaucgcucagcggcaucgcgccaagauugauaacuacauccccaucuuuuga

SEQ ID NO: 66236 - RNA, 246 nt, Artificial Sequence
  derived and/or modified sequence opt5 from ATP6V0E1__Homo_sapiens__NP_003936
auggccuaccacggccugaccgugccccucaucgucaugagcguuuucuggggguuugugggauuccuggugccuugguuuauuccgaagggccccaacagaggggucaucauuacaaugcuugugacgugcuccguuuguugcuaucuguucuggcucaucgcuauucuggcccagcuuaauccucuguuuggaccccaacucaaaaacgagaccaucugguaccugaaguaucauuggccuuga

SEQ ID NO: 66237 - RNA, 642 nt, Artificial Sequence
  derived and/or modified sequence opt5 from ATP6V0E2__Homo_sapiens__NP_001094062
augagagugcggggccccgcccgccugaucgcuagcggggccagacuccugcuucggaugcuguccgcgcucccuggauggggcccggcucaucugcagcgcccccuucuggggccugccucuugccucggcauucugagacccgccaugaccgcucacagcuucgcccugccugucaucauuuuuacaacguucuggggacucguugggaucgcuggacccugguuugugccuaagggcccgaaccggggcgugauuaucaccaugcuggucgccacagcgguguguugcuaccuucugugucccgcccucgggaugaccguugcuccucugucccuuacaacccccucuagcggaccuucccccacacaacugugccucgugaccucuagccugcugcucgccccgcgcgacccugauccccagggccugccuggguccuggaaaagcucucaguccagccagcccgcuagagcccuuggaucucccggccacuccagcgggcggggagacguccugcuccaauauccucauuguucuggcgugugcccgcugucccagggcgaugcggccggggagcuuguuugggugggcagcuucccccugcagacgggacagaugccugggcucucccccucuuga

SEQ ID NO: 66238 - RNA, 1542 nt, Artificial Sequence
  derived and/or modified sequence opt5 from ATP6V1B1__Homo_sapiens__NP_001683
auggccauggagaucgacagcagacccggcgggcugccuggauccucuugcaaccucggcgcugcccgggaacacaugcaggcggugacccgcaauuacauuacacauccgagagucacguaucggaccguuuguagcgugaacgggccccuggugguccuugaucgcgugaaguucgcucaauacgccgagaucguucacuuuacacugccugacggaacccagagauccggccaggugcucgaagucgccgggacaaaagcuauugugcagguuuucgagggaaccucuggcaucgaugcccggaagacaaccugcgaauuuacgggcgacauucugcgcacccccgugagcgaggauaugcuugggagagucuucaauggauccggcaaaccuaucgacaaggggcccguggugauggcugaggauuuucuggacaucaacggacaaccuauuaauccgcauucucggaucuaucccgaagagaugauucagacaggcaucagcccuauugaugucaugaacuccaucgcccgcgggcagaaaauucccaucuucagcgcggccggacucccucacaaugaaaucgcugcccagauuuguagacaagcuggccugguuaagaagucuaaagccgugcuggacuaccaugaugacaacuuugcgaucguguucgccgcuaugggcgucaauauggagaccgcccgguuuuucaaguccgauuuugagcagaacgggacaaugggaaaugugugccucuuccugaaccuugcuaaugaccccaccauugaacgcaucauuacgccgagacuggcccucacaaccgccgaguuucuggcuuaucagugugaaaaacacguucuugugauccugacagacaugagcucuuacgcggaggcccuccgggaagucuccgcugcccgcgaggaggugccuggcagacggggguuccccggauauauguacaccgaucuggccaccaucuacgaaagagcuggccgcguugaggggcggggaggcagcauuacacagaucccuauucugacgaugcccaacgacgauaucacccaccccauuccugaccucacaggcuucaucaccgaagggcaaaucuauguggauagacagcugcauaaucgccagauuuacccgcccaucaacguccuuccuucucugucccggcucaugaaaagcgccauuggagagggcaugacaagaaaggaccacggggauguguccaaccaacuguaugcgugcuacgcuaucggaaaggacguccaggccaugaaggccgugguuggcgaagaggcucuuaccucugaggaucugcucuaucuggaauuucugcagaaauucgagaagaauuuuauuaaccaggggcccuacgaaaaucgcagcguguucgagucccucgaccugggcuggaaacuucugcggaucuuuccuaaggaaaugcucaaacgcauuccccaagccgucaucgaugaguucuauagcagagagggagcucugcaggaccuugccccggacacggcgcuguga

SEQ ID NO: 66239 - RNA, 1536 nt, Artificial Sequence
  derived and/or modified sequence opt5 from ATP6V1B2__Homo_sapiens__NP_001684
auggcccugagagcuaugcggggcaucgugaacggggccgcgcccgaacucccugucccgaccggaggccccgcuguuggggcccgcgaacaggcccuggcugugagcagaaauuaccuuucccaaccucggcugacauauaagacggugucuggagucaacggcccccucgugauucuggaccacguuaaauucccucgcuacgccgagaucgugcaucuuacccugcccgaugggacaaagagaagcggacagguccucgaaguguccggcucuaaagcuguugugcaggucuuugagggcaccagcgggauugacgccaagaaaacauccugcgaauuuaccggagauauccugcggacaccugugucugaggacaugcugggccgcguguuuaaugggagcggaaagccgauugauagaggccccgucguucucgcggaggacuuccuggauaucauggggcagccuaucaacccccaaugucggauuuauccugaagagaugauccagaccggaauuuccgccaucgacggcaugaauagcauugcucgcggccagaagauccccauuuucucugccgcugggcuuccgcacaacgaaaucgccgcgcagaucugcagacaagccggacuggugaaaaaguccaaagauguggucgacuacagcgaggagaauuucgcuauuguguuugccgcuaugggcguuaacauggaaacggcccgguucuuuaagucugauuucgaggaaaauggguccauggacaacgugugucucuuucugaaucuugccaacgauccuaccaucgagcgcauuaucacacccagacuggcucucaccacagcggaguuccuggccuaucagugcgaaaaacauguccuggugauucucaccgacaugagcucuuacgcugaggcccugcgggaaguuuccgccgcucgcgaggaagugccuggaagacggggcuuucccggguauauguacacggaccuugccacaaucuacgagagagcgggacgcgucgaaggccggaauggcagcaucacccagauucccauccugacaaugccuaacgaugacauuacccacccgauccccgaucucaccggguauauuacagagggacagaucuacguggacagacaacugcauaaucgccagaucuauccucccauuaacguccuuccuucccugucucggcucaugaaaagcgcuaucggcgaggggaugacgagaaaggaucacgccgacguguccaaccagcuguacgccuguuaugcuauuggaaaggauguucaagccaugaaggcuguggucggcgaagaggcccugaccagcgacgaucuccuguaccuugaguuccugcagaaauucgaacgcaauuuuaucgcgcaggggcccuaugaaaaccggacaguguucgagacccucgacauuggcuggcagcugcuuagaaucuuuccgaaggagaugcugaaacgcauuccucaaucuacacucuccgaguucuacccccgggauagcgccaagcacuga

SEQ ID NO: 66240 - RNA, 1149 nt, Artificial Sequence
  derived and/or modified sequence opt5 from ATP6V1C1__Homo_sapiens__NP_001686
augaccgaguucuggcugaucagcgcccccggcgaaaagacaugccagcaaacgugggagaaacuccacgcugccaccuccaagaacaauaaccuggcggugacaucuaaauuuaauauuccugaccuuaaggucgggacccuggauguucucgugggacugagcgacgaacuugcuaaacuggaugccuucguggagggcgucgugaagaagguugcccaguacauggcugacgugcucgaagauuccaaagacaagguccaggagaaccugcuggccaaugggguggaucucguuacauauaucaccagauuucagugggacauggcuaaauacccgauuaagcaaucucugaaaaacaucagcgagauuaucgccaagggagugacacagaucgauaaugaccuuaagucccgggcgucugccuauaacaaucugaaaggcaaccuccagaaucuggaacgcaagaacgcugggagccuucugaccagaucccucgccgagauugucaaaaaggaugacuucgugcuggauagcgaauaccuggugacgcuccuggucguugugcccaaacuuaaucauaacgacuggaucaagcaguaugagacccuggcugagaugguggucccucggucuuccaaugugcucagcgaagaccaagauucuuaccuguguaacguuacacuuuuucgcaaagccguggacgauuucagacacaaggcgcgggagaacaaguuuauuguccgcgacuuccaguauaaugaagaggaaaugaaagccgauaaggaggagaugaacagacuguccaccgacaaaaagaaacaguuuggaccccucgugcgguggcugaagguuaauuucagcgaggcuuuuaucgccuggauucaugugaaggcucugcgcgucuucguggaaucuguccucagauacggccugccugugaacuuucaggccaugcuucugcaacccaauaaaaagacacucaaaaagcugcgggaaguucuucacgagcuguacaaacaucucgauuccagcgccgcugcgaucauugacgccccuauggauaucccgggccugaaccugucccagcaggaauauuaccccuauguguacuauaagaucgacugcaaucuccuggaguucaaguga

SEQ ID NO: 66241 - RNA, 744 nt, Artificial Sequence
  derived and/or modified sequence opt5 from ATP6V1D__Homo_sapiens__NP_057078
augagcggcaaggacagaaucgagauuuuccccucccggauggcccagaccaucaugaaagcucgccugaagggggcccaaacaggaagaaaccuccugaaaaagaaaucugaugcgcuuacgcugcgguuucgccagauucucaagaagaucauugaaaccaaaaugcugaugggcgaggugaugagagaagcugccuucagccuugccgaggcuaaguuuacagccggggacuucuccaccacagucauccagaauguuaacaaagcucaggugaagauccgggccaaaaaggauaauguggcgggagucacccugccuguguuugaacacuaccaugagggcacagacucuuaugagcucaccgggcuggcccgcggaggcgaacaacuggcuaagcucaaaagaaacuacgccaaggcuguugagcugcuuguggaacuggccagccuccagacguccuucgucacccuggaugaggcgauuaaaaucacaaaucggcgcgugaacgccauugagcacguuaucauuccgagaaucgaacggacccuugcuuauauuaucacagagcuggacgaacgcgagagagaagaguuuuaccggcucaagaaaauccaggagaagaaaaagauucugaaggaaaaaucugagaaggaucuggaacagcgcagagccgcuggcgaggugcucgaacccgccaaucugcuugccgaggagaaagacgaagaucuccuguucgaguga

SEQ ID NO: 66242 - RNA, 615 nt, Artificial Sequence
  derived and/or modified sequence opt5 from ATP6V1E1__Homo_sapiens__NP_001034455
auggcccugagcgacgcugaugugcagaagcaagccgaggaagaguucaacaucgaaaaaggcagacucguccagacccagcggcugaagauuauggaguacuaugagaaaaaggaaaaacagaucgagcaacagaagaagauucagauguccaaucuuaugaaccaggcgcgccugaaaguucucagagcucgggacgaucugaucacagaccuucugaaugaagccaagcaacgccucucuaaaguggugaaggauacgaccagauaccagguccugcuggacgggcucgugcugcagggacuuuaucagcugcucgagccccggaugauuguucgcugcagaaaacaagauuuuccucuggugaaggccgcuguccagaaggccaucccgauguacaaaaucgcuacaaagaacgacguggauguucagauugaccaagaaagcuaucuucccgaggauaucgccggcgggguggagauuuacaauggagaccggaaaaucaaggucuccaacacccuggaaucucgccucgaucugauugcgcagcagaugaugccugaggugagaggcgcccuguucggggcuaaugccaaccggaaauuucucgacuga

SEQ ID NO: 66243 - RNA, 444 nt, Artificial Sequence
  derived and/or modified sequence opt5 from ATP6V1F__Homo_sapiens__NP_001185838
auggccggcagagggaagcugaucgcugugauuggagacgaggauaccgucacaggcuuccuccuugggggaaucggcgaacugaacaaaaaucggcaccccaacuuucugguuguggagaaggacacgaccauuaaugaaaucgaggauacauuccgcagccucgggucccugccuggaucuguggucgaagccaacccgaaucagagagaucccccucuuugggacgagauugacagccggcaauuucugaaccgcgaugacaucggcaucauucucaucaaucaguacauugcggagauggugagacaugcucuggaugcccaccagcaguccauccccgccguucuggaaauuccuucuaaagagcaucccuaugacgcugccaaggauagcauccuccggcgcgcuagaggcauguucaccgccgaagaccugcgguga

SEQ ID NO: 66244 - RNA, 357 nt, Artificial Sequence
  derived and/or modified sequence opt5 from ATP6V1G1__Homo_sapiens__NP_004879
auggccagccagucccaaggcauccagcagcugcuccaggcugagaagagagccgcggaaaaagugucugaggcucggaagcgcaaaaacagacggcugaagcaagccaaagaagaggcccaggcugaaauugagcaguaccgccuucagagagagaaggaguucaaggccaaagaagcugccgcgcuggggagccggggauccugcucuaccgaagucgagaaggagacacaagagaaaaugacgauccuccagaccuauuuucgccagaauagagacgaaguucuggauaaccuucuggccuucgugugugacauucggcccgaaauccacgagaauuaccgcauuaacggcuga

SEQ ID NO: 66245 - RNA, 237 nt, Artificial Sequence
  derived and/or modified sequence opt5 from ATP6V1G2__Homo_sapiens__NP_001191007
auggccagccagucccaaggcauccagcagcugcuccaggcugagaagagagccgcggaaaaaguggcugacgcccggaagcgcaaagccagacggcugaagcaagcuacccgcagacagguccaggggaugcagucuagccaacagcggaaccgcgagagaguucuugcccagcugcucggaauggugugcgaugugcggccccagguccacccuaauuaccgcauuuccgcuuga

SEQ ID NO: 66246 - RNA, 357 nt, Artificial Sequence
  derived and/or modified sequence opt5 from ATP6V1G3__Homo_sapiens__XP_006725021
augaccagccagucccaaggcauccaccagcugcuccaggccgagaagagagcuaaagacaagcuggaagaggccaaaaagcggaaagggaagcgccuuaagcaggcgaaagaagaggcuaugguggaaauugaucaauacagaaugcagcgggacaaggaguuccgccugaaacagucuaagaucaugggaagccagaacaaucucuccgaugagauugaggaacaaacacugggcaaaauccaggaacuuaacgggcauuauaauaaguacauggagucugucaugaaccagcugcucagcaugguuugcgacaugaagcccgagauucacgugaauuauagagccacgaacuga

SEQ ID NO: 66247 - RNA, 4503 nt, Artificial Sequence
  derived and/or modified sequence opt5 from ATP7A__Homo_sapiens__NP_000043
auggaccccagcaugggcgugaacuccgucaccaucucuguugaggggaugacaugcaauagcuguguguggacgauugaacagcaaaucggaaaggugaacggcguccaccauauuaaagugucccuggaggaaaagaaugccaccaucauuuacgauccuaaacuccagacaccgaagacccugcaggaggcuaucgacgauaugggguucgacgccguuauccacaaccccgauccucuucccgugcugacagacacccucuuucugacagucaccgcgucucuuacgcugccuugggaucauauucagagcacccuccugaaaacaaagggagugaccgacaucaagauuuauccccaaaagagaacaguugcugugaccaucauuccuuccaucgucaaugccaaccagauuaaggaacuggugccggagcucucucuggauacgggcacacuugagaaaaagagcggggccugcgaagaccacuccauggcucaggccggagaggugguccugaaaaugaagguugaaggcaugaccugucauagcugcacaucuaccaucgagggcaagaucgggaaacuccagggagugcaacggauuaaggugucccuggauaaucaggaggcuaccaucgucuaccagccccaccuuauuagcguggaagagaugaaaaagcagaucgaagccaugggcuucccugcguuuguuaaaaagcaacccaaauaucugaagcucggggccauugacguggagcgccugaagaacacaccugucaaaucuuccgaaggaagccagcagagaucucccuccuacacgaaugauagcaccgcuacauucaucaucgacggcaugcacuguaaguccugcgugucuaacauugagagcacccuguccgcccuccaauauguuagcucuaucguggucucccuggagaaucggagcgcuauugugaaauacaacgccucuagcgucacaccggaaucccuucgcaaggcgaucgaggccgugucuccugggcuguauagaguuagcauuaccuccgaaguggagagcacgucuaauucccccuccucuuccagccuccagaaaaucccucugaacgucgugucccagccccuuacacaggaaaccguuaucaauauugacggaaugaccuguaacucuugcgugcaaagcaucgagggcgucauuuccaagaagcccggcgugaaaucuauccgggugagccuggcuaacuccaaugggacaguugaguacgauccucuccugaccagcccggaaacacugcgcggagccauugaggacaugggcuuugaugcuacgcucucugacaccaacgaaccccuggucgugaucgcccagccuuccagcgagaugccccuucugacaucuaccaaugaguucuacacaaaggggaugaccccugugcaggauaaagaggagggaaagaacuccagcaaauguuauauucaggucacgggcaugaccugcgccucuuguguggcuaauaucgaaagaaaccuccggcgcgaggaagggaucuacagcauucugguugcgcuuauggccggaaaggcugaggugagauauaaucccgccgucauccaaccgccuaugauugccgaguuuauccgggaacugggcuucggcgcuacagugauugagaacgccgacgaaggggauggaguucucgagcuggugguccgcggcaugaccugcgcguccugcgugcauaagaucgaaagcucucugacaaaacacagagggauccucuacuguuccguugcucuggccaccaauaaggcccauauuaaauaugaccccgagaucauuggaccucgggauaucauucacacgaucgagagccuuggcuuugaagcuagccuggugaagaaagaccgcucugccagccaccucgaucauaagagagagauccggcaguggagacgcuccuuccuggucucucuguuuuucugcauucccgugauggggcuuaugaucuacaugauggugauggaccaccauuuugcuacacuccaccauaaccagaauaugagcaaggaagagaugauuaaccugcacuccucuauguuccuggaacggcagauccucccuggccugagcgucaugaaucuucuguccuuccuccuguguguucccgugcaauuuuucggaggcugguauuuuuacauucaggccuacaaagcgcugaagcacaaaaccgccaacauggacgugcuuaucguccucgcuacaaccaucgccuucgcuuauagccugauuauccugcucguggccauguacgagagagcgaagguuaauccgauuaccuuuuucgauacaccucccaugcuguuuguguucaucgcccuugggcgcuggcuggagcauauugcuaaaggaaagacgucugaagcccucgcuaaacugaucucccugcaggccaccgaggccacaauugucacccuugacagcgauaacauccuccugucugaagaacagguggacguugaacuggugcaacggggcgauaucauuaaggucgugcccgggggaaaguuuccuguugacggcagagugaucgaggggcacuccauggucgaugagagccucauuacaggcgaagcuaugccgguggcgaaaaagcccggaucuaccgugaucgccggcuccauuaaccagaaugggagccugcuuaucugcgcuacgcaugucggagccgacacaacccugucccagaucguuaaacucguggaggaagcccaaaccagcaaggcuccuauucagcaguucgccgauaaacugucuggcuauuuugugcccuucaucgucuuugugagcauugcgacacugcuuguuuggaucgugauuggguuccucaacuucgagaucgucgagaccuacuuuccuggauauaaucgcuccaucucucggacagaaacgauuaucagauucgcuuuucaggccagcauuaccgugcuguguaucgccugccccuguucccugggccucgcuacaccuaccgccguuaugguggggacaggcgucggagcgcaaaacggcauucugaucaaagggggagagccccuugaaauggcucacaaggugaaagucgugguuuucgacaagaccggcacgauuacccacgggacaccgguggucaaucaggugaaaguucugaccgagucuaaccgcaucagccaucacaagauccucgccauugugggaacagccgaauccaauucugagcauccucugggcaccgcuaucacaaaauacugcaagcaggagcuggauaccgaaacgcuugggacauguauugacuuucaggucgugcccggcugcggaaucagcuguaaggugaccaacauugagggccugcuccacaaaaauaacuggaauaucgaagauaacaauaucaagaacgccucccugguucaaauugacgcuagcaaugagcagucuuccaccucuagcuccaugaucauugacgcccagaucagcaacgcgcucaacgcccagcaauauaaaguccugauugggaaucgggaauggaugaucagaaacggacuugugaucaauaacgaugugaaugacuucaugacagagcaugagcgcaagggccggaccgcuguccugguggccguugaugacgaacucugcgggcugauugcuaucgccgauacggugaaaccugaggccgaacuggcuauucacauccuuaaguccaugggacuggaggucgugcucaugacaggcgacaacucuaagaccgcgagaagcauugccucccagguuggcaucacaaaaguguuugcugaaguccugcccagccacaagguggccaaaguuaagcagcuccaagaggaggggaaacggguggccauggucggagauggcauuaaugacucuccggcucuggccauggcgaacguggggaucgcuaucggaaccggcacagauguggccauugaagccgcugacgucguucuuauccgcaaugaucugcucgacgugguggccuccauugaucugagcagaaagaccgucaaacggaucagaauuaacuucguguuugcgcugaucuacaaucuuguugggaucccuauugcugccggaguguucaugcccaucggccugguccuccagccuuggaugggcucugccgcuauggccgcuagcuccgugucuguugugcugagcucccucuuucugaaacuuuaccgcaagcccacguaugagucuuacgaacugcccgcccggagccagauugggcagaaguccccuagcgagaucucuguccaugugggaauugacgacaccuccagaaacagcccgaagcugggccuccuggaucgcaucgucaauuauuccagagcgucuaucaacagccuucuguccgacaaacggucucucaauagcgugguuacauccgagcccgauaagcacagccugcucgugggggacuuccgcgaagaugacgauaccgcccuguga

SEQ ID NO: 66248 - RNA, 3777 nt, Artificial Sequence
  derived and/or modified sequence opt5 from ATP7B__Homo_sapiens__NP_001005918
augcccgagcaggaaagacaaaucaccgcccgggagggcgcuagccgcaagauucuguccaaacucucucugccuacaagagccugggaaccggcgaugaagaaaucuuucgcuuuugacaacgugggguacgagggaggccuugaugggcugggacccuccucucaggucgccacgagcaccguucggauccucggcaugacaugccaguccugugugaagucuauugaagaccgcaucagcaaucugaaagggauuaucuccaugaaggugagccuugagcagggaucugccaccgucaaguaugugccuuccguugugugccugcaacaggucugucaccagaucggcgauaugggcuucgaggcuagcauugccgaagggaaagcugccucuuggcccuccagaagccucccugcgcaggaggccgugguuaagcugcggguggaaggaaugacaugccaaucuugugucuccagcaucgagggcaaagugcgcaagcugcaggggguggucagaguuaaagugucccucucuaaccaggaggcugugauuaccuaccagcccuaucugauccaaccugaagaccuucgggaucaugucaaugacaugggauuugaggccgcuauuaagagcaagguggccccgcugucccucggccccaucgauauugaacgccugcagagcacaaacccuaaaagaccccuuucuuccgcgaaucagaacuucaauaacagcgagacccuggggcaccaaggaucucauguugugacgcuccagcugcggaucgacggcaugcacugcaagagcuguguccugaauaucgaagagaacauuggccagcuccugggggugcaguccauccaaguuucucuugagaauaaaaccgcccaggugaaguacgauccuagcugcacaucccccgucgcucugcagcgcgccauugaagcucucccgccuggaaacuuuaaagugagccugcccgacggcgccgaggggucuggaaccgaucauagauccagcagcucccacagcccuggcuccccuccccggaaucagguccaagggacauguucuaccacgcuuaucgccauugcuggaaugacaugcgcgagcugugugcacuccaucgaaggcaugaucucucagcuggagggcguucagcagauuagcgugucccucgccgaagggaccgcuacaguccuguauaaccccagcgugaucucuccggaggagcugcgcgccgccauugaagacaugggauucgaggcuuccguugugagcgaaucuugcuccaccaauccccucggcaaccauagcgccgggaacucuaugguccaaaccacagauggaacgccuaccagcgugcaggagguggcgccccacacaggcagacugccugcuaaucaugcccccgacauccuugccaaguccccgcagagcacccgggcuguugccccucagaaaugcuuucugcaaauuaaggggaugacaugugcuucuugcgucuccaacaucgaaagaaaucuccagaaggaggccggcgugcugagcgugcuugucgcgcugauggccggaaaagcugagaucaaguacgaccccgaagugauucagccucucgagaucgcccaauucauucaggaucugggcuuugaagcugccguuauggaggacuaugcgggguccgauggaaacaucgagcugaccauuacgggcaugacaugugccucuugcgugcacaauaucgaaagcaaacucacccgcaccaacgggauuacauacgcuuccgucgcccuggcuaccucuaaggcccuugugaaauucgaccccgagaucaucggaccucgggauauuaucaagauuaucgaaagcaagacauccgaggcccuggcuaaacucaugucucugcaggcgacggaagccaccguugugacacugggcgaggacaaucuuauuaucagagaggaacagguccccauggagcucgugcaacgcggggauaucguuaagguggucccgggcggaaaauuuccuguggacggcaaggugcuggaagggaacaccauggcugaugagagccugauuacaggagaagccaugcccgucaccaaaaagcccggcuccacgguuaucgccgggagcauuaaugcucacggaucugugcucaucaaggccacccaugugggcaacgacacaacccuggcgcagauugucaaacuuguggaggaggcucagauguccaagaauccuaacaaacacaucagccagacagaaguuaucauucgguucgccuuucaaaccucuaucacggugcuguguauugccugcccguguucccucgggcuggcuacacccaccgccgucauggugggcacaggaguugcggcucagaauggcauccugauuaagggaggaaaaccucuugagauggcccauaagaucaagaccgugauguucgauaaaaccggcacaaucacgcacgggguccccagagugaugcgcguucuccugcugggagacguggccacccucccucugcggaagguccuugcuguggugggcacagccgaagcuagcucugagcauccccugggggucgccguuaccaaauacugcaaggaagaacucggcacagagacccugggauauuguacggacuuccaggcggugccuggcugcgggauuggauguaaaguguccaacgucgaaggcauccuggcccacagcgagagaccccuuuccgcuccggccagccaccucaaugaagcugggucucugccugccgagaaggaugccgugccccagacauuuagcguucugauuggaaaccgcgaguggcuccggagaaacggccugaccaucuccucugacgugagcgaugcuaugaccgaccaugaaaugaaaggccaaacagcgauucuugucgccaucgauggggugcugugcggaaugauugcuaucgccgacgccguuaagcaggaggcugcccucgcggugcacacccugcaguccaugggcgucgaugugguccugaucacaggggacaaucgcaagacggcucgggccauugccacccaagugggaaucaacaaaguuuucgcugaagugcuuccuucucauaaggucgccaaagugcaggagcuccagaauaagggcaaaaagguugcgauggugggggauggagucaacgacagccccgcucuggcccaggccgauaugggcguggcuauuggcacagggaccgacguggccaucgaagcugccgauguuguccugauuagaaaugaccuccuggacgugguggcguccauccaccuuucuaagcggacaguccgcagaauccggauuaaccuggugcucgcccugaucuacaaucugguugggauuccgaucgcugccggcguguuuaugccuauugggaucguccuucaacccuggaugggaagcgcugccauggccgcuuccagcgugucuguugugcuguccagccuccagcugaaaugcuauaagaaaccugaucucgagagauacgaggcgcaggcccacggccauaugaagccccugaccgcuucucaggucuccgugcacaucgggauggacgaucgcuggcgggacagccccagagccacgccuugggaucaaguuuccuaugugucucaggucagccuuuccagccugaccucugacaaaccgucccgccauagcgccgcugccgaugacgauggagacaaguggucucuccugcugaacggcagagaugaggagcaguacauuuga

SEQ ID NO: 66249 - RNA, 3450 nt, Artificial Sequence
  derived and/or modified sequence opt5 from ATP8A1__Homo_sapiens__NP_001098999
augcccaccaugagacggacagugagcgagauccgcuccagagccgaaggcuacgagaagacggacgaugucucugagaaaaccagccuggcugaccaggaggaaguucggacaauuuucaucaaccaaccucagcucaccaaguuuugcaauaaccacguguccacagccaaauauaauauuaucaccuuccugccgcgcuuucuuuacucucaguucagacgggcggcuaacagcuuuuuccuguuuauugcccuccugcagcaaauccccgauguguccccuacagggcgcuauaccacgcuugucccccuccuguucauccuggccguggcugccauuaaggagaucauugaggacaucaaaagacauaaggcugauaaugccguuaacaagaaacagacccaggugcugcggaauggagcgugggaaauuguccacugggagaaggugaacguuggcgacaucgugauuaucaaagggaaggaauacaucccugccgauacaguccuccugucuagcuccgagccccaggcuauguguuauauugagaccagcaaucuugacggagaaacaaaccugaaaauccgccaaggccucccugccaccucugauauuaaggacguggauucccugaugagaaucagcgggcggauugagugcgaaucuccgaaucgccaucuuuacgacuuugugggaaacaucagacuggauggccacggcacggucccccucggggcugaccagauccugcugcggggagcccagcuccgcaauacacaguggguucauggcauugugguguauaccgggcacgacacaaagcugaugcaaaacuccaccagcccuccccuuaaacugucuaaugucgagagaaucaccaacgugcagauucucauccuguucuguauucuuaucgcgaugucccugguuugcagcgugggauccgccaucuggaaccggagacacucuggcaaggauugguaccucaaucugaacuacgggggagcuagcaauuuuggccugaacuuccucacauuuauuauccuguucaauaaccuuauuccuaucucccugcucgucacgcuggaagugguuaaauucacccaggccuauuuuauuaauugggaccuugauaugcauuacgagcccacagacaccgcugccauggcccgcacaagcaaccugaaugaggaacucggccaagugaaguauaucuucucugauaaaaccgggacgcugacauguaacgucaugcaguuuaagaaaugcaccauugcuggaguggcguacggccaaaauucccaguucggggacgagaagaccuuuagcgauucuagccugcucgaaaaccugcagaauaaccacccgacagccccuaucaucugugaguuccuuaccaugauggcugucugccauacagccgugcccgaacgggagggagacaagauuaucuaucaggccgcuuccccugaugagggcgcccugguuagagcggcuaaacagcucaauuuuguguucacggggcgcacccccgacucugucauuaucgauagccugggacaggaagaacgguacgaacugcuuaacgugcucgaguuuacauccgccagaaagcgcaugagcguuauugugcggacccccucuggcaaacugagacuguauuguaagggcgccgacacagucaucuacgaccgccucgcugaaaccuccaaauacaaggagaucacgcugaagcaccuugagcaauucgccaccgaagggcugcggacacucugcuuugcuguggccgagauuagcgaaucugauuuccaggaguggagagcgguguaucagcgcgccuccaccagcguucagaaccggcugcugaaacuugaggaauccuacgagcucaucgaaaagaaucugcaacugcucggagcuacagccauugaggacaaacugcaggaucaggucccugaaaccaucgagacgcuuaugaaggcugacauuaaaaucuggauccugacaggcgauaagcaggagaccgccauuaacaucgggcacucuuguaagcuccugaaaaagaauaugggaaugauugugaucaacgaaggcagccuggacgggacaagagagacccuuucccggcauugcaccacacucggcgaugcgcugcgcaaagaaaaugacuuugcccugauuaucgauggaaagacgcucaaauaugcucugaccuucggcgugagacaauacuuccuugaccuggcccucucuugcaaggcugucaucuguugccgggugagcccgcugcagaaguccgagguuguggaaauggucaaaaagcaagugaaaguugugacacuggccauuggggauggagccaacgacgucagcaugauccagaccgcucacgugggcguugggauuucuggaaaugagggccuucaggcggccaacuccagcgauuauucuaucgcucaguuuaaguaccucaaaaaucugcugaugauucauggggccuggaacuauaauagaguguccaaguguauccucuacugcuucuacaaaaacauuguccuguauaucaucgagauuugguuugccuucgugaauggcuuuagcggacagauccuuuucgaacgcugguguauuggccuguacaacgugauguuuacagcuaugcccccucucacccuggggaucuucgagcggucuugcagaaaggaaaauaugcugaaguaucccgagcuuuacaaaacgagccaaaacgcccuggacuuuaacacaaaggucuucuggguucacugucucaauggacuguuucauuccgugauucucuucugguuuccucugaaagcgcuucaguauggcaccgcuuucgggaacggaaagaccagcgacuaccugcuccugggcaauuucguguauacauuugucgugaucaccguuugccugaaagccgggcuugaaacaucuuacuggacgugguucucccacaucgccauuuggggcagcaucgcucuguggguggucuuuuucggaauuuacuccucucucuggcccgccaucccgauggcgccugauaugagcggcgaggcugccaugcuguuuuccucugggguguucuggaugggacuccuguuuauucccguugccagccuucugcucgacguggucuauaaggugaucaagcgcaccgcuuucaaaacacugguugaugaggugcaggaacuggaggccaagucccaggacccuggcgcugucgugcuugggaaaucucugaccgaaagagcccaacuccugaagaacguguuuaaaaagaaucacgucaaccucuaccggagcgagucccugcagcagaaucuucugcauggauaugcguucagccaggaugagaacggcaucguuucucaauccgaagugauucgcgccuacgacacaaccaagcagagacccgaugagugguga

SEQ ID NO: 66250 - RNA, 3567 nt, Artificial Sequence
  derived and/or modified sequence opt5 from ATP8A2__Homo_sapiens__NP_057613
augcugaacggcgccgggcucgacaaggcucugaaaaugagccuucccagacggucccgcaucagaucuagcgugggaccuguccgguccucucugggcuacaagaaagccgaggaugaaaugagccgcgcgaccuccguuggggaccagcucgaggcuccggccagaacaauuuaucugaaucaaccccaccuuaacaaguuccgggauaaucagaucucuacggccaaauacagcgugcugaccuuucucccucgcuuccuguaugaacagauuagacgggcugccaacgccuuuuuccuguuuaucgcccuccugcagcaaauucccgacguguccccuacaggacgcuacaccacacuugucccccugaucaucauucucaccaucgcgggcauuaaggagaucguggaagauuucaagagacauaaagccgacaaugcuguuaacaagaaaaagacaauugugcugcggaaugggauguggcacaccaucauguggaaagaggucgccgugggagauauuguuaagguggucaacggccaguaucuuccugcugacguggugcugcucagcagcuccgagccgcaggccaugugcuacgucgaaacggcgaaucuggauggcgagaccaaccugaagauccgccaggggcucagccauacagccgacaugcaaaccagagaaguucugaugaaacuuucuggaacaaucgagugugagggccccaaucggcaccuguaugauuuuaccgggaaccucaaucuggacggaaagucccuuguggcucugggcccugaucagauucuccugcgcgggacgcagcugagaaacacacaguggguguucggaaucgucguguacaccggccaugacacaaaacucaugcaaaauagcaccaaggcuccccugaaacggucuaacguugaaaaggugaccaacguccagauucuugugcuguuuggcauccuccugguuauggcucuuguguccagcgccggggcccuguacuggaauagaucccacggagagaaaaacugguauauuaagaagauggacacaacgucugauaauuucggcuacaaccuccugaccuuuaucauccuguauaauaaccucauuccuaucagccugcuugucacacuggaaguggucaaauacacccaggcucucuucauuaauugggacacagauauguauuacaucgggaacgacacccccgcgauggcccgcacguccaaucugaacgaggaacugggacaagugaaguaucuuuuuagcgauaaaacaggcacccugaccugcaauauuaugaacuucaagaaauguucuaucgcugggguuacauacggacacuucccggagcucgcccgggagccuuccagcgacgauuuuugcagaaugcccccucccuguucugacagcugcgauuucgacgauccccgccugcucaagaauaucgaagaccggcauccuaccgccccguguauucaggaguuucugacacuucuggcugugugccacacggucgugcccgaaaaggacggcgauaacaucauuuaccaggccuccucuccugacgaggcggcucucguuaaaggcgccaagaaacugggguucguguuuaccgccagaacacccuucagcgucaucauugaagcuaugggacaggagcaaaccuuuggcauccugaaugugcuugaguucuccagcgaucgcaagcggaugucugugauuguuagaacaccuuccgggcgccuccggcuguauuguaaaggagccgacaacgucaucuuugaaagacugagcaaggauucuaaguacauggaggaaacccucugccaucuggaguauuucgcuacggaaggccuucgcacccuguguguggccuacgcggaccucuccgagaacgaguaugaagaguggcugaaaguguaccaggaagccagcacaauccugaaggaucgggcucagagacuugaggagugcuaugaaauuaucgagaaaaaucuccugcugcucggggccaccgcuauugaagaccggcugcaggccggcguccccgagacaaucgcgacccuucugaaggccgaaauuaaaaucugggugcucacgggagauaagcaagagacagcuaucaacauuggcuacuccugccgccugguuucucagaauauggcccugauccuucucaaggaggacagccuggaugcuaccagagccgccauuacacagcacuguaccgaccuggggaaccuccugggaaaagaaaaugauguggcucuuaucauugacggccacacccugaaguacgcgcucuccuuugagguccggagaucuuuccuggaccuggcccuuagcugcaaagcugugaucuguugccgcguuuccccgcugcagaagucugaaaucguggaugucgugaaaaagcggguuaaagccauuacacucgccaucggggacggagcuaacgaugugggcaugauucaaacggcccaugucggggugggcaucucuggaaaugagggcaugcaggcgaccaacaauuccgacuaugcuauugcccaguuuagcuaccuggaaaagcuccugcuugugcacggggccuggucuuauaacagagucacaaaguguauccuguacugcuucuauaaaaauguugugcucuacaucauugagcugugguucgcuuuugugaacggauucuccggccagauccuguuugagcgcugguguauugggcuuuauaaugucaucuucaccgcccugccucccuuuacacucggaauuuucgaaagaagcugcacccaagagucuaugcugcgguuuccucagcucuacaagaucacgcagaacggcgaaggguucaauacaaaaguguuuuggggccauuguauuaacgcgcugguucacagccuuauccuguucugguuucccaugaaggcucucgagcaugauaccgugcugaccuccggacacgccacagacuaccuguucgucggcaacaucguguauaccuacguuguggucacagugugccuuaaagccgggcuggaaacgaccgcuuggacaaaguuuagccaccucgccguuuggggaucuaugcugaccuggcucguguucuucggcauuuauuccacaaucuggccuaccauucccaucgcuccggauaugcgcgggcaagccacgaugguccugagcuccgcgcauuuuuggcuuggacuguuccuggugccuaccgccugucucauugaggacguggcuuggagagccgcuaagcacacaugcaaaaagacccugcuugaggaaguccaggagcuggaaacaaaaucucggguucucggcaaggccgugcugcgcgauagcaaugggaaaagacucaacgagcgggaccgccugaucaagagacuuggccggaagaccccucccacacuguuucgcggauccucucugcagcagggcgugccccauggguacgccuucagccaagaggaacacggagcugucucccaggaggaagugaucagagcguaugauaccacgaaaaagaaaucucggaagaaauga

SEQ ID NO: 66251 - RNA, 3756 nt, Artificial Sequence
  derived and/or modified sequence opt5 from ATP8B1__Homo_sapiens__XP_011524324
augagcaccgagagagacuccgaaacaacguucgaugaggacucucagcccaacgaugaaguggucccuuacagcgacgaugagaccgaagacgagcuggaugaccagggcuccgccguugagccggaacagaaucgggugaaccgcgaggcugaagagaauagagagcccuuucggaaggaaugcacauggcaagugaaagccaacgaucgcaaguaucacgagcagccucauuucaugaauaccaaauuucucuguaucaaggaaucuaaauacgcgaacaaugcuauuaagacauauaaguacaacgccuucaccuuuauccccaugaaucuguucgagcaguuuaaaagagccgcuaaccuuuauuuccuggcccuccugauucuucaggcugucccucagaucagcacacuggccugguacaccacgcucgugccccugcugguugugcucggggucaccgcgauuaaggaccugguggaugacguugcccggcacaaaauggauaaggaaaucaauaaccgcacaugcgaggugaucaaagacggaagauuuaaggucgcuaaguggaaagagauucaggugggcgacgugauccggcuuaagaaaaaugauuucgucccugccgacauucugcuccuguccucuagcgaaccgaacucccuuuguuauguugagaccgcugaacuggauggggagacaaaucucaaguuuaaaaugagccuggaaaucaccgaccaauaccugcagcgcgaggauacgcucgccacauucgacggauuuauugagugcgaggaacccaacaacagacuggauaaguucaccggcacacuuuucuggcggaauaccucuuuuccucuggacgcggauaaaauccuccugcgcgggugugugauuagaaacaccgacuucugccauggacuugugaucuuugccggcgcugauacaaagaucaugaaaaauuccggcaagacgcgguucaagcgcaccaaaauugacuaccugaugaacuauauggucuacacaaucuuugugguucucauucugcugagcgccgggcucgcuaucggacacgccuauugggaagcccaggugggcaauucuuccugguaccuguaugacggggaggaugacacccccagcuacagaggauuccuuauuuucuggggcuauaucaucguccugaacacaauggugccuauuucucucuacguuuccguggaagucauccggcuggggcagagccauuucauuaauugggaucuucaaauguacuaugcugagaaggacacccccgcgaaagccagaacgacaacccugaacgagcagcucggacagauccacuacauuuuuagcgauaagaccggcacacugacccaaaauaucaugacauucaagaaauguugcaucaacggccagauuuauggggaccaccgcgaugcuucucagcauaaucacaacaagaucgaacagguggacuuuagcuggaauacguacgccgauggaaaacuggccuucuaugaccauuaccucauugagcaaauccaguccggcaaggaaccggagguccggcaguuuuucuuccugcuugcugugugucacaccguuaugguggauagaacagacgggcagcugaacuaucaagccgcgagcccugaugagggagcucucgucaaugccgcccgcaacuuuggcuucgcuuuucuggcccggacccagaacacaauuaccaucucugaacuggggacggagagaaccuacaaugugcuugcuauucucgacuucaacuccgaccgcaaacggaugagcaucaucguuagaacacccgaaggaaauauuaagcuguacugcaagggcgccgauaccgugaucuaugagcgccugcaccggaugaacccuacaaaacaggaaacccaggacgcgcucgauauuuuugccaaugagacgcugagaacacuuugucugugcuacaaggagaucgaagagaaagaauuuaccgaguggaacaagaaauuuauggcugccucugucgcuagcacaaaucgcgacgaagcccucgauaagguguaugaggagauugaaaaggaccugauccugcuuggcgcgaccgccaucgaggauaaacuccaagacggggugcccgaaaccauuuccaagcuggcuaaagccgauaucaagauuuggguucugacaggagacaaaaaggagacggcugaaaacaucggcuucgccugcgagcuccugaccgaggauacaaccauuuguuacggggaagacaucaauucucuucugcaugcccggauggagaaccagagaaaucggggaggcgucuaugcuaaauuugcgcccccugugcaggaauccuucuuuccgcccgggggcaaccgcgcccucaucauuacaggauccuggcugaaugagauccugcuugagaagaagaccaaaagaaacaagauucucaaacugaaguucccucggacggaagaggaaagacgcaugcggacacagagcaaaagacgccuggaggcuaagaaggaacaaagacagaaaaauuuuguggaucucgccugcgaguguucugccgucaucugcugucgggugacccccaagcagaaagcuaugguuguggaccuggucaagcgcuacaaaaaggccauuacccuugcgaucggcgacggggcuaacgaugugaacaugaucaagacagcccacauuggaguuggcaucuccgggcaagagggaaugcaggccgugaugagcucugacuauuccuucgcucaguucagauaccugcagcggcuccugcugguccauggccgcuggagcuacauuagaaugugcaaauuucuucgguauuucuuuuacaagaauuucgccuuuacccucgugcacuucugguauuccuuuuucaacggguacucugcgcaaacagcuuaugaagauugguuuaucacgcuguacaauguucuguauaccagccucccugugcugcuuaugggccugcucgaccaggaugucuccgacaaacugucucugcgcuuccccggacuuuacauugugggccagagagaucugcucuuuaacuacaagcgguucuucgugagccugcuccaugggguccugacauccaugauccuguuuuucauuccgcuuggagccuaucuccagaccguuggccaagacggggaggccccuagcgauuaccagucuuuugcugugacaaucgccuccgcucuggugaucaccgucaauuuccagauuggacuggacacgagcuauuggaccuuugugaacgccuucucuaucuuuggcuccauugcgcuuuacuucgggaucauguuugauuuccacagcgccggcauucacguucuguuucccucugcuuuccaguuuacaggaaccgccagcaaugcucuccgccaaccuuauaucuggcugacaaucauucucgccguggccgucugucugcuucccgugguugcuaucagauuccuguccaugaccauuuggccuagcgaaucugacaaaauccagaagcaucggaagagacucaaagcggaggaacaguggcaacgccggcaacagguguucagacgcggcgucuccacacggagaagcgccuacgcuuuuucccaccagcgcggguaugccgaccugauuucuagcggacgguccaucagaaagaaacgcucuccccuggaugccaucguggcugacggcaccgccgaguaccggagaacgggggauagcuga

SEQ ID NO: 66252 - RNA, 3792 nt, Artificial Sequence
  derived and/or modified sequence opt5 from ATP8B3__Homo_sapiens__NP_001171473
augggcgacagccccgggagaggagccccugagcggcgccacaaggcucagccgggcagagcccggaaauacgaauggcgccccgaggggccuaccuccaugggaucucugggccaaagagaagaucuccaggacgaggaucggaacagcgcguucacauggaaggugcaggcuaauaaccgcgccuauaaugggcaguuuaaagaaaaggucauccugugcuggcaacgcaaaaaguacaagacgaacguuauucggaccgccaaauauaauuucuacuccuuucuuccccugaaccucuaugagcaguuccaucgcgugucuaaucuguuuuuccuuaucauuaucauucugcagagcaucccugacaucuccacacuccccugguuuucucugagcaccccuauggugugucuccuguucauuagagcuacacgggaucuggucgacgauaugggacgccacaaguccgacagagccaucaacaaucggccgugccagauucuuaugggcaagagcuuuaaacagaaaaaguggcaagaucugugugugggcgacguugugugccuccgcaaggauaacaucguccccgcugacaugcugcuucuggccucuaccgagccuuccagccucuguuacguggaaacaguugauauugacggggagaccaaucugaaauucagacaggcgcugauggugacgcauaaggaacucgccaccaucaaaaagauggcuucuuuucagggaacagugaccugcgaggcccccaacucccggaugcaccauuucgucggcugucuggaguggaaugacaaaaaguauagccuugauauugggaaccugcuccugagaggaugccgcauccggaauacagacaccuguuacggccuugugaucuacgcugauggguauauguuugucggauucgacacgaaaauuaugaagaacugcggcaagauccaccugaaaagaacaaagcucgaucugcugaugaacaaacucguuguggugauuuucaucucugucgugcugguuugucuugugcuggccuuuggcuucggguuuuccgucaaggaauuuaaagaccaccauuacuaucucagcggagugcacggcuccucuguugcggccgagagcuuuuucguguuuugguccuuccugauucuucugagcgucaccaucccuaugucuauguuuauccucuccgaguucauuuaccuggggaauagcguguuuaucgauugggacguccaaauguauuacaagccccaggaugugccggcuaaggcccgcucuacaagccugaacgaccaucucggacagguugaauauauuuucuccgauaaaaccggcacccugacacaaaauauccuuacguuuaacaagugcugcauuucugggcggguguacggaccugacagcgaagcuaccacaagacccaaagagaauccuuaccuguggaacaaguucgccgacggcaaacuccuguuccacaaugccgcucugcuucaccucguccgcaccaacggcgaugaggcggugcgggaauuuuggagacugcuggccaucugucauacaguuauggugcgcgagucccccagagaaagacccgaccagcuccuguaucaggcugccagcccugaugagggggcccuugucaccgcugcccgcaauuucggauacguguuucugucucggacgcaggacacagugaccaucauggaacucggcgaggagagaguuuaucaaguccuggcgauuauggauuucaacuccacccggaagcgcaugagcgugcuggugagaaagccggaaggggcuaucugccuuuacacaaaaggagccgacaccgucauuuuugagcggcuccacagacgcggcgccauggaguucgcuacagaagaagcccuggcugccuuugcgcaggagacgcugcggacccucugucuggccuauagagagguggcugaagauaucuacgaggacuggcagcagcgccaucaagaagccucucuucugcuccagaauagagcucaggcccugcagcaaguuuauaacgagauggagcaggaucugcggcuucucggggcgacagccauugaagaccgccugcaggauggcgugcccgagaccaucaagugccugaaaaaguccaauauuaaaaucuggguccucacaggagacaagcaggaaaccgcugugaacaucggcuucgccugugagcugcuuagcgaaaauaugcugauucucgaggagaaggaaaucucccggauucuggagacguacugggaaaacucuaacaaucugcuuacccgggagagccucucccaaguuaaacuggcucuggugaucaacggggauuuucucgacaagcugcuugucucucugcgcaaagaaccuagagcccucgcccagaaugugaacauggacgaggcuuggcaggagcugggacaaagccggcgcgauuuccuguacgcgagacggcuuucccugcucugccgcagauuuggccugccccucgccgcuccucccgcccaggacagccgggccagaagaucuuccgaaguucugcaggagcgggcuuucguggaucuugccagcaagugucaggcggucauuugcuguagagugacaccgaaacaaaaggcucugaucguggcccucgucaaaaaguaucaccagguugugacccuggccaucggggacggagcuaaugauauuaacaugaucaagacagccgacgugggcgucgggcuggcgggccaggaaggaaugcaggcugugcaaaauucugauuuuguucuuggccaguucugcuuccugcagcgccuccugcucgugcaugggcggugguccuacgucagaauuuguaaauuucugcgcuauuucuuuuacaagagcauggccucuaugauggugcagguuugguucgccugcuauaacggauuuaccggccaaccucuuuacgaggggugguuccuggcucucuuuaaucugcuguauagcacgcuucccgugcuguacaucggacucuucgaacaggacgucuccgccgagcagagccuggagaaaccugaacucuacgugguuggccaaaaggaugagcuguuuaacuauuggguguucguccaggcuauugcccacggggugacaaccucucuugugaauuucuucaugacacuguggaucucccgggacaccgcgggccccgccagcuucuccgaucaccagucuuuugcugucguuguggcccugagcugccuccuguccaucaccauggaagugauucuuaucauuaaauacuggacagcucugugugucgccacgauccuccugucucucggauucuaugccauuaugaccacaaccacacagagcuuuuggcuguucagaguguccccuaccacguuucccuuccuuuacgcugaccugucuguuaugagcuccccgagcauccugcucgugguccugcuuucuguguccaucaacacauuuccuguucuggcgcuccgcgugauuuuccccgcccugaaggagcuccgggcuaaggaggaaaaagucgaggaaggccccagcgaggaaaucuuuaccauggagccucugccgcaugugcacagagagucucgggcccgcagauccagcuaugccuucucucaucgggaaggguacgcuaaucuuauuacccaaggaacaauccugcgcagaggccccggggucuccagcgauauugccuccgagagccuggacccuucugacgaagaggcggcuagcucccccaaggaaucucaguga

SEQ ID NO: 66253 - RNA, 3579 nt, Artificial Sequence
  derived and/or modified sequence opt5 from ATP8B4__Homo_sapiens__NP_079113
auguucugcagcgagaagaaacugagagaaguggagcggaucgucaaggccaacgaccgcgaauacaaugagaaauuucaguaugcugauaaccggauucacaccuccaaguacaauauccucacauuccugcccauuaaccuuuuugaacaauuccagagaguugccaaugcguauuuucugugucuccugauccuucagcugauuccugagaucucuagccucacgugguucaccacaaucgugccgcuggugcuggucauuaccaugacagcugugaaagacgccaccgaugacuacuuucgccauaaguccgauaaccagguuaauaacagacaaucugaggugcucaucaauagcaagcugcagaacgaaaaauggaugaaugucaaggugggcgacauuaucaaacuugagaacaaucaguucguugccgcugaucugcuccugcuuuccucuagcgaaccccacgggcugugcuauguggagacagccgagcucgacggagaaaccaaccugaagguccggcaugcucuguccgugacgagcgagcucggcgccgauauuucucgccuggcgggguuugacggaaucguggucugugaaguuccuaauaacaaacuugauaaguucaugggcauucuguccuggaaggacagcaaacacucucucaacaaugagaagaucauccugagagggugcauucuucggaacaccuccugguguuuuggaauggugaucuucgccggccccgauacaaaacugaugcagaauagcggcaagaccaaauuuaagcgcacaucuauugacagacucaugaacacccuggugcuguggaucuucggguuccucauuugccugggaaucauccuugcuauuggcaauuccaucugggaaagccaaacgggggaccaguuucggacauuccuguuuuggaacgagggagagaaauccucugucuucagcggcuuucucaccuucugguccuacauuaucauucugaauacagugguuccuaucagccuuuaugugucugucgaagugauccgccuggggcauuccuacuuuauuaacugggauagaaagauguacuauagccggaaggccauccccgcuguugcccgcaccaccacacucaaugaggaacugggacagauugaguacaucuucucugacaaaacgggcacccugacacagaacauuaugaccuuuaagagauguagcaucaauggccggauuuauggggaagugcacgaugaccucgaucagaaaacagagaucacccaagagaaggaaccugucgacuucuccgugaaaucucaggcggauagagaguuucaauucuuugaccaccaucugauggaaagcaucaagaugggagauccgaagguccacgaguuccuucgccugcucgcccugugccauacggugauguccgaagagaacagcgcuggcgagcugauuuaccagguucagucucccgacgaaggggcccuugugacagcugcccggaauuucggauuuaucuucaaauccagaaccccugagaccauuacaaucgaagaacucggcacccuggucacauaucagcugcucgccuuucuggauuucaacaauacgcgcaagcggaugagcgugauuguuagaaaccccgaggggcaaaucaaacuuuacucuaagggagcugacaccauccuguuugaaaaacuccacccuuccaacgaggugcugcugagccuuacauccgaccaccucucugaguucgcgggcgagggccugcgcacccuggccauugcuuaucgggaucucgacgauaaguacuuuaaggaauggcauaaaaugcuggaggacgccaaugccgcuacagaggaaagagaugagcgcaucgccgggcuuuacgaagagauugaacgggaccugaugcuccugggagcgaccgcugucgaggauaagcugcaggagggcgugaucgaaacggugaccagccuuucccucgccaacauuaaaaucuggguucugacaggggacaagcaggagaccgccaucaauauuggauaugcuuguaacaugcugacagaugacaugaaugaugucuucgugaucgccggcaacaaugcuguggaagucagagaggaacuccgcaaagccaagcagaaccuguuugggcaaaaucggaacuucucuaauggccacgugguuugcgagaagaaacagcagcuugagcuggacagcauuguggaagagaccaucacgggagauuacgcgcucauuaucaacggccauucccuggcccacgcucuggaaagcgacgucaagaaugaccuucucgagcuggccuguaugugcaaaacagugaucugcuguagaguuacaccccugcagaaggcucaaguggucgagcucgugaaaaaguaucggaacgccguuacccuggcgauuggggauggagccaaugacgugucuaugaucaaauccgcucauauuggcgucgggaucagcggacaggaaggccuucaggccgugcuggcuucugauuacuccuuugcccaguuccgcuaucuccaaagacugcugcuugugcacgggcgguggagcuacuuuagaaugugcaaguuccuguguuauuucuuuuacaagaacuucgccuuuacccucguccacuucugguuuggcuucuuuugcggauucucugcucagaccguuuacgaccagugguuuauuacacuguucaacaucguguauacgagccucccggugcuggcgaugggcauuuuugaucaagacgucuccgaucagaauagcguggacuguccucagcuuuacaaacccgggcagcugaaccuccuguucaauaagcgcaaauucuuuaucugcguucugcauggaaucuauaccucucuugugcuguucuuuauuccuuacggcgccuucuauaacgucgcuggggaggauggacaacacaucgccgacuaccaguccuuugccgugacaauggcuaccagccucguuauuguggucuccgugcagaucgcccuggauacaucuuauuggaccuucauuaaucauguuuuuaucuggggcagcaucgcgauuuacuucuccauccucuuuacgaugcacucuaacgggauuuucggcaucuuucccaaucaguuccccuuugugggaaacgcucggcacagccugacacaaaaguguauuuggcuugucauccugcucaccaccguggccuccgugaugccugucguugccuucagauuccugaaaguggaccuguacccgacacuuucugaucagauccgcagauggcagaaggcucagaagaaagcccggcccccuagcucccgcagaccccggacccgcagaucuagcucccggcgcagcggcuaugcguuugcucaucaagaaggguacggagagcugauuacaucuggcaagaauaugagagccaaaaacccucccccgacguccgggcucgaaaagacccacuauaauagcacaucuuggaucgagaaccugugcaaaaagaccacagacaccguguccagcuucucccaggacaagacggucaaacucuga

SEQ ID NO: 66254 - RNA, 3444 nt, Artificial Sequence
  derived and/or modified sequence opt5 from ATP9B__Homo_sapiens__NP_940933
auggccgaccagaucccccuguacccugugagaagcgcugccgcggcugccgccaaccggaagcgcgcugccuauuacuccgcugccggcccgagacccggggcggaucggcacucucgcuaucaacucgaggacgaaagcgcccaucuggaugagaugccucuuaugauguccgaagagggauucgaaaaugaggagucugacuaccacacccugcccagagcucggauuaugcagcgcaaaagaggccucgaaugguuugucugcgauggguggaaguuccuguguacaagcugcuguggauggcuuaucaacauuugccggcgcaaaaaggagcugaaagccagaacgguuuggcucggcuguccugaaaagugcgaggagaagcauccccgcaauuccaucaaaaaccagaaguauaauguguuuaccuucauuccuggggugcuguacgaacaguuuaaauucuuucugaaccucuauuuccuggucaucucuuguagccaauuugugccggcucuuaagaucggauaccuguacacauauugggcgccccucggcuucguucuggccgugaccaugacacgggaggccauugacgaauuuagacgguuccagcgcgauaaagaggucaauucccagcuuuacagcaagcugaccgugagaggcaagguucaggugaaaucuuccgacauccaagucggggaucucauuaucguggaaaagaaccagcggauuccuagcgacaugguguuucugagaacaucugagaaagcuggauccugcuucauccgcaccgaucagcuggacggcgagacggauuggaagcucaaagucgccguuagcuguacccagcaacugcccgcucuuggggaccuguucucuauuuccgccuauguguacgcccagaagccucagauggacauccacagcuuugaaggaacauucacccgggaggauuccgaucccccgauccaugaaucucucagcauugagaauacacugugggcuuccaccaucguggcgagcggcacggucauuggggugguuaucuauacaggaaaagaaaccagaucugugaugaacacauccaauccuaagaacaaggucggccuucuggaccucgagcugaaucgccugaccaaagcccucuuucuggcucuuguggcccugagcauuguuauggugacccuccaaggcuucgucgggcccugguaccggaaccuguuuagauuccuucugcucuuuucuuauaucaucccuauuagccugcgcgugaaucuggacaugggaaaggccgucuacggcuggaugaugaugaaagaugagaacauccccgggacagugguucggacguccaccauucccgaggaacucggaagacugguguaccuucugacagacaagaccggcacacucacccagaacgaaaugaucuucaaacgccugcaccuggggacggucucuuauggagcugauacaauggacgagauucagagccacgugcgggauuccuacagccagaugcaaucucaggccggcggcaauaacaccggguccaccccucuuagaaaggcgcagagcucugcuccgaagguucgcaaauccgugagcucccggauccaugaagccgucaaggccaucgugcucugccacaaugugacacccguuuaugagucuagagcuggagucaccgaggaaacagaguuugccgaagcugaccaggauuucagcgacgagaaccggacguaccaagccuccucuccugacgagguggcgcuggugcaguggaccgaaagcgucggccugacacucgugucccgcgaucugaccagcaugcagcuuaaaacacccucugggcagguucuguccuuuuguauucuccaacuguucccuuuuaccagcgagucuaagagaaugggagugaucguccgggacgaauccacggccgagauuaccuucuauaugaaaggcgcugauguggccaugagccccaucguucaguacaaugacuggcuggaagaggagugcgggaacauggcuagagaaggccuucgcacacucguggucgccaagaaggcgcugaccgaggaacaguaucaggauuucgagucucgguacacacaagccaaacugagcaugcaugacagaucccucaagguggcugccguuguggaaagccuggagcgcgagauggaacuucugugccucaccggagucgaggaucagcugcaggcugacgugagaccgacgcuggaaaugcuucggaaugccggcauuaaaaucuggaugcucacaggggauaagcuggagaccgccacauguauugcuaaaucuucccaccuggugagccgcacccaagacauccacaucuuuagacaggucaccucccggggagaagcgcaucucgagcugaacgccuuccgcagaaagcacgauugcgcucuuguuauuucuggcgacagccuggaggugugucucaaguacuaugaacaugaguuuguggaacuggccugccaguguccugccgucgugugcugucggugcucccccacacagaaagcucgcaucguuacgcugcuucaacagcacaccgggagacggacaugugccauuggagauggcgggaaugacgugucuaugauccaggcggcugacugcggcauuggaaucgagggcaaggaggggaaacaggccagccucgccgcugauuucuccaucacccaauuucgccauauuggaagacugcugaugguccacggccggaacucuuacaagagaagcgccgcgcucgggcaguucgugaugcaccgcggacugaucauuuccacaaugcaggcuguuuuuagcucuguguucuauuuugccuccgucccucuuuaccagggcuuccugauggugggguaugccaccaucuacacgauguuucccguuuucagccucgugcuggaccaagaugucaaaccugaaauggcuaugcuguaucccgagcuuuacaaggaccugacaaaaggccggucucucuccuuuaagaccuuccugauuugggugcucaucagcaucuaccagggaggcauucugauguauggggcccuugugcuguucgaaucugaguuuguccauguuguggcuaucuccuucaccgcccucauucugacagaacugcuuaugguggcgcugaccgucagaacauggcacuggcucauggugguugccgaguuucugagccucggauguuacguguccagccuggcuuuccuuaaugaguauuuuggcaucgggcgcgucucuuucggagccuuucuggauguggcuuucauuacgaccguuacauuucucuggaaggugagcgccaucaccgucguguccugccugccgcuguacguccuuaaauaucugcggagaaagcucucuccucccagcuacugcaaacuggccuccuga

SEQ ID NO: 66255 - RNA, 870 nt, Artificial Sequence
  derived and/or modified sequence opt5 from ATPAF2__Homo_sapiens__NP_663729
auguggagaagcugccugcggcuccgcgacggcgggagacggcugcuuaaccgccccgccggaggcccuuccgcuucuaugagcccggggcccaccaucccuucccccgccagagcguacgcuccucccacagagcggaagcgcuucuaucagaaugugucuauuacgcaaggagaaggcggguuugagaucaaccuggaucacagaaaacucaagaccccucaggccaaacuguucacagucccgagcgaagcccuugcuauugccguugcuaccgagugggacucccagcaggauacaaucaaguacuauaccaugcaucugacaacccucuguaauacgucucuggacaaccccacccaacggaauaaagaucagcugauucgcgccgcggugaaguuucucgacacagauaccaucugcuacagaguggaggaaccugagacacuggucgaacuucagcggaacgagugggaccccaucauugaaugggccgagaagcgcuauggaguggagaucagcuccagcaccucuauuaugggcccuuccauccccgcuaaaacgagagaaguucuggugagccaccucgccucuuacaauacaugggcucugcagggcauugaguucgucgccgcgcaacuuaaguccauggugcugacccucgggcugaucgaucugcggcucacaguugaacaggccgugcugcuuagccgccuggaggaagaguaucagauucagaaauggggaaacaucgagugggcucaugacuacgaacuccaagagcugagagcccggaccgcugccggcacccuuuuuauccaccuguguucugaauccacaacggucaagcauaaacuccugaaggaguga

SEQ ID NO: 66256 - RNA, 690 nt, Artificial Sequence
  derived and/or modified sequence opt5 from ATRAID__Homo_sapiens__NP_001164266
auggcuccccacgacccuggcagccugaccacacucgugccgugggccgccgcgcugcuucuggcucucggggucgagagagcccuggcccuucccgaaaucugcacgcaguguccuggauccguucaaaaccugucuaagguggcuuucuacugcaaaaccacacgggagcucaugcugcaugcccgcuguugccugaaucagaagggcaccauucucgggcuggaucuucagaacuguagccuggaagaccccggaccuaauuuucaccaggcucauacaaccgugaucauugaucuccaagccaacccccugaaaggcgaccuugcgaauacauucagaggguuuacccagcugcagacgcucauccugccucagcacgucaacugcccgggaggcauuaaugccuggaacaccaucacauccuauaucgauaaucaaauuugucagggccagaagaaccugugcaauaacaccggggaccccgagauguguccugaaaauggaucuugcgugcccgauggcccugggcuccugcaguguguuugcgcugacggauuccauggcuacaaaugcaugcggcaagggagcuuuucccuucugauguucuuuggaauccucggcgccacaacccugucugugagcauucuucugugggcuacgcagcgcagaaaggccaagacauccuga

SEQ ID NO: 66257 - RNA, 7935 nt, Artificial Sequence
  derived and/or modified sequence opt5 from ATR__Homo_sapiens__NP_001175
augggcgagcacgggcuggaacucgcuagcaugauucccgcucugagagagcuuggauccgccaccccugaagaguacaacacggugguccagaagccgcggcaaauucugugccaguucaucgaccgcauucucacggauguuaaugugguggcggucgaacuggugaagaagaccgacucucagcccacaagcguuaugcuucuggauuuuauccagcacauuaugaaguccucuccucucauguucgugaacgucagcggcucccacgaggcuaaggggucuuguaucgaguuuagcaauuggaucauuaccagacugcugcggaucgccgccacacccuccugccaucuccugcacaaaaagauuugugaagugaucugcagccuucuguuccucuuuaagucuaaauccccugcuauuuucggaguucugaccaaggagcuucugcaacucuuugaagaccugguguaucugcaucgcagaaacgucaugggccacgccguggaguggcccguggucaugagccgguuccucucucagcuggaugagcacaugggguaccuucaguccgcuccucugcagcucaugagcaugcaaaaucuggaauuuaucgagguuacacuucugauggugcucacccgcauuaucgccaucguguucuuuagacggcaggaacugcugcucuggcagauuggauguguccugcuugaguauggcucuccgaaaaucaagucccuggcgauuagcuuccucacggaacuguuucagcuuggcgggcugcccgcccaaccugcuuccaccuucuucucuagcuuucucgagcugcugaaacaucucguggagauggacacagaucagcugaaacuuuacgaggaaccccuguccaagcucaucaaaacccuguucccuuuugaagccgaggcuuaucgcaacauugaacccguuuaccugaauaugcuucucgagaagcugugcgugauguucgaggacggaguccugaugagacucaaaagcgaucugcuuaaggccgcgcugugucaccuccugcaguauuuucugaaauucgugccggccggcuacgaaucugcccuucaaguucggaagguguacguccgcaacaucugcaaagcccuccuggacgugcuggggaucgaggucgaugcugaauaucuccugggaccucuuuacgccgcccugaagauggaguccauggaaauuaucgaggagauucagugucagacacagcaagaaaaucucagcucuaacagcgacggcaucucccccaagagacggcgccugucuagcucccugaauccuagcaaaagagcucccaagcagaccgaggaaauuaaacauguggauaugaaccagaagucuauccuuugguccgcgcucaaacagaaggccgagagccugcaaaucucucuggaguauuccgggcucaagaaucccguuauugaaaugcuggagggaaucgcugugguccuucagcugacggcccucugcacagugcacuguagccaccagaacaugaauugccggaccuuuaaagacugccagcauaaguccaaaaagaaaccuucuguugugauuacauggaugagccuggacuucuacaccaagguccugaaguccuguagaucucuucucgaaagcgugcaaaaacuggaucuggaggccaccaucgacaaggugguuaaaauuuaugaugcucucaucuacaugcaggucaacuccagcuuugaagaccacauucuggaggaucuuugcggcaugcugucucucccguggaucuauucccauagcgacgauggcugucugaagcugacaacguucgccgcgaaccuucugacccucucuugccgcaucuccgacagcuacucuccccaggcucagagccgguguguguuucugcucacacuguucccuagacgcauuuuucuugaguggcggaccgccguguacaauugggcccugcaauccagccacgaagucaucagagcuucuugcguguccggguucuucauucuccugcagcagcaaaacagcuguaaucgcguucccaaaauccugauugauaaggugaaggacgauuccgacaucgucaaaaaggaguuugccucuauccuuggacagcuggugugcacacuccauggcauguucuaucugaccagcucccucacggaaccuuuuucugagcacgggcacguugaccuguucugucggaaccuuaaagcuacaagccagcaugaaugcuccucuagccagcugaaggccuccguguguaaacccuuucucuuccugcugaagaaaaagauuccgagcccugucaaacuugcguuuaucgauaaucugcaccaucucugcaaacaccuggacuucagagaggaugagaccgacgugaaggccguucucggaacccugcuuaaccugauggaagaucccgacaaagaugugcgcgucgcuuuuucuggcaauauuaagcacauccuggagucccucgacagcgaagauggguucauuaaagagcuguuugugcuucggaugaaggaagccuacacacaugcucaaaucucuagaaacaaugagcugaaggacacccucauccugacaacgggagauauuggccgcgccgcgaaaggcgaccucgugccuuucgcccugcuucaucugcugcauugccuccuguccaagagcgcuucugucuccggggccgcuuauaccgagauccgggcccuuguugccgcuaaaagcgugaagcugcaguccuuuuucagccaguacaaaaagcccauuugucaguuccucguggaaucucugcacagcucccaaaugacagcgcucccuaacacccccugccagaaugccgaugucagaaagcaggacguggcucaucagcgggagauggcccugaacacacuuucugaaaucgccaauguuuuugacuucccggaucugaaccgcuuucugaccagaacgcuccaagugcugcuuccugaccuggcugccaaagcgagccccgcugccuccgcccucauucggacccugggaaagcagcucaaugucaacagacgcgagauccugaucaacaauuucaaauauaucuuuucucaccuuguguguagcugcuccaaggaugagcuggaacgggcucugcacuaccucaaaaacgagacagaaaucgagcugggcucucuucugagacaggacuuccaagggcuccauaaugaacugcugcuccgcauuggagagcacuaucagcagguuuuuaacggccuuagcauccuggccuccuucgcgagcucugaugaccccuaccaggggccuagagauauuaucuccccggagcugauggcugacuaccuccaacccaagcugcuuggcauucuggccuuuuucaauaugcagcuccuguccucuagcgugggaaucgaagauaagaaaauggcccugaacagccucaugucccuuaugaagcugaugggcccuaaacaugucucuagcgugcggguuaagaugaugaccacacugcgcaccgggcucagauuuaaagacgauuuccccgagcuguguugccgggcuugggacuguuucgugcgcugccuugaucacgccugucugggaucccuccugagccaugucaucguggcucugcucccucuuauucacauccagcccaaggaaacggccgcgauuuuucacuaucugaucauugagaauagagacgccgugcaggacuuccugcaugaaaucuacuuucucccugaucaccccgagcugaaaaagaucaaggcuguccuucaagaguaucggaaagaaacaucugaguccaccgaccugcagacaacccuccagcugagcaugaaggccauucagcaugaaaacguugaugugcgcauccacgcucugaccucucucaaagagacacuuuacaagaaucaagaaaaacugauuaaguaugccacggacagcgagaccguggagccgaucauuucccagcuggucacagugcuccugaagggcugccaggaugccaacucucaggcuagacuucuguguggggaaugccucggagagcugggcgcgaucgacccugggcggcuggauuucagcaccacagaaacccaaggcaaagacuuuacguucguuacaggaguggaggauuccucuuuugccuacggccuccuuauggagcugacccgcgcuuaucuggccuacgccgacaauagcagagcucaggauuccgccgcguacgcuauccaggaacuccugagcauuuaugacugccgggagauggaaaccaacgggcccggacaccaacuuuggagacgcuucccugagcauguccgggaaauccuggagccccaccucaauacaagauacaagucuucccagaaaagcaccgacugguccggcgugaagaaaccgauuuaucugucuaagcuggggagcaacuuugccgagugguccgccucuugggcuggauaccucaucacaaagguucgccaugaucuugccagcaaaauuuucacguguugcuccaucaugaugaagcacgacuuuaaagugaccauuuaucugcugccucauauccucgucuacgugcugcuuggcuguaaucaggaagaucagcaagaggucuaugcggaaaucauggcugugcugaagcacgacgaucagcacacaauuaacacccaggacaucgccagcgaucucugccagcugucuacacaaaccguuuucuccaugcuggaccaucucacgcagugggcccggcacaaauuucaggcucuuaaggccgagaaguguccccauagcaaaucuaacagaaauaagguggauuccauggucagcaccguggacuacgaagauuaccagucuguuacacgcuuccuggaccugauuccucaagauacccucgcuguggccagcuuccgguccaaagcguauacaagagccgucaugcacuuugagucuuucaucaccgagaagaaacagaacauucaggaacaccugggguuucuucaaaagcuguacgcugccaugcaugagcccgacggcguggcuggagugagcgccauccgcaaggccgaacccucccucaaagagcagauccuggaacacgagagccugggccuccuucgggacgcuacagcgugcuaugauagagccauucagcuggagccugaccagaucauucauuaccacgggguugucaaguccaugcugggacucggccaacugucuaccgugaucacacaggugaaugggguccaugcuaaccggagcgaauggacagaugagcuuaauaccuaucgcguggaagccgccuggaaacugucccagugggaccucguugagaacuaccuggcugccgauggaaagucuaccacauggagcgugagacugggccagcuccuucuguccgcgaaaaagcgggacauuaccgcuuucuaugauucucugaaacucguccgcgccgagcaaaucgugccgcugagcgccgcuuccuuugaaagagggagcuaccagcggggcuacgaguauaucguuagacuucacaugcugugugaacucgagcacucuauuaagccccuguuccagcauuccccuggagacagcucucaggaagauucccugaauuggguggcccgccucgagaugacgcaaaacagcuaccgggcgaaggagcccauccuggcccuuagacgcgcucugcucucucugaauaaacggccugacuauaacgaaauggucggcgagugcuggcuucaguccgccagaguggcucgcaaggccgggcaccaucagacagcuuacaaugcccugcucaacgcgggagaaagccggcuggccgagcuguauguugaaagagcuaaauggcucugguccaagggcgaugugcaccaggcccugauuguccuucaaaaagggguggagcuguguuuucccgagaaugaaaccccuccggagggaaagaacaugcucauccacggccgcgcuaugcugcuugugggcagauucauggaagagacagccaauuuugaaagcaacgccauuaugaagaaauacaaggacgucaccgcuugccugcccgagugggaggaugggcauuucuaucucgcgaaauacuacgacaagcugaugccuaugguuacagacaacaaaauggaaaagcagggagaucugauccgguauauugugcuccacuuuggccgcucucugcaguacgggaaucaauucaucuaucagagcaugcccagaaugcuuacccuguggcucgacuacggaacgaaggccuaugagugggaaaaagcuggccgguccgaucgcgugcagaugagaaacgaccuggggaagaucaauaaagucauuaccgagcauacaaacuaccuugccccuuaucaguuucugaccgccuucucucaacucaucagccggauuugucacucccaugaugagguguucguugugcugauggaaaucauugcuaaggucuuucuggccuacccccagcaggcgauguggaugaugacagccgugucuaaaagcuccuacccgaugagaguuaaucgcugcaaggagauccucaacaaggcuauccacaugaaaaagucucuggaaaaauucgugggagacgccacccggcuuacggauaagcugcucgagcugugcaauaaaccugucgacggcagcuccagcacacuuucuauguccacccacuuuaagaugcugaaaaagcucguggaagaggcuacauucagcgagauucugaucccccugcagucugucaugauucccacccucccuuccauccugggcacccaugccaaccacgcgagccaugaacccuuuccugggcacugggccuauauugcuggauucgaugacaugguggagauccuugccucccugcaaaagccgaaaaagaucucucucaaaggcagcgaugggaaguuuuacauuaugauguguaaacccaaggacgaccugagaaaggauugccgccuuauggaguucaauucccugaucaacaaaugucuccggaaggacgcugaaagcagacggcgcgaacugcauauuagaacauaugccguuaucccucugaaugaugagugcggaauuaucgagugggugaacaauacggcuggccuccggcccauucugaccaaacuuuacaaggaaaaagggguguauaugacaggaaaggagcugcgccaguguaugcucccuaagucugccgcgcuguccgaaaaacuuaaggucuuuagagaguuccugcucccccggcacccgccuaucuuucacgaaugguuccugcgcaccuuucccgacccuacaagcugguacucuagcagauccgccuauugccggucuaccgcuguuaugagcauggugggcuacauccugggccucggggaucgccauggagagaacauucuguucgacucccuuacgggcgagugugugcacgucgauuucaauugccuguuuaacaaaggggaaacauucgaggugcccgaaaucguuccuuuuagacucacccauaauauggugaacggaaugggccccauggggaccgagggacuguuccggagagccugugaggucacaaugcgccuuaugcgggaccagagagaaccgcugaugucugugcucaagaccuuucugcacgauccucuggucgaguggagcaaacccgugaagggccacuccaaggcuccccuuaacgaaacaggcgagguugugaaugaaaaagccaagacgcauguccuggacauugagcagcgccuccaaggggugaucaaaacccggaacagaguuacaggacugccucucagcauugagggccacgugcauuaccugauccaggaagccaccgaugagaaucuucugugccagauguaucugggguggacaccguacauguga

SEQ ID NO: 66258 - RNA, 2097 nt, Artificial Sequence
  derived and/or modified sequence opt5 from ATRIP__Homo_sapiens__NP_001257952
augagcaagaaccccuccggcaaaaauagagagaccgugccuaucaaggacaacuucgaacuggagguccuccaggcccaauacaaagaacugaaggagaaaaugaagguuauggaagaggaggugcuuauuaagaauggggaaaucaaaauucugcgggauucucuccaccagacagagagcgugcuggaagaacagcgcagaucccauuuucuucuggagcaggaaaagacgcaagcucucucugacaaagagaaggaguucagcaaaaagcugcagucccugcagucugagcuccaguuuaaggaugccgaaaugaacgagcugcggaccaaacuucaaacaagcgagcgcgcgaauaagcuggcugccccguccgucagccacgugucuccccggaaaaacccuuccguugugaucaagcccgaagccugcagcccucaguucggaaaaaccucuuuucccacaaaggaguccuucagcgcuaauaugucucucccucauccgugucagaccgaauccggcuauaaaccccuggucgggagagaggacagcaagccucacucccuucgcggagauucuauuaagcaggaagaggcccaaaagagcuuuguggacuccuggagacagcggagcaacacacagggcucuauccugaucaaucuccugcugaagcaaccccucauuccuggguccagccugucucuuugccaucugcucagcuccucuagcgagucccccgcuggaaccccgcugcagccucccggcuucggcagcacgcuugccgggaugucuggacugcgcaccacaggcuccuacgaugggagcuuuucucucuccgcgcugagagaagcccagaaccuggcuuucaccggacucaaucugguugcccggaacgaguguagccgcgacggcgauccugcugaagggggaagacgggccuuuccccuuugccagcugcccggcgcggugcacuuccucccucugguccaauuuuucaucggccuucacugucaggcccugcaggaccucgcugccgcuaaacgcuccggggccccgggagauucucccacacauagcuccugcgugucuagcggcguggagaccaauccugaagacuccgucuguauucuggagggguucagcguuacggcccugucuauccuccagcaccuggugugccauuccggagcuguggucagccuucugcucucuggcgugggggcggauuccgccgcuggagagggcaacagaagccugguucaccggcugucugacggcgacaugacaagcgcccuuagagggguggccgaugaccaaggacagcacccccuccugaagaugcugcuccaucugcuugcuuuuuccagcgccgcgaccggccaucugcaggcuucuguccucacacagugucugaaagugcugguuaaacuugccgaaaauaccuccugcgauuuccucccucgcuuucaauguguguuccagguccugcccaagugccugagcccggagaccccucuccccuccgugcugcuugccgucgaacugcucucucugcuggcugaccacgaucagcuugccccucagcucugcagccacuccgaggggugucugcugcuccugcuuuauauguacauuacaucucggcccgacagaguggcucuggagacgcaauggcuccagcuggaacaggagguuguguggcugcuugccaaacucggaguccaaagcccucugcccccggugaccggcuccaacugccaguguaacguugaagugguccgcgcgcugacagugaugcuccaucggcaguggcugaccgugagacgcgccgggggcccuccccggacagaucagcaaagacgcaccguucggugccuuagagacacgguccugcuccugcacggacugucucagaaggauaaacuuuuuaugaugcacuguguggaggugcugcaucaguucgaccaggucaugcccggcgugagcaugcucauccgcgggcugccugauguuacagacugcgaagaggcugcccucgacgaucugugugcugccgagaccgacguggaagauccggaggucgaaugcggauga

SEQ ID NO: 66259 - RNA, 4290 nt, Artificial Sequence
  derived and/or modified sequence opt5 from ATRN__Homo_sapiens__NP_647537
augguggccgcugccgcggcuaccgaggccagacugcggcgcagaacagccgcuacggccgcucucgccggccggagcgggggaccccacugggacugggaugucacccgcgcgggcagaccugggcugggagccggccuucggcugccgcgccuccugucucccccucuuagaccccggcugcuccugcugcuccugcuucuguccccuccccuccugcuucugcuccugccuugcgaggcugaggccgcugccgcggccgcugccguuagcggguccgcugccgccgaagcuaaggagugugaccgcccgugcgugaacggaggcagauguaaucccggcacagggcagugcguguguccugcgggaugggucggcgaacaaugccagcauugugggggacgguuccgccugaccggcucuagcggguuugugacagauggacccggcaacuacaaauauaagaccaaaugcacauggcucaucgagggccagccuaauagaauuaugcggcugcgcuucaaccacuuugccaccgaguguuccugggaccaucuuuacguuuaugauggggacucuaucuacgcuccccugguggccgccuucagcggacucauugucccggaaagagauggcaaugagacggugccugaaguuguggcuaccuccggguaugcccugcuucacuuuuucagcgacgcggcuuacaaccugacaggauuuaauaucaccuauucuuucgauaugugccccaacaauuguuccggcagaggggagugcaagauuagcaacucuuccgacacagucgagugcgaauguagcgagaauuggaaaggagaagccugcgauaucccucauuguaccgacaacugcggcuuuccccaccggggcaucuguaauucuuccgaugugcgcgggugcagcuguuucuccgacuggcagggacccggcugcucugugccugucccggccaaccagagcuuuuggacgcgggaggaauacuccaaucucaagcugcccagagcuagccacaaggccguugugaacgggaacauuauguggguggucggaggcuacauguucaaucauucugacuauaacauggugcuggcuuacgaucucgccucccgcgaguggcugccucuuaaucggagcguuaacaauguggucgugagauaugggcacucucuggcgcucuacaaagacaagaucuauauguacggcggaaaaauugauagcacaggcaacguuaccaaugagcugcgcguguuucauauccacaacgaauccuggguccuucugacacccaaggccaaagagcaauaugcuguggucgggcacucugcccauauugugacccucaagaauggacggguugugaugcuggucaucuucggccacuguccucuguacggguacauuagcaacgugcaggaauaugaccucgauaagaauaccugguccauccugcauacacagggagcucuuguucaaggcggguacggccacagcucuguguaugaccauagaacgcgcgcccuguacguccacggaggcuauaaagcguucuccgccaacaaguaccggcucgcugaugaccuguauagauacgauguggacacccagauguggacaauccugaaagauagccgcuuuuuccgguaccuucacaccgccgugauuguuucugggacaaugcucgucuuuggaggcaauacccauaacgacacguccaugagccacggggcuaagugcuucuccucugacuuuauggccuaugauaucgccugugacagauggagcgugcugccccggccggaucugcaucacgacgugaaucgcuucggacacuccgcuguccuccauaacucuacaauguacguguuuggcggguucaacagccugcuucuguccgauauucucguuuuuaccagcgagcagugcgacgcgcacagaucugaagccgcuugccuggccgccggcccuggaauccgguguguguggaauaccggcuccagccagugcauuucuugggcucuggccacagaugagcaagaggaaaaacuuaaguccgaguguuucagcaaaagaacccucgaccaugaucgcugcgaccagcacacagauuguuauucuugcacggcgaacaccaaugacugucauuggugcaacgaucacugugucccccggaaucacagcugcuccgaagggcagaucagcaucuuuagauacgagaacuguccuaaggacaaucccauguauuacugcaacaagaaaacaucuugccgcuccugugcucuggaccaaaauugccagugggaaccuagaaaccaggaguguauugcccugcccgagaauaucugcggaauuggcuggcaucucguggggaacagcugucugaagaucaccacagccaaagaaaauuaugauaacgcuaaacuuuucugccggaaucacaacgcccugcucgcgucccugaccacgcagaagaagguugaguuugugcugaagcaacuucgcauuaugcagucuagccaguccaugucuaaacucacccugacaccgugggucggacugagaaagaucaacgugagcuacugguguugggaagacauguccccuuucaccaauucucuccugcaguggaugcccagcgagcccuccgaugcuggcuucugcgggauccuuagcgagccuucuacacggggccugaaagccgccaccuguauuaacccgcucaauggauccguuugcgaacgccccgcuaaccauagcgccaagcaauguagaacgccuugcgcucugcggacagccugcggcgacuguaccucuggguccagcgagugcaugugguguucuaauaugaaacagugcguggauuccaacgcguacgucgccagcuuucccuucggacaguguauggaaugguauacaauguccacaugcccucccgagaauuguagcggcuacugcaccuguucucacugccuggaacagccuggguguggauggugcaccgaccccagcaacacgggcaagggcaagugcaucgagggguccuauaaaggaccggugaagaugccuucucaagcucccaccggcaauuuuuacccucagccccuucucaacagcuccaugugucuggaggauucucgcuauaauuggagcuucauucauugcccggccugucagugcaacgggcacuccaaauguaucaaucagucuauuugcgaaaagugugagaaccugacaaccggaaaacacugcgaaacauguaucagcggcuuuuacggggacccuaccaauggaggcaagugccaacccuguaagugcaacggccaugcuucccucugcaacacgaauacagggaaauguuucugcaccaccaagggagugaaaggcgaugagugucagcugugcgaagucgagaacagauaucaggggaauccucuucggggaacauguuacuacacccugcucauugacuaucaauuuacauucagccugucucaggaggaugaccgcuacuauacggccaucaacuuuguugccacccccgaugaacagaauagagaccuggacauguucaucaacgcuuccaagaauuuuaaccuuaauauuacaugggcggccagcuucucugcuggcacccaggccggggaggaaaugcccgugguguccaaaacaaacaucaaggaguacaaagauagcuuuuccaaugaaaaguucgacuuccggaaccacccuaauauuaccuuuuucgucuaugugucuaacuuuacguggccgaucaagauucaaaucgccuucagccagcauuccaauuuuauggaucugguucaguucuuugugaccuucuuuagcugcuuccucucucugcuccuggucgcugccgugguuuggaaaaucaagcaguccuguugggcgagcagacgccgggagcaacuucugagagagaugcagcagauggcuucucgccccuuugccagcgugaacgucgcccucgaaacagacgaggaaccucccgaucugauuggaggcuccaucaaaaccgugccuaagcccauugcucuggagccuugcuucggcaauaaagccgcgguucuuucuguguucguccggcugccgagagggcucggaggcauucccccucccgggcagagcggacuggcuguggccuccgcccucguggacaucucucaacagaugccuaucgucuacaaggaaaagagcggcgcuguucgcaaccggaaacagcaacccccggcccagccugggacauguaucuga

SEQ ID NO: 66260 - RNA, 4140 nt, Artificial Sequence
  derived and/or modified sequence opt5 from ATRNL1__Homo_sapiens__NP_997186
auggagaccggcgggagagcccggacaggaacgccccagccugcugccccgggcguguggcgcgcgagacccgcugggggaggcgggggaggcgccagcuccuggcugcucgacggcaacucuuggcugcuuugcuacggguuccuguaucucgcccuguacgcucaagucagccaguccaagccuugugaacggaccggaucuugcuuuagcggccgcuguguuaauuccacaugccuuugugaucccgggugggugggagaccagugccagcacugucaaggcagauucaaacugaccgagccuucuggguaucucacagauggacccaucaacuacaaguauaaaaccaagugcacauggcugauugaaggcuacccuaaugccgugcugcggcuccgcuuuaaccauuucgcuaccgaguguagcugggaccacauguaugucuacgauggcgacuccaucuacgccccgcugauugcggugcuuagcgggcugaucguucccgaaauuagaggaaaugagacggugccugaggucgugaccacaucuggcuaugcccuccugcacuuuuucuccgaugcugccuacaaccuuaccggguuuaauaucuucuauagcaucaacucuugccccaauaacuguuccggacauggcaaaugcacaaccagcguuucugugccuucccaggucuacugcgaaugugacaaguauuggaagggggaggcuugcgauauucccuacuguaaagccaauugcggaagcccggaccauggcuauugugaucugacgggcgaaaagcucugcguguguaacgacuccuggcaggggccugauugcucucugaaugugcccagcacagaguccuacuggauccugccuaacgucaaacccuuuagccccucuguuggacgggcgucccacaaggccgugcuccacggcaaauucaugugggugauugggggauacaccuuuaauuauagcucuuuccagaugguccugaacuacaaccuugagagcuccaucuggaaugugggcacaccuucucgcgggccgcugcaaagauauggccauagccucgcucuguaccaggaaaacauuuuuauguauggaggccggaucgagaccaaugacgggaacguuaccgacgaacuuuggguguucaauauucacucccagagcuggucuacaaagacgcccaccguccugggacauggccagcaauacgccguggaggggcacuccgcucacaucauggaacucgauagccgcgacguugugaugaucauuaucuucggauauucugccauuuacggcuacacauccagcauccaggaguaucauauuuccucuaacaccuggcuggucccugagacaaagggggccaucgugcagggcggauacggccacaccagcgucuaugaugaaaucacgaaauccauuuacgugcaugggggauauaaggcucugcccggcaauaaauacgggcucguugacgaucuguauaaguacgaggugaacacaaaaaccuggaccauccuuaaggaaucuggauuugcgagauaccugcacagcgccguccucauuaauggcgcuaugcugaucuucgggggcaacacacauaaugacaccucccuuagcaacggagccaaauguuuuucugccgauuuccuggcuuaugacauugccugcgaugaguggaagauccucccuaagcccaaucugcaccgggacgugaaccgcuuuggccacuccgcgguugugaucaaugggagcauguacauuuucggaggcuuuucuuccguccugcucaacgauauccugguguauaaaccgccuaacuguaaggcuuucagagacgaggaacuuugcaaaaaugccgggcccggaauuaagugcguguggaacaaaaaucauugugagagcugggaaucuggcaacacaaauaacauccugcgggccaagugcccucccaagacggcugccagcgacgauagauguuaccgcuaugcugacugcgccuccuguaccgcgaauacaaacgggugccaauggugugaugacaaaaagugcauuagcgccaauucuaacuguuccaugagcguuaaaaauuacaccaagugccacguccggaacgagcagaucuguaauaaacucacauccugcaagucuugcagccugaaccugaauugucagugggaucagagacaacaggaaugccaggcccuuccugcccaucucuguggcgagggauggucccacauuggcgacgcuugccugcgcgugaacucuagccgggaaaacuaugauaaugccaagcuguacuguuacaaccucuccgggaaucuggcgucucuuaccacgagcaaagagguggaguuuguccuggacgaaauccagaaguauacccaacagaaagugucccccuggguuggacucagaaagaucaacauuagcuacuggggcugggaggauaugucuccguucacaaauaccacacugcaguggcugccuggggaacccaacgacuccggauuuugcgccuaucuugagcgcgcugccguggcuggccucaaagccaaucccuguaccagcauggccaacggccuggucugcgagaagccugugguuucuccgaaucagaacgcucggcccuguaagaaaccuugcucccugagaacgagcuguucuaauugcacauccaacgggauggaaugcaugugguguagcuccaccaagcgcugcguggauagcaaugcguacaucauuucuuuccccuauggacaaugucucgaguggcagacagcuaccugcagcccucagaacuguuccggccugcggaccugcgggcagugucuugaacaacccggaugcggcugguguaaugacccuucuaacacagggagaggacacugcaucgagggcagcucccgcggccccaugaaacugauugggaugcaucacucugaaaugguccucgauacgaaccuguguccgaaggagaaaaauuacgaguggagcuuuauccagugcccugcuugccaguguaacggacauucuaccugcaucaauaacaaugugugugaacaaugcaagaaccugacaaccggcaaacagugucaggacugcaugcccggguauuacggagacccuacaaauggcgggcaguguaccgccugcacguguuccggacacgccaacauuugccaucuucacacaggcaaguguuucugcaccaccaagggcaucaaaggggaucaaugccagcucugugacagcgagaaucgguacguuggaaacccccugagaggcacaugcuauuacucccugcucauugauuaucaguucaccuuuagccugcuucaggaagacgaucggcaccauacagcuaucaauuucauugccaacccggagcaaucuaauaagaaccuggacaucuccaucaaugcgagcaacaauuuuaaccucaacauuacguggucugugggguccaccgcuggaacaaucagcggcgaagagaccuccauugucucuaaaaauaacaucaaggaguaccgcgauagcuucuccuaugaaaaauuuaauuucagaagcaacccuaauauuacauuuuacguguaugugucuaacuucuccuggcccaucaagauccagauugccuuuagccagcacaauaccaucauggaccugguccaguucuuuguuacguucuuuucuuguuuccugagccuucuccugguggccgcuguggucuggaagauuaaacaaaccugcugggccucccggagacgcgagcagcugcuccgggaaagacagcaaauggcgucucgcccuuucgcuagcguggauguugcccuggaggugggggccgaacagacagaguuucuuagaggaccccuggagggcgcucccaagccuaucgccauugaaccgugugcuggcaaccgggccgcgguccucaccguguuccugugccugccccgcggguccucuggagccccucccccuggccagagcgggcuugcuaucgccuccgcucugauugacaucagccagcaaaaagccucugauuccaaggacaaaacaagcggaguuagaaaucggaagcaucucuccacccgccagggcacauguguguga

SEQ ID NO: 66261 - RNA, 7479 nt, Artificial Sequence
  derived and/or modified sequence opt5 from ATRX__Homo_sapiens__NP_000480
augaccgccgaacccaugagcgaauccaagcugaacacacucgugcagaagcugcacgacuuccuugcucauucuagcgaggaauccgaggaaacgucuagcccucccagacuggccaugaaucaaaacaccgauaagaucuccggcucugggagcaauuccgacaugauggagaacagcaaagaggaaggcacaucuuccagcgagaagucuaaauccagcggaucuagccggagcaagcgcaagcccuccauugugaccaaauacguugaaucugaugacgagaagccucucgaugacgagacagugaaugaagaugcgagcaacgaaaauuccgaaaacgacaucaccaugcagagccugcccaaagggacagugauuguccagccugagcccgugcuuaaugaagauaaggacgauuuuaaaggaccugaguucagaucucgguccaagaugaagaccgagaaccugaaaaagcgcggcgaagacgggcuccacggaaucguuagcugcacggcuuguggccagcaagugaaucauuuucagaaagauucuauuuauagacacccgagccugcagguccugaucugcaagaacuguuucaaauacuauauguccgacgacaucucucgggauagcgacggcauggaugagcagugccgcuggugugccgaagggggaaaucucauuugcugugacuuuugccauaacgccuucuguaagaaaugcauccugagaaaucuuggccggaaggagcuguccaccauuauggaugaaaacaaccaaugguacuguuauaucugccaccccgagccucuccuggaccuugugacagcuugcaauagcguuuuugagaaccuggaacagcuccugcagcagaauaagaaaaagauuaaaguggauucugagaaguccaacaaagucuacgaacacaccagccgcuucucucccaagaagacauccagcaauuguaacggggaggagaaaaagcuggacgauuccugcucuggaagcgugaccuauuccuacucugcccucaucgugccuaaagaaaugauuaagaaagcuaagaagcugaucgagacgacagccaauaugaacagcuccuacgucaaauuucuuaagcaagcgaccgacaauagcgaaaucucuuccgccacaaaacugagacagcucaaggcuuucaaaagcguucuggccgauauuaagaaggcucaucuugcccuggaggaagaccucaacucugaguuucgggcgauggacgccgugaauaaagagaagaacaccaaagaacacaaggugaucgaugcuaaauucgagaccaaggcccgcaaaggcgaaaagcccugugcucuggagaagaaagacauuuccaagagcgaagccaaacugucuagaaagcaggucgauagcgagcauaugcaccaaaaugugccgacagaggaacagcggacgaacaaauccaccgggggagagcacaaaaagagcgaccgcaaagaagaaccucaguaugaacccgccaauacaucugaggaucucgacauggauaucguuuccgugccuagcuccguccccgaggacauuuuugaaaaccuggagaccgcuauggaagugcagucuagcguugaucaucaaggcgacggcuccucugggacagagcaggaaguggagagcuccucugucaaacuuaacaucagcuccaaagauaauagaggaggcaucaagagcaaaaccacggcgaaggugacaaaggagcuguacgucaaacucacccccgugucucuguccaacagcccuauuaagggggccgacugccaggaaguuccgcaggauaaagacggauauaagucuuguggccuuaaucccaaacuggagaagugcgggcucggacaagaaaacuccgacaaugagcaccugguggagaacgaagucagccugcuccuggaggaaucugaucuucggagauccccucgcgugaagaccacaccccugcggagaccuaccgagacaaaucccguuacgagcaacuccgacgaagaguguaaugagaccgugaaagaaaagcagaaacucagcgucccggugcgcaagaaagauaagcggaacucuagcgacuccgcuaucgauaauccuaaacccaacaagcugccuaagucuaaacagagcgagacaguggaccaaaauuccgauucugacgaaaugcuggccauucuuaaggagguuagcagaaugucccauucuagcuccagcgauaccgacaucaacgaaauucacacaaaucauaaaacccucuacgaucugaagacgcaggccggcaaagacgauaagggcaagcgcaaacggaagucuuccaccagcgggucugacuucgacaccaagaagggaaaauccgcuaagagcuccaucaucucuaagaaaaagagacagacccagagcgaguccagcaacuaugauucugagcuggaaaaagagauuaaguccaugagcaaaaucggcgccgcgcgcacaaccaagaagcggauucccaacacgaaagacuucgauucuagcgaagacgagaagcacuccaaaaaggggauggauaaucagggacacaaaaaccucaagacaucucaagaaggcagcuccgacgaugcugagagaaagcaggagcgcgaaaccuuuucuagcgccgaggggacagucgacaaagauaccaccaucauggaacugcgggacagacuuccuaagaaacagcaagccuccgcuagcacagauggcguggacaagcugucuggaaaagaggaguccuucacgagccucgaagugcggaaggucgccgagaccaaagaaaaguccaagcaucugaaaacaaagaccugcaaaaaggugcaggacggccugucugauauugcugagaaauuucuuaagaaggaccagagcgaugaaacauccgaggacgauaaaaagcagucuaaaaaggggaccgaggagaagaagaagcccagcgacuucaaaaagaaaguuaucaagauggagcaacaguacgaauccagcucugauggaacggagaaacucccggaacgcgaggagauuugucacuuuccuaagggcaucaagcagaucaaaaaugggacaaccgacggagaaaagaaauccaagaaaauuagagauaagaccagcaaaaagaaggacgagcugucugauuaugccgaaaaauccacaggcaagggggacagcugcgauucuagcgaggacaaaaaguccaaaaacggcgcguacggacgggaaaagaagagauguaaacugcucggcaagucuagccgcaaacggcaggacugcuccagcuccgauaccgagaaguacucuaugaaagaggacgggugcaauagcuccgauaagagacugaagcgcaucgaacuuagagagcggcgcaaccugucuagcaaaagaaauacaaaggaaauucaauccggaucuagcuccagcgacgccgaggagucuuccgaagauaacaaaaagaaaaagcagcggacgagcucuaagaaaaaggcugugaucgucaaagagaagaaacgcaauucccucagaaccagcacaaagcggaaacaggccgacauuaccucuuccagcuccagcgauaucgaagacgaugaccagaacucuaucggcgaggggagcuccgaugaacaaaagauuaagcccgugacagagaaucugguucugucuagccauaccggauucugucaguccucuggcgacgaggcucuuagcaaauccgugcccgucacgguggaugacgacgaugacgauaacgacccugaaaaucgcaucgccaagaaaaugcuccuggaggaaauuaaggcgaaccugucuagcgaugaggacggguccagcgaugacgaaccggaggagggcaaaaagagaaccggaaagcagaaugaagagaaccccggcgaugaagaggccaaaaaccaaguuaauucugaauccgacagcgauucugaggaguccaagaaaccucgguaucgccacagacuccugcggcacaaacuuacagugagcgacggggaauccggagaggagaagaagaccaagcccaaagagcauaaggaggucaaaggcagaaaccgccggaaggugucuagcgaagacuccgaggauagcgacuuucaggaaucugggguguccgaggaagucagcgagucugaggaugaacagagaccucgcacacggagcgcuaaaaaggccgagcuggaagagaaucagagauccuacaagcagaagaagaaacgccggagaaucaagguucaggaagacucuagcuccgagaacaaaucuaauagcgaggaagaggaagaggaaaaggaggaggaagaggaagaggaggaagaggaagaggaagaggaggaagaugagaacgacgauuccaagagccccggaaaaggccgcaagaaaauucggaagauccucaaagacgauaagcugagaaccgaaacacagaaugcucugaaagaggaagaggagcggcgcaagagaaucgccgaacgggagcgcgaaagagagaaacuucgggaagugauugagaucgaggacgccucuccuaccaaaugccccauuacgacaaagcucgugcuggaugaagacgaggaaaccaaagagccgcugguccaggugcacagaaacaugguuaucaagcucaaaccucaucaaguggaugggguccaguucaugugggacuguugcugugaguccgugaagaagaccaaaaagagccccggcuccggaugcauucuggcucacuguaugggccuugggaaaacacugcagguugugucuuuucuccauaccguccugcugugcgacaaacuugauuucagcacggcgcuggugguuuguccucucaauacagcccugaacuggaugaaugaauuugagaaauggcaggaaggacucaaggacgaugagaagcuggaaguguccgagcuugcuaccgucaaacgcccccaagagcggucuuauaugcugcagagauggcaggaagacggcggggugaugaucaucggauacgagauguaucgcaaccucgcccagggccggaaugucaagagcagaaaacugaaggaaauuuucaacaaagcccuggucgauccgggcccugacuuuguugugugcgaugaggggcacauccuuaagaaugaggcuuccgccgugagcaaggcgaugaacucuauucgcucccggagacgcaucauucugacaggaacaccccuccaaaauaaccugaucgaguaccacuguauggucaacuucauuaaagagaaucuccugggcagcaucaaggaguucagaaaccgguuuaucaauccuauucagaacgggcagugcgcugacucuacaaugguggauguucgcgugaugaaaaagagagcccauauccuuuaugagaugcuggccggaugcguccaacggaaagacuacaccgcucucacgaaguuccugccgcccaaacacgaauacgugcuggccguucgcaugaccuccauucaguguaaacuuuaucaguacuaucuggaucaucucacaggcguggggaauaacagcgagggaggcagaggcaaggcgggggcuaaacuguuucaggacuuccaaaugcucucucggaucuggacccacccuuggugccugcagcuugacuacauuuccaaggaaaauaaaggauauuuugaugaggacagcauggaugaguucaucgccucugacagcgaugaaacauccaugagccuguccucugacgauuacaccaagaaaaagaagaaaggcaagaaagggaagaaagacagcuccucuagcggauccggcucugauaacgacgucgaggugaucaaggucuggaauagcagaucccgcgggggaggcgaaggcaacguggaugagacggggaauaacccgagcguuucucugaagcucgaggaauccaaagccacauccucuuccaaucccagcucuccugcucccgacugguauaaggauuuugugaccgacgccgacgcugagguccuggaacauuccggaaaaauggugcuucuguucgagauucuccggauggccgaagagaucggcgauaagguucugguguuuagccagucucucauuucccuggaccuuaucgaggauuuccuggaacuggcgagcagagagaaaacagaagacaaggauaagccucucauuuacaaaggggagggaaaguggcugcgcaacaucgacuacuaucggcuugauggcagcaccaccgcccagucccgcaagaagugggcugaagaguuuaaugacgagacaaacguccgggggcgccuguucaucauuucuacgaaagccggaagccucggcaucaaccugguggcugccaauagagugauuaucuuugaugccuccuggaaccccucuuacgacauucaaagcaucuuccggguuuaucgcuucggccagaccaagccugucuacguguauagauuucucgcucaggggacaauggaagauaaaauuuacgacagacaggugaccaagcaaucccugucuuuccgcgucguggaucagcagcaaguugagagacacuuuacaaugaaugaacuuaccgagcuguauacguucgaaccggaccugcucgacgaucccaacagcgagaagaaaaagaaacgggacacaccuaugcugcccaaggauaccauccuugcggagcugcuccagauccacaaagaacauauugugggauaccacgagcaugacucccugcucgaucacaaggaagaggaggaacugaccgaggaagaaagaaaggccgcuugggccgaauacgaggccgagaaaaagggccuuacaaugagauuuaauaucccuaccgggacaaaccugcccccggucagcuucaauucucagacgccuuauauucccuuuaaccugggagcucucuccgccaugagcaaucagcaacuggaagaccuuaucaaccagggccgggagaaagugguugaagcgaccaauucugugacagcuguccggauucaaccccuggaggauaucaucuccgccguguggaaggaaaacaugaaucucagcgaggcccagguucaagcucuggcccugucccgccaggcgucucaggagcucgacgugaaacggagagaagcuauuuacaacgauguccuuaccaagcagcaaaugcugaucagcugugugcagcgcauucugaugaaucggagacuccagcagcaauauaaccagcagcaacagcagcagaugacauaccaacaggccacccuggggcaccuuaugaugccuaagcccccuaaccugaucaugaauccguccaacuaucagcagauugacaugcgcggaauguaccaacccguggccggcggcaugcagccucccccucuccagcgggcucccccgccuaugagaucuaaaaaucccgggccuagccagggaaaguccauguga

SEQ ID NO: 66262 - RNA, 1236 nt, Artificial Sequence
  derived and/or modified sequence opt5 from ATXN10__Homo_sapiens__NP_001161093
auggccgcucccagaccuccgcccgcccggcugagcggcgugauggucccugcgcccauccaggaccucgaggcucugcgcgcccuuaccgcccuguucaaggaacaaagaaaccggaaucucgauacaauugggguugcuguggaccugauccuucuguuucgcgagcucagaguggaacaggagucccugcugacggccuuccggugcggacuccaguuucugggcaacauugcuucucgcaaugaagauagccaguccaucgucugggugcacgccuucccugagcuuuuucugucuugucucaaccaucccgacaaaaagauuguugcguacagcuccaugauccuguucaccucucuuaaucacgagagaaugaaagaacuggaggaaaaccucaauaucgccauugaugugaucgacgcuuaucaaaagcauccugagagcgaguggccguuucugauuaucacagaucuguuccucaaaucccccgaacugguccaggccauguuuccuaaacuuaacaaucaggagcgggugacccugcucgaccugaugauugcuaagaucacaagcgaugaaccccuuaccaaagacgauauuccuguuuuccugcgccacgccgagcucaucgcgucuacauuuguggaccagugcaagaccguccugaaacuggccuccgaggaacccccggaugacgaggaagcucucgccacgaucagacugcuugacgugcugugugagaugaccgugaacacagaacuccugggguaccuucaagucuucccuggacugcucgagcggguuauugaucugcugcgcgugauccauguggcuggcaaggaaaccacaaauauuuuuagcaacugcgggugugucagagccgagggagacaucucuaauguggccaacggcuucaaaucccaccucauucggcugaucggcaaucuuugcuauaagaacaaggauaaccaggacaaaguuaaugagcuggaugggaucccccucauucuggacaacuguaauaucagcgauucuaacccuuuccugacccagugggugauuuacgcuauccgcaaucuuacggaagacaacucccagaaucaagaucucauugcgaagauggaggaacagggacuggccgacgcuagccugcucaaaaaggucggcuuugagguggaaaagaagggggagaaacugauccuuaaguccacaagagauacccccaagcccuga

SEQ ID NO: 66263 - RNA, 2448 nt, Artificial Sequence
  derived and/or modified sequence opt5 from ATXN1__Homo_sapiens__NP_001121636
augaaaagcaaccaggagagauccaaugaaugccugcccccuaagaagcgggagaucccggccaccucucgcagcuccgaagagaaagcucccacacucccuucugacaaccacagaguggaaggcacggccuggcugcccgggaauccuggaggccgggggcauggaggcgggcgccacggacccgcgggcaccagcgucgagcuuggccugcaacaggggauuggacuccauaaggcucuguccacaggccuugauuacucuccuccgagcgcccccagauccguuccuguggccaccacacugcccgcugccuaugcuaccccucagcccgggacaccggugagcccuguccaguacgcccaccucccccauaccuuccaauuuaucggaucuucccaguauagcggcacguacgcgucuuucauuccuucccagcugaucccucccaccgccaacccugugacaagcgcuguugccucugcugccggggcgaccacaccgucccagcggagccaacuggaggccuauuccacccuccuggcuaauaugggaucucuuagccagacgcccggccacaaagccgaacagcagcaacagcagcaacagcagcagcaacagcagcaccagcaucaacagcagcagcaacagcagcagcaacagcagcaacagcagcaccugucccgcgcuccuggccucauuacacccgggagcccucccccggcccagcaaaaccaguacgugcauaucucuuccagcccucagaauaccggaagaacagccucucccccugcuauccccguccaucugcacccucaccagaccaugauuccccacacccuuacacugggcccgccuagccaagugguuaugcaguaugcggacuccgggucucauuuugugccccgggaggccacgaagaaggcugaaagcucccgccuccagcaggccauccaagccaaagagguccugaacggagagauggaaaagagcagacgguacggcgcucccucuuccgccgaucuggggcucggaaaagcgggcggcaagagcgugccucacccguacgagucucgccauguggucguucaccccuccccuagcgacuauuccucuagagaucccagcggggugcgggcuuccgugaugguccugccuaauucuaacacccccgccgccgaccuugaagugcagcaggcuacacaccgcgaggccagcccuuccacccugaaugauaaaagcggacuccaucugggcaagcccgggcacagaucuuacgcucuuuccccgcauacaguuauucaaaccacgcacagcgccucugaaccucugcccgugggacucccugcgacagccuucuaugcuggcacccagcccccggucaucggguaccuguccggccagcagcaagccauuaccuaugcuggaagccugccucagcaccucgugauccccggcacacagccucugcuuauucccguugggucuaccgacauggaggccagcggagcggcccccgcuaucgugacauccagcccucaguuugccgcugucccgcauacguucgugaccacagcccugcccaagucugagaacuuuaauccugaagcccucgucacccaagcugcguaccccgccauggugcaggcucagauccaucugccuguugugcaguccgucgccagccccgccgcugccccuccgacacuucccccuuauuucaugaaaggcuccauuauccaacuggcgaacggggagcucaagaaaguggaagaucugaagaccgaggacuuuauucagucugcugaaaucagcaaugaucugaaaauugacuccucuacgguugagcggaucgaggauagccacucccccggaguggccgucauccaguucgccgugggcgaacacagagcucaggugucuguugagguccucguggaauaccccuuuuucguguuugggcaaggcuggagcuccuguugccccgagcgcaccagccagcuguucgaccuuccguguucuaagcuguccgucggagacgugugcauuagccucacacugaaaaaccugaagaacggcucuguuaagaaagggcagccuguggaucccgccuccguccuucucaagcauagcaaagcggacggacuggcuggcucucggcacagauacgccgaacaagagaaugggaucaaccagggauccgcccagaugcugagcgagaauggcgaacucaaguuccccgagaaaauggggcugccugcugcccccuuucuuaccaagauugaaccuuccaagccggcugccacacgcaaacggagauggagcgcgcccgagucucgcaagcuggagaaaagcgaagaugagccuccccucacccugccuaagcccucccugaucccgcaggaagugaaaauuuguaucgagggccggucuaacguuggaaaguga

SEQ ID NO: 66264 - RNA, 2070 nt, Artificial Sequence
  derived and/or modified sequence opt5 from ATXN1L__Homo_sapiens__NP_001131147
augaagcccgugcacgagagaagccaggaaugccugccuccgaaaaagcgggaccuccccgucaccuccgaggauaugggccgcacaacgucuuguagcaccaaccauacaccuuccucugacgccagcgaaugguccagagggguugugguggcuggacaaucucaggccggcgcgcgggucagccuugggggagauggcgcugaggccaucaccgggcugacaguggaccaguacggaaugcuguauaaaguugccgugcccccugcuaccuucucccccacaggccucccuagcgucgugaauaugucuccgcugcccccuaccuuuaacguugccuccagccuuauucagcaccccggcauccauuacccuccccugcacuaugcucaacucccgucuacgucccugcaguucauugggagcccuuacucucugcccuaugccgugccucccaauuuucuccccuccccucugcuuagcccguccgcgaaccuggccaccucucaucucccccacuucgucccuuacgcuagccugcuugccgaaggagcuacacccccuccccaggccccguccccugcgcacagcuuuaauaaggcccccucugcuaccuccccuagcggccagcugccccaucacucuagcacacaaccucucgaucuggcccccgggcgcaugccgaucuauuaccagauguccagacugccugcuggauacacccuccaugagacgccucccgccggcgccucuccugugcugacaccgcaggagagccaguccgcucuugaagcggccgcugccaacgggggacaacggccccgcgagagaaaucuggugcggcgcgaaagcgaggcccucgacucuccuaacuccaaaggcgagggccaggggcugguccccguuguggaaugcguggucgauggacagcuuuucagcggcucucaaaccccuagaguggagguugcugcccccgcgcaccgggggacaccugacaccgaucuggaagugcagcgcgucgugggagcucucgccucccaggacuauagaguuguggccgcucagcggaaggaggaacccagcccgcugaaucugucccaccauaccccugaucaccaaggcgaggggcgcggaucugccagaaaccccgcugagcucgccgaaaagagccaggcgcggggcuuuuacccucagucccaucaggagcccgucaaacacagaccgcugccuaaggccaugguggucgcuaauggcaaccuugugcccacagggacggacucuggacugcucccuguuggcagcgaaauucugguggccuccagccuugauguccaagcucgcgccaccuuccccgacaaagagcccacaccuccgcccaucaccucuucccaucugccuagccacuuuaugaagggggcgaucauucagcucgccacaggagaacugaaacggguggaggaccugcagacccaggauuucguuagaucugcugagguguccggcgggcucaagaucgacagcucuacggucguggauauucaagaaagccaguggcccggcuuugugaugcugcacuucguugucggagagcagcaguccaaggugagcaucgaagugccucccgagcaucccuuuuucgucuauggccaaggguggucuuccuguagcccgggacgcacaacccagcuuuucucccugcccugccaccggcuccaggugggcgacguuuguauuucuaucagccugcaaucccuuaauucuaacagcgugucccaggccucuugcgcuccucccagccagcuggggccucccagagaacgcccggagcggaccguccucggauccagagagcugugugauagcgaaggcaaaucucagccugccggggagggcucccgcgugguugaacccagccaacccgagucuggagcccaggcuugcuggccugcgcccuccuuucagcgguacagcaugcagggcgaggaagccagagcugcccugcuccgcccuucuuucauuccgcaagaggugaagcuguccaucgaagggcggagcaaugccggaaaauga

SEQ ID NO: 66265 - RNA, 3942 nt, Artificial Sequence
  derived and/or modified sequence opt5 from ATXN2__Homo_sapiens__NP_002964
augagaagcgccgcugccgcgccccgguccccugcuguggccaccgagucucgcagauucgccgcugcccgguggccgggcuggcgcagccugcagagacccgcucggcgcuccgggagaggaggcgggggagccgcgccuggccccuacccuucugccgcucccccuccgcccgggccuggacccccucccagccggcaauccucuccgccuagcgccuccgacugcuuuggcagcaacggcaaugggggaggcgcuuuccgccccgggucuagacggcuccugggacuuggcgggccuccccgccccuuugucguucugcuccugccucuugccuccccgggagcgcccccugccgcucccacaagagccagcccucugggcgcucgggccucucccccgcgcuccggcgugagccucgccagaccugcucccggguguccucggcccgcgugcgaaccuguguauggaccccugacgaugucucugaagccgcagcagcagcaacagcagcagcaacagcagcagcaacagcagcaacagcagcagcaacagcagcagcaaccuccucccgccgcugccaacgucagaaaacccggcggguccggacuccuggccagcccggcugccgcgcccuccccuucuagcuccagcgugucuuccagcucugcuaccgcccccagcuccguuguggccgcuacaucuggcgggggacgcccuggccuuggccgggggagaaauagcaacaagggacugccccaguccaccaucagcuucgauggcauuuacgccaauaugcgcaugguccacauccucacaucugugguuggguccaaaugugaggugcaggucaagaacggaggcauuuaugaagggguguuuaaaaccuacagcccuaagugcgaccuggugcuugaugcugcccaugagaagucuacagaauccagcuccggccccaaacgggaggagaucauggaaucuauucuguucaaguguagcgacuuugucguugugcaguucaaagauauggacuccucuuaugcgaagagagaugccuuuaccgacagcgcuaucuccgccaaagugaauggagagcacaaggaaaaggaucucgagccgugggacgcuggcgagcugacggccaacgaggagcuggaagcgcucgagaaugaugucagcaacgggugggacccuaaugauauguuccgcuacaacgaagagaauuauggagugguuucuaccuacgacuccagccugucuuccuacacagugccccuugagcgggacaacagcgaagaguuucugaaaagagaagcccgcgcuaaucaacucgccgaggaaaucgagucuagcgcucaguauaaggcccgggucgcccuggagaacgaugacagauccgaagaggaaaaauacaccgcugugcagcgcaacagcucugagcgggaaggccauuccauuaauacaagagagaacaaguauaucccucccgggcagcggaaucgcgagguuauuagcuggggauccggcagacaaaacucuccgcggauggggcagccuggcagcggauccaugcccucuagaagcaccucccacacgucugauuucaauccuaacagcggcuccgaccagcgcguggucaaugggggagugcccuggcccagcccuugcccgucucccuccagccggccucccucuagauaccaauccggcccuaacagccuucccccucgcgcggccacaccgaccagacccccuucucggcccccuucccgccccagcagaccgccuucccaucccagcgcucacgggucucccgccccugucagcacaaugcccaaacggauguccucugaaggaccuccgcgcaugagccccaaggcccagagacacccucggaaucaucgcguguccgcuggcagagggucuaucagcuccggccuggaguuuguuucucacaaucccccuagcgaagccgcgacacccccgguggcucggaccuccccuagcggaggcaccuggucuuccgucgugagcgggguuccccgccucucuccuaaaacgcauagaccccgguccccuagacagaacagcauuggaaacacccccuccggcccggugcuggccucuccucaggccgggaucauucccacagaggcugucgccaugcccaucccugcggcuagcccgacccccgccuccccugccagcaaucgcgcugugacacccucuuccgaggccaaggauagccggcugcaagaccagagacagaacucuccugcuggaaauaaggaaaacaucaaacccaacgagaccagcccuuccuucucuaaggccgaaaauaaaggcauuagcccggugguuuccgagcaccgcaagcagaucgaugaccucaaaaaguucaagaacgauuuucggcugcaacccucuagcacguccgaaagcauggaccagcuucugaauaaaaacagagagggggagaagucucgcgaucucauuaaagacaagaucgaaccuuccgcgaaagacagcuucauugaaaauuccucuagcaacuguacauccggcucuagcaagcccaauuccccuagcaucucucccuccauccugagcaacaccgaacacaagcggggaccggaggucaccucucagggcgugcagacauccagcccugccugcaaacaagaaaaggaugacaaagaggagaagaaagaugcugccgaacaggugagaaagucuacccuuaaucccaacgcuaaggaguuuaauccccgcagcuucucccagccuaaacccucuacaacgccuaccagcccgcggccccaagcccagccuucccccagcauggucgggcaucagcagccuacacccguguauacccaaccgguuuguuuugccccuaacaugauguaccccgugccugucucccccggagugcagccucuguaucccauuccgaugacaccuaugcccguuaaucaggcuaagaccuacagagcggugcccaacaugccucagcaacggcaggaccagcaccaucagucugccaugaugcacccggcuagcgccgccgggcccccuaucgcugccacgcccccugcguacuccacccaauaugucgcuuacucuccccagcaguucccuaaucagccccucgugcaacauguuccgcacuaucagagccagcacccucauguguacucccccgucauucaaggcaacgcccgcaugauggccccucccacacacgcucagccgggacuggugucuagcuccgccacccaguauggcgcgcaugaacagacacacgcuauguacgccugcccuaaacugcccuauaacaaggagaccagccccucuuuuuacuucgccaucuccacgggcagccucgcucaacaguacgcccacccuaaugcuacacugcauccccacaccccucauccgcagcccucugccacaccuaccgggcagcaacagucccagcacggaggcagccaucccgcgccuucucccgugcagcaccaccaacaucaggccgcucaggcccuucaccuggcuuccccucaacagcagagcgccauuuaucaugccgggcucgcuccgacacccccuuccaugacccccgcgagcaacacgcagucuccucaaaauagcuuucccgccgcucagcagaccgucuucacaauccacccgucccauguucagccugccuacaccaacccuccccacauggcccacgugccccaagcucaugugcagucuggaaugguccccagccacccuacagcccaugcgccgaugaugcugaugaccacgcagcccccuggcgggccccaggcugcccuggcccaauccgcccuucagccuauccccgugucuacaaccgcucacuuuccguauaugacccacccuagcguucaggcgcaucaccagcaacagcucuga

SEQ ID NO: 66266 - RNA, 3228 nt, Artificial Sequence
  derived and/or modified sequence opt5 from ATXN2L__Homo_sapiens__NP_009176
augcugaagccccagccucuccaacagccgagccagccccagcaaccucccccuacccagcaggccguggcuagacggcccccuggcgggacauccccgcccaacggaggccugccugggccccuugccacgucugcggcuccucccggaccgccugccgccgcuagccccugccugggcccugucgccgcugccggguccggacuccgcagaggcgcggagggcauccuggcuccccagcccccuccgccccaacagcaccaggaacggccuggggccgccgcuauuggaucugcccgcggccagagcaccgggaaaggacccccucaaucccccguuuucgagggcguguacaauaacucuagaaugcuucauuuucugacagcgguggucgggagcaccugugacgugaagguuaaaaauggaacaaccuaugaaggcaucuucaagacacucuccagcaaauuugagcuggccguggaugcuguccaccggaaggccucugaaccggcuggcgggccucgcagagaggacauuguggauaccaugguuuucaagcccuccgacgugaugcugguccauuuucggaacguggauuucaauuacgccacgaaagacaaguuuaccgauagcgccaucgcuaugaacucuaaagugaauggagagcacaaggaaaaaguccuccagcgcugggagggcggggacuccaacagcgaugacuaugaucuggaaucugacauguccaauggaugggauccuaacgagauguucaaguuuaaugaggaaaacuacggcguuaagacaaccuaugacagcucccuuucuagcuacacagugccccuggagaaagacaauuccgaagaguucagacagcgggaacuccgcgcggcccaacuggcuagagagauugagagcucuccucaguaucggcuucgcaucgccauggaaaacgaugacgggagaaccgaggaagagaagcauuccgccgugcagcggcagggaagcggcagagaaucucccagccuggcuucccgcgagggcaaauacaucccgcucccucaacgggucagagaggggccccgcggaggcgugcggugcucuagcuccagagggggacgccccggccugagcucucugccuccgcgggggccccaccaccucgauaauuccagcccuggccccggaucugaagccagaggcauuaacgggggaccuucccgcaugagccccaaggcgcagcggccucugagaggcgcuaaaacgcuuuccucucccagcaaccgcccguccggggagacaucuguuccucccccucccgccgugggacggauguacccgccuagaagccccaaguccgccgcuccugcccccaucagcgcuucuugucccgaaccuccgauuggcuccgccguccccaccagcucugcguccaucccugugacaagcucuguuagcgaccccggggugggcuccauuagcccugccucucccaaaaucucccuggcuccuaccgaugucaaggagcucagcaccaaggaaccgggacggacacuggagccccaggagcuugcccgcauugcuggcaaagugccugggcugcagaaugaacaaaagagauuucagcucgaggaacugcggaaauucggagcccaguuuaagcugcagcccuccucuagcccugagaacucccucgaccccuucccgccuagaauccugaaagaggaacccaagggcaaggagaaagaagucgaugggcuucugacgucugagcccaugggaagcccuguguccucuaagaccgaaagcguuuccgacaaagaggauaagcccccucucgcgccgagcggcgggacagagggccccgaacaaccucccccucccugcccgucucagaccggauccccucccgugggccugaucaaaggggaggacaaggaugaaggaccugucgccgaacaggugaagaaaagcacacuuaaucccaacgcuaaggaguucaauccuaccaaaccccugcucucuguuaacaaguccacgagcacaccgaccucuccuggcccccgcacccauuccacacccagcauuccugugcugaccgccgggcaguccggacuguauagcccgcaauacaucucuuauauuccccagauccacaugggcccugcuguccaggcuccccaaauguacccuuaucccgugagcaauuccgugccugggcagcagggcaaauaccggggagccaagggcucucucccgccccagagaagcgaccaacaucagccugccuccgcgcccccuaugaugcaggccgcugccgccgcugggcccccgcugguugccgcgacaccuuauucuagcuacauucccuacaacccccagcaauuuccuggacagcccgcuaugaugcagccuauggcccacuauccgucccagcccgucuucgccccuaugcuucaaucuaauccccgcaugcugacgagcggcucccacccucaggcuaucgugucuagcuccaccccgcaguaccccagcgccgagcaaccuacaccccaggcgcucuaugcuaccgugcaucagucuuacccucaccaugccacacagcugcacgcccaucaaccccagccugcuaccacgcccaccgggucccagccgcagagccaacacgccgcuccuucccccguccagcaccaggccggacaggcgccccaucugggcucuggccaaccucagcagaaccuuuaucacccgggggcccucacaggaacacccccuagccugcccccuggccccuccgcucagagcccucaaucuuccuuuccccagccggccgcuguguacgccauccaucaccagcaacugccucacggguucaccaauauggcccauguuacccaggcucacgugcagacgggaauuacagcggcucccccuccccauccgggcgccccucacccuccccaggucaugcuccugcauccuccccaaagccacgggggacccccgcagggcgccgugccccagucuggcguuccugcccuuagcgcuuccacccccucuccuuaucccuacaucgggcacccucagggagagcaaccgggccaggcccccggguuuccuggaggcgcggacgaucggauuagagaguucagccuggcugggggaaucuggcauggccgcgccgaaggccuccagguggggcaggacgccagaguccugggaggcgaauga

SEQ ID NO: 66267 - RNA, 1041 nt, Artificial Sequence
  derived and/or modified sequence opt5 from ATXN3__Homo_sapiens__NP_001121168
auggagagcaucuuccacgaaaagcaggagggcucccugugcgcccaacauugucucaacaaucugcuucagggggaauacuuuucucccguggagcugagcuccauugcucaccagcucgacgaagaggagagaaugcggauggccgaaggaggcgucaccucugaggauuaucgcacauuccugcagguuaucagcaacgcgcuuaaagugugggggcuggaacucauucuguuuaauuccccugaguaccaaagacugcggaucgacccgauuaacgagcgcucuuucaucugcaauuauaaggaacauugguuuacggugagaaaacucggaaagcagugguucaaccugaauagccuucugaccggccccgagcucaucuccgauacauaccuggcucuuuuucuggcccagcuccagcaagaaggguauagcauuuucgucgugaaaggagaccugccugauugugaggccgaccagcugcuccagaugauccggguucagcaaaugcaccgccccaagcugauuggcgaagaacuugcucagcugaaggagcagagagugcauaaaaccgaucucgaacggguccuggaggccaacgacggcucugggaugcuugaugaagacgaggaagaucugcaacgcgcucucgcccuguccagacaggagaucgacauggaggaugaagaggcggaccugcggcgcgccauucagcucagcaugcagggaucuuccagaaauaucagccaagacaugacacagaccucuggcacaaaccugaccuccgaggagcuucggaagcgcagagaggcuuacuuugaaaaacagcagcaaaagcagcagcagcaacagcagcagcaacagcagggggaucugagcggacaauccucucacccuugcgagcggcccgccacgagcuccggcgcucucgggagcgaccugggagaugccaugucugaagaggacaugcuucaggcggccgugaccaugucccuggaaacaguuagaaaugaucucaaaaccgagggcaagaaguga

SEQ ID NO: 66268 - RNA, 2679 nt, Artificial Sequence
  derived and/or modified sequence opt5 from ATXN7__Homo_sapiens__NP_000324
augagcgagagagccgcugacgaugugcggggcgaaccccgcagagccgcggcugccgccgggggagcugccgcugccgcggcccggcagcaacagcagcagcaacagcagcagcaaccuccgcccccucagccccagcgccagcaacacccucccccuccgcccagacggacccgcccugaggacggcgggcccggagcugccuccacaucugcugccgcgauggccacggucggcgaaagacggccucugcccagcccggagguuaugcucgggcaguccuggaaccuguggguggaagcuagcaaacuuccuggaaaggauggcaccgagcuggacgagagcuucaaggaauuuggcaaaaaucgcgaggugauggggcucugcagagaagauaugcccaucuucggauuuuguccugcccaugacgauuucuaccuggucgugugcaacgacuguaaucagguugugaagccccaggcuuuucaaucccacuaugagcggcgccauucuagcuccagcaaacccccucuugccgucccgcccacaucuguguucuccuuuuucccuagccugucuaaguccaagggcgggagcgccucuggauccaacagaagcuccucuggcgggguucucagcgcuuccucuucuuccagcaaacugcugaagucucccaaagagaagcuccagcugcggggaaauacccgcccuaugcaccccauucagcaaagcagagugccgcauggccggaucaugacaccuuccgucaaaguggaaaagauucaccccaagauggauggcacccuucugaaaucugcgguggggccuacaugccccgccaccgucagcucccucguuaagccuggacugaacugucccagcaucccgaaaccuacgcuucccucucccggccagauucugaaugggaagggacucccugcuccgcccacccuggagaaaaagccugaagacaacuccaauaacagaaaauuucugaauaagcgccucagcgagcgggaguucgaucccgacauccacugcggcgugaucgaucuggacacaaagaaaccuuguaccagaucucuuacaugcaagacccauucccugacgcagcgccgggccgugcaggggagacgcaaacgguuugacguccuccuggccgaacacaagaacaaaacaagagagaaggaacuuauucgccaucccgauagccaacagccuccccagccgcugcgggacccucaccccgcuccucccagaaccucccaggagccgcaccaaaauccucauggagugauccccucugaaagcaagccuuucguugccuccaaacccaagccccacacaccuucucucccgagacccccuggcugucccgcgcagcagggcgggagcgcuccuauugaucccccuccggugcaugagagcccccacccuccccugccugccaccgaacccgccagccggcugucuuccgaggagggagaaggcgacgauaaagaggaaagcgucgagaagcucgacugccauuacucugggcaccacccgcagccugcuuccuuuuguaccuucggaagcagacaaaucggccggggguauuacguguucgauucucgcuggaacagacugcggugcgcccuuaaucugaugguugaaaaacaucucaacgcucagcuguggaagaagauuccucccgugcccagcacaacgucccccaucagcacccgcauuccucaccgcacaaacucugucccgaccucccagugcggcgugagcuaucuugccgcggccacagucuccaccucucccgugcugcucagcuccacguguaucucuccuaauagcaaauccguucccgcucauggaacaacccugaacgcccaaccugcugccucuggcgcgauggaccccgugugcagcaugcagucccggcaggucuccucuuccucuagcuccccgagcaccccuucugggcuguccagcgugcccuccagcccuaugucuagaaagccccagaaacucaagagcuccaaaucucugcgcccuaaggagagcuccggaaauucuacaaacugucaaaaugccagcuccucuaccagcggcggguccggaaagaaaagaaagaacagcucuccccuucugguucacuccucuagcuccagcuccucuagcuccucuagcucccacagcauggagucuuuucggaaaaauugcguggcucauagcggcccgccuuaccccuccacagucacgucuagccacuccaucgggcucaacugugugaccaauaaggccaacgcugugaauguucgccaugaucagucuggcagaggacccccuacaggcagcccggccgaauccauuaaacggaugagcgucauggugaacucuuccgacagcacccugucccuggggcccuucauccaccagucuaaugagcuuccugugaacagccauggauccuuuucucacagccacacaccccucgauaagcugauuggcaaaaagcgcaagugcuccccuucuagcuccagcaucaauaacucuuccagcaaacccaccaaggucgccaaagugccugcuguuaacaaugugcauaugaagcacacggggaccauuccgggagcgcagggccugaugaacucuagccuccugcaucaacccaaagccagaccuuga

SEQ ID NO: 66269 - RNA, 294 nt, Artificial Sequence
  derived and/or modified sequence opt5 from ATXN7L3B__Homo_sapiens__NP_001129734
auggaggaaaucagccuggccaaccucgacaccaauaagcuggaggcuauugcccaggaaaucuacguggaucuuauugaggacuccugccugggcuucuguuuugaaguccacagagcgguuaaaugcggguauuucuaccucgaguuugcugagacaggaucugugaaggauuucggcauccaacccguggaagacaaaggggccugucggcugccucuuugcagccugccgggagagcccggcaacgggccugaucagcagcuccagcgcuccccucccgaauuucaauga

SEQ ID NO: 66270 - RNA, 1020 nt, Artificial Sequence
  derived and/or modified sequence opt5 from AUH__Homo_sapiens__NP_001689
auggccgcugccguggcggcugcccccggcgcccuggggagccuccacgcuggaggcgccagacuggucgcugccugcuccgcguggcuuuguccugggcugcggcucccgggaucucuggccggccgcagagcugggcccgccaucugggcucagggauggguuccugccgcgggcggccccgccccuaagcggggguacagcuccgagaugaaaaccgaagacgagcuucgcgugagacaucuggaagaggaaaaccggggaauugugguccucggcaucaaucgcgcuuaugggaagaacucucugagcaaaaaucugauuaagaugcucuccaaagccguggaugcucugaagucugacaagaaaguuagaacaaucauuauccggagcgaggugcccggaaucuucugcgccggcgccgaucuuaaggagcgcgcuaaaauguccagcucugaagucgggccuuuuguguccaagauuagagcgguuaucaacgacauugccaaucugccggugcccacgaucgcugccauugauggacucgcccugggcggcgggcuugagcuggcucucgccugugacauccgggucgcggcuagcucugccaaaaugggacugguggaaaccaagcuggccauuaucccuggcgggggaggcacacaacgccuccccagagcuaucgggaugucccuggccaaggagcuuauuuucagcgcucgggugcuggauggaaaagaggccaaggcggucggccucaucucucacguucuggaacagaaccaggagggcgacgccgcuuaccgcaaagcccuugaucuggcuagagaauuucucccucaggggcccguggccaugcggguggcgaagcuggccauuaaucaaggaauggaggucgaccuggugaccggccucgcuaucgaagaggccugcuaugcucagacaauuccgaccaaagauagacuggaggggcuucuggccuucaaggaaaaacgcccuccccgguacaagggagaguga

SEQ ID NO: 66271 - RNA, 1212 nt, Artificial Sequence
  derived and/or modified sequence opt5 from AURKA__Homo_sapiens__XP_006723935
auggacagaagcaaggagaacugcaucuccggccccgugaaagccaccgcuccugucgggggaccgaagcggguucuggugacacagcaauuccccugucagaauccucuccccgugaacucuggccaggcccagcgcguccugugcccuagcaauuccucucaacggauuccccuucaggcgcagaaacuggugagcucccacaagccuguucagaaccaaaaacagaagcagcuccaggcuacgucugugccgcaucccgucagcagaccucugaauaacacccaaaaguccaaacagccccuuccuagcgcccccgaaaauaacccggaggaggaacuggccucuaagcagaaaaaugaagaguccaagaaacgccaaugggcucucgaggauuuugaaaucgggagaccucugggaaagggcaaguucgggaacguguaccuggcccgggagaaacagagcaaguuuauucucgcucugaaaguucuuuucaaggcccagcuggaaaaagcgggaguggagcaccagcuccgcagagaggucgaaauccaaucucaucugcggcaccccaauauucuucgccuguauggcuacuuucaugacgccacaagaguguaucucauccuggaguacgcuccucugggcaccguguaucgggaacuccagaagcuguccaaauucgaugagcagcgcacagccaccuacaucacagaacuugcuaacgcccugagcuauugucacucuaagagagucauucaccgggacaucaagcccgagaaucuccugcuuggguccgcgggagagcugaaaauugccgauuuuggcuggagcguucaugcucccuccucucgcagaaccacgcucugcgggacccuggacuaccugccuccggaaaugaucgagggacggaugcacgaugaaaagguggaccucuggagccugggcgugcuuuguuacgaguuccuggucgggaaacccccuuuugaagccaacacauaucaggagaccuacaagagaauuucccgcguggaguucacauuucccgauuucguuaccgaaggagcucgggaccucaucagcagacugcuuaaacauaauccuucucaacgccccaugcugcgggaggugcucgaacacccguggauuacggccaacuccagcaagccuucuaacugccagaauaaggagagcgccuccaaacagucuuga

SEQ ID NO: 66272 - RNA, 1038 nt, Artificial Sequence
  derived and/or modified sequence opt5 from AURKB__Homo_sapiens__NP_001271455
auggcccagaaggagaacagcuaccccuggccuuauggcagacaaaccgcuccguccgggcugucuacacucccccagcgggugcugcgcaaagaaccugucacgcccagcgcccuuguucugauguccagaucuaaugugcagccuaccgcggcucccggacagaaggugauggagaacagcuccggcacaccugacauccucacccggcgccacuucacaauugaugacuuugaaaucgggagaccgcugggaaaaggcaaguucgggaaugucuaccuugcccgggagaaaaagucucauuuuauuguggcccugaagguucucuucaaaagccaaaucgaaaaggagggaguggagcaccagcugcgcagagaaauugagauccaggcucaucugcaccaucccaacauccuccggcuguauaauuacuuuuaugaucgcagacggauuuaccuuauccuggaauaugccccucgcggcgagcucuacaaagagcugcagaaguccugcaccuucgacgaacaaagaacagcuaccauuauggaggaacuugccgaugcgcugauguacugucacggcaaaaaggucauccaccgggacauuaagcccgagaaccuccugcuggggcucaaaggagaacugaagaucgccgauuuuggcuggagcgugcaugcuccuucucuucgcagaaaaacgaugugcgggacccuggacuaucugcccccggagaugauugagggacggaugcacaaugaaaagguugaucucugguguaucggcgugcuuugcuacgagcugcucgucgggaacccucccuucgaauccgccagccauaaugagacauauagacgcaucgugaaaguggaccugaaguuuccugcuucuguccccaugggagcccaggaucugauuuccaaacuccugcggcacaaccccagcgaaagacuuccucuggcgcagguuucugcccacccgugggugcgcgcuaauucccggagagugcugcccccuagcgcccuccaguccgucgcuuga

SEQ ID NO: 66273 - RNA, 930 nt, Artificial Sequence
  derived and/or modified sequence opt5 from AURKC__Homo_sapiens__NP_001015878
augagcucccccagagccgugguccagcugggcaaggcucaaccugccggggaggaacucgcgaccgcuaaccagacagcccagcagccgucuagccccgccaugcggcgccugacgguugacgauuucgagaucggaagaccucuuggcaaagggaaguuuggaaauguguaccuggcucggcucaaagaaucccacuucauuguggcccugaagguccuuuuuaaaucucaaaucgagaaggaaggccuggagcaucagcuccgcagagagauugaaauccaggcucaucugcagcaccccaacauucugcggcucuauaauuacuuccacgacgcccgcagaguguaucugauccuugaguacgcgccuagaggggaacuguauaaggagcuccagaaaagcgagaagcuggaugaacaacgcaccgccacaaucauugaggaacuugcugacgcccugaccuacugccaugauaaaaagguuauccacagagacauuaaacccgagaaccuccugcugggauuucggggcgaagugaagaucgcugauuucggcugguccguccacacaccuucucuccgcagaaagaccaugugugggacacuggacuaucuuccgcccgagaugauugagggacggaccuacgaugaaaaaguggaccuguggugcaucggcguucucuguuacgagcugcuugugggguauccucccuuugaaagcgccucccauagcgagacguaccgccggauucugaaggucgaugugcgguucccucucucuaugccccugggagcgagagaccugaucucccgccuccugcgguaucagccgcuugaaagacugccucucgcccagauccugaaacaccccugggugcaagcucauagccgccggguccuuccucccugcgcccagauggcuucuuga

SEQ ID NO: 66274 - RNA, 3708 nt, Artificial Sequence
  derived and/or modified sequence opt5 from AUTS2__Homo_sapiens__NP_001120703
auggacggccccaccagagggcacggacugcggaagaaacgcagaagccggucccagcgcgauagagagcggcgcucuagaggcgggcucggagccggcgcugccgggggaggcggcgcggggcggacacgcgcucugagccuugccuccucuagcggauccgacaaggaagauaacggcaaaccuccgucuagcgcccccuccagaccucggcccccucgcagaaagcggcgcgagagcacgucugcugaagaggacaucauugauggguucgccaugaccuccuuugugacauucgaagcucuggagaaagacgucgcccucaagccccaagagagaguugaaaagcggcagaccccucugacaaagaagaaaagagaggcgcuuaccaauggacugagcuuucauucuaagaaaucccgccucagccacccgcaucacuacucuuccgaucgggaaaacgacagaaaucugugccagcaucugggcaagcgcaagaaaaugcccaaggcccuccggcagcugaaaccugggcaaaacagcuguagagauuccgacucugagagcgcuuccggagagagcaagggcuuccaccggucuuccagccgcgaaagacuuucugauagcuccgcccccucuagccugggcacaggguauuuuugcgacuccgauagcgaccaggaggaaaaggcuucugacgccuccagcgagaaacucuucaauaccgugaucgugaacaaagauccugaacugggagucggcacgcuucccgagcacgacucucaggaugcggggccgauugugccuaagaucuccggacuggagcgcagccaggaaaagucccaagacuguugcaaagagcccauuuuugaaccuguugugcucaaggaucccuguccccaggucgcccagccuaucccgcagccccaaaccgagccucagcugcgggcucccucuccugaccccgaucuggugcagagaacagaagccccgccucaacccccuccccucagcacccagccuccccagggcccgccugaggcucagcugcaacccgcuccccagccucagguucagcgcccgccccggccucaaucccccacacagcuucugcaucagaaucucccucccgugcaggcccacccuucugcccaaagccugucccagccccuuagcgcguacaacucuuccagccugucucucaauucccugagcucuagcagauccagcaccccggccaaaacgcagccugcucccccucauaucucucaccaccccuccgccagcccguucccucugucccuccccaaccauucuccucugcacagcuuuacacccacccuucagcccccugcccauucccaccauccgaauauguucgcucccccuacagcccugcccccucccccuccgcucaccucugggagccugcaagucgcgggacaccccgcuggcuccaccuauucugagcaggacauucuucggcaggaacugaacacacgcuuucucgccagccaauccgccgauagaggcgcuagccuggggccucccccuuaccugcggacggaguuccaccagcaucagcaccagcaucaacacacccaccagcauacacaccagcauaccuuuacacccuucccgcacgccaucccucccaccgcuauuaugcccacgccugcgcccccuauguucgacaaguauccgacaaaaguggaucccuuuuacagacauucucucuuccacuccuauccucccgccgugagcggaaucccucccaugauuccgccuaccggccccuuugggucucugcagggagccuuccaaccuaaacuuaccgaccccuuucgcccuaugcugcggaagcccggcaaauggugcgcuaugcacguccauaucgccuggcagauuuaccaccaucagcagaagguuaaaaagcaaaugcaguccgacccgcacaaacucgauuucgggcugaagccugaauuucugagcagaccucccggccccucucuuuucggagcuauccaucacccgcacgaccucgcccgccccuccacacuguuuagcgcggccggcgcugcccauccuaccgggacacccuucggaccucccccucaccauuccaauuuucugaacccggcugcccaccucgagcccuucaauagaccuagcacguuuaccggccuggccgcugucgggggaaacgcguucggcgggcuuggcaaccccucugugacaccuaauagcauguucggacacaaggauggccccuccgugcagaacuuuucuaauccgcaugaaccuuggaaccggcugcaccgcaccccucccagcuuccccacacccccuccguggcucaaacccggggagcuggagagauccgccucugcugccgcccaugaccgggaucgcgacguggauaagagagacagcuccguuucuaaagaugacaaggaacgggagagcguggaaaaacgccacuccagccauccuucucccgcuccuguccugcccgugaaugcccuuggacacaccagauccagcacggagcaaauccgggcgcaccucaacaccgaggcucgcgaaaaggauaagccgaaagagagagaacgggaccauucugaguccagaaaggaucuggccgccgacgaacacaaagcuaaggagggccaucugccugagaaagacgggcacggacacgaaggccgcgccgcgggggaggaagcuaagcagcucgcccggguucccagcccuuacgugagaacacccgucguggaguccgcccgcccuaauucuaccagcucccgggaagcugagcccagaaaaggcgagccggccuaugaaaacccuaaaaagagcucugaggucaaggugaaggaggaacgcaaagaagaucaugaccugccucccgaggcuccccagacacaccgggccuccgagccgcccccucccaauagcucuagcuccguucauccuggaccccuugcgucuaugccuaugaccgugggcgucacggggauucaccccaugaacagcaucuccucucuggauagaacacgcaugaugaccccguuuaugggaauuagcccucuccccggcggggaacgguucccuuaccccuccuuucauugggacccgaucagagauccucugcgggaccccuaucgcgagcuggauauucacagacgggacccccuuggacgcgauuuccuccugagaaaugacccucugcaccggcucagcacacccagacuguacgaagccgaucgcucuuuucgggacagagagccucaugauuauucccaccaucaccaccaucaccaucacccgcuuagcguggacccccgccgggagcaugaaagaggcgggcaccuggacgagcgcgaacggcuccacaugcugagagaggauuacgaacauacccgccugcacuccguucauccugcuucucuugacggccaccucccccauccuagccugaucacccccggacugccuuccaugcacuauccgagaaucucucccacagccggcaaccagaaugggcuccugaacaagacgccucccaccgcugcccuuagcgccccucccccgcugauuuccacacucggaggccggccugugagcccccgcagaaccacaccccugucugcugagauccgggagcgcccucccucccacacccugaaagauauugaagcgagauga

SEQ ID NO: 66275 - RNA, 1089 nt, Artificial Sequence
  derived and/or modified sequence opt5 from AVEN__Homo_sapiens__NP_065104
augcaggccgagagaggcgcucgcgggggacggggcagacggcccgggcgcggaagaccuggcggggaccggcacagcgaacgcccgggagccgcggcugccguggccagaggcggcgggggaggcgggggaggcgaugggggaggccggcgcggcagagggcggggacgcggcuucagaggggcucggggaggccgcgggggaggcggcgcccccagagggucccggagagagccuggaggcuggggagcuggggccucugcgcccgucgaagacgauagcgacgccgagaccuacggcgaagagaacgaugagcaagggaauuauuccaagcgcaaaaucguuucuaacugggaccgguaccaggauauugaaaaggaggugaauaacgaaagcggcgagucccagagaggaacagacuuuucugugcugcucagcuccgcuggcgauagcuucucucaguuucgcuucgccgaggaaaaagagugggacuccgaagcuagcugcccuaagcaaaauucugccuuuuaugucgauuccgagcugcuugugcgggcgcugcaggaacucccccugugucuuagacugaacguugccgcugagcucgugcaggggacggucccucuggaggugccgcagguuaaacccaagcgcaccgacgauggaaagggccuggggaugcaacucaaaggaccucugggccccgggggccggggaccuaucuucgaacuuaagagcguggccgcuggcugccccguccugcucgggaaagacaauccgucuccuggacccuccagagacagccagaagccuacaucuccccugcaguccgccggcgaucaucuugaggaggaacuggaccuccugcugaaccucgaugcccccauuaaagaaggggacaauauccugccugaucagaccagccaagaccuuaaguccaaggaggauggagagguggugcaggaagaggaagucugugcuaaaccgagcguuacagaggaaaagaacauggagcccgagcagccuucuaccuccaaaaaugugacagaagaggaacuggaggacuggcucgauagcaugauuucuuga

SEQ ID NO: 66276 - RNA, 495 nt, Artificial Sequence
  derived and/or modified sequence opt5 from AVP__Homo_sapiens__NP_000481
augcccgacaccaugcugccugccugcuuccucggccugcuugcuuuuagcuccgccuguuacuuccagaacugcccgagagggggaaagcgggcgaugucugaucuggagcuccgccaaugucugcccugcggcccugggggaaaaggcagauguuuugggcccagcaucugcugugcugacgaacuuggaugcuucgugggcacagccgaggcccugcggugucaggaagagaauuaucucccuucccccugccagucuggccagaaggcuugugggagcggaggccgcugcgccgcuuuuggggucugcuguaacgaugaauccugcguuacggagccugaguguagagaaggauuccaccggcgcgccagagcgucugaccggagcaaugccacccaacuggauggcccggcuggggcccugcuccugcgccuugugcagcuggcuggagcccccgagccuuuugaacccgcgcagccugacgccuacuga

SEQ ID NO: 66277 - RNA, 444 nt, Artificial Sequence
  derived and/or modified sequence opt5 from AVPI1__Homo_sapiens__NP_068378
augggcacccccgccagcguggucuccgagccuccgcccuggcaggcuccuaucgaagccagagggcggaagcaagcgucugcuaacauuuuccaggacgccgagcugcuccagauccaggcccuguuucaacgcagcggagaucagcuugcugaagagagagcccagauuaucugggaaugcgcuggcgaccaccggguugccgaggcgcugaaacgccucagacggaagagacccccucgccagaaaccccuggggcauucccuucaccauuguucucggcugcgcauucucgagccucacagcgcccuggcuaauccgcaauccgccacagaaacggcuucuagcgagcaguaccugcauuccagaaagaaaagcgcccggauccgcagaaacuggcggaagucuggacccaccuccuaucuccaccagauccgccacuga

SEQ ID NO: 66278 - RNA, 1257 nt, Artificial Sequence
  derived and/or modified sequence opt5 from AVPR1A__Homo_sapiens__NP_000697
augagacugagcgccggccccgacgcugggccuuccggaaacucuagcccgugguggccccucgccaccggcgcggggaauacaucccgggaggcugaagcccugggagagggcaacgggccuccccgcgaugugagaaaugaggaacuugccaagcuggaaaucgcuguccucgccguuacguucgcuguggccgugcugggaaacucuagcguccuucuggcgcuccaccggaccccucgcaaaacauccagaaugcaucuguuuauucggcaccugucucucgccgaccuggcuguggccuucuuucagguucuuccccaaaugugcugggauaucaccuaccgcuucagaggcccugacuggcugugucggguggucaagcaucuccagguguuuggcauguucgcuagcgccuauaugcugguugugaugacagcggaucgcuacauugccgucugccacccgcuuaaaacccugcagcagcccgcuagacggucccgccucaugaucgccgcugccugggugcugagcuuugugcugucuacaccucaauauuucgucuuuuccaugauugagguuaauaacgugaccaaggccagagacuguugggcuacguucauccagcccugggggagccgggcguacgugaccuggaugacaggaggcaucuuugucgccccugugguuauucucgggaccugcuauggauucaucuguuacaauauuuggugcaacgugcgcggcaaaacagcuucuagacaguccaagggggccgagcaggccggagucgcuuuucaaaagggcuuccugcuugcccccugugugagcucuguuaaauccaucagccgggcgaagauuagaaccgugaaaaugacguucgucaucgugacagcuuauauugucugcugggccccguuuuucaucauccagaugugguccgugugggauccuaugucuguuuggaccgaaagcgagaaucccacaauuaccaucaccgcccugcucggcucccugaacagcuguugcaauccuuggauuuacauguuuuucucugggcaucuucugcaggacugugugcaguccuuucccugcugccaaaacaugaaggaaaaauucaauaaggaggauacagacagcaugucucgccggcagacguuuuacagcaacaauagaucccccaccaacucuacaggaauguggaaggauagcccuaaauccagcaagucuaucaaauucauuccggucuccaccuga

SEQ ID NO: 66279 - RNA, 1275 nt, Artificial Sequence
  derived and/or modified sequence opt5 from AVPR1B__Homo_sapiens__NP_000698
auggacagcggcccccugugggaugccaacccuaccccgagagggacacucuccgcucccaaugccacgaccccuuggcugggacgggacgaggaacuugcgaagguggagaucggcguccuggcuacaguucucgugcuggccaccgggggaaaccuugccgugcugcucacacugggccagcuggggcgcaaaagaucucggaugcaccucuucguccugcaucuugcucugaccgaucucgccguggcucuguuucaaguucuuccccagcugcucugggacauuacauaccgcuuccagggaccugaucugcugugcagagccgugaaguaucuccagguccugagcauguuugcguccaccuacaugcuucuggccaugacgcucgaccgguaucuggcugugugucacccccuucgcucucugcaacagccuggccagagcaccuaccuccugaucgccgcuccguggcugcucgccgcgauuuucucccugccccagguuuuuaucuucucucuuagagaagugauucaaggcagcgggguccuggauugcugggccgacuuuggauucccuuggggcccccgggcuuaucucacauggaccacacuggccaucuuugugcuuccugugaccaugcugacggcuuguuacucccucaucugccaugagauuuguaaaaaucugaaggucaaaacacaggccuggcgcguugggggaggcggguggagaaccugggaucggcccagcccgucuacacuggccgcuaccacccgcggacucccuuccagagugagcucuaucaacacaauuucccgggcgaagauccgcacggugaagaugaccuucgucauugugcuggccuauaucgcuugcugggcccccuuuuucagcguucagauguggucugugugggacaaaaaugccccugaugaagacuccacaaacgucgcuuuuaccauuagcaugcuucugggcaaucucaacuccuguugcaaucccuggaucuacaugggcuucaacucucaucugcugcccagaccucuucggcaccucgccuguugcgggggaccgcagcccagaaugcgccggagacugagcgauggcucccugagcucucgccacacaacccuccugacgcgguccagcuguccugcgacacuuucucugagccucucccugacccugucugggagaccccgcccugaggagagcccccgggaccuugaacucgcugacggagagggcaccgccgaaacaaucauuuucuga

SEQ ID NO: 66280 - RNA, 930 nt, Artificial Sequence
  derived and/or modified sequence opt5 from AVPR2__Homo_sapiens__NP_001139623
augcugauggccagcaccacauccgcugugcccggccacccuucucucccgagccugcccuccaacucuagccaggagagaccucuugacacgcgggauccccugcucgcccgcgcggaacuggcccuucuguccaucgucuucguugcuguggcccucucuaaugggcuggugcuggcugcccucgcuagacggggacgcagaggccauugggccccuauucacgucuuuaucgggcaucugugccuugcggaccuggccguggcucucuuccaaguucugccccagcuugccuggaaggcuaccgaucgguuucgcggaccugacgcccuguguagagcggugaaauaccuccagauggucggcauguaugccagcuccuacaugauucuggcuaugacacuggaucggcaccgcgccaucugcagaccgaugcucgcuuaucggcaugggagcggagcccacuggaaccgccccgugcugguugccugggcuuucucucuucugcucucccugccucagcuuuuuauuuucgcgcaaagaaauguggagggcggcagcggggucaccgacuguugggccugcuuugcugaacccuggggacggcgcacauacgugaccuggaucgcccugaugguguucgucgccccuacacucggcaucgcugccugucagguucugauuuuuagagagauccacgcgucucuggugcccgggccguccgaacggccuggaggcagacgccgggggagacgcaccggaagccccggcgagggcgcucaugugucugccgccgucgcuaagacggugcggaugacccucguuauuguggucguguauguucugugcugggccccuuucuuucuugugcagcugugggcugccugggaucccgaggcgccccucgaagggggauguuccagaggcuga

SEQ ID NO: 66281 - RNA, 987 nt, Artificial Sequence
  derived and/or modified sequence opt5 from AWAT1__Homo_sapiens__NP_001013597
auggcucacagcaagcagcccucccauuuccaaucucugaugcuccugcaguggccucuuagcuaccuggcuaucuuuuggauucuccagccgcuguucguguaucuucuguuuaccucccucuggccccugccuguccuguacuucgccuggcucuuucuggacuggaaaacacccgagagaggcgggcggcgcucugcguggguuagaaacuggugcguguggacgcacauccgggauuauuucccuauuaccauccuuaagacaaaagaccugagccccgaacauaauuaccucaugggagugcacccucauggccugcuuaccuuuggggcuuucuguaacuuuugcacagaggccaccggauucuccaagacauuuccgggcauuacgccccaccuggccacccucucuugguucuuuaaaaucccuuucguccgcgaauaucugauggcuaaggggguguguagcguuucccagcccgccaucaauuaccugcucagccacggaaccggcaaccuggugggcauugucguugggggagugggcgaggcccuucaaucugugccuaauacaaccacacugauccuccagaagagaaaaggguucguccggaccgcucugcagcauggagcgcaccuugugcccacguuuacauucggcgaaaccgagguguaugaucagguccuguuucauaaggacucccgcauguacaaauuccaaagcugcuuuagacggauuuucggguuuuacuguugcguuuucuauggacagucuuuuugucagggcuccacaggccuccugccguacagccgcccuaucgugaccguggucggggagccccugccucucccccagauugaaaagcccucucaagagaugguggauaaauaucacgcccuguacauggacgcccuucacaagcuguucgaucagcauaagacccacuauggaugcuccgaaacacagaaacucuuuuuccuguga

SEQ ID NO: 66282 - RNA, 3039 nt, Artificial Sequence
  derived and/or modified sequence opt5 from AXDND1__Homo_sapiens__NP_653297
augagccugcccaagaccccuuccacaccgcucaacucuacgagcaccuccgagucuaaaaagcugaaagugagcgucgccaaggaaggcacaagagggcuucccgagcugaaagaaaagaagaauaugguugaccgguccaaacuccugccuaccucucuucagaacgaguucauccccaaggaagugcugcucagccugacauacgcugccaaugcgggaccuugccccgagaaccugcucccuccgaaaaagauuaaaacccccaagggcacacugccucgccuuguggaucacgucuggcaucaccccgugagacggaauaaguuuaaauaucugaucgaccauccuguuucccucaccggggcuggacgcgauauuagcuuccuguacgacgugacguaugccaagggccaaaccagagagaaagccgucugucccccgcaccuugcucggucucugcagucccaugauggggugaucguuccucacaagcccaaaacacucaccgacacacugauuccugaagaguuucacaucgugagcucuaccggagucuccggccuggaaugcuacgaugacaaguauacgacacuccugaccgauagcgagaaccgccuucugcuguuccccucuaugaaacccaauaagagaguggagguggcccagcugaacgacgucauggauacaaugcuugaacgggcuggcguugagaaucaggaauacaccgggccuaccaagaugcauaaacugcuccacauccugaagaaagagcaaacaauuuauaacaugaucuuucaugaacugauucgccagguguccguggacugugccgauagaggagagcuccugagcaagguccgggagcgcuacgugcagaugcuugaccagaucgcgagacaaaugauugacuucuacaaagaucugguuacgcagcgggugauggaccagcgcauccucgaagaacuguauaauuuuaagcacgucauugaagaacuuaccagagaacugugccucgugcgggcccacgauguuaagcugacaaaagagaccgagaaggcucauaaagaccuggcccaggcucuccugaacgccgaaaagaaugcgaaaaucguggaggaauaccacgaucuuuauacacugcaaagagagcgcauggaaaacgacaugaagaagcucgucgccgagcgggauaucugguccucugcuaccuacgagcuggcccugaaagugauugaaagaaaucgcgucauccuugcucggagacucuaucugaacgagaagggcuggaacaaauacacgaagcauuucauuauccugcucagcaauaaagacacagaagaucuggcccuucugcagaagcucacccagaaguggcgcaaccuggugaauaaacugaagcaagagguugagcagauggaagaguccaccagcgaaacacuuaaaauugugaaggacgggcucaucaaauggcaggaguuuuucaacgaaaaggauauccugucuccgaauaaaggaaacauuuuuaauuccguccugcucgacuucaagcaguggcaaaagauccugaacgagaaaaaggaggaauuuaccggcgacgugcuucugagcaaauaugauacacucaagauuaucaaacaccuccaggagaauugggccgacauugggcugggaaucuucaaccggcauaagucucuugaaggcgagaugcccagcgaaagacaguacauggaggagaucauuaagaauauccagaaacucuacaaggaauaugagauucgcaucaacggcgauaauggguacuccaaaauucugccuucucugaucagcucccucgacuucuguagcuuuaagcuggaaaaccuugaguuccccgauacgccucuggaagaguggcaagagauugacgagaaaaucaaugagaugaagucucaccucgauauccugcugaaccuuaccggaauuguuccccagcacaucgacguggauuccgucagcgugcuccaggcuuauauuuuuaacaugauccagcaauggcugcugaagauuggcaaugaaaucaacaaugggaacaucgagcuccagcaucacauggacgagcugcauauuucuaugauccaguggauggugaaucuucugauucucaugaucccgaacuucacagaucaggacugccugcugaaacuugaagaggaauccgcggagaagcacgauauuggaguugcccggcuggaacucgacgcuaucgagcugaccagaaaacucuaccaauauagcuccuaccugucuagcuguugcaagggcauggucacagccauggcccuuuccaaaucuaccaauagccacaagaacgcuacggaggaccuguaugaaguggauaagcucaaaaaggaguguuacgaauggaucaauaccugcuccugucugcugagcaacauuaaagggcgcaagaucacacuucugaccuacgaggaaauugagcggcuccuggaggaagaggccgugaaagaauuuaucgagccugaaauugacgagucuuucaaggaggaugaagaggaauccaaagaggacagaaagcuccaggaggaaaauaaggagcgggcggaggagcagcccagcacaucuaccgaaaaagagaagcugauccgcuuuaucggagaggaugaaaacguccauuccaaaccucuuuucgagacggacgugcugagcucuuggagagaaagcgcuaagcaaggcacacucgcccagaaauaucuggaggccauggcuguuauugaacacaugcaggagaagcugcuugagguggaaaaucgggccagacaggcugaggaaaaguuugaggaugccuacgaaaaacugcaucacacccucaucaagaacaaagaccuggaggagcucgucaugacaucccgcaaggaaagcaaagaggaaaaggagaaucaagaugagcgggaagugaaggaggaagaggaacagcaggaggaggaagagguuagaucugcggaaaacuccagcaaaucccccaagaaaggccauuga

SEQ ID NO: 66283 - RNA, 2589 nt, Artificial Sequence
  derived and/or modified sequence opt5 from AXIN1__Homo_sapiens__NP_003493
augaacauccaggagcaaggcuucccccuggaccucggggccagcuuuaccgaagaugcuccuagaccgcccgugccuggagaggaaggcgagcuggucuccacagacccccggccugccucuuacagcuucugcuccgggaagggaguuggcauuaaaggggaaacgucuaccgcgacaccccgcagaagcgaucuugaccugggauaugagccugagggcuccgcuucuccgacacccccuuaccucaagugggccgaaagccugcacucccuucuggaugaccaggauggcaucagccucuuucggaccuuccugaaacaggaggggugugccgaccugcucgauuuuugguucgcuugcaccggauuucgcaagcuggaacccugugacucuaaugaggagaaaagacuuaagcuggcccgggcuauuuaucgcaaguacauccucgauaacaauggcauuguguccagacagacaaaaccugccaccaagagcuucaucaaagggugcaucaugaagcaacugauugaccccgcgauguuugaucaggcccagacggaaauccaggcuaccauggaggaaaacacauauccgucuuuccuuaaauccgacauuuaccuggaguauacccggacaggaagcgaaucuccuaagguguguuccgaccaaagcuccggcucugggaccggaaagggcaucagcggcuaccuccccacgcugaaugaggaugaggaauggaaaugcgaccaggauauggacgaggaugacgggcgcgaugccgcuccucccggaagacugccccagaagcuccugcuugaaacagccgcgccucgggucuccagcucucgcagauacuccgagggccgggaauuucgcuaugggagcuggagagagccggugaaccccuacuauguuaaugccggauacgcucuggccccugcuaccucugccaacgacagcgagcagcaaucccucucuagcgaugccgacacacugucccuuaccgauagcucuguggacggcauucccccuuaucggaucagaaaacagcaucgccgggaaaugcaggaguccguccaagugaaugggagaguuccccugccgcacauuccucgcaccuaccgggugcccaaggaagucagaguggagccucagaaauucgcugaagaacucauccaucgccuggaggcggugcagcggacaagagaagccgaggaaaagcuggaggagcgccucaaacgggucagaauggaagaggaaggagaggacggcgaucccagcucuggcccucccgggccgugucacaagcugccucccgcucccgccuggcaucacuuuccuccgcgcugcguugacaugggaugugccggccuucgggaugcucacgaagagaaccccgaguccauccuggacgaacaugugcagagagugcuccggacgccugggcgccaaagccccggaccuggccacagaucccccgauucugggcaugucgccaagaugccuguggcgcugggcggagcugccagcggccacgggaaacacguucccaaguccggagccaaacuugacgcugccggccugcaucaccaucggcacgugcaucaccacguccaucacucuaccgcuagaccgaaggaacagguggaagccgaggcgacacgccgggcccagagcuccuucgcuugggggcucgaaccucauagccacggagccagaucucgcggcuauuccgagagcguuggggcugcccccaaugcgucugauggccuggcccacuccggaaaagugggcgucgcuugcaagagaaacgccaagaaagcugagagcgggaagucugccagcaccgaagugccuggagccuccgaggacgcugagaaaaaucagaagauuaugcaauggaucauugagggcgaaaaagagaucagccggcaucgcagaacagggcacggaucuuccggcacccggaagccccagccgcaugagaacagccgcccucugucccucgaacaccccugggcggggccucagcugagaacgucuguccagcccagccaucuuuucauucaagaucccacaaugccuccgcaccccgccccuaauccccugacccagcucgaggaagcucggcgcagacuggaggaggaagagaagcgggccucccgcgccccuucuaaacagagauacgugcaggaaguuaugcggagaggccgcgcuugugugcggcccgccugcgcgccuguccugcacgugguuccggcugugagcgacauggagcuuuccgaaaccgagacaagaucucaacgcaaggucggaggcgggagcgcccagcccugcgauuccaucgugguggccuacuauuuuuguggagagccuauccccuaccggacccucguuagaggccgcgcugucacacuggggcaguucaaagaacugcucacgaagaaaggaagcuaucgguacuauuuuaagaaggugucugacgaguucgauugcggcguggucuuugaagaggugagagaagacgaggccguucugccuguguucgaggagaaaauuaucgggaaggucgagaaaguggacuga

SEQ ID NO: 66284 - RNA, 2532 nt, Artificial Sequence
  derived and/or modified sequence opt5 from AXIN2__Homo_sapiens__XP_011523623
augagcuccgccaugcuggugaccugccuccccgacccuucuagcuccuucagagaggaugcuccgcggcccccuguccccggcgaagagggggaaacaccucccugucagccuggaguuggcaaggggcaagugacgaaaccgaugcccgugucuagcaacacccgcagaaaugaggacggacugggcgaaccugaggggcgggccucccccgauucuccucuuacacgcuggaccaagagccugcacucccuccugggagaccaggauggcgcguaccuuuuuagaacauuccuggagcgggaaaaaugcgucgacacccucgauuuuugguucgcuuguaacggcuuucgccagaugaaucugaaggacacaaaaacccugagaguggccaaggccaucuauaagcgguacauugagaacaauagcaucguuucuaaacagcucaagcccgcuacgaaaaccuauauucgcgaugggaucaagaaacaacagauugacuccaucauguucgaucaggcccagacagaaauccaaagcgugauggaggagaacgcuuaccagauguuucugaccucugacauuuaucuugaauacgucagauccggaggcgagaauacagccuauaugagcaacgggggacugggcucucucaaggugguuugcggguaccugccgacccuuaaugaagaggaagaguggacgugugcggauuucaagugcaaacuguccccuacaguggucggacucagcuccaagacccugcgggccacagcuucugugcgcagcaccgagaccguggacuccggcuaccggagcuuuaaaagaucugaccccgucaacccuuaucauaucggcuccggguacguuuucgcccccgcuacaagcgccaaugauucugaaauuagcuccgacgcgcugacggaugacucuaugagcaugaccgauuccagcguggacggaaucccgccuuaucgcgugggcucuaagaaacagcuccagagagagaugcaccgguccgucaaggccaacgggcaagugagccugccgcauuuucccagaacacaccgccuuccuaaagaaaugacccccguugagccugcuacauucgccgcugaacugauuucucggcucgagaagcugaaacuugagcuggaauccagacauagccucgaggaacgccugcagcagauccgggaggaugaagagagagagggauccgaacugacccucaauucucgcgagggcgcccccacgcaacacccgcugagccuucugccuuccgggucuuacgaagaggacccccagacaauucucgaugaccaccugagccgggugcuuaaaaccccuggaugucagucccccggcgucggcagauauagcccucgcucucggucccccgaucaucaccaucaccaccauagccaguaccacucucugcucccgccugggggaaagcugccucccgccgcugcgucccccggcgccugcccgcugcucgggggaaaaggcuuugugaccaagcaaacaaccaaacauguucaccaucacuauauccaccaucacgcugugcccaagacaaaggaggaaaucgaggccgaagccacgcagagaguccauuguuucugcccugggggcagcgaguacuacuguuauucuaaaugcaagagccacuccaaagcucccgaaaccaugccuagcgagcaguucggaggcucucgcggguccacacugcccaagcggaacggaaaaggcaccgagccugggcuugcccugcccgcgagagaaggaggcgcucccgggggcgccggagcccuccagcugccucgggaggaaggcgaccgcagccaagacguguggcaguggaugcuggaguccgaaagacagucuaagcccaagccucacagcgcucaguccacaaagaaggccuacccccuugagucugcucggagcuccccgggggagagagccucucgccaucaccucuggggaggcaauagcgggcauccucggaccacgcccagagcgcaccuguuuacccaagauccugccaugccuccccugacacccccgaacacccucgcucagcuggaagaggccugccgcagacuugcugaagucuccaaacccccuaagcagcgguguugcguggccagccagcaacgcgacagaaaccauucugcgacaguucagaccggagccacgcccuucuccaauccuagccuggcucccgaggaucacaaagaaccuaagaagcucgccggcgugcacgcucugcaggccucugagcuggucgugacauacuuuuucuguggggaggaaauuccguaucggcgcaugcuuaaagcccaaucccucacccugggccauuuuaaggagcagcugagcaaaaagggaaacuauagauacuauuucaaaaaggcuucugacgaauuugcgugcggcgccguuuucgaggagaucugggaagaugagacagugcuccccauguacgaagggcggauucugggaaaagucgagcgcaucgacuga

SEQ ID NO: 66285 - RNA, 2658 nt, Artificial Sequence
  derived and/or modified sequence opt5 from AXL__Homo_sapiens__NP_001690
auggccuggagaugcccccggaugggccgcgugccucuggcuuggugucucgcccugugcgggugggcguguauggcuccgagaggaacccaggccgaggaaagccccuucgucggcaacccugggaauaucacaggagcccggggccuuacggggacccugcgcugccaacuccagguucagggagagcccccugaagugcacuggcugagagacggccagauucuugagcuggcugauuccacacaaacccaggugccccucggcgaagacgagcaggaugacuggaucgucgugucucagcugcggauuacaagccugcaacucuccgauaccgggcaguaccagugucugguuuuucuuggacaucagacauucgugucucaaccuggcuaugucgggcuggagggacucccguacuuucuggaggaacccgaagaccgcaccguggccgcuaacacgccuuucaaucuuagcugccaggcccagggcccuccugagcccguugaucugcucuggcugcaagacgcggugccgcuggccaccgcuccugggcacggaccccagagaucccuccaugucccuggccugaacaagacaucuagcuuuuccugugaggcccacaaugcuaaaggcgugaccacaagccggaccgccacgaucacagugcuuccccagcagccccgcaaccugcaucucgucucuagacaaccuaccgaacuggagguugcguggacaccggggcuuuccggaauuuauccccugacccacugcacccuccaggccgugcugagcgaugacggcauggggauccaggcuggagaaccugaucccccugaggaaccccugacaucucaggccuccgugccgccucaccaacuccggcugggcagccuucauccccacacgccuuaccauauccgcgucgcuuguaccucuucccaggggcccagcuccuggacacacuggcugccuguggagacccccgagggaguuccgcucggcccucccgaaaauauuucugccacaagaaacggcagccaggccuucgugcacuggcaggagccccgggcuccucugcaagggacccuucugggauaucgccucgcguaccagggccaggacacgccggaaguccugauggauaucgggcugagacaggaggugacacucgaacugcaaggagacggcuccguuagcaaucuuaccgugugcgucgccgcuuauaccgccgccggggacggccccuggucucugccugugccccucgaggcuuggcggccugucaaggagcccuccacacccgccuuuagcuggcccuggugguacgugcugcugggagcgguuguggcugccgccuguguccuuauucucgcucuguuccuggugcauagacgcaaaaaggaaacccgguacggcgagguuuuugaaccgacaguggagagaggggaacucgucgugcgcuaucgggugagaaaaucuuacagccgccggacgaccgaggccacacugaacucccuuggaaucucugaggaacugaaggagaagcucagagauguuauggucgaccgccacaaaguggcucugggcaagacccugggggaaggagaguucggcgccgugauggaggggcagcuuaaucaggaugacagcauucucaaagucgcggugaagacaaugaaaaucgccauuugcacccgguccgaacuggaggauuuucugagcgaagcuguuugcaugaaggaguucgaccauccuaacgugaugagacucaucggcgucuguuuucaaggaucugaacgcgaguccuuccccgccccugugguuauccugcccuucaugaagcacggcgaucuucauagcuuucugcucuauucucggcugggggaccagccgguguaccugccuacgcagaugcuugucaaauucauggcugauauugccuccggaauggaguaucucagcaccaagagauuuauccaccgggaccuggcggcccgcaauugcaugcugaacgaaaauauguccguguguguugcugauuucggccucucuaaaaagauuuacaacggggacuauuacagacagggacggaucgccaaaaugcccgugaaguggauugcuaucgagagccuggccgacagagucuacacauccaaaucugauguguggagcuuuggcgugaccaugugggaaaucgccacacgcgggcaaaccccuuaucccggcgucgagaacuccgaaauuuacgacuaucuucggcagggaaauagacugaagcagcccgcugauugccucgacggccuguacgcgcugaugagccgcuguugggagcuuaacccucaggauagaccgucuuucacggagcuccgggaagaccuggagaauacacugaaggcccugcccccugcucaagaacccgaugagauccucuauguuaacauggacgaagggggaggcuacccugagcccccuggggccgccggaggcgcugauccgcccacccagccugaccccaaagauuccugcagcugucuuacagccgcggaggugcacccugcugggcgcuaugugcugugccccucuaccaccccguccccugcccagcccgccgacagaggcagccccgcugccccuggacaggaagauggcgcguga

SEQ ID NO: 66286 - RNA, 897 nt, Artificial Sequence
  derived and/or modified sequence opt5 from AZGP1__Homo_sapiens__NP_001176
auggugagaaugguccccguucugcucagccugcuucugcuccugggcccugccgugccgcaggagaaccaagacgggcgguacucccuuaccuauaucuacacaggacugucuaagcacguggaagauguccccgcuuuccaggcccucggcagccugaaugaccugcaguuuuuccgcuauaacuccaaagauagaaagucucagccuauggggcucuggcggcaaguggagggaauggaagacuggaaacaggauagccagcugcagaaggcgcgcgaggacauuuuuauggaaacgcuuaaagauaucguugaguacuauaaugacuccaacggcucucaugugcugcaagggagauucggaugcgagauugaaaauaaccggagcuccggcgcuuuuuggaaguacuauuacgauggcaaggacuacaucgaguucaauaaagaaauucccgccugggucccuuuugaucccgccgcucagaucaccaagcagaaaugggaggccgagccuguguauguucagcgcgcuaaggccuaccucgaagaggaauguccggcgacacugagaaaauaucuuaaguacagcaagaacauccuggaccggcaagaucccccuucuguggucgugaccucccaccaggcccccggggagaaaaagaaacucaagugccuggcuuaugacuucuacccuggaaaaauugacgugcauuggacacgcgccggcgaaguccaggagcccgagcugagaggggauguucuccacaauggaaacggcaccuaucaaagcugggugguggucgcugugccgccucaggacacagcccccuacucuugucauguucagcacuccagccuggcgcagccucuugugguccccugggaagccucuuga

SEQ ID NO: 66287 - RNA, 732 nt, Artificial Sequence
  derived and/or modified sequence opt5 from AZI2__Homo_sapiens__NP_001127904
auggacgcccugguggaggaugacaucugcauucucaaccacgaaaaggcucauaaaagagauaccgucacacccguuagcaucuacuccggcgacgagucuguggccagccacuucgcgcuggugacggcuuaugaagauauuaagaaacggcuuaaggacuccgagaaagaaaauucucugcucaagaagcgcaucagauuucuggaggagaaacuuauugcccgguucgaagaggaaaccagcuccgucgggcgcgaacaggugaacaaggccuaccaugcuuauagagagguuuguaucgaucgggacaaucugaaaucuaagcucgauaaaaugaacaaggacaauagcgagucccugaaggugcugaacgagcaacuccagagcaaagaagucgagcugcuucagcugcgcacagaaguggagacccagcaaguuaugagaaaucucaacccuccgucuuccaauugggagguggaaaagcugagcugcgaucuuaaaauccacggacuggagcaggaacucgagcugaugcggaaggaauguucugaccugaaaauugagcuccagaaggccaaacagacagaucccuaccaagaggacaaccugaagucccgcgaccuucagaagcugagcaucucuagacaguccauuugcagcaccgcuugguccgccgucgcgcagucuugggauagcaugaauuuugaagacuguucccucuucgccuga

SEQ ID NO: 66288 - RNA, 1092 nt, Artificial Sequence
  derived and/or modified sequence opt5 from AZIN1__Homo_sapiens__NP_001288597
augaagggcuucaucgacgaugccaacuacagcguggggcugcucgacgagggaaccaaucugggcaacgucauugauaauuauguuuacgaacacacacuuacggggaaaaacgcuuucuucgugggagaccugggcaagaucgugaaaaagcauucccaguggcaaaaugucguggcccagauuaaacccuuuuauaccguuaagugcaacucugcgccugcugugcucgagauccuggccgcccuugggacaggauucgcuuguagcuccaagaaugaaauggcccugguccaggagcucggcgugccgcccgaaaacauuaucuacaucucuccuugcaaacagguuagccaaauuaaguaugcugccaaagugggcgucaauauccugaccugugauaacgagauugagcugaagaaaaucgcgagaaaucaccccaacgccaaggugcuccugcauauugcuacagaagacaauaucgggggagaggaaggcaacaugaaguuugggaccacacuuaaaaauugccggcaucugcucgagugugccaaggagcuggaugugcagauuaucggagucaaauuccacguuuccucugcuugcaaggaaagccagguguacgugcacgcccuuuccgacgcgcgcugugucuuugauauggccggcgagaucggguucaccaugaacaugcuggacauuggaggcggcuuuacggggaccgaauuucagcucgaggaagugaaccacguuaucagcccucugcuggauauuuauuuucccgagggaucuggcgugaaaaucauuuccgagccugggagcuacuacgucucuuccgcuuucacacucgccgugaauaucaucgcuaagaaaguuguggaaaacgacaaguuuccgagcggagucgagaagaccggcucugaugaacccgccuucauguauuacaugaaugacgggguguauggauccuucgccagcaaacuguccgaggaccuuaacacaauuccugaaguccauaagaaauacaaggaggaugagccccuguuuaccucuagccucuggggcccuuccugcgacgaacuguucagauga

SEQ ID NO: 66289 - RNA, 1443 nt, Artificial Sequence
  derived and/or modified sequence opt5 from AZIN2__Homo_sapiens__NP_001288754
auggccggcuaccugagcgaguccgacuucgugauggucgaagagggguuuucuaccagagaucuccugaaggaacuuacacugggagcuagccaggccacgaccgacgagguugcggcuuucuuuguggccgaucucggcgccaucgugcggaaacacuucugcuuucugaagugucuuccccgcgucagaccuuucuaugcugugaaaugcaacuccucuccggggguucugaaggugcucgcccaacugggacugggcuuuagcugugcuaauaaagccgaaauggagcucguccagcauauugggauccccgcguccaagauuaucugcgccaacccuuguaagcagauugcucagaucaaauacgccgcuaagcacggaauccaacugcuuucuuucgacaaugagauggaacuggccaaagugguuaagagccaucccuccgcgaaaauggugcucugcauugccacagaugacagccacucucuguccugucuuagccugaaguuuggcgucucucucaaguccugccggcaucugcuggagaacgcuaaaaagcaccacguggaaguggucggcguuagcuuccauaucgggucuggauguccugauccccaggccuaugcucaguccauugccgacgcccgccucguguuugagaugggcaccgagcuggggcacaaaaugcaugugcuugaucugggaggcggguucccuggaacagaaggcgcuaaggucagauuugaggaaaucgcgagcgugauuaauuccgcccucgaccuguacuucccggagggcugcgggguugauaucuucgcugaacuuggacgguauuacgugaccucugccuuuacagucgccgugagcauuaucgcuaaaaaggagguucugcucgaccagcccggccgcgaggccccucugcccccuccccacaucgcgaccugugcugccuccgaaccgagcccucccgccgaggaaaacgggucuacguccaaaaccauuguguaucaccuggaugagggagucuacggcaucuucaauagcgugcucuuugacaacauuugcccuacacccauccugcaaaagaagcccucuaccgaacagccucuuuacagcuccucucugugggggccggcugucgacggaugcgauuguguggccgagggccucuggcugccccagcuucauguuggcgacuggcugguguucgauaauaugggggcuuauacagucggaaugggcagcccuuuuugggggacccaggccugccacauuacguacgcgauguccagaguggccugggaggcucuccggcgccaacugauggccgcugaacaggaggacgauguugaaggaguguguaaaccccugagcugcggcugggagaucacagacacccucugugucgggccuguguucacacccgccucuaucauguga

SEQ ID NO: 66290 - RNA, 756 nt, Artificial Sequence
  derived and/or modified sequence opt5 from AZU1__Homo_sapiens__NP_001691
augaccagacugacagugcucgcccugcuugcuggccugcucgccagcucccgggcggggucuagcccccugcuugacaucgucggaggccgcaaggcuagaccucggcaguucccguuucuggccuccauucaaaaccaggggcgccacuucugcggaggcgcccucauccaugcuagauuuguuaugacggccgcuucuuguuuccagagccagaaucccgggguguccaccgugguccugggagccuacgaucugcggcgcagagagcggcaaucucgccagacauuuagcauuuccagcaugucugaaaacggcuaugacccucagcagaaucucaacgaucugaugcuucugcaacucgacagagaggcgaaucugaccuccagcgugacaauccuuccccugccucuccagaacgccaccguugaagcuggcacacggugccagguggccggguggggaucucagcgcuccggcgggagacugagccgguucccccgcuuugucaaugugaccguuacgccugaggaucaauguagaccgaacaaugugugcaccggaguccugacacggagaggcgggauuuguaacggagacggcggcacaccccucgugugcgaagggcuggcucacggaguggccucuuucucccuuggcccuugugggcgcggacccgacuuuuucacccgggucgcgcuguuuagagauuggaucgauggcguucucaauaacccugggcccggaccggccuga

SEQ ID NO: 66291 - RNA, 360 nt, Artificial Sequence
  derived and/or modified sequence opt5 from B2M__Homo_sapiens__NP_004039
augagcagauccguggcccuggcuguccucgcccugcuuucucugagcggccucgaggcgauccagcggacccccaagauucaaguuuacucccgccacccugcugaaaacgggaaaucuaauuuccugaacugcuaugugagcggauuucauccguccgacaucgagguggaucuucugaagaauggcgaaagaauugagaaagucgaacacucugaccucagcuucuccaaggauuggagcuuuuaccugcuguauuacacagaguucacgcccaccgagaaagacgaauaugccugucgggugaaccauguuacacucucucagccuaagaucgugaagugggaucgcgacauguga

SEQ ID NO: 66292 - RNA, 996 nt, Artificial Sequence
  derived and/or modified sequence opt5 from B3GALNT1__Homo_sapiens__XP_005247921
auggccagcgcucuguggaccgugcuccccuccagaaugucucugcggagccuuaaguggucccugcuccugcuuucucugcucagcuucuuugucaugugguaccugucccugccucacuauaacguuaucgagcgcgugaauuggauguacuucuaugaauacgagccgauuuauagacaggacuuucauuucacacuccgggaacacucuaacugcagccaucagaaucccuuucuggugauccuugucacgucccacccuagcgaugugaaagcccgccaggcgauuagaguuaccuggggcgagaagaaaucuugguggggguacgaagugcugacauucuuucuccugggacaggaggcugagaaggaagacaaaaugcuugcccugucccucgaggaugaacaucugcuguauggcgacaucauucggcaggauuuccucgacaccuacaacaaucugacacuuaagaccaucauggccuuucgcugggucacagaguucugucccaacgcuaaguacgugaugaaaaccgauacggacguuuuuaucaauaccgggaaccuggugaaguaucuccugaaucuuaaccacagcgagaaauucuuuacaggauacccucugauugauaauuauucuuacagaggcuucuaucaaaagacccacaucuccuaccaggaauaucccuucaaagucuuuccuccguacugcagcgggcucggauacauuaugucucgggaccuggugccccgcaucuaugagaugaugggccaugugaagccuauuaaguucgaagaugucuacguuggcaucugucugaaccuccugaaagugaauauucacauccccgaggacacaaaccuguuuuuccuuuauagaauccaucucgaugugugccagcugcggcgcgucauugccgcucacggguuuuccagcaaggaaaucauuaccuucuggcaagugaugcuuagaaauacgacaugucacuacuga

SEQ ID NO: 66293 - RNA, 981 nt, Artificial Sequence
  derived and/or modified sequence opt5 from B3GALNT2__Homo_sapiens__NP_001264084
augagaaacuggcuggugcuccugugccccuguguccuuggcgccgcucugcaccucuggcugcggcuucgcagcccuccgcccgccugcgcguccggggcuggaccugccggcgggguuucucugcuccugcccagacuggaguguaauggagccgugagcgcucauccuaaccuccaucugcccggcucccgggacucuccugccagcgcuucccagguggccgggaucaccgaucaacuugcgcuguucccgcaguggaagucuacacacuacgacgucgugguuggagugcucagcgcccgcaauaaccacgaacugagaaaugucauucgguccacguggaugcgccaucuucugcagcaccccacccucagccagagagugcugguuaaauuuaucauuggcgcucacggcugcgaggugccugucgaagaucgggaggaccccuauucuuguaagcugcucaacaucacaaauccugugcugaaccaagaaauugaggccuucucccuuagcgaggauaccucuuccgggcugcccgaagaccgcguggucagcguuucuuuuagagugcucuacccgaucgugaucacaucccugggagucuucuaugaugcuaaugacgugggcuuucagcggaacauuaccguuaaacuuuaccaggccgagcaggaagaggcgcuguucaucgcccgcuuuagcccucccuccugcggggugcaagucaauaagcucugguauaaaccuguggagcaguucauucugcccgaaucuuuugagggaacaaucguuugggaaagccaggaucugcauggccucguguccagaaaccugcacaaggucaccgugaaugacgggggaggcguccuucgggugauuacggcuggcgagggggcccugccccaugaguuccucgaaggaguugagggcguggcugggggauuuaucuacaccauucagggcaaguucgccagcuga

SEQ ID NO: 66294 - RNA, 1269 nt, Artificial Sequence
  derived and/or modified sequence opt5 from B3GALT2__Homo_sapiens__NP_003774
augcugcaguggagacggcgccacugcuguuucgccaagaugaccuggaacgcuaaaagaagccucuuucggacacaucugaucggcgugcuuucccuggucuuccucuuugccauguuccuguuuuucaaucaccaugacuggcuucccgggcgcgcgggauuuaaggagaacccuguuacguacaccuucagaggcuuucggucuacaaaaagcgaaaccaaucacuccucucugcgcaacauuuggaaggagacagugccgcaaacccucagaccccagacagcuaccaauagcaacaauacggaucuguccccucagggggugaccggacuggaaaacacacucucugccaauggcagcaucuauaacgagaaagggaccggacaucccaauuccuaccacuucaaguauauuaucaacgaaccugagaagugccaggagaaaagccccuuucugauucuucugaucgccgcugaaccuggccaaaucgaggcccggcgcgcuauuagacagacauggggcaaugaaucucucgccccggggauccagauuacccggaucuuccugcuuggacuguccauuaagcucaacggcuaccugcagcgcgcgauccuggaggagagcagacaauaucacgacauuauccagcaggaauaccucgauacguauuacaaucugacaaucaaaacccuuauggggaugaacugggucgccacauacuguccccauauuccuuaugugaugaagaccgacucugauauguuuguuaacaccgaguaccugaucaauaaacuccugaagcccgaccuuccuccccggcacaacuauuucacaggauaccugaugcgcggcuaugcuccgaauagaaacaaggauuccaaaugguacaugccucccgaccucuauccuagcgaacgguaccccguguucugcucugggacgggauacgucuuuuccggcgaucuggccgagaagauuuucaaagugagccugggcaucagacgccuccaucuggaagacguuuauguggggauuugucuugcuaagcugcggaucgaucccgucccuccgcccaaugaguuuguguucaaccacuggagaguguccuacucuagcugcaaauauucccaccucaucaccagccaucaguuucaaccuucugagcugauuaaguacuggaaucaccuucagcagaacaaacauaaugccugugcgaacgccgcuaaggaaaaggccggacgcuaucggcacagaaaacugcauuga

SEQ ID NO: 66295 - RNA, 1137 nt, Artificial Sequence
  derived and/or modified sequence opt5 from B3GALT4__Homo_sapiens__NP_003773
augcagcugagacucuuccggcgccugcuucuggccgcucuccugcuugugaucgucuggacccuguuuggccccagcgggcucggagaggaacugcugucccucucucuggccagccuucugccugcgccggcuucccccggcccuccccucgcccugccuagacuucugauucccaaccaagaggccugcucugggccuggagcuccgcccuuccuccugauccugguuuguacagccccugaaaaucucaaccagcggaaugcuauucgcgccagcuggggcgggcugagagaggcgcggggacuucgcgugcagacgcuguuucuccugggcgaacccaacgcccagcacccuguguggggcucccaagggucugaccuugcuagcgaguccgccgcucagggagauauccugcaggccgcguuccaggacagcuacagaaaucucacccugaagacacugucuggccucaacugggccgagaaacauugccccauggcucgguauguccugaagaccgaugacgauguguacguuaaugugccggaacuugucuccgagcuggugcuccgcgggggaagauggggccaaugggaacggagcacagagccucagcgcgaggccgaacaggaagggggacagguucugcacucugaagaggugccccuucuguaucucggcagaguccauuggcgggugaacccuucccgcacccccggcgggagacaccgggugagcgaggagcaauggccccauacauggggaccuuuuccgcccuacgcuucuggcaccggguauguccuguccgccagcgccguucagcugauucucaaaguggcuuccagagcgccucugcuuccccuggaggacguguucgucggagugucugcccgccggggcgggcucgcuccuacgcaguguguuaagcuggccggagccacccacuacccccuggauagaugcuguuauggcaaauuucuucucacaagccaccgccuggacccguggaagaugcaagaggcuuggaagcuggugggcggguccgauggagaacggaccgccccuuucugcagcugguuucagggcguccucgggauccugagaugucgcgcgaucgcuuggcuucagucuuga

SEQ ID NO: 66296 - RNA, 933 nt, Artificial Sequence
  derived and/or modified sequence opt5 from B3GALT5__Homo_sapiens__NP_149361
auggccuuccccaagaugagacugauguacaucugccuccuggugcuuggcgcucugugucucuauuuuagcauguacucccugaacccuuucaaagagcagucuuuugucuauaagaaagacgggaauuuccuuaagcugccggauaccgacugccggcaaacacccccuuuucucguucugcuggugacgagcucccacaaacagcucgccgaacgcauggcgauuagacagaccuggggaaaggagcggauggugaagggcaaacagcugaagacauucuuucuucuggggaccacaucuagcgcugccgaaaccaaagaggucgaucaagaaucccagcgccauggagacaucauucagaaggauuuccucgacguguacuauaaccugacacuuaaaaccaugaugggcaucgaguggguucacagauuuuguccccaggccgcuuucgugaugaagacggauucugacauguuuauuaaugucgauuaccugaccgagcuccugcugaagaaaaaccggacaacccgcuucuuuacaggguuccucaagcugaaugaguucccuaucagacaacccuuuagcaaaugguucguguccaagagcgaauauccuugggaccgguacccgcccuuuugcucuggaaccggcuacguuuucuccggcgauguggccagccaggucuauaacgugucuaaauccgugccuuacaucaaacuugaagacgucuuuguugggcugugucucgagcgccugaauauuagacuugaggaacugcauagccagcccacguucuuuccuggaggccuccgguucucugugugccuguuucgcagaaucguggcuugucacuucauuaagccccggacacugcucgauuauuggcaggcccuggagaacucccgcggggaagacugcccgccugucuga

SEQ ID NO: 66297 - RNA, 1497 nt, Artificial Sequence
  derived and/or modified sequence opt5 from B3GALTL__Homo_sapiens__NP_919299
augagacccccugccugcugguggcugcucgcuccgcccgcccugcuugcgcugcucaccuguagccuggcuuucggccuugccuccgaggacacaaagaaagaagugaagcagucucaagaucuggagaaaagcgggaucucccggaagaacgacauugaucucaaaggaaucgucuuuguuauucagucucagagcaauuccuuccacgccaagcgcgcugaacagcugaagaaaucuauccugaagcaagccgcugaccucacgcaggagcugccuagcgugcuucugcuccaucagcuggccaaacaggaaggcgcguggaccauucuuccccugcucccucacuuuuccgugacauacagcagaaacucuuccuggaucuucuuuugcgaggaggaaacccggauccaaauucccaagcugcuggagacacuccgcagauaugauccuagcaaagaaugguuccuggggaaggcccuucaugacgaggaggcuaccaucauucaccauuacgccuuuucugaaaauccgacagucuucaaguaucccgauuuugcugccggaugggcgcuguccaucccucucgugaacaaacugaccaagcggcuuaaaagcgagucucugaaguccgacuucacgauugaucucaaacacgaaaucgcccuguacauuugggacaagggcgggggacccccucugacccccguuccggaguuuuguacaaaugauguggacuucuauugcgcuaccacauuucacagcuuccucccucugugucgcaaacccgucaagaagaaagauaucuucguggccguuaagaccugcaaaaaguuucauggcgacagaaucccuauugugaaacagacgugggaaucccaggcuucucuuaucgaguacuauagcgacuacacagagaacuccauucccaccgucgaucugggcauccccaauacagaccgggggcacuguggaaagaccuucgccauucucgaacgcuuucugaacagaagccaggauaagaccgccuggcuugugaucguggacgaugacacacugaucucuauuucccggcuccaacaucugcugagcugcuacgauucuggcgagccugucuuccucggggaacgcuauggauacggccuggggacgggaggcuauagcuacaucaccggcgggggaggcaugguguuuuccagagaggcuguucggcgccuucuggcgucuaaauguagaugcuauagcaaugacgccccggaugacauggugcucgggauguguuucuccggacugggcauucccgucacacacagcccucuguuucaccaggcucggcccguggauuacccuaaggacuaucuuucucaucagguucccaucuccuuccacaaacauuggaacauugacccggugaaggucuacuuuaccuggcucgccccuagcgaugaagacaaagccagacaagagacacagaagggguuccgcgaggaacuguga

SEQ ID NO: 66298 - RNA, 1044 nt, Artificial Sequence
  derived and/or modified sequence opt5 from B3GAT1__Homo_sapiens__XP_011541055
augggcaacgaggaacccugggugcagccugcccuggagaugccgaagagacgggacauccucgcuauuguccugaucguucuucccuggacccugcucauuacaguguggcaccaaagcacgcuggccccucuucuggcggugcauaaagaugaaggguccgacccccgcagagagaccccucccggagcugauccucgggaauacugcacaucugaccgcgauaucgucgaggugguuagaaccgaguauguguacacacggccgcccccuuggagcgacacccuccccacaauucacgucgugaccccuacguauucccgccccguucagaaggccgaacugaccagaauggccaauacacugcuccaugugccgaaccugcacuggcuugucguggaggaugcuccucggcgcacaccccugaccgccagacuccugcgggacaccggccuuaauuacacgcaucugcacguggaaacaccucgcaacuauaaacucagaggggaugcucgggacccccgcauccccagaggaaccaugcagcggaaucuggcccugagauggcuccgcgagacauucccucggaacucuagccagccgggcgucguuuacuuugcggaugacgauaauaccuauucccuggagcuuuucgaagagaugagaucuacccgccgggugagcguguggcccgucgccuuuguugggggacugagauacgaagcuccucgcgugaacggcgccggcaagguggucggguggaaaacaguguucgacccccaccggccuuuugcuaucgacauggccggauucgcgguuaaucucagacugauucuucaacgcucccaggccuacuuuaagcugcggggcgugaaagggggauaucaggagagcucucuccugagagaacuggucacgcucaacgaucuggagcccaaggcugccaauuguaccaagauccuuguguggcauacacgcaccgagaaaccgguccuggugaacgaaggcaagaaaggguucacagacccuuccguugagauuuga

SEQ ID NO: 66299 - RNA, 972 nt, Artificial Sequence
  derived and/or modified sequence opt5 from B3GAT2__Homo_sapiens__NP_542780
augaaaagcgcccuguucaccagauuuuucauccuccugcccuggauucuuaucgugauuaucaugcuggacgucgauacacggcgcccuguuccgccccucacgccuagacccuacuuuuccccuuaugcugugggccgcgggggagcccggcugccccuuagacggggcgggccugcgcacggaacccagaagcgcaaccaaucuagaccgcagccccagccugagccccagcugccuacaauuuacgcuaucacccccacauauagccggccggugcaaaaggccgaacucacccgccuggccaauacauucagacaggucgcucagcugcauuggauccucguggaggacgccgcugcccgguccgaacugguuucucgcuuucuugcgagagccggccugccuagcacccaccuccaugugcccacgccucggcgcuacaaaagacccgggcugccccgggcuaccgagcagagaaacgccggacuugcuuggcugcgccaacggcaccagcaucagagagcccagccuggcguccucuucuuugcggaugacgauaauacauauucccuggaacuguuccaagagaugcgcaccacacggaaggugucuguuuggccggugggccucgucgggggaagacgcuacgagcggccccugguggaaaacggcaaaguggucgggugguauaccggauggagagccgaccgcccuuuugcuauugauauggccggcuucgcuguuagccuucaggugauccuguccaaucccaaggccguguuuaagcggagagggagccagccuggaaugcaagagucugacuuccucaaacagauuacgacagucgaggaacuggagcccaaggccaacaauugcaccaaagugcuuguuuggcacacacgcaccgaaaaggugaaccuggcuaaugagccgaaauaccaccucgauaccgucaagaucgaaguguga

SEQ ID NO: 66300 - RNA, 948 nt, Artificial Sequence
  derived and/or modified sequence opt5 from B3GAT3__Homo_sapiens__NP_001275652
augaagcugaaacucaagaacguguuccuggccuacuuucuugucagcaucgcuggccugcucuaugcccugguucagcuugggcaacccugcgacugucugccuccgcucagagcggcugccgagcagcugcggcagaaagaucugcgcauuucccagcuccaagccgaacugagacggcccccucccgcuccugcccagcccccugagccggaagcucugcccaccaucuacguggugacaccuacguaugcccgccugguccagaaggcggagcucgugagacugucucagacccuuagccugguuccccggcuccacuggcugcugguggaagacgccgagggaccuacaccccucgucuccggccugcuugcugccucugggcuucucuucacccaucuggugguucuuacaccgaaagcucaacgccugagagagggagaaccuggcugggugcacccccgcggggucgagcagcggaauaaggcccucgauuggcugagaggacggggcggcgcggucgggggagaaaaggacccucccccucccggcacccagggggugguguacuuugccgaugacgauaacacauauagccgcgagcuguucgaggaaaugagauggacccggggaguuuccguguggccggugggccucgucgggggacugcgcuuugagggcccccaggugcaagacggcagaguugugggguuccauacggcuugggaaccuucucggcccuuuccugucgauauggccggauucgcuguggcccuuccccugcuccuggacaaaccgaaugcccaguuugauagcaccgcuccuagaggccaccuugaguccagccugcucucucaucugguugaccccaaggaucuggaaccucgcgcggccaacugcacacggaccgaguccagaugugugacacaggcugggguccaauga

SEQ ID NO: 66301 - RNA, 1194 nt, Artificial Sequence
  derived and/or modified sequence opt5 from B3GNT2__Homo_sapiens__NP_001306004
augagcgugggcagacggcgcaucaagcugcucgggauucugaugauggccaacgucuucaucuacuuuauuauggagguuuccaaaucuagcucccaggaaaagaauggaaaaggcgaggugaucauucccaaggaaaaauucuggaagaucucuaccccuccggaggcuuauuggaacagagaacaagagaaacuuaaucggcaguacaaccccauccugagcaugcucacaaaucagacgggggaggccggacgccuguccaacauuucucaccuuaauuauugcgaaccugaccugagagugaccagcgucgugacaggcuuuaacaaucuccccgaucgguucaaggacuuucugcuguaccuccgcuguagaaacuauucccugcuuaucgaucagccugacaagugcgcgaaaaagcccuuccugcuccuggcuauuaaaagccuuaccccucauuuugcccggcgccaagccaucagagagucuugggggcaggaauccaaugcuggaaaccagacaguugugcgggucuuccugcucggccagaccccgcccgaggauaaucacccugaccugagcgauaugcugaaguuugagucugaaaagcaucaagacauucucauguggaacuaccgcgauacauucuuuaaucugucccuuaaagaggugcuguuccucagauggguuagcaccucuugucccgacacggaauuuguguucaagggcgaugacgaugucuucgugaacacccaccauauccugaacuaucuuaauucccugagcaaaacaaaggccaaagaccucuuuauuggggacgugauccacaacgcuggaccucaccgggauaagaaacugaaguacuacauccccgaggucguuuauuccggccuguacccgccuuaugccgggggaggcggguuccucuacucuggacaucuggcgcuucgccuguaucacauuaccgaccaggugcaucucuaccccaucgaugacguguauacaggcaugugccugcagaaacuuggccuggucccugaaaagcacaagggguuuagaaccuucgauauugaggagaaaaauaagaacaauaucuguagcuacguggaccucaugcugguucacucccggaaaccccaggaaaugauugauaucuggagccaacugcagucugcccaucucaagugcuga

SEQ ID NO: 66302 - RNA, 1119 nt, Artificial Sequence
  derived and/or modified sequence opt5 from B3GNT3__Homo_sapiens__XP_011525929
augaaguaccugagacaccggcgccccaacgccacccucauccuggcuauuggcgccuucacacuucugcucuuuagccugcuuguguccccuccgacgugcaaaguccaggagcaacccccugcgauccccgaagcucuggccuggccuacacccccuaccagaccggcccccgcuccuugucaugccaauaccucuaugguuacacaccccgacuucgcuacccagccucagcaugugcagaacuuucuccuguaucggcacugccgccauuucccccugcuccaagaugugccgccuagcaagugugcccagcccgucuuucugcuucuggugauuaaauccucuccuagcaauuacguuagacgggagcuccugcgcagaacaugggggcgggaacgcaaggugagaggacuucagcugcggcuccuguuccuggucggcaccgcguccaacccccacgaggcccgcaaagugaauagacuccuggaacuugaggcucagacgcacggggacauccugcaaugggauuuucaugacucuuucuuuaaccucacccugaagcagguucuuuuccugcaguggcaggagacacggugcgccaaugcuagcuuugugcucaacggagaugacgaugucuucgcccacaccgacaauaugguguuuuaucugcaagaucaugaccccggccgccaccuguucguggggcagcucauucagaacgucggaccuaucagagcguucugguccaaguacuauguuccggaaguggugacacaaaaugagcgguaucccccuuacuguggcggcgggggauuucugcuuagcagauucaccgccgcugcccugcgccgggcugcccacguccucgauaucuuucccauugacgauguguuccugggcaugugccuugaacuggaggggcucaaaccugccucucauuccggaaucagaacgagcggcguucgcgcucccucucagcggcuguccagcuuugacccguguuucuacagagaccugcuccuggugcaccgcuuucuuccuuacgagaugcugcucaugugggaugcgcugaaccagcccaaucugacaugcgggaaccagacccaaauuuauuga

SEQ ID NO: 66303 - RNA, 1137 nt, Artificial Sequence
  derived and/or modified sequence opt5 from B3GNT5__Homo_sapiens__XP_011511531
augagaaugcuggugagcggccggcgcgucaagaaauggcagcucaucauucaacuguucgcuaccugcuuucuugccucccugauguucuuuugggagcccaucgacaaccacauuguuucucauaugaaaagcuacuccuauagauaccucaucaauucuuaugauuucgugaacgacacacugagccuuaagcacacguccgccgggccucgguaccaguaucugauuaaucauaaggaaaaaugucaggcgcaggaugugcuccugcugcucuuugucaagaccgcuccggagaacuacgaccgcagaucuggaauccggcgcacauggggcaaugaaaacuaugugagaagccaacugaaugccaacaucaagacccuuuucgcccuggggacacccaauccucucgagggagaggaacugcagcggaaacuugcuugggaggaucagcgcuacaacgacauuauccagcaagauuuuguugacuccuucuacaaucugacccucaagcugcugaugcaguuuagcugggccaacacauauugcccccacgcuaaauuccucaugaccgccgaugacgauauuuuuauccauaugccuaaucugauugaauaccuucagucucuggagcagaucggcgugcaagacuucuggauugggagaguccaccggggagcgcccccuauccgcgauaaguccagcaaauauuacgugucuuaugaaauguaccaguggccggccuaucccgacuacacggcuggcgccgcuuacguuaucuccggcgacguggccgcgaaggucuaugaggccagccagacccucaacucuucccuguacauugaugacguguuuauggggcuuugugcuaauaagaucggaauugugccucaagaucacgucuucuucagcggcgaggggaaaacacccuaucauccuugcaucuacgaaaagaugaugaccucccacggacaucuggaggaccuccaggaucuguggaaaaacgccacagaccccaagguuaaaaccauuucuaagggcuuuuucgggcagaucuauuguagacugaugaaaaucauucuccugugcaagaucagcuacguggauacguauccgugucgggcugccuuuauuuga

SEQ ID NO: 66304 - RNA, 1155 nt, Artificial Sequence
  derived and/or modified sequence opt5 from B3GNT6__Homo_sapiens__NP_619651
auggccuuccccugcagacggagccugaccgcuaagacacucgccugucugcuugugggcgucuccuuucuggcgcuccagcaaugguuccugcaggcuccucgcucuccgagagaggaacggagcccccaggaggaaacgccugaggggcccaccgacgccccugccgcugaugaacccccuuccgagcuuguuccgggacccccuugcguggccaacgcuucugccaaugcgacagccgacuuugagcagcugcccgcucgcauccaagauuuccucagauaccggcacugucgccauuuuccucugcugugggacgcccccgcuaaaugcgccggcgggagaggaguguuccuccugcuugcggucaagagcgccccggaacacuaugagcggcgcgaacugauuagacggaccuggggccaggagcgcuccuacgggggaagaccugugcggcgccucuuucugcuuggcacacccggcccugaggaugaagcuagagccgagcggcuggcugaacucguugcccuggaggccagagaacauggggacgugcugcagugggcuuucgcggauaccuuucucaaccugacacuuaaacaucugcaccuccuggacuggcuugccgcucgcuguccccacgcccgguuccugcucucuggagaugacgaugucuuugugcacaccgccaauguugugagauuccugcaggcucaacccccuggccgccaucuguuuagcgggcagcucauggagggauccgucccgauccgggacagcuggucuaaguauuucgugcccccucagcuguuccccggcuccgccuacccuguguauugcagcgggggaggcuuucuucugucuggccccacggcgagagcucuccgcgccgccgcucggcacaccccgcuguucccuauugaugacgccuacauggggaugugucuugagagagcuggacuggcccccuccggccaugaagggauccgcccuuuuggaguccagcuccccggcgcgcaacagagcucuuucgacccuugcauguaucgggagcugcugcucguucacagauuugcccccuacgaaaugcugcuuauguggaaagcucugcacuccccggcccucagcugugaucgcgggcaucggguguccuga

SEQ ID NO: 66305 - RNA, 1194 nt, Artificial Sequence
  derived and/or modified sequence opt5 from B3GNT8__Homo_sapiens__NP_940942
augagaugccccaagugucugcucugccugagcgcccuucugacccuccugggccuuaaaguguacaucgaguggacauccgaaucucggcugagcaaggcuuauccuuccccgcgcgggacgcccccuucucccaccccugccaaccccgagccuacacucccggcgaaucugagcaccagacugggacagacaauuccccucccuuucgcuuacuggaaccaacagcaguggcggcugggcucccuucccucuggggacagcaccgaaacaggaggcugucaggccuggggagccgcugccgcuaccgagaucccugauuuugccuccuaucccaaagaccugcgcagauuccuccugagcgcggccugccggucuuuuccgcaauggcuuccugggggcggcgggucccaggucagcucuuguuccgauacggacguucccuaccugcuccuggcugucaagagcgaaccuggacgcuucgccgagagacaggcugugcgggagaccuggggcucucccgcccccgggauucgccugcucuuucugcuuggauccccugugggcgaagcggggccggaucuggacagccucguggccugggaguccagacgguauucugaucugcuucugugggacuuccucgauguucccuuuaaucagacacugaaagaccugcuccugcuugcuuggcugggacgccacugcccuaccgugagcuucguccucagagcccaagaugacgcuuuugugcauacacccgcccugcuugcccaucugcgggcucucccucccgcguccgcccgcagccuguaccugggcgaaguuuucacccaggcuaugccgcucagaaagccuggcgggcccuuuuaugugccugagucuuucuuugagggaggcuaccccgccuacgccuccgggggaggcuaugucaucgcugggcggcuggccccuuggcuucugagagcggcugcccgcguggcccccuucccguucgaagauguguacacgggacucuguauucgggcucugggccuggucccucaggcccaccccggcuuucuuacagcuuggcccgccgacagaaccgcggaccacugcgccuuccgcaaccuccugcugguucggccucucgggccgcaggcuagcaucagacuguggaagcaacuucaggauccccgccugcaguguuga

SEQ ID NO: 66306 - RNA, 1086 nt, Artificial Sequence
  derived and/or modified sequence opt5 from B3GNTL1__Homo_sapiens__XP_006722335
augagcggcgccggggugggaggcgcuuccgaggaaucucaggccaugcaagcgcacgucagcaucauucugcccguucauaacgcugagccuuggcucgacgaaugccugagauccgugcuucagcaggauuucgaggggaccauggaacugucuguguuuaaugacgccagcaaggauaaauccggagccaucauugagaaguggcgggucaaacucgaggacucuggcgugcacguuaucauugggggacaugauagcccgucccccagaggcgugggcuacgcuaagaaccaggccgucgcucaaagcucuggguccuaucuguguuuccuugacagcgaugacgugaugaugccucagagaguucggcugcagcacgaagccgcggugcagcaucccucuuccaucaucggaugccgcgucagacgggauccucccaauagcacagagcgcuacacgagauggauuaaccaacucaccccugaacagcugcugacacagguguuuaccucuaauggcccgacagugaucaugcccaccugguucuguucccgggccugguuuagccacgucgggccuuucaacgagggaggccaggggguucccgaggaccuccuguuuuucuaugaacaccuucgcaaaggaggcggcgugauuagaguggaucaaucccugcuccuguaccggcaucacccucaggcugccacacauugcguccuugagaccacgaucuggacccaccgcgugagauuucuggaggaacaggcucucccccggugggccgcguucacaauuuggaaugccgggaagcaaggacgcagacuguaucggucucugaccgcuggcagccagagaaagguuguggccuuuugugacgucgaugaaaacaaaauccgcaagggguucuacugccacgaggacucccaggagcggccgaaaccucgcauucccauccuccauuuucgcgcugcccggccucccuucgugaucuguguuaagcuggaccuuacaggaggcgccuucgaagauaaucugagaagccuccaucugcaggaggggcaagacuuucuucacuucucuuga

SEQ ID NO: 66307 - RNA, 987 nt, Artificial Sequence
  derived and/or modified sequence opt5 from B4GALNT1__Homo_sapiens__NP_001263398
auguggcugggcagacgggcccucugcgcucuggugcuucugcucgccugugcgagccuggggcuucuguacgcuuccacccgcgacgcccccggacucagacugccucuggccccgugggcucccccucagucuccccggcgcccugagcuccccgaucuggccccugaaccgagauaugcucacauccccguccggauuaaggagcaaguugugggccuucuggccuggaacaauugcagcugugaauccucugggggaggccucccucugcccuuccagaaacaggugcgcgcgaucgaccuuacaaaggccuuugauccugcugagcugagagccgcuagcgccacgcgggaacaggaguuccaagcguuucucucccgcucucagagccccgccgaccagcugcugauugcuccggccaacuccccucuccaguacccccugcaaggggucgaggugcagccucuuagaagcauccugguucccggacucucucugcaggcugccuccggccaggaaguguaucaagucaaucuuaccgccagccugggcacaugggauguggcuggggagguuaccggagugacacucaccggcgaagggcaggcggaccugacacuggucucucccggacucgaucagcugaaccggcaacuucagcuggugaccuacuccagccgcucuuaucagacgaauaccgccgacacaggcgcuagaccuggguggcgggauggacaggccggccaaaccgagaaaaaccagaagggcugguccgggcagauggccgagggaaugggcgggauuugggcuauggcccgcgcggugcagccgcauaauggaugcuucaacuggacaagcagagcucggggcagaaaaggggccuuuguccaccucggacuggaacaagcccgcggcaagcccgagccuuggguuugucuucccuuccggccuaccgugggcgggcccagaaagcgccugguguga

SEQ ID NO: 66308 - RNA, 1521 nt, Artificial Sequence
  derived and/or modified sequence opt5 from B4GALNT2__Homo_sapiens__NP_001152859
augaccagcggcggguccagauuccuguggcuccugaagauccuugugauuauccugguccucggaauuguuggcuuuauguucgggucuauguuucugcaggccguguucagcucccccaaaccugagcuuccgucucccgcuccuggagugcaaaagcugaaacuccugcccgaagaacggcugcgcaaccucuuuagcuacgacggcaucuggcuguucccuaagaaucagugcaaaugugaagccaacaaggagcaagggggauauaauuuucaggaugcguacggccaguccgaccuucccgcugucaaggccagacggcaggccgaguucgagcacuuucagcgcagagagggccugccucggccgcucccccugcuugugcagccuaaccugcccuucggguauccuguucauggaguggaagucaugccccuccacacagugccgauuccuggccugcaauuugaggggcccgaugcuccuguuuacgaagugacgcugaccgccucucucggaacacugaauacccuugcugacguccccgauagcguggugcagggccgcgggcagaaacagcugaucaucuccacaagcgacagaaagcuccugaaauucauucuucaacaugucaccuauacaucuaccggauaccagcaccagaagguugauaucgugucccuggagagccggucuuccguggccaaauuucccgucacgauucgccauccugugaucccgaagcucuaugaccccggcccugagagaaagcugcggaaccugguuaccauugcgacaaaaaccuuccuccgcccccacaagcugaugaucaugcuuagaagcauucgggaauacuacccugaucugacagugaucgucgccgacgauucucaaaaaccccucgagaucaaggacaaucacguggaauauuacaccaugccguucggcaaagggugguuugcuggacgcaaccuggccauuucccagguuacgacaaaguaugugcuuugggucgaugacgacuuccuguuuaaugaggaaaccaaaaucgaggugcucgucgaugugcuggagaagacagaacuggacguugugggcgggagcguccucggaaacguguuccaguuuaagcugcuucuggagcaguccgaaaauggcgcuugccuccauaaaagaaugggguucuuucaaccucuggauggauuccccucuuguguugugaccagcggcgucgugaacuuuuuccuggcccacaccgagcggcuucagagagugggcuuugacccucgccuccagcggguugcgcauuccgaguucuuuauugaugggcugggaacacugcucgucggcagcugccccgaagugaucauugggcaccagucuagauccccuguggucgacagcgagcuggccgcucuugaaaagacguacaauaccuaucgcucuaacacacugacccgggugcaauucaaacucgcccugcacuacuucaagaaucaucugcagugugcugccuga

SEQ ID NO: 66309 - RNA, 2997 nt, Artificial Sequence
  derived and/or modified sequence opt5 from B4GALNT3__Homo_sapiens__NP_775864
augggcagccccagagccgcucggccuccgcugcuccugcgccccgugaagcugcugagacggcgcuucagacuccugcuugcccuggcggucguuuccguggggcucuggacccuguaccuggagcucguggcuucugcccaggucggaggcaacccucugaaucggcgcuaugggagcuggagagaacuugccaaagcucuggccucccggaacauccccgcuguggacccucaccuccaauuuuaccauccccagcgccugucucuugaggaucacgacauugaucagggaguuagcuccaauucuagcuaucugaaguggaacaaaccugugccguggcucuccgaguucagaggccgggccaaucugcaugucuuugaagacuggugcgggagcucuauccagcaacugcgcagaaaccuccacuucccccuguacccucauauucggacaacgcuucgcaagcuggcggugucccccaaauggaccaauuauggacucagaaucuuuggcuaccugcacccuuucacagauggcaagauucaguuugccaucgcugccgacgauaacgcugaguucuggcuuagccuggacgaucagguuucugggcuccagcugcuggccuccgugggaaagaccggcaaagaauggacagcgcccggggaguuuggaaaguuccggagccaaaucucuaaaccggucucccucagcgccucccacagauauuacuuugaagugcugcauaagcagaaugaggaaggcaccgaccacguggaggucgcuuggcgccggaacgauccuggggccaaauucacaauuaucgacucucuuagccugucccucuuuaccaaugagacguuccugcagauggaugaaguuggacauauuccccagaccgcugccagccacguggacucuuccaacgcccuuccuagagacgagcaaccucccgcugauaugcugcgccccgacccgcgggauacacucuacagagugccccugaucccuaagagccaccuucgccauguccuccccgacuguccuuauaagcccucuuaccugguggauggccuuccgcugcagcgguaucagggccucagauucguucaccugagcuuuguguacccuaaugacuauacccgccugucccauauggaaacacacaacaaaugcuucuaccaagagaaugcguauuaccaggaucgguuuucuuuccaggaauacauuaagaucgaccagcccgagaaacaagggcuugagcagccuggauuugaagagaaccuccuggaagagagccaguauggcgaagucgccgaggagacccccgcuuccaacaaucagaacgccagaaugcuggaagggcgccaaacgccugccagcacacucgagcaggaugcuaccgacuaccggcugagaucucuucggaagcugcucgcccagccccgcgaaggacugcuggcgccguucuccaaaagaaauagcacagcuucuuuuccuggccggaccucccauauucccgugcagcaacccgagaagagaaaacagaagccuagcccggaacccucccaggauucuccucacagcgacaaguggcccccugggcaccccguuaaaaaccuuccucagaugcgcggaccccggccgagaccugccggcgacucuccccgcaagacccaauggcucaaucagguggaguccuauaucgccgagcagagacggggcgaucgcaugagaccucaagcucccgggcggggauggcauggcgaagaggaagucguggccgcugccgggcaggagggacaggucgagggcgaagaggaaggggaggaagaggaggaagaggaagacaugagcgagguguucgaauacguuccgguguuugauccugucgugaacugggaccagacauucuccgcgcgcaaucuggauuuucaagcccugagaacggacuggaucgaucucagcuguaacaccucuggcaaucugcuucugcccgagcaggaggcucucgaaguuacacggguguuccugaaaaagcugaaccagcgcuccagaggacgguaucagcuucaacgcauugucaauguggagaaaagacaggaccagcuccggggcgggagauaccugcuggaacucgagcugcuugaacagggacaacgcgugguucggcugagcgaguaugucucugccagaggcuggcaggggaucgauccugcuggaggcgaggaaguggaggcccgcaaccuccaggggcuggugugggacccccacaaucggagacgccaaguccugaacacccgggcgcaggaacccaaacuuugcuggccucagggcuuuuccuggagccauagagccgugguucacuucguggucccggugaagaaucaggcucgcuggguucaacaguucauuaaggauauggagaaccucuuucaggugacaggagacccccacuucaacaucgucauuaccgauuacucuagcgaggacauggacguggaaauggcccugaagcgguccaaacugagaagcuaccaguauguuaagcucucuggcaauuuugagcgguccgcugggcugcaagccggaaucgaucuugugaaagacccucauagcaucauuuuccugugugaucuccacauccauuuucccgccggcgucauugacgcuauccgcaagcacugcguggaagggaagauggcguucgccccuauggugaugagacugcauuguggagcuacgccccaguggccugagggcuacugggaagucaacggguuuggccugcuuggaauuuauaaauccgaucuggaccggaucggcgggaugaauacaaaggaguuccgcgauagauggggaggcgaggacugggaacuccuggaucggauccuccaggccgggcuggacguugagagacuuucucugcgcaacuuuuuccaccacuuucauagcaaacggggaaugugguccagacgccagaugaagacccucuga

SEQ ID NO: 66310 - RNA, 1197 nt, Artificial Sequence
  derived and/or modified sequence opt5 from B4GALT1__Homo_sapiens__NP_001488
augagacugcgggagccccuccugagcggcuccgccgcuaugccuggggccucucuucagcgcgcgugcagacugcucguggcugucugugcccugcaccuuggaguuacccugguguacuaucucgccggccgggaccugagccgccugccgcaacucgugggggucuccacaccccugcagggaggcucuaacagcgcugccgcuaucgggcaguccucuggagaacuuagaacgggcggcgcccggccucccccuccccugggggcgagcucccagccucgcccgggaggcgauagcucucccgugguugacuccgggccuggacccgccagcaaucucaccucugugccugucccccauacaaccgcucugucccuuccggccugcccugaggaaagcccccugcucgugggcccuaugcugauugaguucaacaugcccguugaucuggaacucguggcuaagcaaaaucccaacgucaaaaugggagggagauacgccccucgggacugugugucuccgcacaagguggcgaucauuauccccuuucgcaauagacaggagcaucugaaauauuggcuuuacuaucugcacccuguccuccagcggcagcaacuggauuacggcauuuauguuaucaaccaggccggcgacacaaucuucaaucgcgcuaaacuucugaacgugggguuucaggaggcccucaaggauuacgacuauaccugcuucguguuuuccgaugucgaccugauucccaugaaugaucauaacgcuuacagauguuucagccagccucggcacaucuccguggccauggacaaguuuggauucucucugcccuacguucaauauuuuggcggggugagcgcccucuccaagcagcaguuccugacaauuaauggauuuccgaacaauuacuggggcuggggaggggaagaugacgacaucuucaaccgccuugucuuuagaggcaugagcauuucucggccuaaugcugugguuggcagaugccgcaugauccggcacuccagagauaaaaagaacgagcccaacccucaacgcuucgaccggauugcgcauaccaaagaaacgaugcugagcgaugggcucaauucucugaccuaucaggugcuugacguccagagauacccccuguauacacagaucaccguggauaucggaacaccuagcuga

SEQ ID NO: 66311 - RNA, 1182 nt, Artificial Sequence
  derived and/or modified sequence opt5 from B4GALT3__Homo_sapiens__NP_003770
augcugagacggcuccuggagcgccccugcacccuugcccugcucgugggcagccagcuggcugucaugauguaccuuucccucgggggauucagaucucugagcgcccuguuuggccgggaccaagggccuacauucgauuauucccacccgcgcgacguuuacucuaaccugagccaucuccccggagcgccuggcgggcccccugcuccccagggacugccuuauuguccggaaagaucuccccuucuggugggcccuguguccgucagcuuuucccccgugccuagccucgccgagaucguugaacggaauccccgcguggagccgggcgggagauaccggccugccggaugcgaaccccgcucuagaacggcuauuaucgucccucaccgggcccgcgagcaucaccugagacuucugcucuaucaucugcaccccuuccugcagcggcagcaacucgcuuacggcauuuaugugauccaccaggccgggaacggaaccuuuaaucgcgcgaagcugcuuaacguuggcgugagagaggcccugcgggaugaagagugggacugucucuuccugcaugaugucgaccuucugcccgaaaaugaucacaaccucuacgugugcgacccuagagggccgcgccauguggcugucgccaugaauaaauuuggauacucccugcccuauccucaguacuucggcggcguuagcgcucugacacccgaucaguaucucaagaugaacggguuuccuaaugaguacuggggauggggcggggaggacgaugacauugccacccgggugagacuggcgggaaugaaaaucucucggcccccgacauccgugggccacuauaagauggucaaacaccgcggggauaagggaaacgaagagaauccucauagauucgaccuucuggugcgcacccaaaacagcuggacacaggacggcaugaacucucucaccuaccagcugcuugcccgggaacugggcccccucuauacgaauaucaccgcugauauugggacagacccuagaggaccccgcgccccuuccggcccccgguacccgccugggagcucccaggcuuuuagacaagagaugcugcagcgccggccucccgccagacccggaccgcugucuaccgccaaucacacagcucuccggggcagccauuga

SEQ ID NO: 66312 - RNA, 1035 nt, Artificial Sequence
  derived and/or modified sequence opt5 from B4GALT4__Homo_sapiens__NP_997708
augggcuucaaccugaccuuucaccucagcuacaaguucagacugcuucugcuccugacacuuugccugacgguggucgggugggccaccuccaauuauuuuguuggagcuauccaggagauucccaaagccaaggaguucauggcgaacuuucauaaaacacucauccugggcaaggggaaaacccugacaaaugaggcuucuaccaagaagguggaacucgacaacuguccuagcguguccccguaccugcggggacaaucuaaacuuauuuucaagcccgaucugacacucgaggaaguccaggccgagaauccuaaagugagccgcggcagauaucggccccaggagugcaaggcccugcagcgcguugcuauccuugugccucacagaaaccgggaaaaacaucugauguaccuccuggagcaucugcaccccuuucuccaacgccagcagcuggacuaugggauuuacgucauccaccaggccgaaggaaagaaguucaauagagcuaaacuucugaacgugggcuaucucgaggcccugaaggaggaaaauugggauuguuuuaucuuccacgacguugaucuugugccugagaacgacuuuaaucuguacaaaugcgaagaacauccgaagcaccucgucgugggccggaacuccaccggguaccgccugagauauucuggauacuucggcggggugacggcgcugagccgggaacaauuuuucaaagucaauggauucuccaacaauuauuggggcuggggaggggaggaugacgaucuccgccugagaguugagcuucagcggaugaagauuagccgcccccugccugaagugggcaaauacaccaugguguuucauacaagagacaagggcaacgaggucaacgccgaacggaugaagcuccugcaccaggugucuagaguuuggcgcaccgaugggcuuuccagcuguucuuauaaacugguguccgucgagcacaauccccucuacaucaacauuacaguggacuucugguuuggagcuuga

SEQ ID NO: 66313 - RNA, 1167 nt, Artificial Sequence
  derived and/or modified sequence opt5 from B4GALT5__Homo_sapiens__NP_004767
augagagcccggcgcggccugcucagacugccccggcgcagccuucuggcugcccucuucuuuuucucccugucuagcucccuucuguacuuuguguaugucgcgccugggaucguuaacaccuaccucuucaugaugcaggcucaagggauucugaucagagacaaugugcggacaauuggcgcccagguguaugagcagguccugcgcucugccuacgcuaagagaaacagcuccgugaaugauucugacuauccgcucgaucugaaccacagcgaaacguuucuucagaccacaaccuuccugcccgaggacuuuacauacuucgccaaucauaccugcccugaacggcuccccuccaugaaagggccuaucgauauuaacaugagcgagaucggaauggacuauauccacgaacuguuuucuaaggaucccacaauuaaacuuggcgggcauuggaagccuuccgacuguaugccgcgcuggaaaguugcuauccugauucccuucagaaaucggcacgagcaucucccugugcuguuucgccaccuucuccccaugcugcaaagacagcggcuucaguucgccuuuuacgucguggagcagguuggaacccaaccuuucaaccgcgcgaugcuguucaaugugggcuuucaggaagccaugaaggaucucgacugggauugccugaucuuccacgacgucgaucauauucccgagagcgacagaaacuacuauggcugugggcagaugccgcggcacuuugcuacgaagcuggacaaauacauguaucugcucccuuacaccgaguucuuuggaggcgugucugggcugacaguggaacaguucagaaagaucaauggauuucccaacgccuucuggggcuggggaggagaggaugacgaucuguggaaucgcguccaaaacgcuggcuauuccguuagccggccugaaggcgacaccgggaaauacaagucuauuccccaucaccacagaggagaggugcaguuucucggccgcuaugcccugcuucggaaauccaaggaaagacaggggcuggauggacucaauaaccugaacuacuucgcgaauaucacauacgacgcccuuuauaagaacaucaccgugaaucugacgcccgagcucgcucaagucaacgaauacuga

SEQ ID NO: 66314 - RNA, 1149 nt, Artificial Sequence
  derived and/or modified sequence opt5 from B4GALT6__Homo_sapiens__NP_004766
augagcgugcugagacggaugaugcgcgucuccaacagaucucuccuggccuucaucuuuuucuuuagccuuuccucuagcugccuguacuucauuuauguugcucccggcaucgccaauaccuaccucuuuauggugcaggcgcgggggauuaugcugcgcgagaacgugaagacaaucggacacaugauuagacuuuauacgaauaaaaacuccacccugaauggcacagacuacccugaagggaacaauucuagcgauuaucucguccaaaccacaaccuaccugccggagaacuucacauauucccccuaccugccuugucccgaaaagcucccuuacaugcggggauuucugaaugugaacguuagcgaggugucuuucgacgaaauccaucagcuguuuuccaaagaucuggacaucgagcccggcgggcacuggcgcccuaaggauugcaaaccgagauggaaggucgcugugcucauucccuuccggaaucgccaugagcaccuuccuaucuuuuuccuucaucugauucccaugcuccagaagcagagacuggaauuugccuucuauguuaucgagcaaaccggaacgcagccuuucaaccgggccaugcuguuuaaugugggcuucaaagaagcuaugaaggacagcgucugggauugugugauuuuucacgacguggaucaccuccccgagaacgaccgcaauuacuauggcugcggggagaugccgagacauuucgccgcuaaacuggauaaguacauguauauccuuccuuacaaagaauuuuucggaggcgucucugggcugaccguugagcaguuucggaagauuaacggauuccccaacgccuuuuggggcuggggaggggaagacgaugaccucuggaaucgcgugcacuaugcgggcuacaacgugacaagaccugagggcgaccuggggaaguacaaauccaucccccaucaccaccggggagaaguccaguuccuuggcagauauaagcugcuccgcuacagcaaagagcggcaauauaucgaugggcugaauaaccugauuuacagacccaagauccucguggaccgccuguauaccaauauuucuguuaaccuuaugccugagcuggccccgaucgaagauuacuga

SEQ ID NO: 66315 - RNA, 984 nt, Artificial Sequence
  derived and/or modified sequence opt5 from B4GALT7__Homo_sapiens__NP_009186
auguuccccagcagacggaaggccgcucagcugccuugggaggacggccgcuccgggcuccugucuggaggccuuccgagaaaaugcagcguguuucaccuguucgucgccugucucucccugggguuuuucucucuucuguggcuccaacugagcugcuccggagauguugcgcgggcugugcgcggccaggggcaggaaaccucuggacccccuagagccugucccccugagcccccuccggaacauugggaggaagacgccagcuggggcccccaccggcuggcugugcucgucccuuuucgcgagagauucgaggaacugcuuguguuuguuccccauaugcggcgcuuccuguccagaaagaaaauccggcaccauauuuacgugcucaaccaggucgaucacuuucgcuucaauagagccgcucugaucaacgugggcuuucuugagagcucuaauuccacagacuauauugccaugcacgauguugaccugcucccucugaacgaagaacuggauuacggguuccccgaggcgggaccguuucauguggccagcccugaacuccacccccuguaucauuacaagacguaugucggcgggauccuucugcucucuaaacaacacuaccggcugugcaauggaauguccaaccgcuucuggggcugggggagagaggacgaugaguucuaucggagaauuaagggagcuggccuucagcuguuucgcccuagcggcaucaccacaggguacaagaccuuccggcaccuccaugaccccgccuggagaaaacgcgaucagaagcggaucgcugcccagaaacaagagcaguuuaagguggacagagaaggaggccugaauacagugaaauaccacgucgcgucucgcaccgcccuguccguugggggagcucccuguacagugcucaacauuaugcuggauugcgacaagaccgccacgccuugguguaccuucagcuga

SEQ ID NO: 66316 - RNA, 1248 nt, Artificial Sequence
  derived and/or modified sequence opt5 from B4GAT1__Homo_sapiens__NP_006867
augcagaugagcuacgccaucagaugcgcuuucuaucaacugcuccuggccgcgcuuaugcugguggcuaugcuccagcugcuuuaccugucccuccugucuggccugcacgggcaggaggaacaggaccaauauuuugaguucuuucccccuagcccgcgguccgucgaucagguuaaggcccagcuccgcaccgcccuggcuucuggaggcgugcuugacgccagcggggauuacagaguguaucggggacugcucaaaacaacgauggaccccaacgaugucauucuggcuacccaugccuccguggacaaucuucugcaccucucuggccugcuggaacgcugggaggggccucucagcguuuccguguucgcggccacaaaggaagaggcucagcuggccaccguccuugcuuacgcccugagcucucauugucccgauaugagagcgcggguggccaugcaccucguuugcccuucccgcuaugaggcugccgugcccgacccuagagaaccgggagaguuugcucugcuucggagcugucaagaagucuucgauaaacuggcccgcguggcccagcccggcaucaacuacgcucucggcacaaaugugucuuacccuaacaaucugcugagaaaccucgcgcgggagggggccaauuaugcucuggucauugacguugauauggugcccuccgagggacuuuggcgcggccugagagaaaugcucgaccagagcaaccaguggggagggaccgcccugguggucccugccuuugagauccggcgcgcuagacggaugcccaugaauaagaacgaacuugugcaacuguaccagguuggcgaggugagaccguucuauuacgggcucugcacaccuugucaggcccccaccaauuauucucgcugggucaaccugccugaagagucccugcuccggcccgcguacgugguucccuggcaagauccuugggagccguuuuauguggcuggaggcaaaguccccacguucgacgaaagauuucgccaguacggcuucaaucggauuagccaggccugcgagcugcauguggccggguuugacuucgaaguccuuaacgagggauuccuggugcacaagggcuuuaaggaagcucucaaauuccacccucagaaggaggccgagaaucaacauaacaaaauccuguacagacaguuuaagcaggaacugaaagcuaaguaucccaacuccccucgccgguguuga

SEQ ID NO: 66317 - RNA, 444 nt, Artificial Sequence
  derived and/or modified sequence opt5 from B9D1__Homo_sapiens__NP_001230404
augaugaccagcacagccuccacggcucugugcaccgccagaacagggcccccucagcggguguggcgcagaggcucucaccggagccauccgcgcgcgaagauguguggaaaacacuggugcggcaccucuccccucauguccccucugaaggcucccacaccuaccgccgggcauagaagcuguuccgccugcauggaccaaauguguucuggaacaaugugguucgaggcuaugggccccugcaccuguccuagccaccuugccgggacgaaaggaccgucccccugccugagccagaaccuccggcugaauugucgcucucuucaggcuggcuccuggggcgggggaccuagcacccagacacccagaugguggcugcgggucaaggccggcaaaccucccucugggcucuccguuaaggauagcucugugucccgcuga

SEQ ID NO: 66318 - RNA, 528 nt, Artificial Sequence
  derived and/or modified sequence opt5 from B9D2__Homo_sapiens__NP_085055
auggccgaggugcacgucaucggccagauuaucggggcuagcggauucuccgaaucuagccuguuuugcaaguggggcauucauaccggggccgcguggaaacuccuguccggaguuagagagggccaaacacagguggacacgccccagaucggggauauggcuuacuggucucacccuauugaccuucauuucgccaccaagggacugcagggcuggccgcggcuccacuuucaaguguggagccaggauuccuucggccgcugucagcuggccggguauggauuuugccauguccccucuagcccuggcacacaccagcuugcuugucccaccuggagaccucugggguccuggcgggaacaacucgcccgcgcuuucgugggaggcgggccccagcugcugcacggagacacaaucuacagcggcgccgauagauaucggcuccauaccgcggccggcgggacaguucaccuggagaucggacuucugcuccgcaacuuugacagauacggcguggaaugcuga

SEQ ID NO: 66319 - RNA, 165 nt, Artificial Sequence
  derived and/or modified sequence opt5 from BAALC__Homo_sapiens__NP_001019543
augggcugcgggggaagcagagccgacgcuaucgagccccgguacuaugaauccuggacccgcgagacagaaucuacguggcugaccuacacagauagcgacgccccuccguccgcggcugcccccgauucuggcccugaggccgggggacuccacagcggcuga

SEQ ID NO: 66320 - RNA, 1257 nt, Artificial Sequence
  derived and/or modified sequence opt5 from BAAT__Homo_sapiens__NP_001692
augauccagcugaccgccacacccgugagcgcucucgucgacgagccuguucacauuagagccacgggccugaucccguuccaaaugguguccuuucaggcgucucuugaagaugagaacggggacauguucuacagccaggcucauuaucgggccaaugaauuuggagagguggaucugaaccacgccuccucucucggcggggacuacaugggaguccaucccaugggccuguucuggagccuuaagccugaaaaacugcucacccgccugcugaagagagaugugaugaaucggcccuuucagguucaagugaaacucuaugaccuggagcuuauugucaacaauaagguggcuuccgccccuaaggcuucucugacacucgagcgcugguacguugcccccggggugaccagaaucaaaguccgggaaggacgccugagaggcgcgcuuuuccugccuccgggcgaggggcucuuucccggagugauugaucuguucggcgggcugggaggccuccuggaauuucgggccagccuucuggcuucccgcggguucgccagccucgcucuggccuaucacaacuacgaggaccuuccuagaaagcccgaggugacagaucuggaauauuuugaggaagcggccaauuuccuccugcggcauccuaaagucuuuggaucuggcguuggcgugguguccgucugccagggggugcagaucggacugagcauggcuaucuaccucaagcagguuaccgccacagugcugauuaacggcaccaauuuccccuucgggaucccgcaagucuaccacggacagauucaccagccucuuccccauucugcucagcugaucuccacgaacgcccucggccugcuugagcuguaucgcaccuuugaaacaacccaagugggggccagccaguaccucuucccuauugaggaggcucagggacaauuucuguucaucguuggcgaaggcgacaaaacaauuaauucuaaggcgcacgccgagcaggcuaucgggcagcugaaaagacauggaaagaacaauuggacccuccuguccuaucccggcgccgggcaccuuaucgaacccccuuacagcccgcuguguugcgccuccacgacacacgaucuccggcugcauuggggaggcgaggugauuccccacgcugccgcgcaggaacaugcuuggaaggagauccaacgcuuucugagaaaacaccuuauuccugacgucaccucucagcucuga

SEQ ID NO: 66321 - RNA, 990 nt, Artificial Sequence
  derived and/or modified sequence opt5 from BABAM1__Homo_sapiens__NP_001275685
auggagguggccgaacccagcuccccuaccgaggaagaggaagaggaggaggaacacucugcugaaccgagaccccggacacgcagcaacccugagggcgccgaggacagagcggucggggcucaggccuccguuggaucucggagcgaaggcgagggggaagccgcuuccgccgaugacggaucucugaauacgagcggcgcugggcccaaguccuggcaagugccucccccugccccggaggugcagauccgcacccccagagucaacugcccugaaaaagugauuaucugucucgaucugagcgaggagaugucucuucccaagcuggaauccuucaauggaagcaaaacaaacgcgcucaauguuucucagaagaugauugagauguuugugcggaccaaacauaagaucgacaagucccacgaauuugcccuggucgugguuaacgaugacacagcuuggcuuagcggccugaccucugauccucgcgagcucugcuccugucuguacgaccuggaaacagccagcugcuccaccuuuaaucucgagggccuguucucucuuauucagcagaaaacggagcugcccgugaccgaaaacguccaaacaaucccgccucccuauguggugagaaccauccucgucuacagccggccucccugucagccccaguuuucccugacagagccuaugaagaaaauguuccaaugcccguauuucuucuuugauguuguguacauucauaaugggaccgaagagaaggaagaggagaugagcuggaaagacauguucgcuuuuaugggaucucuugauacgaagggcacauccuauaaguacgaaguggcccuggcggggcccgcccucgagcugcacaacuguauggcuaaacugcucgcccauccucugcagcgccccugccagagccacgcuucuuauagccuucuggaagaggaggacgaagccaucgaggucgaagccaccguguga

SEQ ID NO: 66322 - RNA, 1131 nt, Artificial Sequence
  derived and/or modified sequence opt5 from BACE1__Homo_sapiens__NP_001193978
auggugcccuucaucuaccugcaggcccacuuuacccucugcagcggcugguccucuacauauagagaccugcggaagggggucuacguuccuuauacgcaaggaaaaugggagggcgaacuugggaccgaucuggugagcauuccgcauggacccaacgugacaguccgcgcuaauaucgccgcgauuaccgaguccgacaaguucuuuaucaacggcucuaauugggaagggauucucggacuggcuuacgccgagaucgccagacuuuguggcgcuggcuucccucugaaccagagcgaagugcucgccuccguugggggaucuaugaucauuggcgggaucgaucacagccuguauacaggaucccugugguacacccccauucggcgcgagugguauuacgaggugaucauugucagaguggaaaucaauggccaggaccucaaaauggauugcaaggaguacaacuaugacaaaagcauuguugauucugggacaaccaaucugcggcuuccuaagaagguguuugaagcugccgucaaauccaucaaggcggccagcucuacggagaaauuccccgacggauuuuggcugggcgagcagcucguguguuggcaagcuggcaccacaccuuggaacaucuucccggugauuucccuguaccuuaugggggaagucaccaaucagagcuuucgcaucacaauucugccccagcaguaucucagaccuguugaggauguggccaccucucaagacgauugcuacaaguucgcuaucucccagagcuccacgggaacagugaugggcgccgucauuauggaaggguuuuaugugguuuucgaccgggcgcgcaaaagaaucggauuugccgugucugcuugucauguccacgaugaguuccggaccgccgcuguggaaggccccuucguuacacuggacauggaggacugcggguacaacaucccucagaccgaugagagcacccugaugacaauugccuaugugauggccgcuaucugugcgcucuuuaugcugccccuuugccugauggucugucaguggcgcugccucagaugucugcggcaacagcaugacgauuucgccgacgauauuucccuucugaaguga

SEQ ID NO: 66323 - RNA, 1557 nt, Artificial Sequence
  derived and/or modified sequence opt5 from BACE2__Homo_sapiens__NP_036237
augggcgcccuggcuagagcccuccugcuuccccugcucgcgcaguggcugcuucgggcugccccugagcuggccccggcucccuucacccucccucugcgcguggccgcugccacaaacagagucguugcgcccacgccugggcccggaaccccugccgaacggcacgcugacggccuggcccucgcucuggagccggcccuugcgagccccgccggggcugccaauuuucuggcuaugguggauaaccuccaaggagacuccggccgcggguacuaucuggaaaugcuuaucggaacaccuccccagaagcugcagauucucguggauaccggcucuagcaauuucgccgucgccggcacaccucauuccuacaucgacaccuauuuugauacagagagaucuagcaccuaccgguccaaaggguucgacgugacgguuaaguauacccagggaucuuggacaggcuuugugggggaagaucuggucaccauucccaaaggauucaacacaucuuuucuggugaauaucgcuaccauuuucgaguccgagaacuuuuuccucccgggcaucaaguggaaugggauccugggacuugcguacgccacgcuggcuaaaccuagcagcucccucgaaacauuuuucgacagccugguuacccaagccaacauucccaauguguuuucuaugcagaugugcggcgccggccuuccugucgcuggguccggaacaaacggcgggagccuggugcucggaggcaucgagcccucucuguauaagggggauauuugguacacccccaucaaggaagagugguacuaucagauugagauccugaaacucgaaauuggaggccagucccugaaucuugacugucgcgaguacaacgccgauaaggcgaucguggacagcggcaccacacugcucagacugccucaaaaagucuucgaugcuguuguggaagccguggcccgggcuucccuuaucccggaguucucugacggguuuuggacgggaagccagcuggccugcuggaccaauuccgaaacacccuggagcuauuucccuaagauuucuaucuaccuccgcgacgagaacuccagcagaucuuuucggauuaccauccugccccagcuguauauucagccuaugaugggcgcugggcucaauuacgaguguuaucgcuucggaaucagccccuccacaaacgcccuggucaucggcgcgaccgugauggaaggguuuuacguuauuuucgauagagcccaaaaacgggugggcuuugcugccucuccgugcgcugagaucgccggagcggccgucagcgaaauuuccggcccuuucagcacggaggacguggcuucuaacuguguucccgcccagucccuuagcgaaccuauccuguggauugugucuuacgcucucauguccgucugcggggccauccugcuggugcuuaucguccuccugcugcuccccuuucgcugucagagacggccuagagaucccgaggugguuaaugacgagagcucccuggugcgccaccgguggaaguga

SEQ ID NO: 66324 - RNA, 2211 nt, Artificial Sequence
  derived and/or modified sequence opt5 from BACH1__Homo_sapiens__NP_996749
augagccuguccgagaacucuguguucgccuacgaaagcuccguccacucuaccaauguucuccugagccuuaacgaccagagaaagaaagaugugcugugcgacgugacaaucuuugucgagggccaacgguuccgcgcucauagauccgugcucgccgcguguucuagcuauuuucacucccggauuguugggcaggcugauggagaacugaauaucacgcuucccgaggaagugaccgucaagggcuucgagccucugauucaguuugccuacacagccaaacucauccugagcaaggagaacguggacgaaguuugcaaauguguggaguuccugucuguccauaauauugaagaguccugcuuucaguuccucaaguuuaaguuccuggauagcaccgcugaccaacaggaguguccgcgcaaaaagugcuuuucuucccacugucagaaaacagaucuuaagcugagccuccuggaccagagagaucuugaaaccgacgagguggaagaguuccuggaaaacaaaaaugugcaaacaccccagugcaagcuccggcgcuaucaggggaacgccaaggcuucuccuccccugcaggauuccgccagccaaaccuacgaguccaugugucuggagaaagacgcggcccucgcucugccuucucuuugccccaaguauagaaaauuucagaaggccuucggaacggaucggguccgcaccggcgaaagcuccguuaaagacauccaugcuagcgugcagccuaaugagagaucugaaaacgagugucucgggggagugccggaaugccgggaccugcaagucaugcugaagugcgaugaguccaaacuugccauggagcccgaagagacaaagaaggacccugcgagccagugucccaccgaaaaaucugaggugacaccuuucccccacaauagcuccaucgauccgcacggccuguacucucucagccugcugcauaccuaugaccaguacggcgaucucaacuuugccgggaugcagaauacgacaguucugaccgaaaagccucuuuccggaacagacgugcaagagaaaaccuucggcgagagccaggaucugccccucaagucugaccuggggacccgcgaagauuccagcgucgcuucuuccgacagaagcuccguggagcgggaaguugccgagcaccuugcuaaaggauuuuggucugauauuugcagcacagacacgccuugucagaugcagcugucccccgccguggccaaggacggcucugagcaaaucagccagaagcgcuccgaaugccccuggcucgggauuagaaucagcgagucuccugaaccgggacagcggaccuucacaacccuguccagcgucaacugucccuuuauuucuacacuguccaccgagggcugcagcucuaaucucgaaaucggcaacgaugacuacgugagcgagccucagcaagagcccuguccuuaugcuugcgucauuucccugggggaugacagcgaaacggauacagagggagacucugaauccuguagcgcgagagagcaggaaugcgaggugaaacuucccuucaacgcccagcgcaucaucucccugucucggaaugauuuucagagccuccugaagaugcauaaacugaccccggagcaacuugacuguauucacgauaucagacgccgguccaagaacagaauugcugcccagcgcugccggaaaagaaagcucgacugcauccagaaucuggaaucugagauugaaaagcugcaaagcgagaaagaaucccuccugaaggagcgcgaucacauccuuucuacccugggcgagacaaaacagaaccucaccgggcugugucagaagguuugcaaagaagccgcucugagccaggagcaaauccagauucuugccaaguacuccgcggcugacuguccucucagcuuccugaucucugaaaaggauaaauccacacccgacggagagcuggcccucccuagcaucuuuucucuguccgaccggcccccugccgugcuucccccgugcgcuagaggcaauagcgagccuggguaugcccgcggacaggaaucucagcaaauguccacggcuaccagcgagcaggccggccccgcggaacagugucggcaguccggcgggauuagcgauuucugccaacagaugacagacaaguguaccacagaugaguga

SEQ ID NO: 66325 - RNA, 2634 nt, Artificial Sequence
  derived and/or modified sequence opt5 from BACH2__Homo_sapiens__XP_005248815
augagcagacacaccggcaagcggcgcaaaacacagguggaggaaacgucccaaaucucuagaaacuggaaugucuucaagagcuggcagucccagggcguuaacggaaugucuguggacgagaaacccgauagcccuauguacguguaugaauccaccguccauugcacaaauauucugcucggccugaacgaccagcggaagaaagauauccuuugugacgugacccugauuguugagcgcaaggaauuuagagcccaccgggcugugcucgccgcgugcucugaguacuucuggcaagcucuggucgggcagacaaagaaugaucuugugguuagccugccggaggaagugaccgcccgcggauuuggcccccuccugcaguucgccuauacagcuaaacugcuccuguccagagagaacauccgggaagucauucgcugugccgaguuucuuagaaugcauaaucuggaggacagcugcuucucuuuucuccagacccaacugcuuaacuccgaagaugggcuguucgugugucggaaggacgcugccugccagcgcccucacgaggauugugaaaauagcgcgggagaggaagaggacgaggaagaggaaacgauggauucugagaccgccaaaauggcuugccccagagaccagaugcucccugaacccaucuccuuugaggccgcugccaucccuguggcggagaaggaagaggcccugcugccggaacccgaugucccuacagacaccaaagagagcucugaaaaggacgcucucacacaguacccccgguauaagaaauaccaacuggccuguaccaagaacguuuauaaugcuuccagccauuccacgucuggcuucgccagcacauuucgcgaggauaacuccagcaauucucuuaaaccuggccuggccagagggcagauuaaguccgagcccccgagcgaagagaacgaagaggagucuaucacccucugccugagcggagacgaaccugaugcuaaagaccgggcgggcgauguggagauggacagaaagcagcccuccccugcccccacacccaccgcuccugccggggccgcuugucuugaacgcucucggagcguggccuccccgagcugccugagaucucucuucuccauuaccaaaagcgucgagcugucuggacugcccuccacaagccaacagcacuuugcgcgcuccccugcuugccccuucgauaagggcaucacgcagggggaccucaagaccgauuacacaccuuucaccggaaauuacggccagccccacgugggccaaaaagaaguuucuaacuuuacaauggggagcccgcugcggggaccuggccuugaggcccuguguaagcaggagggggaacucgacagacgcuccgugauuuucucuagcuccgccugcgaucaggucagcaccucugugcauuccuauagcggaguuucuucccuggacaaagaccuuagcgagcccgugccuaagggccugugggucggggcuggacagucucuccccagcucccaagccuacagccacggcggccugauggcugaucaucugccugggcggaugagacccaacacgucuuguccggugccuaucaaagucugcccccgcagcccuccccucgaaacacggaccagaaccuccuccucuuguagcuccuauucuuacgccgaggacggaagcggcggguccccgugcucucugccccuuugugaauuuagcuccagcccuugcucucagggagcgcgcuuccuggccacagagcaccaggagcccggccucaugggggauggcauguauaaucaggugcggccucaaauuaagugugaacaguccuacggaaccaacagcucugacgaguccggcagcuuuucugaagcugauuccgagagcugccccguucaggacagagggcaggaagugaagcugccuuuccccgucgaucaaaucacagaccugccgcggaaugauuuucagaugaugaucaaaaugcacaaacuuacguccgagcagcucgaguucauucaugacgugcgcagacggagcaagaacagaaucgccgcucaacgcugucggaagagaaaacuggauugcauucagaaucuggaaugcgagauccgcaagcucguuugugaaaaggagaaacugcuuucugagagaaaccagcugaaggccugcaugggagaacuccuggacaauuuuagcugucugucccaggaggugugccgggauauucaaucuccugaacagauccaggcgcuucaccgcuauugucccguccucagaccuauggaccugcccaccgccagcuccaucaacccggcuccucugggcgccgagcagaauauugcugccucucaaugcgccgugggggaaaacgugcccuguugccucgagccuggagcugcgccucccgggcccccgugggcccccagcaauacauccgagaacuguaccucuggccggcgccuggaaggcacagacccuggaaccuucagcgagagagggcccccucuugaaccccggucccagacgguuaccgucgauuuuugccaggagaugacagacaaauguaccacagaugaacagccucgcaaggacuacaccuga

SEQ ID NO: 66326 - RNA, 507 nt, Artificial Sequence
  derived and/or modified sequence opt5 from BAD__Homo_sapiens__NP_004313
auguuccagauccccgaguuugaaccuagcgagcaagaagacuccucuagcgccgagagaggccuggggccgucccccgcuggagauggcccuucugggagcggaaagcaccaucggcaggcccccggccuccugugggacgcgucccaccagcaggaacaaccuaccucuagcucccaucacgggggagcuggcgccguggagauucgcagcagacauucuuccuaccccgccggcacagaggaugacgaagggaugggagaggaaccuagcccguuccggggccgcucuagauccgcucccccuaaccuuugggccgcucagcgguaugggcgcgagcugagacggaugagcgaugaguuugucgacucuuucaaaaagggacucccccgcccuaaauccgccggcacggcgacccagaugagacagagcuccucuuggacacggguuuuucaaagcuggugggaucgcaaucuggggagaggauccagcgcccccucucaguga

SEQ ID NO: 66327 - RNA, 693 nt, Artificial Sequence
  derived and/or modified sequence opt5 from BAG1__Homo_sapiens__NP_001165886
augaacagaagccaggaggugacccgggacgaagaguccacacgcucugaagaggucacgagagaagagauggccgcugccggccugaccguuacagugacccacagcaaugagaagcaugaucuccacgugacaucccaacaggggucuagcgaacccgucgugcaggaccuggcgcagguuguggaggaagucaucggagugccucaauccuuccagaaacuuauuuuuaagggcaaaucucugaaggagauggagaccccgcucagcgcucuggggauccaggauggaugccggguuaugcuuauuggcaaaaagaacagcccccaggaagagguggaacugaagaaacucaagcaucuggagaaauccgucgaaaagaucgccgaccaacuggaggagcucaauaaagaacugacagggauucagcagggauuccuuccuaaggaucugcaggccgaggcucucuguaagcuggaccgcagagugaaagccaccaucgaacaauuuaugaagauccuugaggaaauugauacgcugauccuccccgagaacuucaaagacucucggcugaagcgcaaaggccuggugaagaaaguccaggcuuuucucgccgagugcgauaccguugaacagaauauuugucaagagacagaaagacugcaguccaccaacuucgcgcuugccgaguga

SEQ ID NO: 66328 - RNA, 1728 nt, Artificial Sequence
  derived and/or modified sequence opt5 from BAG3__Homo_sapiens__NP_004272
augagcgccgcuacccacucccccaugaugcaaguggccucuggcaacggggacagagauccucugccgcccggaugggagaucaagauugacccucagacaggcuggcccuucuuugucgaucauaauagccggacgaccacauggaacgacccucgcguucccuccgaagggccuaaagagaccccgucuagcgcgaauggacccuccagagaaggcucucggcucccucccgcucgcgaggggcacccuguguacccccagcugagaccgggauauaucccuauucccgugcuucaugaaggcgccgagaaccggcagguccacccuuuccauguguacccccagcccggcaugcaacgcuuuagaacagaggccgcugccgcugccccucagcggagccaguccccgcugcgcgggaugcccgaaaccacacagccugauaagcaaugcggacagguugcggccgcugccgcugcccagcccccugcgagccacggccccgagagaucucaguccccggccgcuagcgacugcuccucuucuagcuccagcgccucccucccuucuagcgggcgguccagccugggaucucaccaacuuccccgcggcuauaucuccauuccugugauccaugaacagaaugucaccagacccgcugcccagccuagcuuccaccaagcccagaaaacgcauuaccccgcucagcagggggaguaucaaacccaccagccgguguaccacaagauccagggagaugacugggagccucggccccugcgcgcggccucucccuuuagaagcuccguucagggcgcuucuagccgggaaggcuccccugccagaagcucuacaccgcuccauucccccagcccuauucgcgugcacaccgucguggaucggccccaacagccuaugacacauagagagaccgcccccgugucucagccugaaaacaaacccgaguccaagccggggccugucggacccgaacugccucccggccacaucccgauucagguuauccgcaaggagguggacagcaaaccugugucccaaaagcccccuccucccucugagaaagucgaagugaagguucccccggcucccgugccuugucccccucccagcccugggccguccgccguccccucuagcccuaaauccguggcgacggaggaacgggcugcccccagcacagccccugcugaggccacacccccgaagccuggagaagcugaggccccucccaagcaucccggcguucugaaaguggaggcgauucucgaaaagguccaggggcuggagcaggccguggauaauuucgaagggaaaaagaccgacaaaaaguaucuuaugaucgaggaauaccugaccaaagagcuccuggcucuugauucugucgaccccgagggcagagccgacgugcgccaggcucggagagauggcguucgcaaggugcaaaccauucuggaaaagcucgagcagaaagccaucgacgucccuggacaggugcaaguuuacgaacugcagccguccaaccuggaggcggaucagccccuccaggccaucauggagaugggagcuguggccgcugacaagggcaaaaagaaugccgggaacgccgaagauccucacacagagacgcaacagcccgaagcuaccgcggccgcuacaagcaauccuucuuccaugaccgacacacccggaaacccggccgccccuuga

SEQ ID NO: 66329 - RNA, 1266 nt, Artificial Sequence
  derived and/or modified sequence opt5 from BAG4__Homo_sapiens__NP_001191807
augagcgcccugagacgguccggcuacgggcccucugacggaccuagcuauggccgcuacuaugggccgggaggcggggaugugcccguccacccucccccuccccucuacccucugagaccggagcccccucagcccccuaucuccuggcggguucgcggaggcggccccgcugaaaccacauggcuuggggagggaggcgggggagacggcuauuacccgucugggggagccuggccugaacccggcagagcgggcgggagccaucaaucccugaacucuuauacgaauggagcuuacggcccuaccuacccucccgggcccggagccaacacagccagcuauuccggcgcuuacuaugccccgggguacacccagacaagcuauucuaccgaggugcccuccacauaccggagcucuggaaauuccccuacccccgugagccgcuggauuuauccucagcaggauugccaaacggaagcucccccgcucagaggccaggucccuggcuaucccccuucucagaaccccgggaugacccugccucacuaccccuacggagacggcaaucgguccgugccgcagagcgggccuacaguucgcccccaagaggaugccugggcgucccccggagccuacggcaugggcgggagauauccuuggccgucuagcgcucccuccgccccucccggaaaccuuuacaugaccgagagcacaucuccuuggcccuccagcggcucuccucagagcccgcccuccccucccgugcagcagccuaaggacucuagcuaucccuacucccaaagcgaucagucuaugaaucggcauaacuucccguguuccguccaccaguaugaaagcucugggaccgugaauaacgacgauuccgaccugcucgauagccaaguucaguacuccgcugagccucagcuguacggaaaugccacgucugaccaucccaacaaucaggaucaaagcuccucucugccugaagagugcgugcccagcgacgaguccacacccccuagcaucaaaaagauuauccacguccucgaaaaagugcaguaucuggagcaggaaguggaggaauuugucggcaagaaaaccgacaaggcguacuggcuucuggaggagaugcucacaaaggaacugcuugagcuggauucuguugaaaccgggggacaggacuccgugcgccaagccagaaaagaggcuguguguaagauucaggccauccucgaaaaacuggagaagaaaggccuguga

SEQ ID NO: 66330 - RNA, 1467 nt, Artificial Sequence
  derived and/or modified sequence opt5 from BAG5__Homo_sapiens__NP_001015049
augagauuccacuggcugcccacccucagcgagccuuuugaccggaaccaggaacuggagacaugcauccgcccgcuuuggacgcccuccggcucugccugugaaaccgagcauaauaagagcauggauauggggaaccaacacccuuccauuucuagacugcaggaaauccagaaagaggugaaaagcgucgagcagcaaguuauuggauucuccggccucucugacgauaaaaauuacaagaaacuggaacggauccuuacaaagcagcuguuugagauugacagcguggauaccgaagggaagggagacauccagcaggcucgcaaaagagccgcgcaagagacagagcggcuccugaaggaacuggagcagaacgcuaaucauccccaccgcaucgaaauucagaacaucuucgaggaagcccagucccucgugagagagaaaauugucccuuuuuauaauggcgggaacugcgugaccgaugaguucgaagagggaauccaagacauuauccugcggcuuacacauguuaagaccggcggcaaaauuagccugcgcaaggccagauaccacacgcucaccaagaucugugcugugcaggaaaucauugaggauugcaugaaaaagcagcccucucugccucuuuccgaagacgcccacccgagcgucgcuaaaaucaauuuugugaugugugagguuaacaaggcccgcggggugcugauugcgcuccugaugggagucaauaacaaugagacaugccggcaucugucuugugugcucuccggccugaucgccgaucuugacgcucuggaugugugcgggagaaccgaaauucggaacuaucgcagagaggucguugaagacaucaauaaacuccugaaguaccuugaccuggaggaagaggccgauacaaccaaggcuuucgaccuccggcaaaaccacagcauccugaagauugagaaggugcugaaaagaaugcgcgaaaucaagaacgagcuccugcaggcccagaaucccucugaacuuuaucuguccagcaaaacggagcuccagggacugauuggccaacuugaugaggugucccuggaaaagaacccuuguauccgggaggcgagacgccgggccgucauugaagugcagacacucaucaccuacaucgaccugaaagaggcucuggaaaagagaaagcucuuugccugcgaggagcaucccucucacaaagcuguuuggaaugugcuggggaaccuuagcgaaauucagggagagguccuguccuucgauggcaaucgcacagacaagaacuauauccggcucgaggaacugcugaccaaacagcuucucgcccuggaugccguggacccucaaggcgaagagaaguguaaagcugcgagaaagcaggccguucgccuggcucagaauauucucagcuaccuggaucuuaagucugacgagugggaauacuga

SEQ ID NO: 66331 - RNA, 2712 nt, Artificial Sequence
  derived and/or modified sequence opt5 from BAG6__Homo_sapiens__NP_001186626
auggagcccaacgacagcaccuccacagccguggaggaaccugauucucuggaaguccucguuaagacgcuggacagccagaccagaacauucaucgugggcgcucaaaugaaugugaaagaguuuaaggaacacauugccgcguccgucucuaucccgagcgagaaacagcggcuuauuuaccaggggcgcgugcugcaggaugacaagaaacuccaagaguauaacguuggaggcaaggugauccaucuggucgaaagagcucccccucagacccaccuucccuccggggccucuagcggaacaggcuccgccagcgcuacccaugggggaggcucuccucccggcacacgggggccuggagccuccgugcacgaucgcaaugcuaacagcuacguuauggugggcaccuucaaucugccgucugacggguccgccgucgaugugcauauuaacauggagcaggcgcccauccagagcgaaccuagagugcggcucgucauggcccaacacaugauccgcgacauucagacgcugcugucuagaauggagugccggggaggcccccagccucagcacucccaacccccgccucagcccccugcuguuacccccgagcccguggcccucagcucccagacaucugaaccuguggagagcgaagcuccgccccgcgagccuauggaagccgaggaggucgaagagagagcgcccgcccaaaauccugaacugacccccgggccggcuccugccggacccacacccgcucccgagaccaacgccccuaaucaucccuccccggccgaauauguggagguucuucaggagcugcagcggcucgaaagccgccugcagccuuuucuucaaagauacuaugaggugcugggcgcugcggccacgacagauuacaacaauaaccacgaaggccgggaggaagaccagcgccucaucaaucuggucggggagucucugagacuccugggaaacaccuucguggcucuuuccgaucugcgguguaaucucgccugcacaccucccagacaucugcacguugugcgcccuaugagccacuauaccaccccgaugguccuucagcaggccgcuauucccauccaaauuaacgugggcacaacggucaccaugacagggaacggaacccggccucccccuacacccaaugccgaggcgccucccccgggcccugggcaggcuucuagcguggcccccuccucuaccaacguugaaagcuccgccgagggagcuccucccccgggcccugccccgccucccgcuacgagccaucccagagugauccgcauuucucaccaguccgucgaaccugugguuaugaugcauaugaauauccaggacagcggcacacaacccgggggagugcccucugccccuaccggcccccuggggccucccggacacggccagacccucgggcagcaggucccuggcuuuccgacagcgcccacccggguggugaucgccagaccuacacccccucaagcucgccccucccauccgggaggcccucccguuagcgggacgcugggagccggccuggggaccaacgcuucccucgcccagauggucucuggacuggugggccagcuucugaugcaacccgugcucgucgcgcaggggacaccuggcagccccggaggccuggggcuugagucccugucuccugaguucuuuaccagcgugguucagggagugcucuccagccugcugggcucucucggggcccgggcuggauccagcgaaucuauugccgcuuucauccagagacuguccggcagcucuaauauuuuugagccgggggccgauggcgcccuuggauucuuuggcgcucugcucagccugcugugucaaaacuucuccauggucgacgugguuaugcuucuccacgggcacuuucagccccugcagcgccugcagccucaacuccggagcuucuuccaucagcacuaccugggaggccaggaacccacaccuucuaauaucagaauggcgacccauacgcuuauuaccgggcuggaggaauacgugcgcgaguccuuuagccucguccaggugcaacccggaguugacaucauccggacaaaccuggaguuccugcaggaacaguuuaauuccauugccgcucacgugcuucacugcaccgauucuggcuucggggccagacuccuggagcuguguaaccaaggccucuuugaaugccuggcccuuaaucugcauugucucggaggccagcagauggagcuggcugccgucaucaacgggcggauucgcagaaugagccggggagugaauccgucccuggugucuuggcuuacaaccaugaugggccucagacugcaggucguucuggaacacaugccuguggggcccgacgcgauccuccgcuaugugcggagagucggagauccuccccaaccucugcccgaggagccgauggaagugcagggcgcugagcgcgccagcccugaaccccaggaguggguucccauuauccagcaagacauccagucccagagaaaggugaaaccucagccgccccuuucugaugccuaccugagcggcaugccugcuaagcggcgcaaacucagauccgacauucaaaagcggcugcaggaagaucccaacuauagcccucagcgcuuccccaaugcccagagagcguuugcugacgauccuuga

SEQ ID NO: 66332 - RNA, 1536 nt, Artificial Sequence
  derived and/or modified sequence opt5 from BAIAP2L1__Homo_sapiens__NP_061330
augagcagaggccccgaggaagugaaccggcugaccgaguccacauaccgcaaugucauggaacaguucaacccugggcucagaaaucugaucaaccuuggaaagaauuaugagaaagccguuaacgcuaugauucuggccggcaaggcguacuaugacgggguggcuaaaaucggagaaauugccacgggcucuccggugagcaccgagcucgggcacguccugaucgagauuuccucuacacauaagaaacuuaaugaaagccuggaugagaacuuuaagaaguuccacaaagaaaucauccaugagcucgagaagaaaauugaacuggacgugaaguacaugaaugccacccugaaacgguaucaaacagagcacaagaacaagcucgaaucccuggagaaaucucaggcugaacuuaagaaaauccgcagaaagagccagggaucccggaaugcccugaaauacgagcauaaggagauugaauauguugagaccgugacaagccgccagucugaaauccaaaaauuuauugcugauggcugcaaggaggcccuccuggaagagaagagacgguucuguuuucuugucgacaaacacugcggcuucgcgaaccacauccauuacuaccaucugcaguccgccgagcuccugaauagcaagcugccccgcuggcaggaaaccuguguggaugcuauuaaaguuccugagaagaucaugaacaugaucgaagagauuaaaacgcccgccucuaccccuguguccgggacaccccaggcuagcccuaugaucgaaagaucuaaugucgugcggaaggacuaugauacccucuccaagugcagcccgaaaaugcccccugcccccuccggacgcgcguacacaucuccucugauugacauguuuaacaaccccgccaccgcugccccgaauagccaaagagugaacaauuccacgggcacaagcgaggauccuucucuucagcgguccgucagcguugcuaccgggcugaacaugaugaagaaacagaaggugaaaacaaucuucccccacaccgccggaucuaauaagacccuccugagcuuugcccagggcgacgugauuacacuucugaucccugaggaaaaggauggguggcucuauggagagcacgacgucuccaaagcucgcggcugguuccccucuagcuacacgaagcugcuggaagagaacgagaccgaagcggugacaguucccaccccuuccccgacacccgugagaagcaucucuaccgucaaucucuccgagaacagcucugugguuauuccucccccugauuaucuggaaugucuuuccaugggcgccgcugccgaccggagagccgacagcgcucgcacgacauccaccuuuaaagcccccgcgucuaagccggagaccgcugccccuaaugaugccaacgggacagcuaaacccccuuuccugagcggagaaaaucccuuugccaccgugaagcuccggccuacagucacgaacgacagauccgcucccaucauucgcuga

SEQ ID NO: 66333 - RNA, 3351 nt, Artificial Sequence
  derived and/or modified sequence opt5 from BAIAP3__Homo_sapiens__NP_001186025
augagcacccugcucgacaucaaguccucugugcugagacagguccaaguuugccccagcuuccggcgcagaacagagcaggauccuggcuccgccucugcugacccgcaggaacccgccacgggggcguggaaaccuggagauggcguggaguuuuucgcucacaugcggcuuaugcugaagaaaggggaaggacgccagggccuccccugucuggaggugccucuuagaagcgggucccccgccccuccggaacccgucgacccuucucugggacuccgggcccuggcucccgaggagguggaaaugcuguacgaggaagcccucuauaccguucuguaccgcgcuggcacaaugggcccugaucaaguggacgaugaggaggcccuucugagcuaucuccagcaggucuuugggaccucccuggaagaacauacagaagcgauugagagagugcggaaggccaaagcucccaccuacgcccuuaagguuagcgugaugcgcgcuaagaaccugcucgccaaagacccgaauggauucucugauccuuauugcaugcugggcauccugcccgcguccgacgccacaagagaaccucgggcucagaaggagcaacgcuuuggguucagaaaaggaagcaagcggggcgggccccuccccgccaaauguauucaggucaccgaggugaagucuuccacgcugaacccuguguggaaggaacacuuucuuuucgagaucgaagaugucagcaccgaccagcugcaucucgauauuugggaccacgacgaugacguuucucugguggaggcuugccgcaaacuuaaugaagugaucggacugaagggcaugggcagauacuuuaaacagaucgucaaguccgcccgggccaacgggacagcuggaccgaccgaggaucauacagacgauuuccucggcugucugaauauucccgugagacgcgacaccgcgaugagccaacgggggagauccggauuucugucucaccuccugcuucugagccaccuccugcgccuugagcauuccgccgaagaaccuaacuccucuuccuggcggggcgaacugagcacgcccgcugccacaauccucugccugcacggggcccagucuaaucugagcccucuccagcuggcuguucuucauuggcaaguguccucuagacaccaccagaccuguacacuggauuauagcuaccuccugggacugcuugaggacaugcaggcccauugggaagaggcgcccucccucccgcaggagcaagaagagagccuggcugauucucuguccgccuucagcgaauuuggccuccagcugcuucgccagcugcgggacuacuucccugccaccaacucuaccgcuguccacagacucgagcugcugcuuaaaugccucggcaagcugcagcuguuccaacccuccuuugagauuuguccuuucgaaagcgagcucaauauggauaucgccgcugcccugaaacgcgggaaccgggaaugguaugaccgcauucuuaaugacaagagccccagagagcagccuggaccccagcggcugccgggccucgugguucuggcggaugccguguacgacgaucugcaguuuugcuauucugucuacgcuagccuuuuccauuccauccucaacguggacgucuuuacacugacguucagacaacuggaacggcucguggccgaggaggcuuggguucugaccgaggagcuuucuccuaagaugacacuggaaguggccagcgggcucuuugagcuguaucugacccuugcggaucuccagcgcuucugggacuccauucccggaagagauagccggucucuggcccuggcuggcauccacgcccccuuucucccugcugucaaacugugguuccaggugcuuagagaccaggccaaguggcgccugcaaggggccguugauauggacacacucgaaccgguggaugcuuccagccggcauucuuccagcgcggccaccgcuggccugugucugucucacauccaggagcuuugggucagacuggccuggcccgacccugcccaggcucaaggacucggcacgcagcuggggcaggaugugugcgaggccacacucuuuuacaccgaacugcuucgcaaaaagguggacacccagcccggagcggcuggcgaggccguuagcgaagcccugugcgucgugcucaauaacguggagcuggucagaaaagcugccgggcaagcgcugaagggacuugcuuggccugaaggcgccacagggcccgagggcgugcugccucggccccuccuguccuguacccaggcccucgacgaugaccugcagcgcgaggcucacacaguuacggcccaucuuaccagcaagauggugggagauauuagaaaauauguccagcacaucucucuguccccggacagcauucaaaaugaugaagcuguggccccucucaugaaguaccuggacgagaaacuggcgcuucugaacgccucccucguuaagggcaaccugucucgggugcucgaagcucugugggagcuucugcugcaggccauccuccaggcucugggggccaaucgcgaugucagcgccgacuucuacuccagauuucauuucacacuugaggcucuggugucuuucuuucacgcggaaggacagggccucccccuggagagccuccgggauggguccuauaaacgccugaaggaggagcuuagacugcacaagugcucuacccgggaauguauugagcaauucuaccuggacaaacucaagcagcgcacacuggagcagaacagauuuggacggcuuagcguuagaugccauuaugaagccgcugagcaacgccuggccguggaaguccuccacgccgcugaucugcucccucuggacgccaauggccuuuccgaucccuucgugaucguggagcuggggccgccucaucuguuuccccucguccggagccagagaacccagguuaaaacgcgcacccugcacccuguguacgacgaacuuuucuauuuuucugugcccgcggaggcuugucggagacgcgccgccugcguccuguucacagugauggaccaugauuggcucuccaccaacgacuuugcuggcgaggccgcgcugggacucggcgggguuacaggaguggcucggccccaggucggcgggggagccagagccggccaaccugugacccugcaccuuugucgcccgcgggcucagguuagaagcgcccugcggcgccuggaagggagaacgucuaaggaggcucaggaguucgugaaaaagcucaaggaacuggaaaaaugcauggaggccgaucccuga

SEQ ID NO: 66334 - RNA, 636 nt, Artificial Sequence
  derived and/or modified sequence opt5 from BAK1__Homo_sapiens__NP_001179
auggccagcggccaggggcccggaccuccgagacaagagugcggcgaacccgcucugccuuccgccucugaggaacagguggcgcaggacaccgaggaagucuuccggagcuacguuuucuaucgccaccagcaagagcaggaggcugaagggguggccgcccccgcugauccugagauggugacacucccccugcagccuuccucuacgaugggacaggucggcagacaacuugccaucauuggggacgauaucaaccggcgcuacgacagcgaauuucagaccaugcugcagcaucuccagccgacagcugagaaugccuaugaguacuuuaccaagauugcgacaucccuguucgaaucuggaaucaacuggggcagagugguugcccuucugggcuuuggguaucggcucgcucugcacguguaccaacauggacugaccggcuuccucgggcaggucacacgcuuugugguugauuucaugcugcaccauuguauugccagauggaucgcucagcggggaggcuggguggccgcgcuuaaucuggggaacggacccauccucaauguccugguggugcuuggcgucguucugcucggccaauuuguggugcgcagauucuuuaaaagcuga

SEQ ID NO: 66335 - RNA, 783 nt, Artificial Sequence
  derived and/or modified sequence opt5 from BAMBI__Homo_sapiens__NP_036474
auggacagacacagcuccuacaucuucauuuggcugcagcucgagcugugcgccauggcugugcuucugaccaagggcgaaauccgguguuauugcgaugccgcgcauugugucgcuacaggguacaugugcaaaucugagcucagcgccuguuuuucccgccugcuugacccccaaaacucuaauagcccucugacgcacggaugccucgauucccuggccucuaccacagacauuugucaggcuaagcaggccagaaaccauagcggcaccacaaucccgacccuggaaugcugucacgaggauaugugcaauuaucgggggcuccaugacguucuguccccuccccgcggagaagcuagcggccaggggaacagauaccaacacgauggaucucggaaucuuauuacaaaagugcaggagcugaccuccagcaaggagcucugguuccgcgccgcggugaucgccguccccaucgcuggcggccugauucuugugcugcucaucaugcuggcccugagaaugcuccggucugaaaacaaacgccugcaggaccagagacaacagaugcuuucccggcugcacuauagcuuucaugggcaccauucuaagaagggacagguugcuaaacucgaucuggaguguauggugccugucuccggccacgaaaauugcugccuuacgugugacaagaugcgccaggccgaucugagcaacgacaaaauucucucccuggugcacugggggauguacucuggacauggcaagcuggaguucguuuga

SEQ ID NO: 66336 - RNA, 270 nt, Artificial Sequence
  derived and/or modified sequence opt5 from BANF1__Homo_sapiens__NP_001137457
augaccacaagccagaagcacagagacuucguggccgagcccaugggcgaaaaaccugucgggucccuggcuggaaucggcgagguucucgggaagaaacuggaggaacggggauuugauaaggccuacguggugcuuggccaauuccugguccucaaaaaggacgaagaucuguuucgcgaguggcuuaaggacacgugcggggcgaacgcuaaacagucuagagauuguuucggaugccugcgggaguggugugacgccuuucucuga

SEQ ID NO: 66337 - RNA, 2268 nt, Artificial Sequence
  derived and/or modified sequence opt5 from BANK1__Homo_sapiens__NP_001077376
augaucuacgaggaagacgccgaggaaugggcucuguaucucaccgagguguuccugcacgucguuaagagagaagccauucuucuguaccggcucgagaacuuuagcuuccgccaucuggagcuucugaaucucacauccuauaaaugcaagcugcugauccucucuaacagccugcuuagagaucugacgcccaaaaagugucaguuucucgagaaaauucugcacuccccuaagucuguggugacccuucugugcggcgucaagagcuccgaccaacucuacgagcugcugaauaucucucagagccggugggaaauuuccacagagcaggagccggaagauuauaucagcgugauccagucuauuaucuucaaagacuccgaggauuacuuugaaguuaacauucccaccgaccuccgcgcgaagcauagcggggagaucucugaaagaaaagagauugaggaacuguccgaggcuagccggaauacaaucccucuugccgugguccugcccaccgaaauuccuugugagaaccccggagaaaucuucaucauucuccgcgaugaggugaucggcgacacaguugagguggaauuuaccucuuccaauaagcggauucggacgcgcccugcccuguggaacaaaaaggucuggugcaugaaggcucuugaguucccggccgggagcgugcacgugaaugucuauugugauggaaucguuaaagcuaccacaaagauuaaauacuaccccaccgccaaggcgaaagaaugccuguuuagaauggccgacuccggcgagucucucugucaaaacagcaucgaagaacuggauggggugcugacauccaucuucaagcaugagauuccuuauuacgaauuucagagccuccagaccgagaucugcucucagaauaaauauacgcacuucaaggaacugcccacacuucugcacugugcugccaaguuuggacucaaaaaccuggcuauucaucuucugcaaugcuccggcgccaccugggcgagcaagaugaaaaauauggagggcucugacccugcccacaucgcugagcggcaugggcacaaggaacucaaaaagauuuucgaggauuucagcauccaggaaaucgacauuaacaaugagcaggaaaacgacuacgaggaggauaucgccuccuuuucuacauauauucccagcacccagaacccggcuuuccaccaugaaucccgcaagaccuacggacaaagcgccgacggcgccgaggcuaaugaaauggagggggaaggaaaacagaacggcucugggauggagacaaagcacuccccucuggaggugggaagcgaaucuuccgaggaucaguaugacgaucuguacgucuuuauccccggcgcggacccugaaaauaacagccaagagccccucauguccucuagacccccucugccgcccccucggcccguggccaaugcuuuccagcuugaacgcccucauuuuacgcugcccggcaccaugguugaggggcagauggagagaagccagaacuggggacacccgggcgugcggcaagaaacaggggaugagccuaaaggagaaaaggagaaaaaggaggaagagaaggaacaggaggaagaggaggaccccuacaccuucgccgaaauugaugacuccgaguaugauaugauccucgccaaucugucuauuaaaaagaaaacaggcagcagauccuuuaucaucaaccgcccucccgcuccuacccccagaccgacgagcauuccucccaaggaagagacaacccccuacaucgcccaggucuuccagcagaaaaccgcgagacgccaaucugacgacgauaaguuucgggggcugccuaagaaacaggacagagcucgcauugaauccccggccuucagcacacuucggggaugucucaccgauggccaggaggagcugauccugcuccaagaaaaggugaaaaauggcaagaugucuauggacgaggcccuggaaaaauuuaagcauuggcagauggggaaauccggacuugagaugauucagcaggaaaagcugagacaacuccgcgauugcaucaucggcaagcggcccgaggaggaaaacguuuauaauaaacugacaauugugcaccacccugggggaaaggagacggcucauaacgaaaauaaauucuacaacguccacuuuagcaauaagcugcccgccagaccucagguggagaaagaguucggcuucugcuguaagaaggaccauuga

SEQ ID NO: 66338 - RNA, 1518 nt, Artificial Sequence
  derived and/or modified sequence opt5 from BANP__Homo_sapiens__NP_001167010
augaugagcgagcacgaccuggccgaugugguccagaucgcuguugaagaccucucccccgaucauccuguggugcuggagaaccacgucgugaccgacgaagaugagccggcccuuaagagacaacggcuggaaauuaauugccaggaccccucuaucaagagcuuccucuacuccauuaaccagacaaucugucugcgccuugauucuauugaggcgaaacugcaggcucucgaggccacgugcaaaagccuggaagagaagcuggaccucguuaccaauaaacaacauuccccuauccaggugcccauggucgccggcucuccucugggggcuacacagaccuguaacaaggugagaugcguugugccccagacaaccgucauccuuaauaacgaucggcaaaaugccauuguggcuaagauggaagacccucugagcaaccgcgccccggauucccucgagaaugugaucagcaacgcgguccccggaagacggcagaauacaauuguugugaaagugccuggccaggaggacucucaccaugaagauggggaguccggaagcgaagccucugacuccgucagcucuuguggccaggcugggucccaaagcaucggauccaacgugacccugauuacgcuuaauucugaggaagacuaucccaacggcaccuggcugggcgaugagaauaacccugagaugcgcguuagaugcgccaucauucccagcgacaugcuccacaucuccacaaacugucggaccgcugaaaagauggcccugacacugcucgauuaccuguuucaccgcgaggugcaggcggucagcaaucuuucugggcagggaaaacauggcaagaaacaacuggacccgcucaccaucuaugggauuagaugccaccuguucuacaaguuuggaaucacggaauccgauugguaucggauuaagcagagcaucgacucuaaaugucgcacagccuggagacggaagcagcgcggccagagccuugcugugaaauccuucucuagacggaccccuaacagcuccagcuacugccccucugagccuaugauguccacacccccucccgccagcgaacugccgcaaccccagccucagccccaggcucuccauuaugcccuggccaaugcucaacagguucagauucaccagaucggggaggauggacaagugcaggucggccaucugcacaucgcccaggugccucagggcgagcaaguccagauuacccaggacucugaagggaaccuccaaauccaccaugugggacaggauggccagguucugcagggggcgcaacuuauugcuguggccuccagcgaccccgccgcugccggagucgauggcuccccgcugcaggggucugacauccaggugcaguacguucaacucgcgccugugagcgaccacaccgcuggagcccagacagccgaggcucugcagcccacgcuucagccugaaaugcaacuggagcauggcgccauucagauccaguga

SEQ ID NO: 66339 - RNA, 2190 nt, Artificial Sequence
  derived and/or modified sequence opt5 from BAP1__Homo_sapiens__NP_004647
augaacaagggcuggcuggagcucgaaagcgaccccgggcuguucacccuucugguggaggauuuuggagucaaaggcguucagguggaagagaucuacgaccuccaauccaagugccaggggccuguguauggauucauuuuucuguucaaauggaucgaagagagacggucucgcagaaaggucagcacacuuguggaugacacguccguuauugaugacgauaucgugaauaacauguuuuucgcccaccagcugauucccaauucuugugcuacccaugcccuccugagcguccugcucaacugcuccucuguggaccugggccccacacuuagccggaugaaagauuuuaccaagggguucuccccugagagcaagggauacgcgaucggcaaugcucccgaacuggccaaagcccacaacucucaugcucgcccugagcccagacaccucccugaaaagcagaauggccuguccgccguucggacaauggaggcuuuucauuucgugagcuaugucccgaucaccgggcgccuuuuugagcuggacggacucaaaguguaccccauugaucacggcccuuggggagaagacgaggaauggacagauaaggccagacgggugaucauggagcgcauugggcuggcgaccgccggcgaacccuaucacgacaucagauucaaccugauggcugucguuccugaccggcgcauuaaauacgaggccagacuccaugugcugaaggugaaucggcaaacgguccuugaggcucugcagcagcucauccgcgugacccagcccgaacugauucaaacacacaagucucaggagucccagcuuccggaagagagcaaaucugccuccaacaagagcccucugguucucgaagcgaauagagcccccgcugccuccgaggggaaccauaccgauggagcugaggaagccgccggcucuugugcucaggcgccuagccacuccccgcccaauaaaccuaagcugguggucaaaccgcccggcagcucucugaacggggugcacccuaaucccacaccuaucguucaacggcuccccgccuuucuggacaaccauaacuaugcuaaguccccgaugcaggaggaagaggaucuugccgccggagugggcagaagccgcgucccugugcggcccccucagcaauacucugacgaugaagacgauuacgaggacgaugaggaagacgauguccagaauaccaacagcgcucugagauauaaagggaagggaacgggcaagcccggggcccucuccggaucugcggacggccagcugagcgugcuucagccuaauacaaucaacguucuggcugagaaacucaaggaaucccaaaaagaccugagcauuccccugucuaucaagaccuccagcggcgccgggucuccggccguggcugucccuacacacucccagcccagccccaccccuuccaaugagucuaccgauacagccagcgagauuggauccgcuuucaacucuccgcuccgcagccccauccgguccgccaauccuacgagacccagcucuccugugaccucccauauuagcaaaguucuguucggcgaagacgauucucuucugcgcguggacugcauccgguacaacagagcgguccgcgaucucgggcccgugaucuccacaggacugcugcaccuugccgaggacggcgugcucagcccucuggcucugaccgaagggggcaagggaucuagccccuccauucggccgauccagggcagccaggggucuuccagcccuguugagaaggaagucguggaggccacagauuccagagagaaaaccggaauggugcgccccggcgaaccucucucuggggagaaguauagccccaaagaacugcuugcucugcucaagugugucgaggccgaaauugcgaauuacgaggccugccugaaagaggaaguggagaagcggaagaaauuuaagaucgacgaucaaagacggacgcauaacuaugacgaguucauuuguacauuuaucuccaugcuggcucaggaaggaaugcuugccaaucucguugaacagaacaucucugugcgcagacggcagggcgucagcauugggagacugcacaaacaacgcaagccggaucggagaaaacgcuccagaccuuacaaggcuaagcggcaguga

SEQ ID NO: 66340 - RNA, 2334 nt, Artificial Sequence
  derived and/or modified sequence opt5 from BARD1__Homo_sapiens__NP_000456
augcccgacaacagacagccucggaaucgccaaccgagaauccggagcggcaacgagccccgcuccgccccugcuauggaacccgaugggagaggagccugggcgcacucucgggcugcccuggaccgccucgagaagcugcuuagaugcagccgguguaccaauauucugcgcgaaccugugugccucggcgggugugagcauaucuucugcuccaacugugucucugauugcauuggaacaggcugucccguuugcuacacgccugccuggauccaggaccugaaaauuaauagacagcuugauagcaugauccagcuguguuccaagcuccggaaccugcugcacgacaaugaacucucugaucugaaagaggacaagccgcgcaaaagccuuuuuaacgaugcugggaauaagaagaacuccaucaaaaugugguucagccccagaucuaagaaagugcgguauguggucuccaaggccagcgugcaaacccagccugcuauuaaaaaggacgccucugcgcagcaggauuccuacgaguuuguuagccccucuccucccgccgacguguccgaacgcgcuaagaaagccagcgcuagauccggaaagaaacaaaagaaaaagacacuggccgagaucaaucagaaauggaaccucgaagcggagaaggaggauggcgaguucgacucuaaggaagaaagcaaacagaagcuggucuccuuuugcagccagccgucugugauuuccagcccucaaaucaauggcgagauugaccuucuggccucugggagccucaccgaauccgaguguuucggaucucugacagagguuagccugccccucgcugaacagaucgaguccccugauaccaaaagccggaacgaaguggucacacccgagaaggugugcaaaaauuaucugaccucuaagaagucccuuccccuggaaaacaacggcaaaagagggcaucacaaucgccucagcucuccuauuuccaagcggugcagaacgagcauccuguccaccucuggagacuuugugaaacagacagucccgagcgagaacaucccccuuccugaguguuccucucccccuagcugcaagcgcaaaguuggcgggaccuccggacggaagaauagcaacaugucugaugaguucauuucccugagccccggcacaccgccuucuacccucuccagcucuagcuacagacgcgugauguccagccccucugccaugaagcugcugccuaauauggcugugaaacggaaccauagaggcgaaacgcuccugcacaucgccuccauuaagggggacauccccagcgucgaauaucuucugcaaaauggauccgauccuaacgugaaagaccacgccggcuggacaccccuccaugaggcuuguaaucacgggcaucugaagguuguggaacuucugcuccagcacaaagcgcuggucaacaccacaggauaccagaaugauucuccgcugcacgacgccgcuaagaacggccauguggauauuguuaagcuccugcuuagcuauggggccucccgcaaugccgugaacaucuuuggacugcggccugucgacuacaccgaugacgagucuaugaaaagccuccugcugcuucccgagaagaaugaauccucuagcgcuucccacugcagcgugaugaacaccggccagagacgcgacggcccccucguccugaucgggucuggacuguccagcgagcaacagaaaaugcucucugaacuggccgugauucuuaaggcgaaaaaguacacagaguucgauuccacgguuacccauguggucgugccuggcgacgcuguucagagcacacugaaauguaugcucgggauccugaacggaugcuggauucugaaguuugagugggugaaggccugucuucggagaaaagucugcgaacaggaggaaaaguaugagaucccggaaggcccccggcgcucuagacucaaucgggagcaacugcugccuaaacucuucgauggguguuacuuuuaucuguggggcaccuucaagcaccaucccaaagacaaccuuauuaagcuggugacagccggaggcgggcagauccucuccagaaagccuaaacccgauagcgacgugacccagacgaucaauacaguugcuuaccacgcccgcccugauuccgaccagcgguucugcacccaauauauuaucuacgaggaucuguguaacuaucaccccgaaagaguccgccagggaaagguguggaaagcuccgagcucuugguuuauugacugcgugaugagcuucgagcugcuuccucucgauuccuga

SEQ ID NO: 66341 - RNA, 984 nt, Artificial Sequence
  derived and/or modified sequence opt5 from BARHL1__Homo_sapiens__NP_064448
auggagggcagcaacggguucggaaucgacuccauucugucucacagagccggcagccccgcucucccuaagggggauccgcugcuuggagacugccggucuccccuggaacucuccccucgcagcgaguccucuagcgauuguuccagccccgccucuccuggcagagacugccuggaaaccgggacaccccggccuggaggcgcguccggcccggggcuugauagccaucugcagcccggacaacucucugcuccugcccagucccgcacggugaccagcucuuuucugaucagagacauucuggccgauuguaaaccccucgcugccugcgcuccuuacuccagcuccggccagcccgccgcgccggagccugggggacggcuggccgcuaaggccgcugaagacuuccgcgauaaacuugacaagucuggcagcaaugccuccagcgauucugaguauaaagucaaggaggaaggggacagagagaucuccagcucucgggauagcccucccguucgccugaagaaacccagaaaggcgcggacagccuuuaccgaccaccagcucgcucaacuggaacgcuccuucgagagacagaaauaccuuucugugcaggaccggauggagcuggccgcuagccucaaccugacagauacccaggugaagacaugguaucaaaaucgcagaaccaaauggaagcggcagacggccgucggacuggaacuccuggccgaggcuggcaacuacuccgcgcuucagagaauguuucccagcccuuauuucuacccgcagucucugguguccaaucucgaccccggcgccgcucuguaucuuuaccgcgggccuagcgcucccccucccgcccugcaacggccgcucguuccucgcauucugauccauggacugcagggcgccucugaacccccucccccucugcccccgcucgccggggugcuuccuagagcggcucagccccgguga

SEQ ID NO: 66342 - RNA, 765 nt, Artificial Sequence
  derived and/or modified sequence opt5 from BARX1__Homo_sapiens__NP_067545
augcagagacccggcgagccuggggccgcucgguucggaccgcccgaaggcugcgccgaccaccgcccucacagauaccggagcuuuaugaucgaggaaauucugaccgagcccccugggcccaagggagcggcuccugccgccgcugccgcugccgcgggcgaacuccugaaauucggggugcaagcccuucuggcugcccgcccguuucacucccaucucgcuguccugaaggccgagcaggcggccguuuucaaauuuccccuugcuccucugggauguucuggccucagcuccgcccugcuggcugccggccccgggcucccuggagccgcuggcgcgccccaucugccgcuugagcugcagcucagagggaagcuggaagccgcuggaccuggcgagcccgggacaaaagccaagaagggacggcgcucuagaacgguguucaccgaacuucagcugaugggccucgagaaacgguuugagaagcaaaaauaucugagcacaccugaucgcaucgaccuggccgaaucccucggccugucucagcuucaggugaagaccugguaccagaauagacggaugaaauggaagaagauuguccugcaagggggaggccucgagagccccacaaaacccaaggggcgcccuaaaaagaacuccaucccgaccagcgaacagcugacagagcaggaaagagcuaaagaugccgagaagcccgcggaggugccuggagaacccucugaccggucccgcgaggauuga

SEQ ID NO: 66343 - RNA, 840 nt, Artificial Sequence
  derived and/or modified sequence opt5 from BARX2__Homo_sapiens__NP_003649
augcacugccaugccgagcugagacucagcucccccggccagcugaaggcugcccggcgcagauacaaaaccuucaugaucgacgaaauucuuucuaaggagacaugugauuauuuugaaaaacugagccucuacuccgugugcccuucucuggucguucggccgaagccccuucacagcuguacgggguccccuucucugcgcgcguauccccuccugagcgugaucaccagacaaccuacagugauuucccaucugguccccgcuaccccuggaaucgcccaggcccucagcugccaccaggugacagaggcuguuucugccgaagcuccgggcggggaggcccuggcguccagcgagucugaaaccgagcagcccacaccucggcagaaaaagccccgcagaucccggaccauuuucacggaacuucagcugaugggacucgagaagaaauuucagaagcagaaauaccugagcaccccugaccgccuugaucuggcccaaucucucggccugacacagcugcaagugaagaccugguaucagaacagacggaugaaauggaagaagaugguccucaaagggggacaagaggcucccacaaagccgaaaggccgcccuaagaaaaauuccauccccaccagcgaagagaucgaagccgaggaaaagaugaacucccaggcucagggccaagagcagcuggagccuucucaggggcaggaggaacuuugugaagcccaagagcccaaagcgagagacgugccccuggaaauggccgagccuccggaucccccucaggagcuccccauuccuagcuccgaacccccgccucugagcuga

SEQ ID NO: 66344 - RNA, 684 nt, Artificial Sequence
  derived and/or modified sequence opt5 from BASP1__Homo_sapiens__NP_006308
augggcgggaagcugagcaaaaagaaaaagggauacaacgugaaugacgagaaagccaaggaaaaggauaaaaaggcugagggcgccgcgaccgaagaggaagggacacccaaagaguccgagccucaggcugccgccgaaccggcugaggccaaggaaggaaaagagaagcccgaccaagaugcugagggcaaggccgaagagaaagaaggggagaaggacgcggccgcugccaaagaagaggcuccuaaggccgagcccgagaaaacggagggagcggccgaagcuaaggccgagccucccaaagcuccugaacaggagcaggccgccccgggccccgcugcgggcggggaggccccuaaggcugccgaagccgcugccgcgcccgcugagucugccgccccugcugccggagaagaacccagcaaggaagagggcgagccgaaaaagaccgaagcuccugccgcgcccgccgcucaggagacaaaauccgauggggccccugcuucugacagcaagcccggauccucugaagccgcgcccagcuccaaagagaccccugccgcuacagaggccccgagcucuacccccaaggcucaaggcccugccgccuccgcugaggaacccaagccugucgaagcgcccgccgcuaacagcgaucagacaguuaccgugaaagaguga

SEQ ID NO: 66345 - RNA, 825 nt, Artificial Sequence
  derived and/or modified sequence opt5 from BATF2__Homo_sapiens__NP_612465
augcaccugugcggcgggaacggacuccugacccagacagaccccaaggagcaacagagacagcuuaaaaagcagaaaaaucgggccgcugcccaacgcagcagacagaagcauacggauaaagcggacgcucugcaccagcagcaugaaucccucgagaaggauaaccuggcccuucggaaggaaauccaaucucugcaggccgagcucgcuugguggagccgcacccugcacgugcaugaaagacuguguccuauggacugcgccuccuguucugcuccgggccuccuggggugcugggaucaggccgagggacuucugggccccgggccucagggacaacacggcugucgggagcagcucgaacuguuccagacacccggcagcugcuacccugcgcaaccccuuuccccugggccgcagccccacgacucuccuagccugcuccaguguccccugccuucccugagccucggacccgccgucguugcugagccgccugugcagcugucucccuccccucuucuguuugccagccauaccggcagcucccuccaagggucuucuuccaaacugagcgcccuucagcccucccugacagcucagaccgcgcccccucagccgcucgaacuggagcaccccacacgcggaaagcugggcucuagcccugauaaucccuccagcgcccucgggcuggcuagacuucaaucucgggagcauaaaccugcccuguccgcugccaccuggcagggacucguggucgaccccagcccgcacccucugcuugccuucccccugcucucuagcgcucaggugcacuuuuga

SEQ ID NO: 66346 - RNA, 378 nt, Artificial Sequence
  derived and/or modified sequence opt5 from BATF__Homo_sapiens__NP_006390
augccccacagcuccgacucuagcgauuccucuuucagcagauccccuccgcccggcaagcaggacucuagcgaugacgugcggcgcguccaaagacgggagaaaaaccgcaucgccgcucagaaguccagacagcggcagacccaaaaagccgauacacugcaucucgaaagcgaggaccuggaaaagcagaaugcggcccuucgcaaagagauuaagcagcugacggaggaacucaaguacuuuaccucuguucugaacucccacgagccucuuugcagcgugcuggcugccucuacacccuccccucccgaaguggucuauagcgcucaugccuuccaccagccucaugugucuuccccgagauuucaacccuga

SEQ ID NO: 66347 - RNA, 666 nt, Artificial Sequence
  derived and/or modified sequence opt5 from BAX__Homo_sapiens__NP_001278357
auggacggcagcggggagcagcccagaggaggcgggccuaccuccucugaacaaaucaugaagacaggagcccugcuccugcagggcuucauucaggaucgggcugggcgcaugggaggcgaggccccggaacuugcgcuggaccccgugccucaggaugcuagcacgaaaaagcucuccgagugccugaaaagaaucggcgacgaacuugauucuaacauggagcugcaacggaugauugccgccgucgacaccgauagcccccgcgagguguuuuucagaguugcugccgacauguuuuccgaugggaauuucaacuggggacggguggucgcucucuuuuacuucgccucuaagcuggugcugaaagcgcucuguacaaagguuccugaacugauccgcaccauuaugggcuggacacuugacuuucugagagagcggcuccugggguggauccaggaucagggaggcugggggcuuccccuggccgaaagccucaagcgccugaugucccugagcccuggaagaccgccccuccugcuuugggacgcucacguggccgaucgggaccaucugugcggcggcucugcucaccgccucacccaucaccuggaggaggacgggcuuagaccucccgccgcgcuggauugugucuucccucccuga

SEQ ID NO: 66348 - RNA, 4671 nt, Artificial Sequence
  derived and/or modified sequence opt5 from BAZ1A__Homo_sapiens__NP_038476
augccccugcuccacagaaagccuuucgugcggcagaaaccgcccgccgaccugcgcccugaugaggaagucuuuuacugcaagguuaccaacgagaucuucagacauuaugacgacuuuuucgaacggaccauucuuuguaauagccuggugugguccugcgcugugacgggccgccccgggcucaccuaccaagaggcccuggaaucugagaaaaaggcgagacagaaccuucagagcuuuccugagccccugaucauuccuguccucuaucugacaucccugacccaccggucucgccuccaugaaaucugugaugauauuuucgcuuacgugaaagacagauauuuuguugaggaaacaguggaggucauccggaauaacggagcccgccugcagugcagaauccuugaggugcugccgcccagccaccaaaauggcuucgccaacgggcauguuaauuccguggauggagaaaccauuaucauuucugacagcgaugacuccgagacacagagcuguucuuuucagaacggcaagaagaaagaugcuaucgacccucuccuguucaaguacaaaguccagcccaccaagaaagaacuucacgaguccgccauugugaaggcuacgcaaaucagccggcgcaagcaccuguuuucuagagauaaacucaagcuguuccugaaacagcauugcgaaccucaggacggggugauuaagaucaaagccuccagccucucuaccuauaagaucgcggagcaggacuuuuccuacuucuuccccgaugacccgccuacauuuauuuucagccccgccaaucggcgcagaggacggccucccaaaagaauccacauuucccaagaggauaacgucgcuaauaagcagacccuggccucuuaccgcagcaaggcuacaaaagaacgggacaaacuucugaagcaggaggaaaugaagucccucgccuuugagaaagcgaagcugaagagagaaaaagccgaugcucuugaggccaagaaaaaggagaaagaagacaaggagaagaaacgcgaggagcugaagaaaaucguugaagaggagcggcucaagaaaaaggaagagaaggaaagacugaaaguggagcgcgagaaggaacgggagaaacugagagaagagaagcgcaaauauguggaauaccucaagcaauggagcaaaccccgggaggauauggagugugacgaucugaaggaacuuccugagccgacccccgucaagacgagacugccucccgaaauuuucggcgacgcucucauggugcuggaguuucuuaacgccuucggcgaacuguuugaucuccaggacgaguucccugacgggguuacacuggaggugcuggaagaggcccucgucggaaaugauucugaaggcccccugugcgagcuucuguuuuucuuucucaccgcuaucuuccaggcgaucgccgaagaggaggaagagguggcuaaagaacagcugacagacgccgauaccaaggaccugaccgaggcccuugaugaggacgcugauccgacaaaauccgcccucagcgcgguugcuucucuggccgccgcuuggccucaacugcaucagggguguagccucaagucccuggaccuugauucuugcacgcugagcgaaauucuccgccugcacauccuggccuccggagcugacgugaccagcgccaacgcgaaauaucgguaccagaagagaggcggguuugaugccacagacgaugcuuguauggagcuucggcucucuaaucccucccuggucaagaaacugagcucuaccuccguguaugaccucacaccuggagaaaagaugaaaauucugcacgcccuuugcggcaagcugcucacccuggucagcacgcgcgacuucaucgaggauuacguggacauucugagacaggcuaaacaagaguuccgggagcuuaaggccgagcagcauagaaaggaacgcgaggaagcggccgcucggaucagaaaacgcaaggaggaaaaacucaaggagcaggagcagaaaaugaaggaaaagcaagagaaacugaaggaagaugagcagagaaacuccacagccgacaucucuauuggcgaagaggagcgggaagauuuugacaccagcaucgaguccaaagauaccgaacagaaggagcuggaccaggauaugguuacagaggacgaagaugaccccgggucucacaaacgcggaagacggggcaagcgcgggcaaaacggauucaaagaguuuaccagacaggaacagauuaauugcgugacacgggagccucucacggcugaugaagaggaggcccugaagcaagaacaucagcgcaaggagaaagaacuucuggagaagauccagagcgccauugcuuguaccaacaucuucccccucggcagagaccggauguaucgcagauacuggauuuuuccguccaucccugggcuguucaucgaagaggacuacagcggacugacagaggauaugcuucucccccggcccucuuccuuucagaauaacguccaaagccaggacccucaggugucuaccaaaacaggcgaaccgcugauguccgagagcaccucuaauauugaucagggccccagagaccacagcguucaacugccuaagcccgugcauaaaccuaaccgcuggugcuucuauuccagcugugaacagcucgaucagcugaucgaggcgcuuaauucucgggggcacagagaauccgcccugaaggagacgcuccugcaggaaaagagccgcauuugcgcucaacuggcccgguuuuccgaagagaaauuccacuuuucugacaagccccagccugauagcaaacccaccuacuccagaggacgcucuagcaacgccuaugacccgucccagaugugugcugaaaagcaacuugagcugcggcucagagauuuccugcucgacaucgaggaucgcauuuaccagggcacacugggggccaucaaagucaccgaccggcauaucuggagaucugcgcuugaaagcggacgguaugagcugcucuccgaagagaauaaggaaaacggcauuaucaagacagugaaugaggacguggaggaaauggagauugaugaacagaccaaaguuaucgucaaggaccgccugcuggggauuaaaacggagacaccuagcaccgugucuacaaacgcuuccacaccccagagcgugucuuccgucgugcacuaccuugccauggcccuguuucaaaucgaacagggcaucgagagacgguuccucaaggcuccucuggaugccagcgacucuggacgcuccuauaaaaccguucucgauagauggcgggagagccugcuuuccagcgcgucucugagccagguguuccuccaucuguccacccuggacagaucugucauuuggagcaaguccauccuuaaugcucgcugcaagauuugucggaaaaagggcgaugccgaaaacauggugcugugcgacgggugugauagaggacaccacacguacugcguucgccccaaacucaagaccgugccggagggcgacugguuuuguccugaaugccggcccaaacagagaucucgccggcugagcuccagacaacgcccuucucucgagagcgaugaagacgucgaggauuccaugggaggggaggacgacgaaguggauggcgacgaggaagaggggcagagcgaggaagaggaauacgagguugaacaggaugaggacgauucucaggaggaagaggaagugucccugcccaagagaggccggccccaaguccgccuuccugugaagacaagaggaaaacugucuagcuccuucagcucccggggccagcagcaggagccggggcgcuaucccucuagaagccaacaguccaccccuaagacaaccgugagcucuaaaacgggacggucccugagaaagaucaauagcgcucccccuacagaaaccaaaucucuccgcauugccagccgguccaccagacauucucacggcccccugcaggccgacgucuuuguugagcuucugagcccucgccggaagagacgggggcgcaaauccgcuaacaacacaccggaaaauucucccaacuucccuaauuuuagagugaucgccaccaagagcuccgaacaaagccggucugugaacaucgcguccaagcucagccugcaggaguccgaaucuaaacgcagaugccggaagcgccagagccccgagccuucccccgucacacucggaagacggucuagcggccgccaagggggcgugcaugaacuguccgccuucgagcagcuuguuguggagcuggucagacacgaugacagcuggccguuucugaaacucgugucuaagauucagguuccugauuacuaugacaucauuaaaaagcccaucgcucugaauauuauccgggaaaaggugaacaaaugugaguacaaacuugccuccgaguucauugaugacaucgaacugauguuuagcaauugcuucgaguauaaccccagaaauacgucugaagcuaaggccggaacccgccuccaggccuuuuuccauauccaggcucaaaagcugggccuccacgucacaccuuccaacguggaucagguuagcacacccccugcggccaaaaagucucggauuuga

SEQ ID NO: 66349 - RNA, 4452 nt, Artificial Sequence
  derived and/or modified sequence opt5 from BAZ1B__Homo_sapiens__NP_115784
auggcuccccugcucggcagaaagccuuucccgcuggugaaaccccuuccuggggaggaaccccuguuuaccaucccucacacacaggaggcuuuccggacgcgcgaagaguacgaagccagacucgagcgguauagcgagcgcauuuggaccugcaaguccacaggaucuagccaacugacccauaaagaagcgugggaggaggaacaggaggucgcugaacuucugaaggaggaauuucccgccugguacgagaaacucguucuggaaauggugcaccauaacacagccucccuggagaagcucguggacaccgcuuggcuggagaucaugacaaaguaugccgucggcgaagagugugauuucgaaguggggaaagagaagaugcuuaaaguuaagauugugaaaauccacccucuggaaaaggucgacgaggaggcuaccgaaaagaaaucugauggagccugcgacagcccguccucugauaaggagaauagcucccagauugcgcaggaccaucaaaagaaggaaacggugguuaaagaggaugaaggcagacgggagagcaucaacgaccgcgccagacggucuccccgcaagcucccuaccucccugaaaaagggggagagaaagugggcucccccuaaauuucuuccccacaaguacgaugugaaacugcagaaugaagacaagaucauuagcaacgucccggccgauucucucauccggacagagcgcccucccaauaaagaaauugugagauauuucauccggcacaacgcucugcgcgccggaaccggcgagaaugcgccuuggguggucgaggacgaacugguuaagaaguacucccuccccagcaaauuuucugauuuccugcuugaccccuauaaguacaugacacugaacccuuccaccaaaagaaagaauacgggcagcccggaccggaaacccuccaagaagucuaaaacagauaacagcucccucagcucuccucugaaucccaaacuuuggugucaugugcaccugaaaaagucccucagcgggucuccucugaaagugaagaacagcaaaaauuccaaaucucccgaggaacaucuggaggaaaugaugaagaugaugagcccgaacaaacuccacaccaauuuucacauuccuaagaaaggacccccugccaagaaacccggcaagcauuccgacaagccucugaaagcuaaggggagaagcaaaggaauccuuaacggccagaagucuacagggaacuccaaaagccccaagaagggacugaaaaccccgaagaccaaaaugaagcagaugacacuccuggauauggccaaaggcacgcaaaagaugacccgcgcuccuagaaauucuggcgggacacccagaaccuccagcaagccccacaaacaucuuccuccggccgcccugcaccucauugcuuacuauaaggagaacaaagaccgcgaggauaagcgguccgcgcugucuugcgucaucagcaaaacagccagacugcucuccucugaagaccgcgcucggcugcccgaggaacuuagaagccuggugcagaagcgcuacgagcuccuggaacauaagaaacggugggccuccaugagcgaggagcagagaaaggaauaucugaaaaagaaacgcgaggaacuuaagaaaaagcucaaggagaaagccaaggaacggagagagaaagagaugcuggaacggcuggagaagcagaaacgcuacgaagaucaagagcucaccggaaagaaucugccugcuuucagacuuguugacacgcccgagggccugccuaacacacucuuuggggauguggccauggucguggaguuccugucuuguuauuccggacugcuucuccccgacgcgcaguacccuaucaccgcuguuagccugauggaagcccugucugccgauaagggcggguuucucuaucugaaucgggugcuugucauucugcuccagacccugcugcaagacgaaaucgcugaggacuacggagaacuuggcaugaaacucuccgagauuccccugacacugcacagcgugucugagcucgucagacugugccuucgccggagcgaugugcaggaagaguccgaaggcagcgacaccgaugacaacaaggauucugccgcuuucgaggacaaugaaguucaggaugaguuccuggagaaacucgaaacauccgaguuuuucgaacugacgagcgaggaaaagcugcagauccuuaccgcccucugucaccggauucugaugacauacuccgugcaagaccauauggagacccgccagcagaugucugcggagcuguggaaagaaagacucgccguccugaaggaggaaaacgauaagaaacgggcugagaagcagaaacgcaaggagauggaagccaaaaauaaggagaacgggaagguggaaaauggacuuggcaaaacagacagaaagaaagagaucguuaaguuugaaccgcaaguggauaccgaggcugaggacaugaucagcgccgucaaaucccggcgccugcucgcgauucaggccaagaaggaaagagagauccaggaacgggagaugaaagugaagcuggaacgccaggcugaggaggaacggauuagaaaacacaaggccgcugccgagaaagccuuccaagaagggaucgcuaaggcgaaacuggugaugcgcagaacgccuauuggaaccgaucggaaccauaauagauauuggcuguuuucugacgagguucccggccuuuucaucgaaaagggguggguccacgacagcaucgauuaccgcuuuaaccaccauugcaaggaccacacaguguccggcgaugaggacuauuguccucggucuaaaaaggccaaucucggaaagaacgcuagcaugaacacccagcauggcacagccaccgagguggccgucgaaacgacaacccccaagcaggggcagaaucugugguuccucugcgauucccaaaaagagcuggacgaacuucugaacugucuccacccgcagggaauuagagagagccagcugaaggagcgccuggaaaagcgguaccaagauaucauucauucuauccaccuugcuagaaaaccuaaucugggccucaaguccugcgacgggaaccaggagcugcucaauuuucugcgcagcgaucuuauugaaguggccacacggcugcagaaaggaggccucggguauguugaggaaaccucugaguucgaggcgagagugaucucccuggaaaagcugaaagacuuuggcgagugcgucauugcccuucaggccagcgugaucaagaaguuccugcaaggauuuauggcccccaaacagaagcgccggaaacuccagucugaagauuccgcuaagaccgaggaaguugacgaggagaaaaagaugguggaagaggccaaggucgcgagcgcucuggaaaaauggaagacagccaucagagaggcccagacguucucccggaugcacgugcuccugggcaugcuugaugcuuguauuaaaugggacaugagcgccgaaaacgcucgcugcaagguuugucggaaaaagggggaggacgauaaacugauccugugcgacgaguguaauaaggccuuccaucucuuuugccugagaccugcgcuuuacgaagugcccgauggagaguggcaaugucccgccugccagccugcuaccgcccgcagaaacucucggggcagaaauuauacagaagagagcgcuuccgaggacucugaagaugacgagagcgaugaagaggaagaggaggaagaggaagaggaagaggaggaagacuacgaggucgccgggcugcgccuccggccgagaaagaccauucgcggaaaacacuccgugauucccccugccgcucggucuggcagacgccccgggaagaaaccucauagcacacggagaucccagcccaaggcgccuccgguggaugacgccgaagucgaugagcugguucuccagaccaaacgcucuagcagacggcaaucccuggaacuucagaagugugaggagauccugcacaagaucgugaaauaccgcuucagcuggcccuuuagagaaccugugacgcgggacgaggcugaagacuauuacgaugucaucacacaucccauggacuuccagaccgugcaaaacaagugcucuuguggcuccuaucgcagcguucaggaguuucugaccgauaugaaacagguguucacaaaugccgaggucuacaacugcagaggaucucacgugcucuccugcaugguuaagaccgaacagugucugguggcccuucugcacaaacaucucccuggccaccccuauguccggagaaagcgcaagaaauuuccggaccggcuggcugaggaugaaggggacagcgagccugaagccgugggacaauccagaggccgccggcagaagaaauga

SEQ ID NO: 66350 - RNA, 5712 nt, Artificial Sequence
  derived and/or modified sequence opt5 from BAZ2A__Homo_sapiens__NP_001287834
auggaggccaacgaccacuucaauuuuaccggccugcccccugcuccggccgcgagcgggcucaagcccuccccuucuagcggagaaggccuguacacaaacgggucccccaugaauuucccucagcaaggaaaaucucuuaacggcgaugugaaugucaacgggcugagcacgguuucccauaccacaaccucuggaauccucaauagcgcuccccacuccagcucuacaucccaucugcaccauccuagcguggccuaugacugccuuuggaacuacucucaguauccguccgccaaucccggcagcaaccugaaggauccuccccuccugucucaguuuuccggcgggcaguacccucugaauggaauucucggcgggagcagacaacccuccucuccgagccacaacaccaaucugcgggcuggaucccaggaguucugggccaacggcacacagagcccuauggggcuuaauuuugacucucaggaacuguaugauuccuuccccgaccaaaacuuugaggugaugccuaacggaccccccagcuucuuuaccucuccucagacgagcccgaugcucggcuccucuauccagaccuucgcucccagccaggaagucggcuccgggauucacccugaugaggccgcggagaaagaaaugacaagcgugguugccgagaauggaaccggccugguggggucucuugaacuggaggaggaacaacccgagcucaagauguguggauacaacggcuccgucccuagcguggaaucucugcaucaggagguuuccgugcugguccccgacccgacagugagcugccucgaugacccuucccaccugcccgaucagcuugaagacaccccuauccugucugaggauagccucgagcccuuuaauucccuggcuccugaacccgugucugggggacuuuauggcauugacgacacggagcugaugggcgccgaagauaaacucccgcuggaggacagcccugucaucuccgcucuggauugucccagccucaacaaugccacagcguucucucugcuugccgacgauucccaaaccagcacaucuaucuuugcuucccccaccagcccuccgguucugggggaaucugugcuccaggacaacagcuucgaucugaauaacggauccgacgccgagcaggaggaaauggagacccagagcucugauuuccccccuucccuuacacaacccgcuccugaccagagcuccacgauucagcugcaucccgccaccucuccugccgugagccccacaaccuccccggcugucucucucgugguuagcccugcggccucccccgaaaucucuccugaggugugccccgcugccagcacagucguguccccggccguuuuuagcguggucucuccugcuuccagcgccgugcugcccgcggucucucuggaagugccucucaccgcuuccguuacgagccccaaggccucucccgugacauccccugccgcugccuucccgaccgcuagccccgccaauaaggaugucuccagcuuucuggagaccacagcggacguggaggaaauuaccggcgaggggcuuacagccucuggaagcggcgacguuaugcgcagacggaucgcuacgccugaagaggugcgccugccccuccagcacggguggagacgggagguccgcauuaaaaagggcucccacagauggcaaggagaaaccugguacuacggcccuugugggaaacggaugaagcaguuccccgaggugaucaaauaucugucucgcaacgugguucauagcgucagacgggaacacuuuuccuucucuccucgcaugccggugggagauuuuuucgaggaaagagacacacccgagggccugcagugggugcagcuuagcgccgaggaaauuccuucccggauccaagcuaucaccgggaagcgcggaagaccccggaauacagagaaggccaaaaccaaggaagucccuaaagugaagagaggccgcgggcggcccccgaaaguuaagauuacggagcuccugaacaaaaccgauaauagaccucugaagaagcucgaagcgcaggagacacugaacgaggaagacaaagccaagaucgcuaaaucuaagaaaaagaugcgccagaaggugcagcggggcgagugccaaaccacaauucagggacaggccagaaauaaacgcaagcaagaaaccaaaagccuuaagcagaaagaggcuaagaagaaauccaaggccgaaaaagagaagggcaaaacgaagcaggagaagcugaaagaaaaggucaaacgggagaagaaagaaaaggugaaaaugaaggagaaggaggaaguuacaaaagccaagcccgcuuguaaagcggauaagacccucgccacacagagacgccuggaggaacggcaaagacagcagaugauccuggaggaaaugaaaaagcccaccgaggacaugugccuuaccgaucaucagccucuccccgacuuuagccgcgugccugggcugacacugccgucuggagcuuucuccgauugucucacgauugucgaguuucugcacagcuucggcaaggugcuuggguuugaccccgccaaagauguuccuucucugggagugcuccaagaaggccugcugugccagggggacucccuuggcgagguccaggaucuccuggugcggcugcucaaggccgcucugcaugaccccggauucccuagcuacugucagucccuuaaaauccugggcgaaaaggugucugagaucccccucaccagagacaacgucagcgaaauucugcggugcuuccugauggccuaugggguugagccggcgcuuugcgaucgccucagaacacaaccuuuucaggcucagcccccucaacagaaagccgccgugcuggcuuuccuggugcacgagcucaacggauccacccugaucauuaaugaaaucgacaagacacuugagagcaugucuuccuaccggaagaacaaauggauugucgaaggcagacugcgccggcucaagaccgugcuggccaaaagaacggggcgcagcgagguugaaauggagggacccgaggaaugucugggcagacggcgcucuagcagaaucauggaggaaacauccgggauggaggaggaagaggaagaggaaucuaucgcggcugugccuggccggcgcggaagacgggauggcgaggucgacgccaccgccagcuccauucccgagcuugaacgccagaucgagaagcugucuaaaagacagcucuuuuuccggaagaagcugcuccacagcucccaaaugcugcgcgcugugagccuugggcaggauagauaucggagacgcuacuggguucugccguaucucgccggaauuuuuguggaaggcaccgaggggaaucuggucccugaagaggugaucaaaaaggagacagacucucugaaaguugcugcccaugcgucccuuaaccccgcccuguucagcaugaagauggaacucgcuggauccaauaccacagccucuagccccgcucgggccagaggccgcccucggaaaacgaagccgggcuccaugcagcccagacaccugaaaucuccugugcgcgggcaggauagcgagcaaccccaggcccagcuccagccugaagcucaacugcaugcgcccgcccagccucagccgcagcuucaacugcagcuccagucccacaagggauuucuggagcaagaaggcagcccccugucucuugggcagucccagcacgaccugagccagucugcuuuccucuccuggcugagccaaacccagucucauagcucccuccugucuagcuccguccuuacaccugauagcucccccggaaagcuggacccugcccccucucagccgccugaggagcccgaacccgaugaggccgaaagcuccccugacccccaggcucugugguuuaacauuucugcccaaaugccuugcaaugcggcuccgacccccccucccgccgugagcgaggaucagccuacacccuccccgcagcagcucgccucuagcaaaccuaugaaccggcccuccgcugccaauccuuguagccccgugcaauucucuuccaccccucuggcgggccuugcucccaagagacgcgccggggacccgggagagaugccucagagccccacgggccugggccagcccaaacggagagggcggccuccgucuaaguuuuucaaacaaauggaacagcgcuaccucacccagcugacagcccagcccgucccucccgagaugugcuccggauggugguggaucagagacccugaaaugcucgaugcuaugcugaaggcccuucacccccggggcauucgcgagaaggcucugcauaaacaccugaacaagcauagagacuuucuccaagaaguuugucugcggccuagcgccgaucccaucuucgagccgagacagcuuccugcguuccaggaggggaucaugucuuggucccccaaagaaaagaccuacgagacagaccuggccgugcuccaguggguggaagagcuggaacaacgcgucauuaugagcgaucuccagauccggggauggaccugcccuucccccgacagcacaagagaggaucuggcuuauugugagcaccuuucugacagccaggaagauauuaccuggcgcggccgggggagagagggacuggccccgcagcgcaaaacgacaaauccucuggaccucgcugugaugcggcuggccgcccuugaacaaaacguugagagacgcuaccugagagaaccccucuggcccacccacgaggugguccuggagaaggcucuccuguccaccccuaauggcgcgcccgaaggcacaaccacggagaucucuuaugaaauuacaccucggauccgcguguggagacagacccuugagcggugccgcagcgccgcucagguuugucugugccuggggcagcucgagagauccaucgccugggaaaagucugugaacaaagucacaugucuggugugccggaagggagauaaugacgaguuucuucugcucugcgacggcugugauagagggugccauauuuacugucaccgcccgaaaauggaagccguccccgagggagacugguucugcaccgugugucuggcucaacagguugaaggcgaguuuacacagaagccuggguuccccaaacggggacaaaagagaaagagcggcuauucccugaacuuuucugagggcgaugggcgccggagacgggugcuccuucgcggaagagaaagcccugccgcgggcccccgguacuccgaggaagggcugagcccuucuaaacgcagacggcuguccaugcgcaaccaucacagcgaccucaccuucugcgagaucauucugauggaaauggagucucaugaugcugccuggccguuucuugagcccgucaauccuagacugguguccggauaucggcgcaucauuaagaaccccauggacuucagcacgaugagagaacggcuccugagaggcggguacaccuccucugaggaauuugccgcugaugcccugcucguuuucgacaauugucagacauuuaacgaggaugacagcgaagugggaaaagcgggccacaucaugcgccgguucuucgaguccagaugggaggaauuuuaccagggcaagcaggccaaucuuuga

SEQ ID NO: 66351 - RNA, 6399 nt, Artificial Sequence
  derived and/or modified sequence opt5 from BAZ2B__Homo_sapiens__NP_001276904
auggagagcggcgaaagacugcccuccucugccgcuagcuccaccacaccuacgucuagcuccaccccgucuguggccagcgucguuuccaaggggggacucagcacaggcguggcgucucuguccagcaccaucaaccccugcgggcaccuuuuccggacagcuggagaccagccuuuuaaucugucuaccguguccagcgccuuccccauggucucucauccuguguuuggccuccacuccgccagcuccgggcauucugaguucggaggccugggcacacuugggacccccacggcucuggccgcucacccucaacucgccagcuuuccggaaugguggcgcaccacagaugcgcauaccagaacaggagccaccuucuuucccccucugcugggcauucccccucucuucgcucccccggcccagaaccacgacuccagcucuuuucacucccggacgagcgggaaaucuaaucgcaacggaccugagaagggcguuaaugggagcaucaacggauccaauacaucuagcgugauuggcaucaacaccuccguccugagcacaaccgcuucuuccagcaugggccagaccaaaucuacauccagcgggggaggcaauagaaaguguaaccaggaacaauccaaaaaucagccccuugaugcccggguggacaagauuaaggauaaaaagccucgcaaaaaggcgauggagucuagcuccaacucugacagcgauuccgggacgagcucugacaccuccagcgagggaaucucuuccagcgauucugacgaucuggaagaggacgaagaggaggaagaucagagcaucgaggaauccgaggacgacgauagcgacucugaauccgaggcccagcauaaaagcaauaaccaaguucuccugcacggcauuuccgaucccaaggcugacgggcagaaggccacagagaaagcucaggaaaagagaauccaucagccccuuccucuggccucugagagccaaacccacuccuuccagucucagcaaaaacagccgcaggugcucagccagcaacugcccuuuauuuuccaguccucucaggccaaggaagagagcgucaauaaacacacauccgugauccagagcaccggacuggugucuaacgucaagccucucucccugguuaaccaagcuaaaaaggaaacguacaugaagcuuauugugcccagcccugaugugcugaaagcgggcaauaagaacacaucugaggaguccagccuccugaccucugaacuucgguccaaacgcgagcaguauaagcaggccuuucccagccagcugaaaaagcaagaauccagcaagucucucaaaaaggucaucgcugcccugagcaauccgaaagccaccuccucuagcccugcucaucccaagcagacacuggagaacaaucacccuaaccccuuccucaccaaugcccugcuuggcaaccaucagccuaauggggugauucaguccguuauccaagaagcgccccuggcucucacaacgaaaaccaagaugcagucuaagaucaacgagaauauugccgccgcuagcuccacaccguucucuagcccugugaaccuguccaccagcggaagacggacacccggcaaucagacccccgucaugccuucugccuccccgauccuucacagccaagggaaagagaaggcugugucuaacaauguuaaccccgugaaaacgcagcaucacucccacccugccaagagccuggucgaacaguuucgcggaaccgacuccgauauucccucuagcaaagacuccgaggauagcaacgaagacgaggaggaagaugacgaggaagaggacgaagaggaugacgaggaugacgaaucugaugacucccagagcgagucugauagcaauuccgaaucugacacagagggcagcgaagaggaggaugacgaugacaaggaucaagacgaauccgacucugauaccgagggggaaaagacaagcaugaaacucaacaagaccacguccagcgugaaaucuccuuccaugagccugacaggccauuccacccccagaaaucugcacaucgcgaaggccccuggaucugcucccgccgcucucugcagcgagucccagucuccggccuuccugggcacaagcuccagcacccuuaccucuuccccucauagcgggacaucuaaacggcgcagagucacggacgaacgggagcugagaauuccccucgaguacggauggcagcgcgaaacccggaucagaaacuuuggcgggcgccugcagggagagguggcguauuacgccccuuguggcaagaaacugcggcaauaucccgaaguuaucaaggggaugcaguggugccuucucaaggaggaggaugugauuccgagaauccgcgcuauggaaggccggagaggacgcccucccaauccugaccggcagagagcccgcgaggaaucccggaugagacggcgcaaaggcagaccccccaacgucgggaaugcugaguuccuggauaacgccgacgccaagcugcuccggaaacugcaggcucaagaaauugcgagacaggccgcucagaucaagcuucugcgcaaacuccaaaagcaggagcaggcccggguggccaaggaggcuaaaaagcagcaagccauuauggcggcugaagagaaaagaaagcagaaagaacagaucaagaucaugaagcagcaagagaaaauuaagcgcauccagcagauuagaauggaaaaagagcugcgggcccagcaaauccuggaggccaagaaaaagaagaaagaagaggcugccaaugcgaagcuucucgaagcugagaaacgcauuaaggaaaaagagaugagacggcagcaggccguucugcugaagcaccaggagcgcgaaagacggcgccaacacaugaugcucaugaaagccauggaggcuagaaagaaggccgaagagaaagagcggcugaagcaggaaaaacgcgaugagaagagacuuaacaaagaacggaagcuggagcagagacgccucgaacuggagauggcuaaggagcugaaaaagccuaaugaagacaugugucuugccgaucaaaaaccgcuccccgagcugccucggauccccggacuggugcucagcggcucuacauuuagcgacugccugauggucgugcaguuccuuagaaacuuugggaaggugcugggauucgauguuaauauugacgucccuaaccucuccgugcugcaggaaggccugcuuaauaucggggauucuaugggcgaggugcaggaccuccugguccgccugcucagcgcggccgugugugaccccggacugaucaccggcuacaaagcuaagacagcccuuggggaacaucugcucaacguuggagugaaccgggauaaugucuccgagauucugcaaaucuuuauggaggcucacugcggccagaccgaacugacggagagccuuaagacaaaagccuuccaggcccauaccccugcucagaaggcguccgugcuggccuuucucauuaacgaacuggcuuguucuaaaagcguuguguccgagaucgacaagaauauugauuauaugucuaaccucagacgcgacaaaugggucguggaagggaagcugcggaagcuuagaaucauccacgccaaaaagaccggaaaacgcgauacaagcggcgggauugaccugggcgaggagcaacauccgcucggaacccccacaccuggccggaagagacggcgcaaagggggagauuccgacuacgaugacgaugacgacgaugacucugaugaccagggcgaugaagacgaugaggacgaagaggauaaggaggacaagaaagggaagaaaacggauaucugcgaagacgaggaugaaggagaccaggccgcuagcguugaggaacuggagaagcagauugagaaacuguccaagcaacagagccaguacagacggaaacuuuucgacgccucucacucccugcgcagcgugauguuuggccaagauagauaucggagacgcuacuggauccucccccaguguggcgggauuuucgucgaaggaauggagucuggcgaagggcuggaggaaaucgcgaaggagcgggagaagcucaaaaaggcugaauccgugcagaucaaagaggaaauguucgagaccagcggagacucucugaauugcuccaacacagaucacugcgaacagaaggaggaccuuaaagagaaggauaauaccaaccuguuucuccaaaagccuggcagcuucuccaaacugagcaagcugcuugaaguggccaaaaugcccccggagucugaagucaugacaccuaagcccaaugccggggcuaacggauguacccugagcuaucagaauuccggcaaacauucucucggcagcguucaguccacggccacccagucuaacguggagaaggcggacagcaauaaccuguuuaauacaggguccucuggacccggcaaguucuacagcccucuccccaacgaucaacugcuuaaaacccugacagagaagaacagacagugguuuucccugcucccucgcaccccgugcgacgauacaagccugacccacgcugacaugucuacggccucccuugugacaccccagagccagccucccucuaaauccccuagccccaccccggccccucugggguccucugcucaaaaucccgucggacucaacccuuucgcccugagcccccuccaggugaagggcgggguuuccaugaugggacugcaguuuuguggcuggccuaccggcguggucacaagcaauauucccuucaccucuuccgugccgagccuugggucuggacugggccugagcgaagggaacggaaauuccuuucucacgucuaacguugcuagcuccaaaucugagagcccugugccccagaaugaaaaggccacauccgcgcaacccgccgcugucgagguggccaagccuguugauuucccgagccccaaaccuauccccgaagagaugcaguuuggcugguggcggauuaucgacccugaggaucugaaggcucuucugaaagugcuccaucugagagggauucgcgaaaaggcccuccagaaacaaauccagaagcaccuggacuauaucacccaggccugccuuaaaaacaaggacgucgcuauuaucgagcugaaugaaaacgaggaaaaucaggugacacgggauauuguggagaacuggucugucgaggaacaagcgauggagauggaccuguccguucuccagcagguggaagaucuggagagacgcguggccagcgcuucccuucaggucaagggauggaugugucccgaaccugccucugagagagaggaccugguguacuucgaacauaaaagcuuuaccaagcucugcaaagagcacgauggcgaauucacaggcgaggacgaguccucugcccacgcucuggaacggaagagcgauaauccgcucgacaucgccguuacccgccuggcggaucuugagagaaacauugaacggcgcaucgaggaagacauugcucccgggcugagaguguggcggagagcccuguccgaggcccgcagcgcugcccaagucgcgcucuguauccagcagcugcagaaaucuaucgccugggagaaguccauuaugaagguguauugccaaaucugucggaaaggagauaaugaagagcuucugcuccugugcgacggcugugacaaggggugccauacguacugccacagaccuaaaauuaccacaauccccgauggagacugguucuguccugcuugcauugccaaggcuagcggccagacccugaaaaucaagaagcuccauguuaaagggaagaaaacaaacgaaucuaagaaaggaaagaaggugacccuuacgggcgauacagaggacgaagauuccgccagcaccucuuccagccugaaacgcggcaauaaggaccugaaaaagcggaaaauggaggagaacacaucuaucaaccucagcaagcaggaauccuuuaccagcgucaaaaagcccaagagagaugacuccaaagaucuggcucuuuguucuaugauucugaccgagauggaaacacacgaggacgccuggccguuccuccugccugugaaucugaagcucguccccggguacaaaaaggugaucaaaaagcccauggauuuuagcacgauucgggaaaagcuuuccucuggacaauauccuaaccuggagaccuucgcgcuggacguucgccucguguuugauaauugcgagacauucaacgaagacgacagcgauaucggcagagccgggcacaauaugcggaaauacuuugagaagaaauggaccgacacauucaaggucuccuga

SEQ ID NO: 66352 - RNA, 786 nt, Artificial Sequence
  derived and/or modified sequence opt5 from BBC3__Homo_sapiens__NP_001120712
augaaguucggcauggggagcgcccaggcuugccccugucaagugccuagagccgcguccaccacaugggucccgugccagaucuguggaccccgggagcgccacggcccuagaacgcccgggggacagcugccuggcgcucggcgcgggcccggaccuagacggccggcuccccucccugccagacccccuggcgcccugggcucuguucuucgcccccugcgggcccgcccggggugcagaccucggcgcccccauccugcugccagaugucucccccugcggccccaccgcccuaccagacggcauagacgcccgggaggcuuuccccuugcgugggggagcccucagcccgccccucggcccgcuccgggaagauccucugcccuggcucucgccggcggggcggccccuggaguggcucgcgcccaacggcccggcggcagcgggggaagaucccacccuggcgggcccggaucuccucgcggcgggggaacagugggccccggcgaccgggggccggcugccgccgauggaggcagaccucagcgcaccguccgggcugcggaaacaagaggggccgcugccgccccuccccugacccuggagggacccgugcagagccaucacggcacaccggcucucacccaggggccccaauccccucgcgacggcgcccagcugggagcgugcacgcggcccguugaugugagagacagcggcgggcggccucuucccccucccgauacccuggcuucugccggagacuuccucuguacaauguga

SEQ ID NO: 66353 - RNA, 312 nt, Artificial Sequence
  derived and/or modified sequence opt5 from BBIP1__Homo_sapiens__NP_001182233
augcugaaggccgcugccaaaagacccgagcucagcggccugcuuaaguucaacaauuacgggauccuguccgaaucuccucucaccagccagcggacaacguggcugcuuuaucaauccccgucuuuuauucccggauucgcguacccuagccgcugccugaaaaccaucggcgggguguauaagcaggcucggaaaaagcacuacauucagcagcucagauauggacgcuccgaggucaacguucccggcucuagcuccaaggccagagccacagugugugggcgguacaaugacaacggagcuguguga

SEQ ID NO: 66354 - RNA, 1164 nt, Artificial Sequence
  derived and/or modified sequence opt5 from BBOX1__Homo_sapiens__XP_011518705
auggccugcaccauccagaaggcugaggcccuggacggcgcgcaccucaugcaaauucugugguacgaugaagaggaaagccuuuaucccgcuguguggcugagagacaacuguccuugcuccgauuguuaccucgacucugccaaagcccggaagcugcuugucgaggcucuggauguuaauaucgggauuaaaggacucaucuucgaccgcaagaaaguguauauuacauggccggaugaacauuacagcgaguuucaggccgacuggcugaagaagagaugcuucuccaaacaggcucgggccaagcugcagcgcgagcucuuuuuccccgaaugucaauauuggggcucugagcugcagcuuccuacgcuggauuuugaagacgugcucagauacgaugagcacgcguauaaauggcugagcacccuuaagaaagucgggaucgugcggcugacaggagccuccgacaagcccggcgagguuucuaagcucgggaaacgcaugggauuccuguaccugaccuuuuacggccauacauggcaagugcaggauaagaucgacgcuaacaaugucgccuauaccacaggcaaacucagcuuccacaccgacuacccugcucugcaucaucccccuggggugcagcuucugcacugcauuaagcagacgguuaccggaggcgauuccgaaaucguggacggguuuaacgucugucagaaacucaagaaaaauaacccgcaggccuuccaaauucugagcucuacauuuguggauuucaccgacaucggaguggauuauugcgacuuuuccguccagagcaagcacaagauuaucgagcuugaugacaaaggccagguugugagaauuaauuucaacaaugcgacacgggauaccaucuucgacgugcccgucgaacgcgugcaaccuuuuuacgccgcucugaaggaguucguugaucucaugaacucuaaagaauccaaguuuacguucaaaaugaaucccggggacgugaucacauuugacaacuggagacugcugcacggacggcgcagcuaugaggccggcaccgagauuucuagacaucucgaaggcgcuuacgccgauugggacgucgugaugucccggcugcgcauccuuagacagcggguugagaaugggaacuga

SEQ ID NO: 66355 - RNA, 2172 nt, Artificial Sequence
  derived and/or modified sequence opt5 from BBS10__Homo_sapiens__NP_078961
augcugagcuccauggccgcugccggcucugugaaggcggcucuccaggucgccgagguucuggaagccaucgugagcugcuguguggggcccgagggaagacaaguccuuugcaccaaaccuacaggcgaagugcugcucucccggaacgggggacgccugcuugaggcucugcaccucgaacauccgauugccagaaugaucguugacugugugucuagccaccugaagaaaacgggcgauggggcuaagaccuucauuaucuuucugugccaucuccugcggggacuucacgccauuacagaccgcgagaaagauccccugaugugugagaauauccagacccauggcagacacuggaagaacugcucccgguggaaguucaucucucaggcgcuccugacauuucagacccaaauucuugacggcaucauggaucaguaccugagccgccacuuccucuccauuuuuagcucugccaaagaaagaacacugugucgguccagccuggagcuccugcuugaggcuuauuucugcgggcgcgucggaagaaauaaccauaaguuuaucucucagcugaugugugacuacuucuuuaaaugcaugaccuguaaguccggcauugggguguucgaacucguugaugaccacuuuguggagcugaaugucggagugacgggccuuccugugagcgauucucggaucauugccgggcugguccuccagaaagacuucuccguuuaucgccccgcugauggagacaugagaauggugaucgugaccgaaacaauccaaccucuguuuagcaccuccggcucugaguucauucugaacagcgaagcccaguuccagacaucccaguuuuggaucauggagaagaccaaggcgauuaugaaacaucuccacagccaaaaugucaagcugcuuaucucuuccgugaaacagcccgaucugguuagcuacuaugccggcgugaacgggauuucugucguggaaugccucagcuccgaggagguuucucugauccggcgcaucauuggacuuagcccuuucgugccgccccaggcuuuuucccaaugcgaaaucccuaauacggcccuggucaaguucuguaaaccccucauucugagaagcaagcgguacgugcaccugggccucaucucuacaugcgcuuuuauuccucauuccaucguccugugugggcccgugcacggacuuaucgagcagcaugaagacgcccugcacggcgcccucaaaaugcugagacagcuguucaaggaccuugaucucaacuauaugacccagacaaaugaccaaaacgggaccagcucucuguuuauuuacaaaaauuccggagagagcuaccaggcuccggauccuggcaacggcuccauccagcgccccuaucaggacaccguugcggaaaauaaggaugcccuggagaagacacaaacguaccucaaagugcauucuaaccuggucauuccugacguggagcuugaaaccuauauccccuacagcacacccacccugacaccuaccgauacguuccagacaguugagacccugaccugccugucccuggaacggaacagacuuacagacuauuacgagccgcuccugaagaauaacucuaccgcuuauagcacacgcgggaaucggauugaaaucuccuacgagaaccuccaggugacgaauauuaccagaaaaggaagcaugcuccccgucucuuguaagcugccuaacaugggcacaucccagagcuaccuuucuuccagcaugcccgccgggugcgugcugccugugggaggcaauuuugagauccuccugcacuauuaccugcuuaacuaugccaagaaaugucaccaaucugaagagaccaugguuagcaugaucauugcuaaugcccuccuggggauccccaagguccuguacaaauccaagacaggcaaauauagcuucccgcauaccuacauucgcgcggugcacgcucuccagacgaaccagccucuggugucuucccagaccggacuugaaagcgucaugggcaaguaucaacugcucacauccgugcugcagugccugaccaagauccuuacaauugauaugguuaucaccgugaaacggcauccccagaagguccacaaucaagacucugaggaugagcucuga

SEQ ID NO: 66356 - RNA, 2133 nt, Artificial Sequence
  derived and/or modified sequence opt5 from BBS12__Homo_sapiens__NP_689831
auggugauggccugcagagucguuaacaagcggcgccacaugggccugcagcaacucagcuccuucgcugagaccgggagaacauuucugggaccccuuaaaucuagcaaguucaucauugacgaagagugucaugaauccgugcugaucucuagcacggugcggcuccuggagucccuugaucugaccucugccgucggccagcuccugaaugaagcggugcaggcucagaacaauacauaccgcaccgggauuagcacacugcucuuucugguuggagccugguccagcgccguggaggagugccuucaccugggcgucccuaucucuauuaucguguccguuaugagcgaagggcucaacuucuguucugaggaaguggucucccugcaugugccggugcacaauaucuuugacugcauggauagcaccaaaacauucucucaacuugagaccuuuuccgucagccugugucccuuccuccagguuccuuccgacacggaucugauugaggaacugcauggacucaaggacguggcuucucagacccugacaaucagcaaccuuuccggcagaccccugaaaagcuaugagcucuuuaagccucagaccaagguggaagccgauaauaacacaucucggacccugaaaaauucccuucuggcugacacgugcugucgccaaagcauucucauccacucuagacacuucaaccggacagauaauaccgagggcgucagcaagcccgacggguuucaggaacaugugacagccacccacaaaaccuaccgcugcaacgaucugguugagcuggcggugggacucucccauggcgaccacucuagcaugaagcuggucgaggaagccgugcagcuucaguaucaaaaugcuuguguucagcaggggaacugcacaaaaccuuucauguuugauauuuccagaaucuucacguguugccugccgggacuccccgagaccagcucuugcguguguccuggcuacauuacagucguguccgucagcaauaaccccgugaucaaggaacugcaaaaccagccuguucggaucgugcuuauugagggggaccugaccgaaaauuaucgccaccucggauucaacaagucugccaauaucaaaacaguccuggacuccaugagacugcaggaggauagcuccgaggaacucugggcuaaccaugugcugcagguucuuauucaauuuaaggugaaucugguccucgugcagggcaacgugucugagcggcugaucgaaaaaugcauuaauagcaagcgccugguuaucggcuccgucaacgggucugugaugcaggccuucgcggaggccgcuggagccgugcaggucgcuuacaucacccaagugaaugaagacuguguuggcgauggggugugcgucacguuuuggagaagcagcccccuugacgugguugaucggaacaauagaauugccauccuccugaaaacagagggaauuaaccuggugaccgccguccucaccaauccggugacagcucagaugcagaucaaggaggaccgcuucuggaccugugcguaucggcuguacuacgcccuuaaagaagagaagguuuuucugggcgggggagcuguggaguuccucugccuguccugucugcacauucuugccgaacagucucucaagaaagagaaccaugccugcuccggcuggcugcacaauacaagcucuuggcuggcuuccagccucgccaucuauagaccuacgguccugaaguuucuugcgaacggcuggcaaaaauaccugucuacccuccuguauaacacagcuaauuacagcuccgaguucgaagccagcaccuauauccagcaucaucugcagaacgccacagauucugggucccccagcuccuacauucuuaaugaauauucuaagcucaacagccgcaucuuuaauuccgacauuucuaacaaacuggagcagaucccucggguguacgauguggucacccccaagauugaggcuuggagacgcgcccuggaccucguucugcuugugcugcaaacggauagcgaaaucauuaccggacacggccacacacagaucaauucccaggagcucaccggguuccuguuucuguga

SEQ ID NO: 66357 - RNA, 1782 nt, Artificial Sequence
  derived and/or modified sequence opt5 from BBS1__Homo_sapiens__NP_078925
auggccgcugccagcuccucugacagcgaugcgugcggcgcugaguccaacgaagccaauucuaaguggcuggacgcccacuacgaucccauggcuaacauccauaccuucagcgccugucucgcucuggccgaccuucacggggauggagaguauaaacugguggucggcgaccucgggccuggaggccagcaaccgagacugaagguucuuaaagggccccuggugaugacagaauccccucuccccgcgcugccugccgcugccgcuacguuucugauggagcagcaugaaccccggaccccugcccucgcgcuggccucuggaccgugcguguacgucuauaagaaucuucgccccuacuucaaauuuagccugccucagcugcccccuaacccccucgagcaggaucuuuggaaucaagcuaaggaggacagaauugauccgcugacacucaaggaaaugcuggaguccauccgggaaaccgccgaggagccucugagcauucagucucuccgcuuccugcagcuugaacuguccgagauggaggcuuuugugaaccagcacaaaagcaauucuaucaagagacaaacaguuauuaccacaaugaccacgcucaaaaagaaccuggccgacgaggaugccguguccugucuuguccugggcaccgaaaauaaagagcuccuggugcuggaccccgaggcuuucacaauccucgcgaagaugagccugccuucuguucccguguuucuugaagucuccggccaguucgauguggaguuucggcuggccgcugccugccgcaacgggaauaucuauauucucagacgggacagcaagcaucccaaauacuguaucgaacuguccgcccagccugugggacuuauucgcguccacaagguucugguggugggcucuacccaggacagccuccacggguucacacauaaaggaaagaaacuguggaccguccaaaugccggcugccauccugacgaugaaccuccuggagcagcacuccagaggccuucaggcggugauggcugggcuggccaauggagaaguucggauuuaucgcgauaaggcccuccugaacgugauccauacacccgacgcugucaccagccugugcuuuggcagauacggccgggaggauaauacacuuauuaugaccacccgcgggggaggccucaucaucaaaauucugaagagaacagccguguucguugaagggggaucugaagugggcccucccccugcucaagccaugaagcugaacgucccccggaaaacgagacucuacguggaccagacccugcgcgagcgggaagcggggacagccaugcacagagcuuuucagaccgaucuuuaucugcuccgccugcgggccgcuagagccuaccugcaggcgcuugaguccagccucucuccgcugagcacaaccgcccgcgaaccucugaagcuccacgcugucgugcaaggacugggccccacguucaaacuuacacugcaucuccagaacaccuccaccacacggccuguucugggccugcuuguguguuuccucuauaaugaggcccuguacucucugcccagagccuuuuucaaggucccucuccuggugcccgggcuuaacuauccgcuggagaccuuuguugaaagccucuccaauaaaggaaucagcgacauuaucaaggugcugguccugcgcgagggccagucugcuccucuucucuccgcccacgugaacaugcccgggagcgaaggacuggcugcggccuga

SEQ ID NO: 66358 - RNA, 2166 nt, Artificial Sequence
  derived and/or modified sequence opt5 from BBS2__Homo_sapiens__XP_005256137
augcugcuccccguguucacccugaaacuuagacacaaaaucagcccucggauggucgccauuggccgcuacgacgggacacauccgugccuggcugccgcgacgcagaccggaaagguuuuuauccacaacccccauacaagaaaucaacacguguccgcuucucggguguuccagagcccucucgaguccgaugucucucugcuuagcauuaaccaggccguguccugucugaccgccggcguucucaaucccgaacugggguaugacgcucugcucgugggaacacagaccaaccugcuugccuacgaugucuauaauaacucugaccuguuuuaccgcgagguggcugauggcgccaaugcgaucguucucgggacacugggagacauuagcuccccucuugccaucaucggcggcaacugcgcucugcaaggguucaaucaugaaggaagcgaucucuuuuggaccgugacgggcgacaacgucaauucucuggcccugugugauuucgacggggauggaaagaaggagcuccuggugggcuccgaagacuuugauauuagaguguucaaagaggacgagaucgucgcugaaaugaccgagacagaaauuguuaccagccuuugccccauguaugggucucgguuuggauacgcccuguccaacggcacagugggcguguaugacaagaccagccgcuacuggagaaucaagucuaaaaaucacgcgauguccauucacgccuucgaucucaacagcgacggggucaaugagcugaucacgggaugguccaacggcaagguggaugcucggucugaccgcacaggggagguuauuuuuaaagauaacuucagcuccgccaucgcuggaguggucgaaggcgacuacagaauggaugggcauauccagcuuauuuguugcagcguggacggagagauccggggcuaucugccuggcaccgccgaaaugcgcgggaaucucauggauacaucugccgagcaggaccugauuagagaacugucccagaagaaacaaaaccuccugcuugagcugcggaauuacgaggaaaacgcuaaggcggagcucgccagcccgcugaaugaagcugauggacaccgcggcaucauucccgccaacaccagacuucauaccacacugucuguuagccucgggaaugagacgcagaccgcccacacagaacugcggaucuccaccucuaacgacacaaucauuagagcugugcugaucuuugccgagggaauuuucaccggcgagagccacgucgugcauccuuccauccacaaucucucuagcuccauuuguauccccaucgucccucccaaggacgugccgguugaucugcaucuuaaagcguucgugggguaucgcagcucuacgcaguuucacgucuucgaauccacacggcagcugccuagauuuagcauguacgcucucaccucccuggaccccgccucugagccuauuagcuaugugaacuucaccaucgccgaacgcgcucaacggguuguggucuggcugggccagaauuuucuucuccccgaggauacacauauucagaacgcccccuuccaagugugcuuuaccucccugagaaauggaggccaucugcacaucaagauuaaacucucuggggaaaucacaauuaacacggacgauaucgaccuggcuggagauaucauucagagcauggccuccuucuuugcgaucgaggaccuucagguggaggccgauuucccuguuuacuuugaggaacugcgcaagguccucgugaaaguggacgaauaucacagcguccaccagaagcugucugcugauauggccgaccauuccaaucugauucggagccuucucgugggcgcugaggaugccagacugaugcgcgacaugaaaaccaugaagucucgguacauggagcuguacgaccucaacagagaucugcuuaacggguauaagauccgcuguaauaaccacacagaacugcucggaaaucugaaagcgguuaaccaagccauucagcgggcuggcagacugcggguggggaagccgaaaaaucaggucaucaccgccugccgcgacgcuaucagauccaacaauauuaacacacuuuucaagaucaugcgggugggcaccgccagcucuuga

SEQ ID NO: 66359 - RNA, 1560 nt, Artificial Sequence
  derived and/or modified sequence opt5 from BBS4__Homo_sapiens__NP_149017
auggccgaggaaagaguggcuacccggacacaguuccccgucagcacggagucccaaaagccucgccagaaaaaggccccggaauuucccauccuggagaaacagaacuggcucauucaucugcacuacaucagaaaggacuaugaagcgugcaaagcuguuauuaaggagcagcuucaagagacccagggccugugugaauacgccaucuaugugcaggcccucauuuuccggcuggaggggaauauccaggaaucucuugagcuguuucaaacaugcgcugugcucagcccucaguccgccgauaaccugaagcaggucgcucgcucucuguuccuccugggaaaacacaaggccgcgaucgagguguacaaugaagccgcuaaacuuaaccagaaggacugggagauuagccauaaucugggcguuuguuauaucuaccucaaacaauuuaacaaggcccaggaucagcugcacaaugcucuuaaccugaauagacaugaccucaccuauauuaugcuggggaagauccaucugcucgaaggagaucuggacaaagccauugagguguacaagaaagcggucgaauuuucccccgagaacacagagcuucugaccacacucggccugcuuuaccugcaacucgggaucuaucagaaggccuuugaacaccugggaaaugcucugaccuacgauccuacgaacuauaaagccauucucgcugccggcucuaugaugcagacccacggcgacuucgauguggcccugacaaaguaccggguuguggcuugcgcgguccccgagagcccuccgcuuuggaauaacaucgggauguguuucuucggaaagaagaaguauguggccgcuaucuccugccugaaacgcgccaauuaccucgcccccuuugacuggaagauucuguauaaccuuggccuggugcaccucaccaugcagcaauacgcuagcgccuuccauuuucugucugcggcuaucaacuuccagccuaaaaugggggaacuguacaugcuccuggccgucgcccuuacaaaucuggaggauauugaaaacgcuaagagagccuaugcugaggccguucaccucgacaaauguaauccccuggugaaccugaauuacgcggugcuucucuauaaccagggagagaagaagaaugcccuggcucaguaccaagaaauggagaaaaaggucucccugcucaaagauaacagcucucuggaguucgacuccgaaaugguggaaauggcccagaaacuuggcgcugcccugcagguuggggaggcgcucguguggaccaaaccugucaaggaccccaagagcaaacaccagacgacaucuaccuccaagccggccagcuuucaacagccucugggauccaaucaggcucugggccaggccaugucuagcgcugccgccuaucggacacuucccuccggcgcugggggaaccagccaauucaccaaaccucccucucucccccuggagccugaaccggcgguggaguccagccccacagaaacgucugagcagauccgcgagaaguga

SEQ ID NO: 66360 - RNA, 1026 nt, Artificial Sequence
  derived and/or modified sequence opt5 from BBS5__Homo_sapiens__NP_689597
augagcgugcuggacgcccucugggaggauagagacguccgguucgaucuguccgcucagcaaaugaagacccgccccggcgaaguucuuaucgacugccuggauucuauugaggacacaaaagggaacaauggagauagaggccggcuccuggugacgaaccuucgcauccuguggcacagccucgcccuguccagagugaaugucucugugggguacaacuguauucugaauaucaccacacggaccgcgaacagcaagcuccgcggacagacagaagcucuguauauucuuaccaaaugcaauuccacaagauuugaguucaucuuuaccaaccugguuccuggcucuccgcgccucuucacgagcgugauggccguccaucgggccuacgaaaccuccaagauguauagagacuuuaaacugcggagcgcucuuauccagaauaagcagcugcgccuccugccccaagagcacguguacgauaagauuaacgggguuuggaaucugucuuccgaccagggaaaccucggcacauucuuuaucaccaaugugagaauugucuggcaugccaacaugaaugauagcuucaacgugucuaucccuuaucugcagauucgguccaucaaaauucgcgacagcaaguuuggccuugcucuggugaucgagucuucccagcaaagcgggggauacguccucggcuucaaaaucgaucccguugaaaagcugcaggaguccgugaaagaaauuaacucucuucacaagguguauagcgccuccccuaucuuuggggucgacuacgagauggaggaaaagccccagccucuggaggcgcucacaguggaacagauucaagacgauguugagaucgacagcgauggacauaccgacgccuucguggcuuacuuugccgauggcaauaaacagcaggacagagaaccggucuucucugaggagcuggggcuggcuauugaaaagcucaaagauggauucacgcugcaaggccuuugggaggugauguccuga

SEQ ID NO: 66361 - RNA, 2019 nt, Artificial Sequence
  derived and/or modified sequence opt5 from BBS7__Homo_sapiens__NP_060660
auggaccugauccucaacagaauggauuaccugcagguuggcgucaccagccaaaagacaaugaaacuuauucccgccucccggcaccgcgcuacgcagaagguugugaucggggaccaugauggaguggucaugugcuucggcaugaaaaagggggaggccgcggcuguguuuaaaacccugccuggaccgaagauugccagacucgaacugggcgggguuaucaauacaccccaggagaagauuuucaucgccgcugccucugaaauccggggauuuaccaaacgcggcaagcaguuccuuagcuuugagacaaaccugaccgaauccauuaaagcuaugcacaucucuggcagcgaccucuuccuguccgccucuuauauuuacaaucauuauugugauugcaaggaccaacacuacuaucugagcggggauaaaaucaacgacgugauuugucucccugucgagagacugucccggaucacacccgugcuugcgugccaggaucgcguucugagagugcuccagggaagcgacgucauguacgccguggaggugccugggcccccuaccguccuggcucugcauaauggcaacggaggcgauucuggggaagaccugcucuuuggaacguccgauggcaagcuggcccugauucagaucaccacaagcaagccgguucggaaaugggagauccaaaaugaaaagaaacgcggcgggauucucuguaucgacucuuucgacauugugggagauggcgugaaggaccugcuugucgggagagaugacggaaugguggagguuuauuccuuugauaacgcuaaugagcccgugcugcgguucgaccagaugcucagcgaaucugucaccuccauccagggcgggugcgugggaaaagauagcuacgacgagauuguuguguccacauacucuggcugggucaccggccugacgacagaaccuauccacaaggagagcgggcccggagaggaacuuaaaaucaaccaggagaugcaaaauaagauuuccagccugcgcaacgaacucgagcaccuucaguauaaggugcugcaggaaagagagaauuaccaacagucuucccagagcucuaaagccaagagcgcggucccuuccuuuggcaucaacgauaaauucacccucaauaaggacgaugccucuuauagccugauucuugaagugcagacagcuaucgacaacguucugauucaauccgacgugcccaucgaucuccuggacgucgauaaaaacagcgccgugguuucuuuuuccagcugugacucugaguccaaugauaacuuccuucuggcuaccuaccggugccaggccgacaccacacgccucgagcugaagaucagaagcauugaagggcaguauggaacgcugcaggccuacgugaccccgcggauccaaccuaagacaugucaggucagacaguaucauauuaaaccccucucccugcaccagcgcacccauuucaucgaucacgaccggccuaugaauacacuuacccugacgggccaauuuucuuucgcugaggugcacagcugggugguguuuugccuccccgaaguccccgagaagccuccggcgggggaaugugugacauucuacuuucagaacaccuuccuggauacccagcuggaguccacauacagaaaaggcgagggaguguuuaagucugacaauauuagcaccaucuccauucuuaaagauguccucagcaaggaagccacaaagcgcaaaaucaaccugaauaucucuuaugagauuaacgaaguguccguuaagcauacgcugaaacucauccaccccaagcuggaguaccagcuucugcucgcuaaaaaggugcaacugauugacgcccugaaggagcuucagauccaugaaggcaauaccaacuuccucauuccugaguaucacugcauccuggaagaggccgaucaucugcaggaagaguacaaaaagcaacccgcucaccucgagcggcuguauggguga

SEQ ID NO: 66362 - RNA, 2559 nt, Artificial Sequence
  derived and/or modified sequence opt5 from BBS9__Homo_sapiens__NP_001028776
augagccuguucaaggccagagacuggugguccaccauccucggcgauaaagaggaauuugaccaggggugccugugucuugcuaacguggauaauucuggaaacggccaagacaagauuaucgucgggagcuucaugggauaccugcggaucuuuucuccccacccugccaaaaccggcgauggggcgcaggcugaggaccuccugcuugaaguugaucugcgcgacccggugcuccagguggaggucggaaaguucguguccggcacggaaaugcugcaucuggccguucuccacagcagaaaacugugcguguauuccgucucuggcacccuugggaauguggagcauggaaaccagugucaaaugaagcugauguacgagcacaaucuccagcggacagccugcaacaugaccuauggcagcuuugggggaguuaagggccgcgaucugauuuguauucaguccauggacgggaugcuuaugguguucgaacaggagagcuacgcuuuuggaagauuccugcccggcuuucuccugccuggcccccuggccuauucuucccggacagauagcuuccucaccgucucuuccugccaacagguggaaagcuacaaauaucaggugcuggcuuuugccacagacgcggauaagcgccaggagaccgagcaacagaaacuugggucuggaaagagacuggucguugacuggacgcucaauaucggcgaacaggcccuggacaucuguauuguguccuucaaccaaagcgcuuccucuguguuuguccuuggggagcggaauuucuucugccugaaagauaacggacagauccgcuuuaugaagaagcucgacuggagcccuuccuguuuccugcccuacugcagcgugucugaaggcaccauuaauacacugaucgggaaccauaauaacaugcuccacauuuaccaggauguuacccugaaaugggccacacagcuuccucacaucccgguggcugucagagugggaugucugcaugaccucaagggcguuauugugacccuguccgaugacggccaccuucaaugcagcuaucuggggacggaucccucucucuuucaggccccuaauguccagagccgggagcugaacuacgacgaacuggauguggagaugaaagagcuccagaagaucaucaaagacgucaacaagucccaaggaguguggcccaugacagaacgcgaggaugaccugaauguuucuguggucgugagcccuaacuucgacuccguuagccaggcgaccgauguggaagucggcacagaccuugugcccucugugaccguuaaagucacccugcagaauagagugauucuccagaaggccaagcuguccguguauguccaaccgccucuggagcuuacaugcgaucaguuuacguucgaauuuaugaaccggaaucccgacgggaucccucgcgugauucaguguaaauucagacucccccugaagcugaucugccuccccggacagccuagcaaaaccgcuucucauaagauuacaaucgauaccaacaaauccccgguuagccugcuuucccuguuucccggcuucgccucucaaagcgacgaugaccaggugaaugucaugggguuucacuuccucggcggagcucggaucacagugcuggccuccaagaccucucagagauaccgcauucaaagcgagcaguuugaggaucuguggcuuaucacgaacgaacucauucugcggcugcaggaguauuucgaaaagcagggcguuaaagacuucgccuguuccuuuagcgggucuaucccucuccaagaguacuucgaacugauugaucaccauuuugagcuuagaaucaauggagagaagcuggaggaacuccuguccgaacgcgcugugcaguuccgggcgauccagagacgccugcuugcccgguuuaaagacaagacacccgcuccucuccagcaccuggauacccugcucgacggcaccuauaaacaagucauugcccuggccgacgcuguggaggagaaccaggggaaucuuuuccagagcuuuacaagacugaagucugccacccaucucguuauccugcugauugcgcuuuggcagaagcucuccgcugaucaaguggccauccuggaagccgcuuuccugccccuccaggaggacacacaggaacugggaugggaggaaacggucgaugccgcuauuagccaccuucugaaaaccugccucucuaagagcuccaaagagcaagcccugaaccugaauagccagcuuaacaucccgaaggacacaucucagcugaaaaagcauauuacccuccugugugaucgccucuccaagggcgggcggcugugccuuagcacagacgcggccgcuccucagaccauggugaugcccggcggauguacgaccaucccugaguccgaucuggaagagagaucuguggaacaagacagcacagagcucuuuaccaaucaccgccaccugacagccgaaacaccccggccugaggucucuccccugcagggcguuuccgaguga

SEQ ID NO: 66363 - RNA, 2826 nt, Artificial Sequence
  derived and/or modified sequence opt5 from BBX__Homo_sapiens__NP_001136040
augaagggcagcaacagaaauaaagaccacuccgccgagggggaaggagugggcaagcggcccaaacgcaagugccugcaguggcauccucuccuggcuaaaaagcugcuggauuucucugaggaagaggaagaggaggacgaagaggaagauaucgacaagguccaacuccugggggccgauggacuugagcaggacguuggcgagaccgaagaugacgagagcccggaacagagagcgcggcgccccaugaacgcuuuucuucucuucuguaaaagacaccggucccuggugcgccaggagcauccuagacuggauaaucgcggggccacaaagauucucgccgacuggugggcugugcuggaucccaaagaaaagcaaaaauacacggacauggccaaggaguauaaggaugcuuuuaugaaagccaacccuggauacaaguggugccccaccacaaauaaaccugucaagucuccgacccccacagugaacccucgcaaaaagcugugggcguuccccagcgacuccucuagagaccuuccuagccccaaaaaggccaagaccgaggaaaugccgcagcucaauuuuggcauggcugauccuacacagaugggcgggcuguccaugcuucugcucgccggagagcacgcucugggcacccccgaaguuagcucugggacgugucggccugacguguccgagagccccgaacugcgccagaaaucuccccucuuccaauuugccgagaucuccagcucuaccucccauagcgaugcguccacaaagcagugccagaccucugcccuguuccaguuugcugagauuagcuccaacacaagccaacuuggaggcgccgaaccugucaaaagaugugggaagucugcucuguuccagcucgccgagaugugccuggccuccgaaggaaugaaaauggaggaaagcaaacuuaucaaggcuaaggagucugacggcggccggauuaaggagcuggaaaaagggaaggaggaaaaagagaucaagauggagaagaccgaugaaacgcgccuccagaaagaggcggaauuugaaaagagcgccaaagaaaaucugagagacuccaaggagcugcggaacuucgaggcucuccaaaucgaugacauuauggccaucaaaauggaagauccgaaggagauuagaaaggaggagcuggaagaggaccacaaauguucucacuuucccgauuucagcuauuccgccagcucuaagaucauuaucuccgacgugccuagccgcaaagaccauaugugccacccccauggaauuaugaucaucgaggauccugcugcccuuaauaagcccgaaaaacugaagaaaaagaagaaaaagucuaaaauggaccggcacggcaacgauaaguccacaccgaaaaagaccuguaagaaaagacagagcuccgagucugacauugaaagcguuaucuacacaauugaggcgguggcuaagggggauuggggaaucgaaaaacucggcgacaccccucgcaagaaaguccggaccuccucuagcgggaagggauccauucuggaugccaagcccccuaaaaagaaagucaagagcagagagaaaaagaugucuaaggagaaauccagcgacacaacgaaggaaucucggcccccugauuucaucuccaucagcgccucuaaaaauauuagcggcgagacccccgaaggcaucaaggcugagccgcuuacaccuauggaggacgcccugccucccucccucagcgggcaggcuaaacccgaagauucugacugccaccggaagauugagaccuguggauccagaaaaagcgaacgcuccugcaagggcgcccuguauaagacacuggugucugaggggaugcucaccagccugcgggcgaacguggauagaggaaaacgcuccucuggcaaggggaauagcuccgaccaugaaggcugcuggaacgaggagucuuggacguuuagccaguccggaacaagcggcucuaaaaaguucaaaaagaccaagccgaaagaagacugucuucugggguccgccaagcucgaugaggaauuugagaaaaaguucaacagccugccccaauacucuccuguuaccuuugaccggaaaugcgugcccgugccuagaaagaagaaaaagacaggaaaugucuccagcgaacccaccaaaacaucuaagggcccuuuccagucccagaaaaagaaccuguuucacaagaucgugagcaaauauaagcauaaaaaggagaaacccaauguuccggagaagggguccggagauaaguggagcaacaaacagcuuuuccucgacgcuauucacccuacggaagccaucuuuucugaggaucggaauaccauggaacccgugcauaaggucaaaaacaucccuagcauuuucaauacacccgagccgaccacaacccaagaaccucuggugggcucccagaagcgcaaagcuagaaagacgaaaaucacccaccugguucggacagccgacgggagagugucucccgcgggcggaacccucgaugacaagccuaaggagcagcugcagcgcagccuucccaaagccacagagaccgauuguaacgacaagugcucccacaauacggaagucggcgagacacggucuagcacccccgaaaugccugcuguguccgccuuuuucucucuggcugcccucgccgaggucgcugcgauggagaacgugcauagagggcaacgcagcacaccgcugacccacgauggacagcccaaagaaaugccucaggcccccguucugauuuccugugcugaccaguga

SEQ ID NO: 66364 - RNA, 1767 nt, Artificial Sequence
  derived and/or modified sequence opt5 from BCAM__Homo_sapiens__NP_001013275
auggagcccccugacgccccggcucaggccagaggcgcgccccggcugcuccugcuugcugugcugcucgccgcccacccugaugcucaagccgaaguccgccugagcguucccccucuuguggaggugaugagagggaaguccgucauccuggacugcacccccacaggaacgcaugaucacuacaugcucgaaugguuccugaccgaccggucuggcgcucgcccuagacuggccagcgcggagaugcagggguccgaacuccaggugacaaugcaugauacccggggacgcucuccgcccuaucagcuggacagccaaggcagacuuguucuggccgaggcucaggugggggaugagcgggacuacgucugugugguucgcgccggagcugccggcacagcggaagccaccgcuagacucaacguguuugccaaaccugaggcuacagaagucucccccaauaagggcacccugucugugauggaggauagcgcccaggagauugccacgugcaacucccggaaugggaacccugcucccaaaaucaccugguaucgcaauggacagagacuugaagugccggucgagaugaacccugaaggcuacaugacaagccggaccguucgcgaggcgucugggcugcucucccugacaagcacccuguaucucagacugcggaaggacgauagagacgccucuuuccacugugcugcccauuacucccuucccgaaggacgccacggccggcuggauagcccuacguuucaccucacacugcauuaucccaccgagcacgugcaauucuggguggggucucccuccaccccugccggaugggucagagagggcgacacagugcagcuucugugccgcggcgacgggagcccgucccccgaauacacccucuuucggcugcaggaugagcaggaagagguucugaaugugaaccucgaaggaaaucugacacuugagggcgucacgagagggcaaucuggaaccuacggcugucgcguggaggacuaugaugcugccgacgauguucagcugagcaaaacacucgaacugcggguggcguaccuugacccucuggagcucuccgaagggaagguccugagccugccccucaacucuuccgcuguggucaauugcagcgugcauggacugccuacccccgcccuuagauggacaaaggauucuaccccgcugggcgacggcccuaugcucagccuguccucuauuacguucgauagcaacgggacauauguuugugaggccucccugcccaccgugccuguccuuagccgcacccagaauuuuacacuccuggugcaaggaucucccgaacugaaaaccgcugagaucgagccuaaggccgacggcuccuggcgggaaggggaugagguuacacucauuugcagcgcuagaggacaccccgacccgaaacugucuuggucccagcuuggcgggagcccugccgaacccauccccggccgccagggauggguguccucuagccugacgcucaaggucaccuccgcgcugucucgggacggcaucagcugugaggccuccaacccucacgggaauaaaagacauguguuccacuuuggaacagugagcccgcagaccucucaagcuggcguugccgucauggcuguggccguguccgucgggcugcuucuccuggugguugcgguguucuacugcguccggcgcaagggaggccccuguugcagacagcggagagagaagggggccccuuga

SEQ ID NO: 66365 - RNA, 2016 nt, Artificial Sequence
  derived and/or modified sequence opt5 from BCAN__Homo_sapiens__NP_940819
auggcccagcuguuccucccccugcuugcugcccuggugcucgcgcaagcuccugccgcccuggcugacguccuugagggcgauagcuccgaagacagagccuuucggguucgcaucgcuggggaugccccgcugcagggagugcucggcggggcgcugaccauucccugccacgugcauuaccugagaccucccccuucucggcgcgccguccucggaagccccagagugaaguggacauuccugucccggggccgcgaggcugaaguucuuguggccagagggguccgggugaaaguuaacgaggcuuaucgcuuuagaguggcccugccugcguacccggccucucucacggacgucagccuggcucuuuccgaacugcggcccaaugauucuggaaucuaucgcugugaggugcagcacggcauugacgauagcuccgacgccguggaggucaagguuaaaggcgugguguuccucuacagagaagggagcgcucgguaugccuuuucuuucuccggagcccaggaggcuugcgcgcgcaucggcgcccauauugcuaccccugaacaacuguacgccgccuaucucgggggauacgagcagugugaugcuggcuggcugagcgaccagacagucagauaccccauccagaccccucgggaggccugcuauggggauauggacggauuucccggcgugagaaacuacggcguuguggauccggacgaccuguaugaugucuacuguuaugcggaagaccuuaauggggagcuguuccucggagauccucccgaaaagcugacacuugaggaagcucgcgccuacugccaagagcggggcgccgagaucgcuaccacagggcagcuguaugccgcuugggacggaggccucgaucacuguucuccuggguggcuggccgacggauccgugagauaccccauuguuacccccagccagcgcugcggcggcgggcugccuggagugaaaacgcucuuucuguucccgaaccagaccggcuuucccaauaagcauucucgguucaacgucuacuguuuuagagauuccgcgcaaccuagcgccauccccgaagccuccaauccugccucuaaccccgcuagcgacgggcuugaggccauugugacagucaccgaaacacuggaggaacuccagcugccgcaggaggcgaccgaguccgaaagccgcggagccaucuauucuauuccuaucauggaggauggcgggggcggauccagcacgcccgaagacccugcugaggcuccccggacacuucuggaguucgaaacccaaucuauggugccucccacaggcuucagcgaggaagaggggaaggcucucgaagaggaggaaaaauacgaggaugaagaggaaaaggaggaggaagaggaagaggaagagguugaggacgaagcccugugggccuggccguccgagcugucuagcccuggacccgaggcuucccuccccaccgaaccugcggcccaggaagagagccugucucaggcuccggccagagccgugcuucagcccggcgcuuccccucugcccgacggggagagcgaagccucucgcccuccccggguccacggaccucccaccgagacacucccgacgccuagagaacgcaaucuggcgucccccagcccuuccacccugguggaggcucgggagguuggcgaagccacagggggccccgagcuuucuggagugccgagaggcgaaagcgaggaaaccggguccucugagggagccccuagccuccugcccgcuacacgggccccugagggcacccgcgaacuggaggcgcccuccgaagauaacagcgggagaacggcucccgccggaacaucuguccaagcccagccugugcucccgaccgacuccgcuagccggggcgggguggccguuguccccgcuucuggcaauuccgcccagggaagcaccgcgcugucuauucuucugcucuuuuucccucugcagcugugggugacauga

SEQ ID NO: 66366 - RNA, 1047 nt, Artificial Sequence
  derived and/or modified sequence opt5 from BCAP29__Homo_sapiens__NP_001008405
augacccugcagugggccgcuguggccacauuccucuacgcggagaucggccugauucuuaucuuuugccugcccuucauuccuccgcaaagauggcagaagaucuuuagcuucaacgucugggggaaaauugcuacguuuuggaauaaggccuuccucaccaucaucauucugcuuaucguucuguuucucgacgccgugcgggaagugcgcaaauauuccucuguccacacaauugaaaagagcuccaccucuagacccgaugcuuacgagcauacacagaugaaacuguuccggagccagcgcaaccuguauaucuccggauuuucucucuucuuuuggcuggugcuuagacggcugguuacccucauuacacaacuggccaaggagcuuagcaauaagggcgugcugaaaacccaggcugaaaacacgaauaaggccgcgaaaaaguucauggaggagaacgaaaaacucaagcgcauccugaagucccacgggaaagacgaggaauguguccuggaggccgagaauaagaaacucguggaagaucaggagaagcugaaaaccgaacuuagaaagacaagcgacgcucugucuaaagcccagaacgauguuauggagaugaagaugcaauccgaacggcucagcaaggaguacgaccagcugcuuaaagagcauucugaacugcagcacuccagcuuuggagaguuccucucuaagcgcucccauaaaaauggcagcauugggaagcagaccggauccagaaaaggcucuuuccggaagcgccaacaggaaaagacagugaacuuuaucaaagauaccugcaauauccugugucagaacgacaauuucgucaugcuggcuagcagaaaguuuaaauuccggaagaugcacuaugaucgcuuugugauuuuccucaugccucacaucggcugcauugugauggcccuguccaaauaccuuaugauguuucaaaucuauuguaaggucugcauucccgcgcugaagaaaaacaucagcaugcucaauacgaucuucacauacuga

SEQ ID NO: 66367 - RNA, 942 nt, Artificial Sequence
  derived and/or modified sequence opt5 from BCAP31__Homo_sapiens__NP_001132929
augggcgccgaggcuagcuccucuuggugccccgggaccgcccugccugaagagagacucagcgugaagcgggcguccgaaaucucuggauuccugggccaggggagcuccggagaggcugcccuugacguccugacacacguucucgaaggcgccgggaacaaacugacgucuagcuguggaaagccguccagcaaucgcaugucucuucaauggaccgcuguggccacauuucuguacgcugagguguucgucgugcuccugcugugcauucccuuuaucuccccuaaaagauggcagaagauuuucaaaagccggcucguugagcugcuugugucuuauggcaacaccuuuuucgucgugcugaucguuauucucgugcugcuugucaucgaugccgugcgcgaaaucagaaaguacgacgaugugacagagaaggucaaucugcagaacaaucccggcgcgauggaacauuuucacaugaaacucuuccgggcccagcgcaaccuguauauugcuggguuuucccugcuccugagcuuccuucugagacggcucguuacccugaucucucaacaggccacacuucuggcuuccaaugaggccuuuaagaaacaggcggagagcgccuccgaagcugccaagaaauacauggaggaaaacgaccagcucaagaagggagcugccguggauggcgggaaacuggacgugggaaaugccgaggucaagcuggaagaggagaaccgcucucucaaagcugaucugcaaaaacuuaaggacgaacuggcgagcaccaagcagaaacucgagaaggccgaaaaucaggugcuggcuaugagaaagcaguccgagggccuuacgaaagaauaugaucggcugcucgaggagcaugccaagcugcaagccgcuguugacgggccuauggauaaaaaggaagaguga

SEQ ID NO: 66368 - RNA, 2751 nt, Artificial Sequence
  derived and/or modified sequence opt5 from BCAR1__Homo_sapiens__NP_001164185
augcccgccaagccuuuccugagcuccgugcuccugucuuggaaaguccuugacuuuagcggcccggggccccagggaaccggccaaccuugcuccugugggcacugggcugagggacagggcgggcccccugaacccgccggaggcccuaacguucuggcgaaggcucucuacgauaauguggccgagucuccggacgaacugagcuucagaaaaggcgauaucaugacagugcuugagcaggacacgcaggggcuggauggaugguggcucugcucccugcauggccggcaagggauuguccccggaaaccgccugaagauccucgugggcauguaugacaaaaagccugccgggcccggaccugggcccccggcuaccccugcccagccccagccuggccugcacgcucccgcgcccccugccucucaguacacaccgaugcuucccaauaccuaucaaccucagcccgauagcguuuaccuggugccuacacccuccaaggcccagcagggccucuaucaagucccgggaccuagcccccaguuucagucuccucccgcuaaacaaaccuccacauucagcaagcagaccccucaucaccccuuuccgucuccugccacggaccuguaccaggugccucccggccccgggggaccggcucaggauauuuaucaaguucccccuuccgccggcauggggcaugacaucuaccaggugcccccuagcauggauaccagaucuugggaaggaacaaaacccccugcgaaggucguggugcccacccgggucggccagggcuacguuuaugaggccgcucagccggagcaagacgaauacgauauuccucgccaccuucuggcccccgggccucaggacaucuaugacgugcccccggugagaggacuccugccuucccaguacggccaggaggucuaugauacacccccuauggcugugaaagggcccaacggacgggacccccugcucgaaguuuacgaugugccuccgagcgucgagaagggccugcccccuuccaaucaccaugccguguaugacguucccccuucugugagcaaggauguccccgacgggccucuucugcgcgaggaaaccuacgaugugccgcccgccuucgcuaaagcgaagccuuuugaccccgccagaacgccucucguccuggcugcucccccgccugauuccccucccgccgaggacguguacgauguucccccucccgccccggaccuuuaugacgugcccccuggccugcggcgccccggaccuggcacacucuacgauguccccagagaacgggugcugccgccugagguugccgacgggggaguggucgauagcggcguguaugcggugcccccucccgcugaacgcgaggccccugccgaggggaaaagacugucugcuuccagcaccggaucuacacggagcucccaaucugccagcucccucgaaguugcuggccccgggcgcgagccgcuggaacuugaggucgccguggaagcgcuggccagacuccagcagggcgugagcgcuaccgucgcccaucugcuugaccuggcuggaucugccggcgcgaccggguccuggcggagcccuucugagccccaggagccccucgugcaagaucugcaggccgcuguugccgcugugcaguccgccguccacgaacugcucgaguucgccagaagcgcugugggaaacgcggcccacacauccgaccgcgcucugcacgccaaacuuucucggcaacugcagaagauggaagauguucaucagacgcucguggcccacggccaggcucuggacgccgggagaggaggcagcggggcgacccuggaggaucuugaccgccucgucgcuuguucccgggccgugccugaagaugccaagcaacuggcuucuuuucugcauggcaaugccagccuccuguucagacgcacaaaagcgaccgcuccgggacccgagggcgggggaacacuucacccuaaccccaccgacaagacguccagcauccagucucggccucugcccuccccuccgaaguuuacaagccaggauucucccgacggccaguacgagaacuccgaagggggauggauggaggacuaugauuacguucaucuccaaggcaaagaagaguucgagaagacccagaaagaacugcuggagaaggggagcauuaccagacagggcaaaucucagcuugaacuccaacagcugaagcaguuugagcgccuggaacaagaggugagccggccuaucgaccacgaucucgccaauuggacacccgcccagccucuggcucccggaagaaccggcgggcuuggaccguccgaccgccagcugcuccuguucuaucuggagcagugcgaagccaaucuuacaacgcucaccaacgcugucgaugccuucuuuacagcgguggccaccaaucaaccucccaagauuuucguggcucacagcaaauuugucauccugucugcccauaagcugguuuucauuggcgacacacucucccggcaggcuaaagccgccgaugugagaagccaggugacccacuacuccaaccugcuuugugaccugcuccgggggaucgucgcuacgaccaaggcggccgcucugcaguaccccucuccuagcgccgcccaagauaugguggagcgcguuaaagaacugggacauuccacacagcaguuuagacgggugcuuggccagcucgcugccgcguga

SEQ ID NO: 66369 - RNA, 1755 nt, Artificial Sequence
  derived and/or modified sequence opt5 from BCAS1__Homo_sapiens__NP_003648
augggcaaccagaugagcgugccccaaagagucgaggaccaggaaaaugagccugaagccgagaccuaccaggauaacgcuuccgcccugaaugggguuccggugguggucucuacacacacggugcagcaucucgaagagguugaccugggaaucagcgugaagaccgauaacgucgcgacauccucucccgagaccacagaaauuagcgcuguggccgacgccaauggcaaaaaccuugggaaggaggcuaaaccugaagcccccgcugccaagucccgguucuuucugaugcucucucgcccuguucccggaagaaccggcgaucaagcggccgacagcucccuggggagcgugaaacuugaugucucuuccaauaaggcuccugccaacaaggacccgagcgagucuuggacacugcccguggcugccggaccuggccaggauaccgacaaaacgcccggccacgcgccugcccaggauaaggugcucuccgcugcccgggaccccacccugcugccgccugagacagggggagcuggcggggaagcccccagcaaaccuaaggauucuuccuucuuugacaaauucuuuaagcucgacaagggacaggagaaaguccccggcgauagccaacaggaagccaagcgcgcugagcaucaggacaaaguugaugaagugcccgggcuguccggacagucugacgaugugccugcgggcaaggacaucgucgauggcaaagagaaggaggggcaagaacuuggaaccgccgacugcagcgugccgggcgaucccgaggggcuggaaacagcuaaagacgauucccaggccgccgcuauugccgagaauaacaauagcaucaugucuuucuuuaagacccucguuuccccuaacaaggcggaaacgaaaaaggaccccgaggacacaggagcugagaaaagcccuaccacaucugccgaucuuaagagcgacaaagccaauuucaccucccaggaaacccaaggcgcugggaagaacucuaagggauguaaucccagcggccacacacaguccgugacgaccccggagccugccaaagaaggcacaaaggagaaaagcgggcccaccucucugccucugggaaagcucuuuuggaaaaaguccgucaaggaagauagcgugcccacaggcgcugaggagaacguugugugcgaaucuccugucgagauuaucaaauccaaggaaguggagagcgcccugcagaccgucgaccugaacgagggggaugcggcccccgaaccgacggaggcuaaacucaagagagaagaguccaaaccucggacaucucugauggccuuccuucgccagaugagcgugaagggagacggcgggaucacccauuccgaagagauuaauggcaaggauucuagcugucaaaccuccgacagcacagagaaaaccaucacaccucccgaacccgagccgacgggagcuccccagaagggcaaagaagggucuuccaaggauaaaaagagcgccgcggagaugaacaaacagaagucuaauaagcaggaagccaaagagccugcucaaugcaccgagcaggccacaguugacaccaacucccugcagaauggagauaagcuccagaaaagacccgaaaagcggcaacagagccugggcggguuuuucaaaggacuuggcccuaagcgcaugcuggacgcucaggugcagacagaucccgucucuauugggccugugggcaagagcaaauga

SEQ ID NO: 66370 - RNA, 2787 nt, Artificial Sequence
  derived and/or modified sequence opt5 from BCAS3__Homo_sapiens__NP_001092902
augaacgaggccauggcuaccgacagccccagacggccuucccgcugcacaggcgggguggucguuagaccgcaggccgugacggaacaaucuuacauggagagcguggucaccuuccugcaggaugugguuccccaggcguauuccggaacaccucucaccgaagagaaggagaaaaucguguggguccgguuugaaaaugcugaccugaacgauacaucucgcaaucuugaguuccacgaaauucauagcaccggcaacgagcccccucugcucaucaugauuggguacuccgacggaaugcaaguguggucuauccccauuagcggcgaagcccaggagcuguuuuccguuagacacgggccuauccgggccgcucgcauccuuccggcuccccaguucggagcccagaagugugauaauuuugccgagaaaagaccucugcucggcgugugcaagagcauuggcagcuccgggacaucucccccuuauuguugcgucgaccuguacucucugcggaccggagaaauggugaaauccauccaguucaagacgcccauuuaugaucuccauuguaacaagcgcauccugguggucguucuucaagagaaaauugcggccuuugacagcugcaccuucacaaagaaauuuuucgugaccucuuguuacccgugcccuggccccaauaugaacccuaucgcucugggguccagauggcucgccuaugcugaaaauaagcugauucggugucaccagagccgcggaggcgccugcggggauaacauccaguccuacacagcgaccgugaucucugccgcuaaaacgcuuaagagcggacugacaauggucggcaaggugguuacccagcucacaggcacccugcccuccggggugaccgaggacgaugucgccauucauagcaauucuagacggagcccccuggugccuggaaucauuacaguuaucgacacggaaaccgugggcgaggggcaaguccucgugagcgaggauucugacagcgacggaauugucgcucacuuuccggcccacgaaaaacccguguguugcauggccuucaacacauccggcaugcugcuuguuaccacagauacccuggggcaugacuuucacguguuccagauccucacgcauccuuggucuagcucccagugcgcuguccaccaccuguacacacuucaucgcggagagaccgaagcgaaggugcaagauaucuguuucagccacgacugcagauggguuguggucucuacccugcggggcacaucccauguguuucccauuaauccuuauggcgggcagcccugugugagaacccacaugagcccgcgcguugucaaccggaugucuagauuccagaaauccgccggacucgaggaaaucgagcaggagcugacaagcaagcaaggcgggcgcugcuccccugugcccggacugucuagcuccccuucuggcagcccccuccaugggaaacuuaauucccaggauagcuacaacaacuuuacgaauaacaauccuggcaacccccggcugucuccgcugccuucccucaugguggucaugccccuggcucagauuaagcagcccaugacccuuggaacaaucaccaaaagaacaggcccuuaucuguucggggccggauguuuuagcauuaaggccccgugcaaggugaaacccccuccccaaaucucuccuuccaagagcaugggcggggaguucuguguugcugccaucuuuggaaccucucgcagcugguucgcgaauaacgcuggccucaaacgggaaaaggaccaguccaaacagguggucguggaaagccuguacauuaucucuugcuaugggacgcugguugagcacaugauggaacccagaccucucuccaccgcccccaagauuagcgaugacacaccgcuggagaugaugaccuccccucgcgccucuuggacacuugugcggacgccccaguggaaugagcugcaaccucccuuuaacgcuaaucacccgcuccugcuggccgcugaugccguccaguacuaucaguuccuucucgcgggccuggugccucccggaagcccuggccccaucaccagacauggguccuacgacucucuggccagcgaucacuccggacaggaagacgaggaauggcucucucaaguugagauugugacacauaccggcccccaccgccggcuguggauggggccucaguuucaguucaagacaauccacccgagcggacaaaccaccgucauuuccuccucuuccagcgugcuucagucucauggccccuccgacacaccucagccccugcucgauuuugacacggaugaccuggaucugaacagccuuagaauccagccugugcggucugaccccgucuccaugccugggagcucccgcccgguuagcgauagacggggcgugucuaccgugaucgacgcugccagcggaacauucgauagauccgucacccuccuggagguguguggcucuuggcccgaaggguucggacugcgccacaugagcuccauggagcauacagaagagggccuccgggaaagacuggcugacgccauggcggagucuccuagccgcgauguugugggguccggaaccgagcuucaaagagaaggcucuauugagacgcugagcaauuccagcgggucuacauccggcagcaucccccggaacuuugacggauaccgcucuccucuccccaccaaugaaucccagccgcugagccuguucccuaccggcuuucccuga

SEQ ID NO: 66371 - RNA, 477 nt, Artificial Sequence
  derived and/or modified sequence opt5 from BCAS4__Homo_sapiens__NP_001010974
augcagagaaccggcgggggagcuccccggccuggccgcaaccacgggcugccgggaagccucagacaacccgacccuguggcccugcuuaugcugcucgucgaugccgaccagcccgagccuaugcgguccggcgcgcgcgaacuggcucuuuuccugacacccgagccuggggccgaagccaaggagguugaagagacgaucgagggaaugcuccugagacuggaagaguuuugcucucucgcugaucugauucggagcgacaccucccagauccuugaagagaauauuccggugcugaaagccaagcucacagagaugcgcggcaucuacgcuaaaguggauagacuggaaaagucucccgccccuguccccgugaccuaugagcuuccuacacuguaccggaccgaagacuauuuccccguugaugcgggcgaggcccagcaucacccgcgcacauguccuagaccccucuga

SEQ ID NO: 66372 - RNA, 1050 nt, Artificial Sequence
  derived and/or modified sequence opt5 from BCAT1__Homo_sapiens__NP_001171562
augaaggacugcagcaacggcuguuccgccgagugcaccggggaaggaggcucuaaagagguggucgggacauucaaggcuaaagaucugaucguuacgcccgccaccauucucaaggaaaaaccugacccgaauaaccugguguuuggaacaguguucaccgaucacaugcuuacagucgaguggagcuccgaauuuggcugggagaagccccauaucaagccucugcagaaucucucucugcaccccgggagcuccgcgcuucauuacgcuguggagguuuucgacaaagaggaacugcucgaauguauucaacagcuggugaagcuggaucaggagugggucccuuauucuaccagcgccucccucuacaucagacccacauuuauuggaaccgagccuagccugggcgugaaaaagccgacgaaagcccuucuguucguucuccugucucccgugggcccuuauuuuuccagcgggaccuucaaccccgucucucuuugggcuaauccuaaguacgugcgggccuggaagggaggcacaggggacugcaaaaugggaggcaacuauggguccagccuguuugcucagugugaagccguggauaauggaugccaacagguccucuggcuguacggcgaggaccaccagaucaccgaaguuggcacaaugaaccuguuccucuauuggaucaaugaggauggggaagaggagcuggcgacgcccccgcuugacggaauuauccugccuggcgugacccgcagauguauucucgaucuggcccaucaguggggagaauuuaaggugucugagcgguaccuuacaauggacgaucugaccacagcucucgaagggaaccgcgucagagagauguucggcuccgggaccgccugcgugguuugucccgugagcgacauccuguacaaaggagaaaccauucacaucccuacaauggagaauggccccaagcuggcuucccggauucucucuaaacugacggacauccaauauggccgcgaggaaagcgauuggaccaucguccuuuccuga

SEQ ID NO: 66373 - RNA, 903 nt, Artificial Sequence
  derived and/or modified sequence opt5 from BCAT2__Homo_sapiens__NP_001158245
auggccgcugccgcgcugggccagcuguucgaggggaugaaggcuuuuaaaggaaaggaccaacaggugagacucuuccggcccuggcuuaacauggaucgcaugcugagaagcgccaugcggcucugccugccuuccuuugacaaacuugaacugcucgaguguauccgcagacugauugaagucgauaaggacuggguuccggaugccgcuggcaccucucuguacgugcggcccgugcucaucgggaaugagccuagccugggagucucccagcccacacgcgcccuucuguucgugauucucugcccuguuggcgcuuauuuucccgggggaucugugacgccugucagccugcuugccgacccggcguucaucagagccugggugggcggcguugggaacuacaaacugggaggcaauuaugggcccaccgugcucguccagcaagaagcucugaagcggggaugugaacaggugcuguggcucuacggcccugaucaccagcugacagagguggggaccaugaacauuuuugucuauuggacacaugaagacggaguucuugagcuggugacacccccucucaauggcgugauccugcccggcgucgugcgccagucccuucuggauauggcccaaaccuggggagaguucagaguuguggagcggaccaucacgaugaagcagcuccugcgcgcucuggaggaagggagaguccgggagguguuuggcucugggaccgccugccagguuuguccggugcaccgcauucucuacaaagacagaaaccugcauaucccuacaauggaaaauggacccgagcuuauucugcgguuccagaaggaacucaaagagauccaauauggcauuagagcgcacgaguggauguuuccugucuga

SEQ ID NO: 66374 - RNA, 969 nt, Artificial Sequence
  derived and/or modified sequence opt5 from BCCIP__Homo_sapiens__NP_057651
auggccagcagauccaagcggcgcgcuguggagucuggcgucccccagccuccggaucccccuguucaaagagacgaagaggaagagaaagaaguggagaacgaggacgaagaugacgaugacagcgauaaggagaaagacgaagaggaugaggugaucgacgaagaggucaauauugaguucgaagccuacucccugucugauaacgacuaugaugggaucaagaaacuccugcagcagcuuuuucugaaggcgcccgugaauaccgcugaacucacagaccugcuuauucagcaaaaccacaucggaagcguuauuaagcagacggacguguccgaggauucuaaugacgauauggacgaggaugaagucuucggcuuuaucagccugcucaaccugaccgagcggaaagggacacagugcguggaacagauccaagagcugguucuccgcuucugugaaaagaauugcgagaaauccaugguggagcagcuggacaaguuucuuaacgauaccacaaaaccugucggacugcuccugagcgaaagauucauuaaugugcccccucagaucgcccuuccgauguaccagcaacugcagaaggagcucgccggcgcucaucggaccaacaagcccugugggaaaugcuauuuuuaccugcugauuucuaagacauucguggaagccggcaaaaauaacuccaagaaaaagccuagcaauaaaaagaaggcugcccucauguuugcgaacgccgaggaagaguucuuuuaugaggaacagggaaaacccgagguccugggcgggccugacacccgcagaggacuugaacccguuccgauccaacacaauggcgggucucggggacaggugacggcucuggugucccucaaggccggccugauucagagccgcucuacccuuuccgauuuccaggggacauuuaugaccgucggaaucgcucugagcuga

SEQ ID NO: 66375 - RNA, 879 nt, Artificial Sequence
  derived and/or modified sequence opt5 from BCDIN3D__Homo_sapiens__NP_859059
auggccgugcccaccgagcuggacggcgggagcgucaaggaaacagcugccgaggaagaguccagaguucucgcgccuggagcugccccguucggcaacuuuccccacuacucucgguuccauccucccgaacagcgccugagacuucugccucccgagcuccugcggcaacuuuuuccugagagcccggaaaaugggcccauccugggacucgaugugggcugcaacuccggggaccugucuguggcccuguauaaacacuuccucagccugccugauggagagacguguuccgacgcuucucgcgaauuuagacuucugugcugugauauugaccccguccucgugaagcgggccgagaaagagugcccuuuccccgaugcucugaccuuuaucacacuugacuucaugaaucagcgcaccagaaagguucugcucagcuccuuucugagccaguucggccggucuguguuugauauuggcuucuguauguccaucacaauguggauucaucugaaccacggggaccauggacucugggaauuucuggcccaccuuagcucucugugccacuaccuccuggucgagccgcagccuuggaaauguuaucgcgcggccgcuagacggcuucgcaagcugggccuccaugauuucgaccacuuccauucccuggccaucagaggggauaugcccaaucaaaucgugcagauucugacccaggaccacggaauggaacucaucugcuguuuuggcaacacaagcugggaccggucucugcuucuguuccgcgcuaagcagaccauugagacgcacccuauccccgaaucccucauugagaaagggaaggagaaaaauagacugagcuuucaaaagcaguga

SEQ ID NO: 66376 - RNA, 1809 nt, Artificial Sequence
  derived and/or modified sequence opt5 from BCHE__Homo_sapiens__NP_000046
augcacagcaaggugaccaucauuugcaucagauuccuguuuugguuccuccugcuuuguaugcugauuggcaaaucccauacagaggacgauaucauuaucgccacgaagaacgggaaaguccggggaaugaaucucaccguuuuuggcgggacagugaccgcuuuccugggaauccccuacgcccagccuccgcuuggccgccugagauuuaagaaaccccaaucucucacaaaguggagcgacauuuggaacgcgaccaaguaugcuaauuccugcugucagaacaucgaucagucuuucccuggguuucacggaagcgaaauguggaaucccaacacagaccuguccgaggauugccuguaccucaauguguggauuccugcccccaaaccuaagaacgccaccguccugaucuggauuuauggcggcggguuccagacgggaaccucuagccuucauguguacgacggcaaauuucuggcucggguugaacgcgugaucgucguguccaugaauuauagaguuggggcccucggauuccuggcucugccgggcaaccccgaggccccugggaauaugggacuguuugaucaacagcucgcgcugcagugggugcagaagaacauugccgcuuucggcggcaaucccaaaagcgucacacuguuuggggaaucugccggagcugccuccgugagccuccaccuucuuucuccuggcucccauagccuguucacccgggcgauccuccaaucuggguccuucaacgcccccugggcugugacaagccuguacgaggcccgcaauagaacccuuaaccuggcuaagcucacgggauguucccgggagaacgaaacagagaucauuaagugccugcgcaauaaagacccgcaggaaauccugcucaacgaggccuuugucguuccuuauggcacaccccugucugugaauuucgggccuaccguggauggagacuuucuuaccgauaugcccgacauucugcucgagcugggccaguucaagaaaacccagauccuugucggcgugaacaaggaugaagggacagccuuucugguuuacggagcucccggcuucagcaaagacaauaacuccauuaucacgagaaaggaguuucaagaagggcucaaaaucuucuuuccuggagugagcgaguucggcaaggaaucuauucuguuucacuacaccgacugggucgaugaccagcggccggagaauuaucgcgaggcgcugggggaugugguuggcgacuacaacuucaucugucccgcccucgaauuuacaaagaaauucuccgaguggggaaauaacgcuuucuuuuauuacuucgaacacagaagcucuaagcugccuuggcccgaguggaugggcgugaugcauggguaugaaauugaguuugucuucggacuuccucuggagcggcgcgauaauuacaccaaagccgaagagauccucagcagauccauugugaagcggugggccaacuuugcuaaauauggcaaucccaacgaaacacagaauaacucuaccagcuggccggucuucaaguccacggagcaaaaguaccugacacugaacaccgaaagcaccagaaucaugacaaaacuucgcgcccagcagugccgguuuuggaccucuuucuuuccuaaggugcucgagaugacagggaauaucgacgaggcggaaugggaguggaaagcuggauuccacagauggaacaauuacaugauggauuggaagaaccaguuuaaugacuauacguccaaaaaggaaagcuguguuggccuguga

SEQ ID NO: 66377 - RNA, 1338 nt, Artificial Sequence
  derived and/or modified sequence opt5 from BCKDHA__Homo_sapiens__NP_000700
auggccguggcuaucgccgcggcuagagucuggcggcugaaccgcggccucagccaggccgcccugcuucugcucagacaacccggggcucggggacuggcccgcucccacccuccgagacagcagcagcaauucucuagccuugacgauaagccccaguuuccuggcgcuuccgccgaguucauugacaaacuggaauuuauccagcccaauguuauuucugggaucccuauuuaccgggugauggaucgccagggacaaaucaucaaccccagcgaggacccucaucucccgaaggaaaaagugcugaagcuguauaaauccaugacccuccugaauacaauggaucggauucuuuacgagucucagagacagggccgcaucagcuucuauaugacgaacuacggggaagagggaacccacgucggcuccgcggccgcucuggacaauacagaucucguguuuggccaguauagagaggccgggguucugauguaccgggacuauccccuugaacuguucauggcucaaugcuacggaaacauuagcgaucucggcaaggggcgccagaugccugugcauuacggauguaaggagagacacuuugucaccaucucuagcccccuggccacacagauuccucaagcggugggcgccgcuuaugccgcuaaacgggccaaugccaaccgcguugugaucugcuacuucggggaaggagcugcguccgagggcgacgcccaugcuggcuuuaauuucgccgccacccuggagugucccauuaucuuuuucugcagaaacaauggguaugcuaucucuacaccgaccuccgaacaguaccggggagauggcauugccgcgagagggccuggauauggcaucaugagcauucgcgucgacgggaacgauguguuugcuguguacaaugccacgaaggaggcccggagacgcgcugucgccgaaaaccagcccuuccucaucgaggcuaugaccuaucggauuggacaccacucuacauccgacgacagcuccgccuacagaucuguugaugaagugaauuacugggacaaacaggaucauccuaucagccgccugcggcacuaucuucugucccaaggcuggugggacgaggagcaggaaaaggcguggagaaaacagagccgccggaaggugauggaggccuucgaacaggcugagagaaagcccaaacccaacccuaaccuccuguuuucugaugucuaccaagaaaugccggcccagcuucgcaagcagcaggagucccuggcucggcaucuccaaaccuauggcgagcacuacccccuggaccacuucgauaaauga

SEQ ID NO: 66378 - RNA, 1179 nt, Artificial Sequence
  derived and/or modified sequence opt5 from BCKDHB__Homo_sapiens__NP_000047
auggccguggucgcugccgcggcuggcuggcugcucagacugcgggccgccggggcugagggacacuggcgcagacuucccggcgccgggcuggcucggggauuccuccauccugccgcgaccguugaagacgccgcucagcgcagacaaguggcccacuuuacauuccagccggaucccgagccucgggaauacggccagacgcagaagaugaaccuguuucaaagcgugaccuccgcucuugacaauucucuggccaaagaucccacagcggucaucuucggggaggacguggccuuuggaggcguuuuccgcugcaccgugggccucagagauaaguaugggaaagaccgggucuuuaacacaccucugugugaacagggaauugugggcuucgggaucggaauugcuguuaccggcgccacagcuaucgccgagauucaguuugccgauuacaucuuccccgcuuuugaccagaucgugaaugaggcggccaaguaucgcuacagaagcggggaucuguucaacugcggaucccucaccauucggucuccuuggggcugugucggccauggggcucuguaucacagccaauccccggaagccuuuuucgcccauugccccggaaucaaaguggugauuccucgcucucccuuccaggcuaagggccuucugcucagcuguaucgaggacaagaauccuugcaucuuuuucgaacccaaaauucuguacagagccgcggcugaggaggucccgauugaaccuuauaacaucccccuuucccaggccgagguuauccaggaagggagcgaugugacgcugguggccuggggaacccaaguccacgugauucgggagguugcuucuauggccaaggaaaaacucggcguguccugugaggucaucgaccugcgcacaauuaucccuugggauguggacaccauuugcaagagcguuaucaaaacagggagacugcucaucucucacgaggcuccccugaccggaggcuuugccuccgaaauuagcucuacggugcaggaggaauguuuccuuaaucuggaggcgcccaucucccgggucugcggcuacgacacaccuuuuccgcauauuuucgaacccuuuuacaucccugauaaguggaaguguuaugacgcccucagaaaaaugauuaacuacuga

SEQ ID NO: 66379 - RNA, 1098 nt, Artificial Sequence
  derived and/or modified sequence opt5 from BCKDK__Homo_sapiens__NP_001116429
augauccuggccagcgugcucagauccggccccgggggaggccugccucuucggccgcugcucgggcccgcucuggcccuucgcgcgagaucuaccagcgcuacagacacgcaccaugucgagauggcccgggaacgcuccaagaccguuacaucuuucuacaaccagagcgccauugaugcugccgcugagaaaccuuccgugagacugacccccacaaugaugcucuaugccggacggucucaagacggcagccaucugcugaaguccgcgcgcuaccuccagcaggaacugccugugagaaucgcccaccggauuaaaggguuucgcugccuucccuucaucauuggauguaauccuaccauccugcacguccaugagcucuauaucagagcuuuucagaagcugacagauuucccgcccauuaaagaccaagccgaugaagcucaguacugccagcuugugcggcagcugcucgacgaucacaaggacguugugacccugcuggccgagggccuccgcgagagcagaaagcacaucgaagaugagaaacugguccgguauuuucuugacaagacgcugaccucucgccucggcauuagaaugcuggcgacacaucaccuugcccugcaugaagauaaaccugacuucguggggaucauuuguacccggcucucccccaagaaaaucauugagaaguggguugauuuugcuagacgccugugcgagcacaaguacggaaacgccccucgggugagaaucaauggccacgucgcugcccgcuuccccuuuaucccgaugccucuggacuauauucuccccgaacugcuuaaaaacgccaugcgggcuacaauggagagccaucuggacaccccuuacaaugugcccgauguggucaucacgauugcgaacaaugacguugaucucaucauuagaaucucugaccgcgggggaggcaucgcccacaaggaucuggaccgggugauggauuaccauuucacaaccgcugaagccuccacacaagaccccagaauuagcccucuuuuugggcaccuggauaugcauucuggagcccaguccggcccgaugcacggcuga

SEQ ID NO: 66380 - RNA, 648 nt, Artificial Sequence
  derived and/or modified sequence opt5 from BCL10__Homo_sapiens__XP_011540701
auggcccuggagaaccucagaguguaccugugcgaaaagaucauugcugagcggcacuucgaccaucuucgcgccaaaaagauccugagcagagaagauaccgaggaaauuuccugucggacaucuagccgcaaaagagcgggcaagcuccuggacuaucuucaggagaaucccaaagggcuggauacgcucgucgaguccauccggcgcgaaaagacccaaaacuuucugauucagaagaucacagacgagguucugaaacucagaaauaucaagcuggaacaccuuaaaggacugaagugcucuagcugugagccuuucccggauggcgcuaccaacaaucucucccggucuaacagcgacgaguccaauuuuagcgaaaaacugcgcgccucuacagugauguaccaucccgagggggaauccagcaccacaccuuucuuuucuaccaacuccagccuuaaucugcccgugcucgaggucggaagaacggaaaacaccauuuucucuuccacaacccugccucggcccggcgauccuggggccccgccccugccucccgaccuccagcuggaggaggaaggaacaugcgcuaauagcuccgagauguuucuuccucugcgcucuagaaccgugagccggcaguga

SEQ ID NO: 66381 - RNA, 2322 nt, Artificial Sequence
  derived and/or modified sequence opt5 from BCL11A__Homo_sapiens__NP_060484
augagcagacggaagcagggcaaaccccaacaccuguccaagcgcgaguucucuccugaaccgcucgaggccauccugaccgacgaugaacccgaccaugggccucuuggagcucccgagggcgaucacgaccugcucacaugcgggcagugucagaugaacuuuccucugggagauauucuuaucuucauugaacauaaaagaaagcagugcaauggcagccugugucucgagaaagccguggacaagcccccuuccccgucucccaucgagaugaagaaagcgagcaacccugucgaaguugggauucaagugacgcccgaggaugacgauugccuguccaccucuagccggggaaucuguccuaagcaggaacacaucgcugacaaacugcuccauuggcgcggccuguccagccccagaucugcccacggcgcccuuauuccgacaccugggauguccgcugaguacgcuccccagggaaucugcaaggaugagccuagcucuuauaccuguacaaccugcaaacagcccuuuacauccgccugguuccugcuccaacacgcccagaauacccauggccugcggauuuaccuugaaagcgagcacgggucuccccugacgccucgcgugggaaucccguccggccucggggcggaaugucccagccagccuccccugcauggcauucacaucgccgacaacaauccuuuuaaccugcuccggauucccggauccgucucuagagaggcuagcggccuggccgaagggcgcuucccgccuacacccccucuuuuuagcccuccgcccagacaccaucuggauccccaccggaucgagcgccucggagcugaggaaauggcccuggcgacccaucacccuuccgccuucgacagagugcuucggcugaaucccauggcuauggagcccccugccauggacuuuucucgcagacuccgggaacuggcuggcaacaccuccagcccgccccugucuccugggagacccagcccuaugcagcgccuccugcaacccuuccagccuggauccaagcccccguuucuugccacaccuccccugccuccccuccagucugccccgccucccagccaaccucccguuaaguccaaaagcugcgaguucuguggcaagaccuuuaaauuccagucuaaucuggugguccaucggagaucccacacgggggaaaagcccuauaaaugcaaccuuugcgaucacgcuuguacacaggcgagcaagcugaaacgccauaugaagacccacaugcauaagucuuccccuaugacagugaaaagcgacgauggacucuccaccgccucuagcccggagcccggcaccuccgaccugguuggcucugcuagcuccgcccucaagagcguggucgccaaauucaagucugagaaugauccuaaccugauccccgaaaauggggacgaggaagaggaagaggaugacgaggaagaggaagaggaggaagaggaagaggaagaggagcugacagaauccgagcggguggauuacggauuuggccuuagccuggaagcugccagacaccacgagaacucuucccgcggggcgguggucggaguuggcgacgaaagccgggcucucccugaugugaugcaggggauggugcugucuagcaugcaacauuucuccgaggccuuucaccagguccugggcgagaaacauaagagaggacaccuugccgaagcugagggccaucgcgacacgugcgacgaagauagcguggccggggagucugaccggauugaugacggaaccguuaauggcagaggguguucccccggagaaagcgcuuccggcgggcucucuaagaaacugcugcucggcagcccuuccucucugagcccguucuccaagcgcaucaaacuugagaaggaguuugaucugcccccugccgcgaugcccaacacagaaaacguguauucucaguggcucgccggauacgcugccagccggcagcugaaagacccuuuccuguccuuuggcgauagcagacaaucucccuucgcuuccagcucugagcacuccagcgaaaaugggucucuucgguuuuccaccccgccuggagagcucgacggcgggauuagcggacgcuccggcacagggagcggcggaucuacgccccacaucagcggccccgggccuggaagacccuccucuaaggagggccggagaagcgauaccugcuccucucauacaccuauucgccggagcacccagagagcccaggacgucuggcaguucuccgaugggucuagccgcgcgcugaaguuuuga

SEQ ID NO: 66382 - RNA, 2472 nt, Artificial Sequence
  derived and/or modified sequence opt5 from BCL11B__Homo_sapiens__NP_075049
augagcagacggaagcagggcaacccccaacaccugucccagcgcgagcucaucaccccugaagccgaccauguggaggcugccauucuggaagaggaugaagggcuugagaucgaggaaccgucuggacugggccucauggucgggggacccgacccugaucugcuuacaugcggccagugucagaugaauuucccccugggggacauucucguuuuuaucgagcacaaaagaaagcaaugcggaggcagccugggcgcguguuacgauaaagcucuggacaaggauuccccucccccuucuagccgguccgaacuccgcaaagugucugagccgguggagauugggauccaggucacgcccgacgaagaugaccaucugcuuagcccuaccaagggaaucugccccaagcaggagaacauugccggcaaagaugaaccuuccagcuauaucuguacaaccugcaagcagcccuucaauucugccugguuucugcuccaacacgcucagaacacacauggguucagaauuuaccuggagccgggaccugccuccagcucucuuacaccccggcugaccaucccuccuccccucggccccgaagcuguggcccaguccccgcugaugaauuuucugggggacagcaaccccuucaaucuccugcgcaugaccggaccuauucuuagagaucaccccggcuuuggcgaggggcggcugccuggaacgcccccgcuguucucuccucccccucgccaccaucucgacccccacagacuuuccgcggaggaaaugggccugguugcccagcauccuagcgcuuuugaccgggugaugcgccucaaccccauggccaucgauuccccggcuauggacuucucuagacggcugcgcgagcuggccgggaauagcuccaccccuccucccgucagccccggaagaggcaacccgaugcaccggcuccugaaucccuuucaaccuucucccaaauccccuuuccuuagcacacccccucugcccccgaugccucccgggggaaccccucccccgcagccucccgcgaagucuaaaagcugugaauuuugcggcaagacauucaaguuccaguccaaccucauugugcacagacgcucucauaccggcgagaaaccuuauaagugucaacugugcgaucacgccuguagccaggcuuccaaacuuaagcggcauaugaaaacgcacaugcauaaggccgggagccuggcuggaagaucugacgauggccucuccgccgccagcucucccgaacccgggacauccgagcuggcuggagagggccugaaagcggccgacggggauuuucgccaccacgaaagcgacccuucccucggccaugagccggaagaggaagaugaggaggaagaggaagaggaggaggaacugcuucuggaaaaugagucucggcccgaaagcuccuucucuauggacagcgagcucuccagaaaccgcgagaauggaggcgggggaguuccuggcgugcccggggcuggaggcggggccgccaaggcucuggccgaugaaaaggcgcugguccuuggcaaagugauggagaacgugggacucggcgcucugccucaguacggggaacugcucgccgacaagcagaaacggggagccuuucugaagagagcugccggcgggggagacgcuggcgaugacgaugacgccgggggcugcggagaugcgggcgccgggggagcugucaacggccgcgggggaggcuucgcccccgggaccgagccuuuuccgggccuuuucccccggaaaccugcuccccugccuagccccggacucaauucugccgcgaagagaaucaagguugaaaaagaccuggagcugccgccugccgcucuuauccccuccgagaacguguauagccaauggcucgugggcuacgccgcuucucgccacuuuaugaaggaucccuuccugggguuuacagacgcccggcaguccccuuucgccaccagcucugaacauagcuccgagaauggaagccugagauuuucuacacccccuggcgaucuccuggacgggggacuuuccggccggagcggcaccgcuuccgggggaucuacgccgcaccugggcgggcccggaccuggccgccccagcuccaaagaagggagacggucugauaccugcgaguauuguggaaaggucuucaaaaacugcagcaaucucacagugcacagacgcucccauaccggcgaacggccuuacaagugugagcugugcaacuacgcgugugcccagucuagcaagcugacaagacacaugaaaacccauggccagauugggaaggagguuuaucgcugcgacaucugucaaaugcccuuuuccguguacagcacgcuugaaaaacacaugaagaaauggcauggagagcaccuccugacaaaugaugucaagauugaacaggcugagagaucuuga

SEQ ID NO: 66383 - RNA, 492 nt, Artificial Sequence
  derived and/or modified sequence opt5 from BCL2A1__Homo_sapiens__NP_001108207
augaccgacugcgaguucggcuacaucuauagacuggcccaggauuaccuccaaugugugcugcagauuccccagccugggagcggaccguccaagacaucucggguccuucagaacguugcuuuuagcgugcaaaaagaaguggagaagaaucugaaauccugccucgacaacgucaaugugguuucuguggauacggcccgcacccuguucaaccaggucauggaaaaggaguuugaagacggcaucauuaauugggggagaaucgugacaauuuucgcguuugagggaauccuuaucaaaaagcugcuccggcagcagauugcucccgauguugacaccuauaaggagaucagcuacuucguggccgaauuuauuaugaacaauacaggcgaguggauccgccaaaacgggggauggggcaaauggcacaaucauaccccuaugcuggucgaauccguggcccacaagaaaagaaagauggcucuguga

SEQ ID NO: 66384 - RNA, 720 nt, Artificial Sequence
  derived and/or modified sequence opt5 from BCL2__Homo_sapiens__NP_000624
auggcccacgcuggcagaaccggguacgacaaccgggagaucgugaugaaguauauucauuacaaacugagccagcgcggauaugaaugggaugccggcgacgucggggcggcucccccuggagccgccccggcucccggcaucuucuccucucaaccugggcacacaccccauccugccgcuagcagagaucccguugcccggacguccccucuccagaccccggcggcccccggagcugccgcuggcccugcccugucucccgugccucccgugguccaccuuacacugcgccaggcgggcgacgauuuuagcagacgguaccgcagagacuucgccgagauguccucucagcuccaucugaccccguuuacagcucgggggcgcuucgccaccgugguugaagaacuuuuuagagauggagugaauuggggccggauugucgcuuucuuugaguucgggggagugaugugcguugagagcgugaaccgcgagauguccccucuggucgacaauaucgcccucuggaugacagaauaucugaacagacaucugcacaccuggauucaagauaauggcgggugggacgccuuuguggagcucuacggacccagcaugcggccucuguucgauuuuucuuggcuuucccugaagacgcuccugagccuugcucuggugggcgcguguaucacccucggcgccuaucuggggcacaaauga

SEQ ID NO: 66385 - RNA, 615 nt, Artificial Sequence
  derived and/or modified sequence opt5 from BCL2L10__Homo_sapiens__NP_065129
augguggaccagcugagagagcggaccacaauggccgauccccuccgcgaaagaacggagcugcuucuggcugacuaccucggcuauugcgcccgggaaccugggaccccggagcccgcgccuagcacacccgaagcugccguccugcgcuccgccgcugccagacuucggcaaauccaccgcucuuucuuuagcgcuuaccugggauauccuggcaacagauucgagcucguugcccugauggcggauuccgugcugucugacagccccgggccuaccuggggacggguggucacacucgugaccuuugccggcacacugcuugagcgcgggccgcugguuaccgcuagauggaagaaauggggauuccagccccggcucaaggaacaggagggcgauguggcccgcgacugucagagacuggucgcccuucuguccucucggcucaugggccaacaucgcgcuuggcugcaggcgcaagggggaugggauggcuuuugccacuucuuuagaacgccuuucccccuggccuuuuggcggaaacagcucgugcaggcuuuccugagcugucuucugaccacagccuuuauuuaccucuggaccagacugcuuuga

SEQ ID NO: 66386 - RNA, 258 nt, Artificial Sequence
  derived and/or modified sequence opt5 from BCL2L11__Homo_sapiens__NP_001191036
auggccaagcagcccagcgacguguccucugagugcgauagagaaggccggcaacugcagccugcugagcgcccgccccagcucagaccuggggcccccaccagccugcagacagaaccucaagcguccaugcggcaggcugagcccgccgacaugcgcccugaaaucuggauugcccaggagcuuagacggaucggagaugaguucaacgcuuacuaugcccgcagacuggcuaaacuccuggccucuagcacguga

SEQ ID NO: 66387 - RNA, 1002 nt, Artificial Sequence
  derived and/or modified sequence opt5 from BCL2L12__Homo_sapiens__NP_001035758
augggcagacccgccgggcuguucccuccgcucugccccuuucugggauuccggccugaggcuuguugggaacgccacaugcagaucgagagagcccccagcgugccucccuuucuucggugggcgggcuaccgcccugggccggucagacggcgcggaaagguugaacugauuaaauucgugagagugcaauggcggcgcccccaggucgaguggagacggcgcagauggggcccugggcccggagcuuccauggccggcucugaggaacucggccugcgggaggacacccuucgcgugcuggccgcuuuucucagaagaggggaagccgcuggaagcccuguucccacaccgccuucccccgcccaggaggaaccuacggauuuccugucucggcugcgccggugccuccccuguagccugggcagaggggcggcccccuccgagucuccucgcccgugcagccuucccauccggccuuguuauggacuggagcccggcccugcuacccccgacuuuuacgcccucguggcucagagacuggaacaacuuguccaggagcagcugaaguccccgccuagccccgaacuccaggggccucccucuacagagaaagaagccauucugcgccggcugguggcgcuccuggaggaggaagccgagguuaucaaccaaaaacuugcuuccgauccugcccugagaagcaagcucgugcgccugucuuccgacagcuucgcucggcuugucgaacuguuuugcucuagagaugacuccagccgccccucccgggccuguccgggaccucccccucccucuccggagccccucgccagacuggcucuggcgauggaacucagccggcgcguggccggccugggcgggacccuugcuggacuguccguggagcauguccacagcuucacaccuuggauucaggcccauggcgggugggagggaauccucgccguuucucccguggaucugaaucuuccucuggacuga

SEQ ID NO: 66388 - RNA, 1386 nt, Artificial Sequence
  derived and/or modified sequence opt5 from BCL2L13__Homo_sapiens__NP_001257656
augagcggcuccucugggcccgccccuaccccggcugugacaaaggccagacggggagaccugacgcuccagcacggcgggggaggccgccuggggcccagagucggagcgcuuaccgcugccggcggcccuugccggaaacaacugcccccucccccucucagcucccugcuugggcagggaccgggccccgggguucagcuggauaucgccucucagagccucgaccaagagauucugcugaaggugaaaacagaaaucgaggaggaacucaagucccuggauaaagaaauuucugaggcuuucaccagcacaggauuugaccgccauaccuccccuguguucagccccgccaacccugagucuuccauggaagauugucuugcucaccugggcgagaaggucagccaggaacucaaggagccccugcauaaagcccuucagaugcugcucucucagccggugacauaccaagcguuuagagagugcacccuggaaacgaccguucacgccuccggguggaauaagggaacaguguucagccuggagucugaagaggaagaguauccuggcaucaccgcugaggacuccaacgauauuuacauccuccccagcgacaauuccggccaggucucuccucccgaaagccccacagugaccacguccuggcagagcgagucucugccuguuucccuuagcgccucucagagcuggcauacagaaucccugccggugucucucgggcccgagagcuggcaacagaucgcuauggauccugaagaggucaaaucccuggacagcaacggagccggcgagaagucugaaaauaacuccagcaauucugauauugugcacguggagaaagaagagguccccgaagggauggaggaggcggccguugcuuccguggugcuuccugcccgggaacugcaggaggcucuccccgaagccccggccccucugcugccccacaucaccgcuacaagccuccugggaacccgcgagccugacaccgaggucauuacaguggaaaaguccucucccgcgacgagccuuuuuguugagcuggaugaagaggaagugaaggccgcuaccacagagccuaccgaggucgaagaggugguucccgcccucgaaccgacagagacccugcuuuccgaaaaagagaucaacgccagagaggaaucucugguggaggaacucagcccugcuuccgagaagaaacccgugcccccuagcgaaggcaagucucggcuguccccggccggggagaugaaacccaugccucugagcgagggaaagucuauucuccuguucggcggcgcggcugccgucgccauccuugcugucgccauugggguggcucuggcccuccgcaaaaaguga

SEQ ID NO: 66389 - RNA, 759 nt, Artificial Sequence
  derived and/or modified sequence opt5 from BCL2L14__Homo_sapiens__NP_110393
augugcagcaccuccggcugugaccuggaggaaaucccccucgaugacgaugaccugaacacaauugaguucaagauccuugccuacuauacgagacaccauguguuuaaaucuaccccugcucuguucagcccgaagcuccugcggacacgcucccuuucucagagagggcugggaaauugcagcgccaacgaauccuggaccgaggucucuuggcccugucggaauagccaauccagcgaaaaagcgauuaaccucggcaagaaaaagucuuccuggaaggccuuuuucgggguuguggagaaagaggauagccagucuaccccugcuaagguguccgcccagggacagcgcacacuggaauaccaagacagccacucucagcagugguccagaugccugagcaaugucgagcagugucucgaacaugaggcuguggaucccaaaguuaucuccauugccaaccggguggcugagaucgucuauucuuggccucccccucaagccacacaggcgggcggguuuaagagcaaagaaaucuucgugaccgagggacuguccuuucagcuucagggccacguuccgguggccucuagcuccaagaaggacgaagaggaacaaauucuggcuaaaaucgucgagcuccugaaguacagcggcgaucagcuugagcgcaaagacacggccuucauucccaucccucugguggauaccucuauucagggguuuccccaagacggacucauggcuugcaucuga

SEQ ID NO: 66390 - RNA, 513 nt, Artificial Sequence
  derived and/or modified sequence opt5 from BCL2L1__Homo_sapiens__NP_001182
augagccaguccaacagagagcugguggucgacuuccucucuuacaagcugagccaaaaaggcuauuccuggucucaguuuagcgauguugaagagaaucggaccgaagcccccgaggggacagaauccgagauggagacgccuucugcuaucaacggaaauccgagcuggcaccuugccgacucccccgcggugaacggcgcuaccgggcauucuagcucccuggaugcccgcgaagugauuccuauggccgcugucaagcaggcccucagagaggcuggagacgaguucgaacugcgguaccgcagagccuuuagcgaucuuacaucucagcugcacaucacccccggcacagcguaucaauccuucgagcaggacaccuuuguggaacucuacgggaauaacgccgcugccgagagccggaaaggacaggaacgcuucaauagaugguuucugacaggcaugaccguugcuggcgugguccugcucgggucucuguucucccggaaguga

SEQ ID NO: 66391 - RNA, 582 nt, Artificial Sequence
  derived and/or modified sequence opt5 from BCL2L2__Homo_sapiens__NP_004041
auggccacccccgcuagcgccccugacacaagagcgcugguggcugauuucgucggcuacaagcuccggcagaaaggguauguuugcggagccggcccgggggagggacccgccgcugacccucugcaccaagccaugcgcgcugccggcgaugaauuugagacgagauuccggcgcaccuuuuccgaccuugcggcccagcugcaugugacacccgggucugcucagcagagauucacccaagugagcgaugaacucuuucagggaggcccuaacuggggccggcuggucgccuucuuuguguucggggcugcccuuugugcggaguccguuaauaaggaaauggagccccuggugggacagguccaggaguggaugguggccuaccucgaaacacgccuggcugacuggauccacucuagcggcgggugggccgaguuuaccgcucuguauggagauggcgcccucgaagaggccagacggcugcgcgaggggaacugggcuuccguuagaacagugcuuaccggagcggucgcccugggcgcucucgugacggugggcgccuucuuugccucuaaauga

SEQ ID NO: 66392 - RNA, 1002 nt, Artificial Sequence
  derived and/or modified sequence opt5 from BCL2L2-PABPN1__Homo_sapiens__NP_001186793
auggccacccccgcuagcgccccugacacaagagcgcugguggcugauuucgucggauacaagcuccggcagaaaggguauguuugcggagccggcccgggggagggacccgccgcugacccucugcaccaagccaugcgcgcugccggcgaugaauuugagacgagauuccggcgcaccuuuuccgaccuugcggcccagcugcaugugacacccgggucugcucagcagagauucacccaagugagcgaugaacucuuucagggaggcccuaacuggggccggcuggucgccuucuuuguguucggggcugcccuuugugcggaguccguuaauaaggaaauggagccccuggugggacagguccaggaguggaugguggccuaccucgaaacacgccuggcugacuggauccacucuagcggcgggugggagcuggaagccauuaaagcuagaguucgggagauggaggaagaggccgaaaagcucaaagagcugcaaaacgaaguggagaagcagaugaauauguccccuccgcccggaaacgccggcccugucaucaugucuauugaggaaaagauggaggcugaugcgcgcagcaucuauguggggaauguggacuacggagccaccgcugaggaacuugaagcccauuuucacggcugcggcuccgucaacagaguuacaauucugugugauaaauucagcgggcaucccaagggauuugccuauaucgaguucucugacaaagaguccgugcggaccagccucgcucuggaugaaucucuuuuucgcggcagacagaucaaggugauuccuaaacggacgaaucgccccgggaucuccaccacagacagaggauucccgcgggccagauaccgcgcgcggaccacaaacuauaauagcucuagaucccgcuucuacagcggcuuuaacucccggccuagagggcgcgucuaccggggcagagcucgcgccaccucuugguauagccccuacuga

SEQ ID NO: 66393 - RNA, 1365 nt, Artificial Sequence
  derived and/or modified sequence opt5 from BCL3__Homo_sapiens__XP_011525499
augcccagaugcccugccggcgcuauggacgaggggccgguggaccugcggacccgccccaaggccgcgggacucccuggcgcugcccugccccuuagaaaacggccucugcgcgcccccagcccugaaccggcugcccccagaggggcugccggacucgucguuccucuggacccccuucggggcgggugugaucugccugcggugcccggaccgccucacggccucgcccgccccgaggcucuguacuauccuggcgcccugcucccccuguaccccacaagagcuaugggguccccuuucccgcuugugaaucugcccacgccucucuaucccaugaugugcccuauggaacauccccugucugccgacaucgcgauggccacccgggcugaugaggacggagauacaccgcuucacauugccgucgugcagggcaaucugccugcuguucaucgccucgugaaccuguuucaacagggcggaagagaacuggacaucuacaauaaccuccggcagacaccccugcaccuugccgucauuaccacccugccuagcgugguucgccuccuggugacagccggcgcuucccccauggcgcuugauagacaugggcagaccgccgcucaccuggccugugagcaccggucuccuacgugccuccgcgcccugcuggacagcgcugcccccggaacccucgaucuggaggcgagaaauuaugacggccuuacagcucugcaugucgccgugaacaccgaaugucaagagacagugcagcuccugcuugaacggggcgccgauaucgacgcugucgacauuaaguccgggagaucuccgcugauccacgccguugagaauaacagccucuccauggugcagcugcugcuccagcauggagcuaaugugaacgcccaaauguacagcgggucuuccgcgcugcacagcgccucugggcgcggacuucugccucucguccggacccuggugagauccggcgcugauagcucucugaaaaauugccacaacgacacgccccuuaugguugcccgcucccggagagugaucgauauucuccgcgggaaggcuacacggcccgccagcaccucccagccugacccgucucccgauagaagcgcgaauacauccccugagucuagcucccgccugagcucuaacggacugcucagcgccucccccucuagcuccccuagccagucucccccucgggaucccccgggcuucccuauggcucccccuaacuuuuuccugcccuccccgagcccucccgccuuucuuccuuucgcuggcguccugagagggcccggacgccccgugccuccgucucccgccccuggcggguccuga

SEQ ID NO: 66394 - RNA, 1443 nt, Artificial Sequence
  derived and/or modified sequence opt5 from BCL6B__Homo_sapiens__NP_862827
augggcagccccgccgcuccugagggggcccugggauacgugagagaguucacccggcacuccucugacguccucggcaaccugaaugaacuucgccugagagggauccucacagauguuacgcugcuugugggaggccagccgcugcgggcgcauaaggcugugcucauugccugcagcggguuuuucuauuccaucuuucgcggcagagccggagucggcguggacguucugucucugcccgggggaccugaagcucggggcuucgcuccccuccuggauuuuauguacaccagccgccuuagacuguccccugcuacagcccccgcggugcucgccgcugccaccuaucugcaaauggagcacgucgugcaggcuugucaucgguucauucaggccucuuacgaaccucuugggaucagccugcgcccgcucgaggcggagcccccuacacccccuaccgcucccccgccuggaucccccagacggagcgaaggccacccugacccucccacagagucucgcuccugcagccaggggcccccgucucccgccuccccugaucccaaagccuguaacuggaagaaauauaaguacauuguucugaauagccaagccucucaggccggaucccuggugggcgaaagaagcuccggccagccuugcccccaggcccggcucccgucuggggacgaggcuagcuccucuagcuccagcucuagcuccucuagcuccgaggaaggaccuauccccggcccucaaagccgccugucucccaccgcggccacgguccaguuuaaauguggggcuccugccuccacccccuaucuucugacaagccaggcccaggauaccucuggauccccgagcgagagagcucggccucuccccggcuccgaguucuuuucuugccaaaacugugaagccguggcggggugcagcuccggacuggacucucuugugcccggcgaugaagacaagccuuacaagugucagcugugcagaagcuccuuccgcuacaaaggcaaucucgcuagccaucggacaguccacaccggggagaagccguaucacuguucuaucugcggagccagauuuaaccgccccgccaaucugaaaacgcauucccggauucacagcggcgagaagccuuacaaaugcgaaacaugugggucuagauucguucagguggcucaucugcgcgcccacgugcucauccacaccggagagaagcccuauccuugccccacauguggcacccgguuuagacaucugcaaacccuuaagucccacguccgcauucauacaggggaaaaaccuuaccacugcgaucccuguggccugcauuuccggcacaagagccagcucagacugcaccuucgccagaaacauggagcugccacgaacaccaaggugcacuaucauauccugggcgggccguga

SEQ ID NO: 66395 - RNA, 2121 nt, Artificial Sequence
  derived and/or modified sequence opt5 from BCL6__Homo_sapiens__NP_001124317
auggccagccccgcugacuccugcauccaguucaccagacacgccucugaugugcugcucaaccugaaucggcuucgcagcagagacauucugacagaugucguuaucguggugucccgggagcaauuucgcgcgcauaagacgguccucauggcuuguucuggccuguucuacagcauuuuuaccgaccagcuuaaaugcaaccuguccgugaucaaucucgauccugaaauuaacccggagggguucuguauccugcuggacuuuauguauacaucuagacucaaucugcgggaaggaaacaucauggccguuauggccaccgcuauguaccuucagauggagcacguggucgauacaugccgcaaguucauuaaagccagcgaagcugagaugguguccgccaucaagcccccuagagaggaauuucugaauagccggaugcucaugccccaggacauuauggcguaucgcggcagagagguuguggaaaacaaucugccucuucggucugcccccgggugugagucccgcgcuuucgccccuagccuguacucuggacucuccaccccgcccgcuagcuauucuauguacucccaucugccugucagcucccugcucuuuucugaugaggaguucagagacgugcggaugcccguggccaacccuuuucccaaagaacgcgcgcugccgugcgauagcgccagaccuguccccggcgaauauucccggccuacacuugagguuagccccaaugugugucacucuaacaucuacucccccaaggaaaccauuccugaggaggcuagaagcgacaugcauuacucuguggccgaagggcugaagccggcugcccccagcgcccgcaaugcuccuuauuuccccugcgauaaagcguccaaggaggaggaacggccuucuagcgaagacgagaucgcccuccacuuugagcccccgaacgcuccucugaauagaaaaggacuugucagcccccaauccccucagaagucugacugucagcccaacuccccuacggaaagcuguucuuccaaaaacgccugcauucugcaggccagcggcucucccccggcuaaguccccuaccgaucccaaggccugcaauuggaaaaaguacaaauucaucgugcucaacagccugaaucaaaacgcgaagcccgagggcccugaacaggcugagcuggggcgccucuccccgcgggccuauacagcucccccugcuugccagcccccuauggaacccgagaaucuggaccuucagucuccuaccaaacugagcgccuccggagaggauagcacaaucccccaagccucuagacucaacaauauuguuaaccgcuccaugaccggcagcccgcggucuuccagcgaaucucacagcccucuguacaugcaucccccuaaguguacguccugcgggagccagucuccccagcacgccgagaugugucuucauacagcgggaccgaccuucccugaagagaugggcgagacacaauccgaauauagcgacuccucuugcgagaauggggccuuuuucuguaacgaaugcgauuguagauuuagcgaggaggcuucccugaaacgccacacccuccagacccacucugacaagcccuacaagugcgaucggugucaggccagcuucagauauaaaggaaaucuggcuucccauaagacagugcacacgggcgaaaaaccuuaccgcugcaacaucuguggcgcccaguuuaaucggcccgcgaaccugaagacccauacacggauucacucuggggagaaacccuacaagugcgaaaccugcggagccagauucguccaaguggcucaucuccgcgcccacguucugauccacacaggcgagaagccuuauccgugugaaauuugcgggaccagauuucggcaucuucagacgcugaaaagccaccucagaauccauacaggagagaagcccuaccacugugaaaaaugcaaucugcacuuccgccauaagucccagcugcggcuucaccucagacagaaacauggcgcuaucaccaacaccaaggugcaauaucgcgucagcgccacagaccugccucccgagcugccuaaggccuguuga

SEQ ID NO: 66396 - RNA, 633 nt, Artificial Sequence
  derived and/or modified sequence opt5 from BCL7A__Homo_sapiens__NP_001019979
augagcggcagauccgugcgggccgagacccgcucuagagcuaaggacgauaucaaacgggucauggccgcgauugaaaagguucgcaaaugggagaagaaaugggugacagugggggacacgagccugagaaucuacaaguggguccccgugaccgaaccuaagguugaugacaaaaacaagaauaaaaagaaaggaaaggaugagaagugcggcuccgaagugacaaccccggagaacucuagcucccccgggaugauggacaugcacgaugacaauucuaaccagagcuccauugcugaugccagcccuaucaaacaagaaaauucuuccaacagcucucccgccccugagcccaauuccgcugucccuagcgacggaacagaggccaagguggaugaagcucaggccgacggcaaagagcauccgggggcggaggaugccucugacgaacagaacucccagagcuccauggagcacucuaugaauagcuccgaaaagguugaccggcaacccagcggagauucuggccucgcugccgagaccuccgcuauuagccaggaccuggaaggcgugccucccucuaaaaagaugaaacuugaggccagccagcagaacuccgaggaaauguga

SEQ ID NO: 66397 - RNA, 438 nt, Artificial Sequence
  derived and/or modified sequence opt5 from BCL7B__Homo_sapiens__NP_001184173
augagcggcagauccgugcgggccgagacccgcucuagagcuaaggacgauaucaaaaaggucauggccgcgauugaaaaaguucggaagugggagaaaaagugggugacagugggggacacgagccugcgcaucuucaaguggguccccgugaccgauuccaaagaaaaggagaaaucuaagagcaacuccucugcugccagagaaccuaauggauuuccgagcgacgccuccgcuaacagcucucuccugcuugaguuccaggagcccucccugccuagcucugaaguugccgaugagcccccuacacucaccaaagaggaacccgugccucuggagacacaagucguggaagaggaagaggacuccggcgcuccgccccuuaagcgguuuugcguugaucagccuaccgugccccagacagccagcgaaucuuga

SEQ ID NO: 66398 - RNA, 729 nt, Artificial Sequence
  derived and/or modified sequence opt5 from BCL7C__Homo_sapiens__NP_001273455
auggccggcagaaccgugcgggcugagacacgcagcagagccaaggacgauaucaaaaaggucauggcgacgauugaaaaaguucggcgcugggagaagagaugggugaccgugggggacacaucccugcggaucuucaaauggguccccgugguugauccucaggaagaggaacgcagacgggcuggaggcggggccgagcgcucuagaggacgggagcgcagaggccgcggggccagcccgcggggaggcggcccccucauucugcuugaccugaacgaugaaaauuccaaccaaucuuuucacagcgaggggucccuccagaagggaaccgaaccuucucccggcgggacaccucagcccagcagaccuguguccccggcuggacccccugagggcguccccgaggaagcccagccuccccggcuggggcaagagagagacccgggaggcaucaccgcuggcagcacagaugaaccucccaugcuuaccaaggaggaaccugugcccgagcugcucgaggccgaagacucugggguucgcaugacgcggagagcgcugcaugagaaaggacugaagaccgaaccccuccgccggcugcuuccuagacgcggccugcggacaaaugugagaccguccagcauggccguccccgauacccgcgcuccugggggaggcucuaaagcuccccgggccccuagaacaauuccccaggggaagggacgcuga

SEQ ID NO: 66399 - RNA, 4500 nt, Artificial Sequence
  derived and/or modified sequence opt5 from BCL9L__Homo_sapiens__NP_872363
augagaauccuggccaacaagacccggcucccccacccucgcagacgggaggcuccgggcagccccccucuguccccccgcgggcauugcccucccgccccugcgaaaccgaugcaccccgaaaauaagcuuacaaaccauggaaaaacgggcaaugggggagcucagucucaacaccagaacgugaaucagggcccuaccuguaacgucgggagcaagggaguuggcgccggcaaucauggggccaaagcuaaccagauuucccccucuaauagcucccugaagaacccucaagccggagugcccccguucucuagccucaagggcaaagugaagagagaccgguccgucagcguggauucuggggagcagcgcgaagcuggaacaccuucccuggacagcgaggccaaagaaguugcgcccagaucuaagcggcgcugcgugcuugagagaaaacagccuuacuccggcgaugagugguguagcgggcccgacucugaagaggaugacaagcccaucggagccacccacaauugcaacgucgcugauccugccauggcugccccgcagcugggccccggccaaacaacccagcucccucuguccgaaagcuccgugcccggggcgccucacggacccccgccuggccugcggcccgacgccccugggggaggcgggggaggcggcgggguucccggaaagccucccucucaguuuguguaugucuucacaacccaucucgcuaauacggccgcugaggccgugcugcagggccgcgccgauagcauucuugcuuaccaccaacagaacgugccgagagcgaaacuggaccaggccccuaaggucccccccaccccugagccgcucccccuguccacaccuagcgcugggaccccccaaucucagccucccccucuucccccgccucccccucccgccccgggauccgccccucccgcucugccucccgaaggccccccugaggauagcucucaggaccucgccccgaauagcguuggggcggcuuccacaggcggaggcaccgggggaacgcaucccaacacaccuaccgccacaaccgccaacaauccccugccucccggcggggauccuucuagcgcuccgggacccgcccugcucggcgaagcugccgcgccugggaacggccagcggucccuggugggaagcgagggccuuucuaaagaacaacuggagcaccgcgagagaucccuccagacccugcgggacaucgaaagacuucugcuccgcagcggggagacagaacccuuucugaagggaccucccggcggggccggagagggcgggccgccugcucaggccccccccccuccccagcaaccuccgacggcucccccuucuggccugaaaaaguaugaagagccccuccaguccaugauuagccagacccagucccugggaggcccuccccuugagcacgaagugccggggcauccucccggaggcgacauggggcaacagaugaauaugaugauccagcggcugggacaggauucucucacaccugagcaagucgccuggagaaaacugcaggaagaguacuaugaagagaagcgccggaaggaggaacagaucggccuucacgggagcagaccccugcaagacaugaugggcaugggaggcaugauggugcgcgggccucccccgccuuaccauuccaaacccggagaucaguggcccccuggcaugggggcgcagcuccggggaccgauggacguucaggaucccaugcaacugagaggcggcccucccuucccugggccccgcuuuccuggaaaccagauucagcgggugccgggcuucgggggaaugcagucuaugcccauggaggucccuaugaaugccaugcaaagacccgugcgcccuggcaugggguggaccgaagaccugcccccgaugggaggcccuagcaacuuugcucagaauacaaugcccuaucccggcgggcagggagaggccgagcgguucaugaccccuagaguucgggaagagcuccugcgccaccagcuucuggaaaagagauccaugggcaugcaacggccccucgggauggcuggaagcggcauggggcagucuauggagauggaaagaaugaugcaggcccaucgccaaauggauccugccauguuuccgggacagauggcuggcggcgaggggcuggcgggaacgcccaugggcauggaguucgggggaggccgggggcugcuuuccccucccaugggacagagcggccucagagaaguggacccucccaugggcccggggaaccugaauaugaacaugaaugucaacaugaauaugaacaugaaucugaacgugcagaugacaccucaacagcagaugcucaugucucagaaaaugcgcggacccggcgaucugauggggccucaaggacuuucccccgaggaaauggccagaguccgggcucagaacagcucuggcgugauggggggaccucagaagaugcugaugcccagccaguuuccgaaucaaggccagcagggcuucuccgggggacagggcccuuaccaagccaugagccaggacauggggaacacccaggauauguuuucucccgaccaauccagcaugcccauguccaauguuggaaccacacgccucucucacaugccucugccgcccgccagcaacccucccggcaccgugcacuccgcuccuaauagagggcugggacggcgccccucugaccuuacaaucagcauuaaccagaugggcuccccuggcauggggcaucucaaaucucccacgcugagccagguccacuccccgcuggugaccagcccuucugccaaucucaaguccccccagacaccuagccaaaugguuccccugccgucugcgaacccucccggaccccuuaaguccccucaggugcugggcagcucucucuccgucagaagccccaccggguccccuagccggcugaaaucuccgagcauggcugugcccuccccuggauggguggccucucccaagacagccaugccuagccccggcguuucccagaauaaacagccuccgcugaacaugaauucuagcaccacgcuuuccaacauggagcaagggacccuccccccuucuggaccccgcagcuccagcucugcuccucccgccaauccgccuuccggccugaugaaccccagccugcccuucacaucuuccccugaucccaccccuagccagaauccgcucucccugaugaugacacagaugucuaaguacgcgaugcccagcuccaccccucuuuaucauaacgcuaucaaaacgauugccacaagcgacgaugaacugcuccccgacagaccucugcugcccccgccucccccuccccagggcucugggccgggaaucuccaacagccaaccuucucagaugcaccuuaauagcgccgcugcccagucccccaugggcaugaaccuccccgggcaacagccucugucucacgagcccccuccggcuaugcugcccagcccuaccccccucggauccaauauuccucugcaucccaacgcccagggcacagggggcccuccgcagaauucuaugaugauggcgcccggaggcccugauagccuuaacgcccccugugggccuguccccuccagcucucaaaugaugccguucccuccccggcugcagcagccccacggagcuauggccccuaccggcgggggaggcgggggccccggacuccagcaacauuacccuuccggcauggcucugccgcccgaggaccugccuaaucagcccccugggcccaugccgccucagcagcaccuuaugggaaaggccauggccggccgcaugggggaugcuuaucccccuggagugcugcccggcguggcgagcguccucaacgacccugaacuguccgaggugaucagacccaccccgacagggauccccgaauuugaucucucucggauuaucccuagcgagaagcccuccucuacgcugcaauacuucccuaaaagcgaaaaucagccgcccaaggcccagccucccaaccuucaucugaugaaucuccagaacaugauggcugagcaaaccccuuccagacccccuaaucugcccggccagcagggaguucaacgcggccugaacaugagcaugugccacccggggcagaugucucuucugggacggacaggcgugccuccccagcaggggauggucccucacggacuccaucaaggcgugaugucccccccgcagggccugaugacccagcagaauuuuaugcucaugaaacaaagagggguuggaggcgagguguauagccagccuccccacaugcugucuccccaggggucccuuaugggaccucccccucagcaaaaccugauggucagccauccgcuccgccagcggucugugagccuggacucccagaugggcuaccugcccgccccugggggaauggccaaccuucccuucuga

SEQ ID NO: 66400 - RNA, 2610 nt, Artificial Sequence
  derived and/or modified sequence opt5 from BCLAF1__Homo_sapiens__NP_001070908
augggcagaagcaacucccggucucacagcucccgcucuaagagcagaucccagucuagcucccggagccgcucuagaucccauagccggaaaaagcgcuacagaucucggucccgcaccuauagcagaucucggucccgcgacagaauguacagccgggauuaucgcagagacuaccggaauaacagagggaugcgccggcccuauggauacagaggccgcgggcggggauauuaccaaggcgggggaggcagauaccaccgcggcggguaucggccuguguggaauagacgccauucccggucuccgagacgcggacggagcagaucccggagccccaaacgcagaucugucuccagccagcggucuagaagccgcucccggagaucuuaccgcagcuccagaagcccucggucuuccagcucucgcuccagcucccccuauucuaagagcccuguuuccaaaagacggggcucucaggagaagcagacaaagaaagccgaaggggagccccaagaagagagcccucugaaguccaaaagccaggaagaaccgaaggauacguucgagcacgaccccucugaauccaucgaugaguuuaacaaaagcucugcuaccuccggagacauuuggccuggccucagcgccuacgauaauucuccccgcagcccucauucccccagcccgaucgcgacaccucccucucaguccagcuccugcucugacgcuccuaugcugagcaccgugcacuccgccaagaacacacccucucagcacagccauuccauucaacacucucccgaaagaagcggguccggaagcgugggcaauggcagcucccgguauagcccuucucagaacuccccgauccaucacauucccagccgcagaucuccugccaagaccaucgcuccccagaaugccccucgggaugagucccgcgggagaagcuccuucuaccccgacggaggcgaucaggagacagcuaaaaccgggaaguuucuuaaacgguucacggacgaagagagcagagucuuucugcucgaucgcggaaacacccgggacaaggaagccucuaaagagaagggcagcgaaaaagggagagcggagggagagugggaagaccaagaggcccuggauuauuucuccgacaaggaaucuggcaagcagaaauuuaaugauagcgagggcgacgauacagaagagaccgaggacuaccgccaguuccggaaguccgugcuugcugaucaagggaaaucuuuugccacagcuagccacagaaacaccgaagaggaaggacugaaguacaaauccaagguuucucucaagggcaaucgcgagagcgacggguuccgggaagagaaaaacuauaagcugaaagagacgggauacguggucgaaagaccguccacaaccaaggauaaacauaaggaggaagacaagaauagcgagcgcaucacagugaaaaaggagacccagucuccugaacagguuaaauccgagaagcugaaagaucucuuugacuauucucccccucugcacaagaaccuugacgcccgggaaaagucuaccuucagagaggaaagcccccugcggauuaaaaugaucgcgagcgauucccaucgcccugaggugaagcucaaaauggcccccgucccgcuggacgauucuaacagaccugcuagccuuacaaaggaccggcugcucgccuccacgcuggugcacagcgugaaaaaggagcaggaauuucgcucuauuuucgaucauaucaaacugccccaggcuuccaagagcaccucugagagcuucauucaacacaucgucucccucguucaccaugugaaggaacaguacuuuaaaucugccgccaugacacugaaugagagauucaccagcuaucagaaggcuacagaggagcacuccacccggcaaaaaucucccgagauucauagacgcaucgacaucagcccuuccacgcuucggaagcacacaagacuggcgggcgaggaacgcguguuuaaagaagagaaccagaagggggauaagaaacuccggugugacagcgccgaucugagacacgacauugaucgccggagaaaggaacgcucuaaagagagaggcgacuccaagggaagccgggaguccucuggcagccgcaaacaggaaaagaccccgaaggauuacaaagaguauaaguccuacaaagacgacucuaagcauaaaagagaacaggaucacagccgguccuccucuuccagcgcuucucccuccagcccuucuagccgcgaggagaaggaauccaagaaagagagagaagaggaguucaagacccaucacgaaaugaaagaguacucuggguuugccggagucagccggcccagaggcacauuccaugacgaucgcgacgaugggguggacuauugggccaagcggggaagaggccgcgggaccuuucaacggggcagaggacgguucaauuuuaaaaaguccggcagcuccccuaaauggacacacgauaaguaccagggggacggaaucguugaagaugaggaagagacgauggaaaacaaugaggagaagaaagaccgcagaaaggaagagaaagaauga

SEQ ID NO: 66401 - RNA, 1644 nt, Artificial Sequence
  derived and/or modified sequence opt5 from BCO1__Homo_sapiens__NP_059125
auggacaucauuuucggcagaaaccggaaggagcagcuggaacccgugcgcgccaaagucaccgggaagaucccugcuuggcuccaaggaacacugcuuagaaauggcccggggaugcacacgguuggagagagccgguacaaccauugguuugauggccuggcccuccugcacuccuucaccauucgcgacggggaaguguauuacagaucuaaauaucuucggagcgauacauacaauaccaacaucgaggcgaaucgcauuguggucuccgaauuuggaacaauggcuuaucccgacccuugcaagaacaucuucucuaaagccuuuagcuaccugucccauaccauccccgauuucacagacaauugucucauuaacaucaugaagugcggcgaggauuuuuaugccaccucugagacgaauuacauuagaaagaucaacccucagacccuggaaacacuggagaaaguggacuaccggaaguauguugcugugaaucucgccaccagccacccccauuacgaugaagcuggcaacguccugaauauggggacauccauuguggagaaaggaaagaccaaauauguuaucuucaagauuccugccacggugccggagggcaagaaacaggggaaaagccccuggaaacacacagaagucuuuuguucuaucccuucccgcagccuucugucucccuccuacuaucacagcuucggagugaccgagaacuacgugaucuuucucgaacagccuuucagacuggacauucuuaagauggcgacagccuauauccggcgcaugucuugggcuuccugccuggccuuucauagagaggaaaagaccuacauucacaucauugaucaacggacccgccagcccguccagacaaaguucuacacggacgcuaugguuguguuccaucacgugaaugccuaugaggaggauggcuguaucgucuuugacgugaucgcguacgaagacaacagccucuaucagcuguucuaccuggccaaccucaaucaagauuuuaaagagaacuccagacugaccucuguuccgacacuucggagauucgcugugccucugcacgucgacaagaaugccgaaguggggaccaaccucauuaagguugcuagcacaaccgccacggcccugaaagaggaagauggacagguguauugccagcccgaguuucuuuacgagggccuggaacucccucgcgucaauuaugcucauaacggcaagcaguaccgguacguguucgcgacagggguccaauggucccccauccccaccaaaauuaucaaguaugacauucugaccaaaagcucucugaaguggagagaggaugacuguuggccugccgaaccgcucuuugugcccgcuccuggagccaaggaugaggacgauggcguuauccuguccgccaucgugagcacagacccccagaaacuuccuuuccugcucauucuggaugcuaagucuuuuaccgaacuugcccgcgcgagcgucgacguggacaugcacauggaucugcauggacucuucaucacagacauggauugggacacgaaaaagcaggcugccuccgaggagcaacgggauagagccucugacugccacggggcuccccugaccuga

SEQ ID NO: 66402 - RNA, 1620 nt, Artificial Sequence
  derived and/or modified sequence opt5 from BCO2__Homo_sapiens__NP_001243326
augggcaacacaccccagaagaaagccguguucgggcaaugcagaggacugccuugugucgcuccgcuccugaccacgguugaggaagcgccccggggcaucagcgcccgcgugugggggcacuuuccuaaguggcuuaauggaucccugcucagaauuggccccgggaaauucgaguuuggaaaggacaaauacaaccauugguucgauggcauggcucugcuucaccaguuucggauggccaagggcaccgugacauaucgcucuaaguuccugcagagcgacaccuacaaagccaauuccgcuaagaacagaaucgucauuucugaauuugggacacucgcccugccugaucccugcaaaaauguguucgagcgguuuaugagccgcuucgaacugccuggaaaggcugccgcgaugaccgacaacacaaauguuaacuaugugagauacaaaggcgauuauuaccucuguaccgagacgaauuuuaugaacaaggucgacaucgagacccuggaaaagacagagaaaguggauugguccaaguucauugccguuaauggggcuaccgcccauccgcacuaugaccccgauggaacagcuuacaacaugggcaauucuuuugggccuuacggauucagcuauaaagugauccgggugcccccugaaaaggucgaccuuggcgagaccauccauggcgugcaggucauuugcuccaucgccagcacggagaaagggaagcccucuuacuaucacuccuucggaaugacacgcaacuacauuaucuuuauugaacaaccgcugaaaaugaaucucuggaagaucgcgaccagcaagauuagaggcaaagccuucucugaugggaucuccugggagccucaguguaacacacgguuucacguuguggaaaagcgcaccggacagcugcuucccggcagauauuacagcaaaccuuucgugaccuuucaucagaucaacgcuuucgaggaccaagggugcgucauuaucgaucuguguugccaggacaauggacggacacucgaaguguaucagcugcagaaccugcgcaaggccggcgagggccucgaccaaguucacaauucugcugccaaauccuuucccagacgguucgugcugccccuuaacgucagccugaaugccccugagggggauaaccucuccccgcugucuuacacgagcgcuuccgcggugaagcaggccgacggaaccauuugguguagccaugaaaaucuucaccaggaggaucuggaaaaggagggcgggaucgaauuuccccaaauuuacuaugacagauucucuggcaaaaaguaccacuuuuucuauggaugcggguuucgccaucucguuggcgauucccugaucaaaguggacgucguguggcgggaggauggauucuacccuagcgagcccgucuucgugccugcucccggcacaaacgaagaggacgggggaguuauccugucuguggucauuaccccgaaucagaacgaaagcaauuuucuccuggugcuugaugccaagaacuucgaggaacugggcagagccgagguuccugugcagaugcccuauggguuucacggaacauucaucccuauuuga

SEQ ID NO: 66403 - RNA, 5166 nt, Artificial Sequence
  derived and/or modified sequence opt5 from BCOR__Homo_sapiens__NP_001116855
augcuguccgcuacaccccucuacggcaacgugcacuccuggaugaauagcgagagaguccggaugugcggggcuuccgaagaccgcaagauccugguuaacgauggagacgccuccaaagcgagacuugagcugcgggaagagaauccucucaaccauaacgugguggaugcuucuaccgcccaccgcauugacggacuggccgcucuuagcauggaucgcacggggcugauccgggaaggacuccgcgucccgggcaacauuguguauuccucucugugugggcugggaagcgagaagggccgggaggccgcuaccuccacacucggcgggcugggauucagcucugaacggaaucccgagaugcaguuuaaaccuaacacccccgaaacaguugaggccuccgcggugagcggcaagccucccaauggguucucugccaucuacaaaaccccuccgggcauucaaaaguccgcugucgccacagcugaggcccuuggccuggaccgccccgcgagcgauaagcagucuccucucaacaucaauggggccuccuaucugagacuucccugggugaacccuuacauggaaggagcuacccccgccaucuauccguuucuggacagcccuaauaaauacucccucaacauguauaaggcucugcugccccagcagucuuacagccucgcccaaccucuguacucccccguuugcacgaauggcgagcgguuccuuuaucugcccccuccgcauuacgugggcccccacauuccuagcucucucgccucccccaugcgccugagcaccccuucugcuagccccgcgaucccgccucuuguccauugugccgauaaaucccugcccuggaagaugggggugucuccuggaaaccccguggacagccacgcuuauccucacauucagaacuccaaacagcccagagucccgagcgccaaggccguuacaucuggccucccuggggauaccgcucugcugcugccgcccuccccucggccgagcccccgcgugcaucugccuacacagcccgccgcggacaccuacucugaauuucacaagcauuaugcuagaaucuccacgagcccuuccguggcccuuucuaaacccuacaugacagucagcuccgaguucccugccgcucggcugucuaauggaaaguaucccaaagccccggaaggcggggagggagcucaaccugugcccggccacgccagaaagaccgcgguucaggaucgcaaagacggcagcuccccuccccuccuggagaagcagacagugaccaaagacgucaccgauaagccgcuugaccugagcucuaaggugguugauguggacgccuccaaagcugaucacaugaagaaaauggccccuacaguccucgugcauagccgggcugggucuggacugguccuguccggcagcgaaauucccaaggagacgcucucuccucccgggaacggaugcgccaucuacagaagcgaaauuaucuccaccgcgcccagcucuugggugguuccuggcccgucccccaaugaggaaaacaaugggaaaagcaugucccugaagaacaaggcccuugacugggcuaucccucagcaacgcucuagcuccuguccccggaugggcggaacagaugccgugauuaccaaugucucuggcagcguguccucugcugggagaccugccagcgccucccccgcuccuaacgcgaaugccgacggaacaaaaaccagcagaucuuccguugagacgacaccgagcgugauccagcacgucggccagcccccugcuacccccgccaagcauucuuccagcaccucuuccaaaggggccaaggcuagcaacccugagcccuccuuuaaagccaaugaaaacggacugccgccuagcucuauuuuccucagccccaaugaggcguuucggucucccccuauccccuacccuagaucuuaucugccguaccccgcuccugaaggcauugccgugagcccccugucccuucacgggaagggcccuguguauccccauccgguucuccugccuaacggaucucuguuccccggccaccucgccccuaagcccgggcugccuuacggacuucccacaggccgcccggaguuugucaccuaucaagaugcucuggggcucggaauggugcacccuaugcugaucccccauacacccaucgaaauuacgaaagaggagaagccugaacggagaagccgcucccacgagcgggccagauacgaagacccgacccugcggaaucgcuucucugagauccuugagacaagcuccaccaaacuccaucccgaugugccuacagacaagaaccugaaacccaacccuaauuggaaccagggcaagaccgucgugaaguccgacaaacugguuuauguggaucuccugagagaggaacccgacgcgaagacggauaccaaugucucuaaaccuuccuuugcugccgaaagcguggggcagucugccgagccgcccaagccuuccguugaacccgcccuucagcaacaccgggacuucauugcccugagagaggagcucggccgcaucagcgauuuccacgaaacauacaccuuuaaacagccuguguucacagucuccaaggacucugugcuggcuggaaccaacaaagagaaucugggccuucccguuagcacgccguuucucgaaccuccccugggguccgauggacccgccgugacauucggcaagacccaggaggacccuaagcccuuuugcgucgggagcgcgccuccgucuguggaugugacacccaccuacaccaaagacggagccgaugaagcugaguccaacgacggcaagguccugaaaccuaagcccagcaaacucgccaagcggauugcuaauucugccggguauguuggcgauagauucaagugugugacaacggagcuguacgccgacagcucccagcuuucucgcgaacaaagagcucugcagauggagggacuccaggaagacagcauccugugccugccugcggccuauugugagcgggcuaugaugcgcuuuuccgaacuugagaugaaagagagagaaggcgggcaucccgccaccaaggauucugagaugugcaaauucagcccggccgacugggaacggcucaagggaaaccaggauaaaaagccuaaguccgugacacuggaggaggcuaucgccgaacaaaaugagagcgaacgcugugaguacucugucggcaacaaacacagagaccccuuugaagcgccugaggauaaggaccugcccguggagaaauauuucguugaacggcagccuguguccgagcccccggcugaucaggucgccagcgacaugccucauucccccacccuccgcguggauagaaagcggaaaguuucuggggacagcucccacacagaaaccacggccgaggaagugcccgaggauccucugcuuaaggcuaagcgcagacgggucucuaaaggacugcauccgaagaaacagagacaccuccugcaccuccgcgagcggugggaacaacaggugagcgccgcggacggcaagcccggcagacagucccgcaaagagguuacacaagcuacccagccugaagccauuccccaggggaccaauaucacagaggaaaagccuggacggaaaagagccgaggcuaagggcaaccgcagcuggucugaggaaucccuuaagcccagcgauaaugagcaggggcugccuguguuuucuggaagcccucccaugaaaagccucucuagcaccuccgccggcgggaagaaacaagcucagcccucuugcgcccccgcgagccggccucccgccaagcagcagaaaauuaaggaaaaccaaaagacagacguccugugcgcugacgaggaggaagauugucaggccgcuucccuccugcagaaauacacggacaauagcgagaagccguccggaaaaagacuuugcaagaccaaacaucugaucccucaggaaucucgccggggccucccccugacaggcgaguauuacguggaaaacgccgaugggaaggugaccgucagacgguuccgcaagagacccgagccuagcuccgacuacgaucugucucccgccaaacaagagccuaagccguuugaccggcuucagcagcugcuccccgcuagccaauccacacagcugccuuguucuagcagcccccaggaaaccacgcagagccgcccuaugcccccugaggcgagacggcucauuguuaacaaaaaugccggagaaacccugcuucaaagagcugcccgccugggcuaugaggaaguggugcucuacugccuggagaacaagaucugugaugucaaucaccgggacaacgccggguauugcgcucugcaugaggccugugcgagaggauggcuuaauauugugcgccaucugcuugaauacggcgcugauguuaacugcucugcccaggacgggacacggccgcugcacgaugccguggagaaugaccaccucgaaaucgucagacugcuucuguccuauggagcugaccccacccuggccacauacagcggccgcaccaucaugaaaaugacacacucugagcucauggaaaaguuccugaccgauuaucuuaacgaccugcagggccggaaugaugacgaugcguccgggacgugggacuucuacggaagcucugugugugagccugaugacgaguccggcuacgauguucucgccaaucccccugggcccgaagaccaggaugacgaugacgacgcuuauagcgauguguuugaguucgaauuuuccgagacaccgcugcucccuugcuacaauauucaagucagcguggcccagggacccagaaacuggcugcuucugucugacguccugaagaaacucaagaugagcucccgcaucuucagauguaauuuucccaacguggagauuguuaccaucgcugaagccgaguucuauagacaggugucugcuagccugcucuuuuccugcucuaaagaucuggaagccuucaauccugagagcaaggaacuccuggaccucgucgaguuuaccaacgagauucagacacugcuuggcuccucuguggaauggcugcaucccagcgaucuggcguccgacaacuacugguga

SEQ ID NO: 66404 - RNA, 5136 nt, Artificial Sequence
  derived and/or modified sequence opt5 from BCORL1__Homo_sapiens__NP_068765
augaucagcaccgccccccuguacuccggcgugcacaacuggacaucuagcgacagaauucggaugugcgggaucaaugaggaacgcagagcuccucucuccgaugaggaaucuacgaccggagacugucagcauuucggcagccaagaguuuugcgucuccucuagcuucuccaagguugaacugacagccguggggagcggaucuaacgcgcggggcgcugauccggacggguccgccaccgagaaacuuggacacaagagcgaggauaaacccgacgauccucagcccaagauggacuaugccggcaauguggcugaagccgagggccugcucgucccucugucuucccccggggauggacuuaaacugccugcuagcgacucugccgaagcguccaacagccgcgccgauuguuccuggacaccgcucaauacccagaugucuaagcagguggacugcagccccgcuggcguuaaggcccuggauuccagacaaggggugggagagaaaaacacauuuauucuggcuacccucggcacgggggucccuguggagggaacccugccccuuguuacaaccaauuucagcccucugcccgccccgaucuguccucccgcgccuggcucugccuccgugccccauagcguccccgacgcuuuucaggugccucucucugugccggcccccgucccucacagcggccugguucccgugcagguggcuacauccgucccugcccccucuccgccucuugcccccgugccugcucuggcgcccgccccucccagcguuccgacccucauuuccgacagcaacccucugucuguguccgcuagcguccuggugcccguucccgccucugccccuccguccgggcccgugccucucagcgcucccgccccugcgccccuguccgucccugugucugcucccccgcuugcccugauccaggccccuguccccccuagcgcucccacgcucgugcuggccccgguuccuacacccgugcuugcuccuaugcccgccuccacccccccugcggccccggcucccccuucuguccccaugccuacacccaccccuagcuccggaccgcccagcaccccuacacugauccccgccuucgcuccuacgcccgugccggccccuacccccgcgcccauuuuuacaccugcccccaccccuaugccggcugccacacccgcugccaucccuaccucugcccccauuccugcuuccuucagccucucucggguuugcuuucccgcggcccaagcuccggccaugcagaaggugccucuguccuuccagcccggcacgguccugacaccuagccagccccucguguacaucccucccccgucuugugggcaaccucugagcguggccacccuucccaccacacugggaguuuccagcacccucacacugcccguccuuccuucuuaucugcaggaucgcugccucccgggcgugcuggcuucccccgaacugagaagcuacccuuaugccuuuuccguggcgcggccccucacgucugacagcaaacuggucucccuugaggugaaucgccugccuuguaccucucccagcggguccacaaccacacagccugcuccggauggaguucccggcccucucgccgacaccucucuggugacggccagcgcuaagguccugcccaccccucaaccccuucucccggccccuuccggcagcucugcgcccccccauccugcuaaaaugcccuccgggacagaacagcagaccgagggaacaagcgugaccuucucuccucugaaguccccgccccagcuggaaagagagauggccagcccucccgagugcucugaaaugccucucgaucuguccagcaaguccaaccggcaaaaacuuccccugccgaaucagcgcaagacgccucccaugccuguucucacacccgugcacaccagcucuaaagcccugcugagcacaguccuuuccagaucucagcggaccacccaggcugccggcgggaacgugacaagcugucucggauccacgucuagcccuuuuguuauuuuccccgagaucgugcgcaauggcgacccguccaccugggucaagaacucuacagcucugauuagcaccaucccugggacauacgugggcguggccaaucccguccccgcgucccugcuccugaacaaagauccuaaccuuggacugaauagagacccgcggcaccuccccaagcaagaaccuaucagcauuaucgaucagggcgagcccaaagggaccggagccacgugcggcaagaaggggucucaggcuggagccgaaggccagccuuccacaguuaaaagauauacccccgcucgcauugccccugggcugcccggcugccaaaccaaggagcugagccuuuggaaaccgacaggaccugccaacaucuacccccgguguucugugaauggcaagccuaccuccacacaggugcuccccgucggguggagcccguaccaucaggcuucccugcugucuauuggaaucagcuccgcgggccagcucacgccuagccaaggggcccccaucagacccaccucugugguuuccgaguucagcggagugccuucucugagcuccucugaagcuguccacggccuucccgaggggcagccucgcccgggcggaagcuuugugcccgaacaggacccuguuacaaaaaacaagaccugccggauugccgccaagcccuaugaggaacaagugaauccuguccugcucacacuguccccccagaccggcacgcuggcucuuucugugcagccuagcgggggagauaucagaaugaaccagggcccggaggaguccgaaagccaucucuguucugacuccacccccaaaauggaggggccucaaggagccugcggccugaagcuggcgggggacacaaaacccaagaaucagguucucgcuaccuacaugagccacgaacuggugcuugccacaccucagaaccugcccaaaaugccggagcucccucugcugccccacgauucccaucccaaggagcuuauucuggacgucgugccuucuagccgccggggcuccucuaccgaaagaccccagcucggaagccaaguggaucugggccgcgucaagauggagaaaguugacggggaugugguguucaaucucgccacauguuuucgggcugacggacugccugucgccccgcagagaggccaggcggaagugcgcgcuaaggccgggcaggcccggguuaaacaagaguccgugggagucuucgcuugcaagaacaaauggcagcccgaugacgugaccgaaagccuuccucccaagaagaugaaauguggcaaggagaaagauucugaggaacagcaacugcagccucaggccaaggcuguugugagauccagccaccggcccaaaugccgcaagcucccgucugacccucaggaguccacgaaaaagagccccagaggcgccucugauagcgggaaggaacauaauggaguccggggcaaacacaagcauagaaaaccuacaaagcccgagucccaaucuccggggaaacgcgcggacagccacgaagagggaucccuggagaagaaggccaaaagcuccuuucgggauuucaucccugugguccugucuaccagaacccgcagccaguccggcucuauuuguagcuccuuugcugggauggccgacucugacaugggaagccaggaaguguuccccacagaggaagaggaagagguuacccccacgccugcuaagagacggaaagugcgcaagacacagagagauacccaauaucggucccaccaugcccaggacaaaagccuucugucucagggccgcagacaccucuggcgggcccgcgagaugcccuggagaacagaagcugcgcggcagaugugggauaccaacgaggaagaggaggaagaggaagaggaaggccugcucaagcgcaagaaaagacggagacaaaagucccgcaaauaccagacaggggaguaucugaccgagcaggaagacgagcagcggagaaagggacgcgccgaucuuaaagcucggaagcaaaagacgagcucuucccagagccuggaacauagacuccgcaaucggaaccugcugcuuccuaauaaaguccagggcaucucugacuccccgaacggguuucugcccaacaaucucgaggaaccugccugccuggagaacagcgagaagcccuccggaaaaagaaaguguaaaaccaagcacauggccacagugagcgaagaggcuaaagauguugugcucuacugccugcaaaaggacucugaagaugucaaucaccgcgacaacgccggcuauaccgcgcuucaugaggcuugcagccggggguggacagauauccugaauauucugcucgaacacggagccaacgugaauuguuccgcccaggacggcaccagaccugugcaugaugcuguugucaacgacaaucuggagacgaucuggcuucugcucucuuacggcgccgaccccacacuggcgaccuacagcgggcagacagccaugaagcucgcuuccucugauaccaugaaacgguuccugagcgaccaccuuuccgaucugcagggacgcgccgagggcgacccuggggugucuugggauuuuuauagcuccagcgugcuggaagagaaggacggauucgcuugcgaucuccugcauaacccgcccggcucuuccgaccaagaaggggaugacccuauggaggaggaugacuuuauguucgaacuuagcgacaaaccccugcucccuuguuacaaucugcaggucucuguguccagaggacccugcaacugguuccucuuuagcgauguucugaagcggcuuaaacuguccucucgcauuuuccaggccagauuuccgcacuucgagaucaccacaaugccuaaggcugaauuuuaucggcagguggccagcucccaacugcucacgcccgcggagagacccggcggccuggacgaucgcagcccucccgggucuuccgaaaccgucgagcuugugcgguacgagccugaccugcucagacugcucggaagcgaaguugaguuccagucuuguaauagcuga

SEQ ID NO: 66405 - RNA, 3816 nt, Artificial Sequence
  derived and/or modified sequence opt5 from BCR__Homo_sapiens__NP_004318
augguggaccccgucggcuucgccgaggcuuggaaggcccaguuuccugauagcgaaccgcccagaauggagcugcgguccguuggggacaucgaacaagagcucgaacgcugcaaagcgucuauuagacggcuggagcaggaggugaaccaggaacgcuucagaaugaucuaccuucagacccugcucgcuaaggagaaaaagagcuaugaucggcaacgcuggggauuuagacgggccgcccaggcuccugacggcgccuccgaaccccgcgcuucugccagcagaccucagcccgcgccugccgauggggcugacccgcccccugccgaggagcccgaagcucggccugauggagagggcucccccgggaaagcccgcccgggaacagcgagacggccuggcgccgcugccucuggcgaacgcgacgauagagggcccccugcuagcguggccgcccugcgguccaauuucgagcgcauuagaaagggacacggccagcccggggcugacgcggaaaagcccuuuuacgucaacguggaguuccaucacgagcggggacuuguuaaagugaaugauaaggaagucagcgacagaaucucuucccugggcagccaagccaugcagauggagcgcaaaaagucucagcauggggcuggauccagcgugggcgaugccucucggccuccguauagaggccgcuccagcgaauccucuugugggguugacggagacuacgaggaugccgaacucaacccccgguuucugaaagacaaucugauugaugcuaacggcgggagcagaccucccuggccuccccucgaguaucagccguaccaauccaucuaugugggaggcaugauggagggggaaggaaagggcccucugcuucgcagccagucuacguccgagcaggaaaagcggcugaccuggcccagacgcagcuacucuccucggagcuucgaggacugcggcgggggauacacacccgauuguuccucuaaugaaaaccucaccagcuccgaggaggacuuuagcucuggccaauccagcagagucucuccuucccccacaaccuaucggauguuccgcgauaaaagcagauccccgucucagaauagccagcaguccuuugacucuagcuccccucccacaccccaaugccacaagcggcauagacacuguccugugguggucagcgaagccaccaucguuggggugcgcaaaacgggacagauuuggccgaacgauggcgagggggcguuccacggcgacgcugauggaucuuuuggcacacccccuggguacggaugcgccgccgaccgggcugaggaacagagacgccaucaggacggccugcccuauaucgaugacuccccuagcucuagcccccaccuuuccucuaaggggagaggaagccgggaugcccugguguccggcgcucucgagagcaccaaagccucugaacuggaccuggagaaggggcucgaaaugcgcaaauggguccuguccggcauucuugcgagcgaggaaaccuaccugucccaucucgaggcccugcuucugccuaugaagccccucaaggcugccgcuacaaccucucaaccggugcugacgagccagcagaucgagacaauuuucuucaaaguuccugaacuguaugagauccacaaggaauuuuacgauggacucuuccccagagugcagcaauggucccaccagcagcgggucggcgaccuguuucagaaacuugccucucaacuggggguguaucgcgcguucguugauaauuacggaguggccauggagauggcugaaaaguguugccaggccaacgcucaguuugccgagauuagcgagaaucucagagcccgguccaacaaagacgcuaaggauccuaccacaaagaacucucuggaaacccuucuguacaaacccgucgaccgcgugaccagaagcacacucguccugcaugaucugcucaagcacacgccggcgucccauccugaccacccccugcuucaagaugcccugcggaucagccagaauuuccucucuuccaucaacgaggaaauuaccccucgcagacagagcaugacagugaaaaagggcgagcaucggcagcugcugaaagacucuuuuaugguugaacuuguggagggggcuagaaagcuccgccacgucuuccuguuuaccgaccugcuccuguguacaaaacuuaagaagcaauccggaggcaaaacccagcaguaugauugcaagugguacaucccccugacggaccucagcuuccagaugguggaugagcuggaagccguucccaauauuccucuggugccggacgaggaacuugaugcccucaaaaucaagauuucucaaaucaagaacgacauccagcgggagaaaagagcuaauaagggguccaaagccacagagcgccugaagaaaaagcugagcgaacaggagucccuccugcuucugaugagccccucuauggcguuucggguccacagcagaaacggcaaauccuauaccuuccucauuucuagcgauuacgaacgcgcugaguggcgggaaaauaucagagagcagcaaaagaaguguuuucgcuccuucucucugaccagcguggagcugcagaugcuuacaaacuccugcgugaaacuccagaccguucauucuauuccucugacaaucaauaaggaagacgaugagagccccggacuguauggcuuccucaacgucauugugcacuccgccacgggguuuaaacaaagcucuaaucuguacugcacccuugaaguggacuccuucggauauuuugucaacaaggccaaaacacggguguacagagauaccgcugagccuaauuggaacgaagaguucgagaucgaacuggagggcagccagacacuccggauccuguguuacgaaaagugcuauaauaagaccaaaauucccaaggaggacggggaaucuacggaucgccugaugggaaaaggccagguucagcuugacccucaagcccuccaggacagagauuggcagcggaccgugaucgcgaugaacgggauugaggucaagcuguccgugaaauuuaauagccgcgaguucucccugaagagaaugccgucucggaagcagacaggcguuuuuggagugaaaaucgcugucgugaccaagagagaacgcagcaaaguucccuacauugugcggcaaugugucgaggaaaucgagagacgcggcauggaggaaguggggauuuaucggguguccggagucgccacagacauccaggcccucaaggcugccuucgauguuaacaacaaagacgugagcgugaugaugucugagauggaugucaaugcuaucgccggcacccugaaacuuuacuuuagagaacugccugagccccucuucacggacgaauuuuauccuaacuucgcggaggggauugcccuguccgaucccguggcuaaggagagcugcaugcugaaucuucugcucucucugccggaagccaaccuccugacauuucuuuuccugcucgaccaucugaagcgcguugcugagaaggaagccgugaauaaaaugagccugcacaaccuugccaccgucuucggaccuacacugcuccggcccuccgagaaggaaucuaaacugcccgcuaauccuagccagcccaucaccaugaccgauuccuggucucucgaggugaugagccagguucaagugcugcuuuacuuucugcagcucgaggcgauuccugccccggacuccaagagacagagcauccuguucucuacagaagucuga

SEQ ID NO: 66406 - RNA, 1260 nt, Artificial Sequence
  derived and/or modified sequence opt5 from BCS1L__Homo_sapiens__NP_001073335
augccccugagcgacuucauccucgcccugaaggauaacccuuacuuuggcgcuggguucggacuugugggcgucgggaccgcccuggcgcucgcuagaaaaggaguucagcugggccuuguggccuuucggcgccacuauaugauuacacuggaggugccggccagagaccgguccuacgcuuggcuccugucuuggcugacgcgccauagcaccagaacacaacaccucuccgucgaaaccucuuaucugcagcaugagagcgggcggaucuccacaaaguucgaauuugugcccucuccuggaaaucacuucauuugguaccgcggcaaauggaucagaguugagcggagccgcgaaaugcagaugauugaucuucagaccggcacacccugggaguccgugaccuuuacggcccuggggaccgacagaaaggucuucuuuaacauccucgaggaagcucgggagcuggcccuucaacaggaagagggaaaaacagugauguauaccgcgguuggcagcgaguggcgcccuuucggguaccccagacggcgcagaccucucaauucugugguccugcagcagggacuggccgaucggaucgugagagacgugcaagaauuuauugauaacccgaagugguauacagaccgcggcauccccuaccggagaggguaccugcucuauggaccucccggcugcggcaaguccagcuucauuaccgcucuggccggggagcuugaacauucuaucugucugcucucccugacggauagcucucuuuccgacgaucgccugaaucaccuccugagcgucgcuccucagcagucccugguucuccuggaggacguggaugccgcguuucuuucucgggaccuggccguggaaaaccccgucaaauaccagggacucggcagacugacauucagcgggcuucugaaugcucucgacggaguggccuccaccgaggcucgcauuguuuucaugacaaccaaccacguggaucggcuggacccggcccugaucagaccuggccgcgucgaucucaaggaguaugugggguacugcagccauuggcaacugacccagauguuucagcgguucuaucccggacaagccccuucucuugcugaaaauuuugcggagcacguucugagagccacaaaccagauuucccccgcucaggugcagggcuacuucaugcucuauaaaaaugaccccgucggcgccauccauaacgccgaaagccugcgccgguga

SEQ ID NO: 66407 - RNA, 1032 nt, Artificial Sequence
  derived and/or modified sequence opt5 from BDH1__Homo_sapiens__NP_976059
augcuggccaccagacucagccggccccugucccgccuuccuggcaagacacugucugcuugcgacagagagaacggggcccggcgcccgcuccugcuuggaagcacguccuucauccccauuggcagacggaccuacgcgucugcugccgaaccuguggggagcaaagccguccugguuacaggaugugauuccggcuuuggguucucucucgcuaagcaucugcacagcaaaggauuucugguguucgccggcugccucaugaaggacaaaggccacgauggggugaaggagcuggacucccuuaauagcgaucgccugagaaccguccagcucaacguguguucuuccgaagagguugaaaagguggucgagaucgugcggagcucucugaaagaccccgagaagggaauguggggccuuguuaauaacgcugggauuuccacauuuggagaaguggaguucaccagccuggaaacauauaaacaagucgccgaggugaaucucuggggcaccgugcgcaugacgaagucuuuucugccucugaucagacgggcgaaagggcgcgucguuaacauuuccagcaugcucggaagaauggccaaucccgcucgguccccuuacugcaucaccaaguucggcguggaggccuuuucugauugucugcgcuaugaaauguacccgcuuggcgugaaggucagcgugguugagcccgggaacuucaucgcugccacaucccuguauagcccugaaucuauucaggcgaucgccaaaaagaugugggaggaacuccccgagguggucagaaaagacuacggaaagaaauauuuugaugagaagauugcuaaaauggaaaccuacugcuccagcggcucuacagacaccagcccugugaucgaugccguuacgcaugcucugacagccaccacacccuacacccgguaucacccgauggacuacuauugguggcuuagaaugcagauuaugacccaucugccuggggccaucuccgauaugauuuacauccgcuga

SEQ ID NO: 66408 - RNA, 624 nt, Artificial Sequence
  derived and/or modified sequence opt5 from BDH2__Homo_sapiens__XP_005263197
augggcagacuggacgggaaggugaucauucucaccgccgcugcccagggaaucggccaagcggcugcccuggccuucgcucgggagggggccaaagucauugcuacagauaucaacgaaagcaaacuucaggagcuggaaaaguaccccggcauucagacgcgcguucucgacgugaccaagaaaaagcagaucgaucaauuugccaaugagguggaaagacuggacguccuuuucaacguggcgggauuuguucaccaugggacagugcuggauugcgaggagaaggacugggauuucuccaugaaucucaacguccggucuauguaucugaugaucaaagccuuucugccuaagaugcucgcucagaaaagcggaaauauuaucaacauguccucuguggccagcuccguuaagggcaccguggacacaccgucucugcaggaacgcauucaggcuagaggcaaucccgaggaagcccggaacgauuuccuuaaacgccaaaagaccgggagauuugcgacagccgaggagaucgcuaugcugugugucuaccucgccagcgacgaauccgcuuaugugaccggaaauccugugauuaucgauggcggguggagccuguga

SEQ ID NO: 66409 - RNA, 1062 nt, Artificial Sequence
  derived and/or modified sequence opt5 from BDKRB1__Homo_sapiens__NP_000701
auggccagcuccuggcccccucuggagcuccagucuagcaaccaaucccagcuguucccgcagaaugcuaccgccugcgacaacgcgcccgaggcuugggaucuucugcacagagugcucccuacauuuaucauuucuaucuguuucuuuggccugcuugggaaucuguucguccuccugguuuuucugcucccccggcgccagcugaacguggccgaaauuuaccuugccaaucuggcugccagcgaccucguguucguccugggacuuccuuuuugggcugaaaacaucuggaaucaauucaacuggcccuuuggcgcccugcucugcagagugauuaaugggguuaucaaggcgaaccuguucaucuccauuuuucugguggucgccaucucucaggaucgguaucgcgugcucguucauccuauggcuagcagacggcagcagcgcagacggcaagcccgcgugacguguguccugauuuggguggugggaggccuucuguccaucccgaccuuccuccugagaagcauucaggcuguccccgaccuuaauaucacagccugcauucugcuccugccucacgaggcguggcauuuugcccggaucguugaacugaacauccucggguuccugcuuccccuggcugccauuguguucuuuaauuaccacauccucgcuucucugcgcaccagagaggaggugucccggacacgcuguggaggcagaaaagauagcaagaccacagcccuuauucugacccucgucguggccuuccugguuugcugggcuccuuaucauuucuucgcguuucuggaauuucucuuucaggugcaggccguccggggcuguuucugggaggacuuuaucgaucuggggcuucaacuggcuaacuucuuugccuucaccaauucuucccucaaccccgugauuuacguuuuugugggaagacuguuccgcacgaaagucugggaacuguauaagcagugcacaccgaaaagccuugccccuaucucuuccagccaccggaaggagaucuuccagcucuuuuggagaaacuga

SEQ ID NO: 66410 - RNA, 1176 nt, Artificial Sequence
  derived and/or modified sequence opt5 from BDKRB2__Homo_sapiens__NP_000614
auguucagccccuggaagaucuccauguuucugucugugagagaggacagcgucccuaccacagccuccuucucugcugauaugcucaacguuacgcugcagggcccgacccuuaaugggacauuugcccaaagcaaaugcccccagguggaauggcugggauggcucaacaccauucagccucccuuccugugggugcuuuuuguccuggcgacacucgagaauaucuucgugcuguccguguuuugucugcacaagucuagcugcaccguugcugaaauuuaccucggcaaccuggccgccgcugaccuuauccuggccugugggcucccuuucugggcuauuacaaucuccaauaacuuugauuggcuguucggagagacccuuugccgggucgugaaugccaucauuagcaugaaccuguauucuuccaucuguuuucucaugcugguuagcauugaccgcuaccuggcgcucgugaaaacgaugucuaugggcagaaugcgcgggguccggugggccaagcuguauucccuugugaucuggggaugcacccugcuccugagcucucccaugcuuguguucagaacaaugaaagaauacuccgaugagggccauaaugucaccgcuuguguuauuagcuauccuucccugaucugggagguguuuacaaacaugcuccugaauguggucggcuuccugcucccgcugucugugauuaccuucugcacgaugcagaucaugcaaguucuucggaacaaugaaaugcagaaguuuaaggagauccagacagaacgcagagccaccgugcugguccucgugguucugcuucuguucauuaucuguuggcuccccuuucagauuagcacauuccuggacacccugcaccggcucgggauccuguccagcugccaagaugagcgcauuaucgacgugaucacccagauugcuucuuuuauggccuacuccaacagcugucuuaauccucuggucuaugugaucgucggaaaaagauuccggaagaaaucuugggagguguaccagggcguuugccagaaagggggaugccgcagcgaacccauucaaauggagaacuccaugggcacacucagaacgucuaucagcguggaacggcagauucauaagcugcaggauugggcggggucccgccaauga

SEQ ID NO: 66411 - RNA, 744 nt, Artificial Sequence
  derived and/or modified sequence opt5 from BDNF__Homo_sapiens__NP_001137280
augaccauccuguuccucacaauggugauuagcuacuuuggcugcaugaaggccgcucccaugaaagaggccaacaucagagggcagggaggccuggcguauccugggguccggacgcacggaacccuugaauccguuaauggcccgaaggcugggucucgcggacugacaagccucgccgacaccuucgagcaugugauugaggaacugcuugaugaagaccaaaaagugagacccaacgaggagaauaacaaggaugccgaccuguacacaucccgggucaugcucucuagccaggugccucuggaacccccucugcucuuucugcuugaggaauauaaaaauuaccuggaugcugccaacauguccaugcgcguuagacggcacucugaccccgcucgcagaggcgagcucagcgugugugauuccaucagcgagugggucaccgccgcggacaagaagacagccguggauaugucuggcgggaccguuacggugcuggaaaaagucccuguguccaagggacagcuuaaacaguauuucuacgagaccaagugcaauccgaugggcuauacaaaagaagggugucggggaauugacaagcgccauuggaacagccaaugcagaaccacacagucuuacgugcgggcucugaccauggauuccaagaaacgcaucggcuggagauuuauccggauugacacgagcugugucugcacacucaccaucaagcgcgggagauga

SEQ ID NO: 66412 - RNA, 7875 nt, Artificial Sequence
  derived and/or modified sequence opt5 from BDP1__Homo_sapiens__NP_060899
auguucagacgggcccgccuguccgugaagcccaacgucagaccuggcguuggggcucggggcuccacagccucuaauccgcagcgcggcagagaaucuccccggccucccgauccugccacagauuccgcuuccaaacccgccgaaccuacggacgugccgaccguggauuuugggggagccgaaccccaggaaaaggcuccucgcagcuccacagagaaaaccggcggggacaacgaugucgaagagucuagcagauccagcucuacagugucccagcggcgcaagagaaucagcucuaccuccagccucguuaaaucuuccgugagcguccccuccgagucucacccucugagcacaauuaaucaggaagcgccccagccgaccgcuacguccaccaaggagaagcaaccuugcagcgaccgguaucgcaucuauaaagcccagaaacuuagagaaaugcugaaagaggagcuccggaaggagaagaagcaguggaagaacaaauacgcgauuaaugagucucagagacccccugauagauccaagaugacaaugcgggacuucaucuauuaccugcccgauaacaaucccaugaccagcucucuugaacaagagaaaaagacagaaaaaccuagcaccccggugcagacgagagagcaggagggaaaguccacacccaacgccgaagacaaugagauggaagaggaaaccgaugacggcccucugcucguuccccgcgugaaagucgcugaggauggcucuauuauccuggacgaggaaagccugacaguggaggugcuccggaccaaggggccuugugucguugaagagaacgaccccaucuuugaaagaggauccaccacaacguauagcucuuuccgcaagaauuacuauuccaaaccguggagcaacaaggagaccgauauguuuuuccuggccauuucuauggugggcacagacuuuuccaugaucgggcagcuuuucccucaucgggcuagaauugagaucaaaaauaaguuuaaacgcgaagagaagaccaacggauggcggauugauaaggccuuccaagagaaaagacccuuugacuucgacuuuuucgcgcaucugcuccagaaggugcuggccgaggaggaaaaacgcaagcagaaaagcgucaagaaucacucccuuaaggagaaaaagucuacaaaaccucggaagaacgugaaaguuaagaagguggcuugcgaaggcgucaacaaugaccccgaugagagcauguccucuagaaucagcgacaccgaacgcucccaaaaagaugcccagacgguggaggaggaaagccugacacucucucgggaggacgcugaacagguugcccuggagguggaucugaaccagaagaaaagacggcgcaagaaacaagacggggccaaugaacucggagucaacaaucugcuugagaacgcuaccgugcaggcgggcccuuccaagggcgagaaacacaagaauaagugucaggccauuagacccgaacugaaagagggggaaugcagcaaggagcagaugcucucuuguacccaaaacaucgacggaaucgucggcuucgcuuccacagaaaaaguggagaagcggaccgauccgauucugagccuuucuaaucagcaggacgccacaagcguugccacggaguccagcgaaucuuccaccagcgaucugccuuccuuugagguggggaucagagcucucugcgaagucaacaaugccgagggaucuuguauugaggaacgcaacguggaccugaaaaauaacagccuggagaucgaucagacagaaaauguuaagcccaugcuccggggcagauuccaacgccccaagccuaaccuguccagagcggggaaaaagucugugcuuagccagggaaaaaccgaguccgaaucuaagaacagccauuccaaaacaagcgucgagaagaaucacguggagaaggacaaaaugaacacccuggauauucuccggauggaaacgaccgagcgcgaaaauccggaggcugaaacagugucuguucugggcgagaagaacugccuucaggagggcucccagcugaaagcccucagacccguccaagugcgggggcgccugcagaagccuaaacccaaugccggaaaggcugccgaaagaaaggagauccugaucagccaggaagagauuggcgcuaacguggagaaaaaugagaacgagucuugugccgaccgggauaccccucaacacauggaagaccagucccgcaaggauuuugaggaagaggacgucauccuccagcccgagaaaaaugauagcuuccagaacgugcaaccugacgaacccaagguucugaaugagugccuuucugugcaggaaaacaauaaagcgaacaagcugaaucaggucccgauucucagaacacgguuucagaaaccuaagcccaacaucgggcgcggaaccggcagacgggagauuuccagcaaggaagaggugcuggagaaaauccugguuuccggggaaauggccgcugcccuuagagagacggugcgccucgacacaagcccuaaggaaaugguccccgcugagaucaacaccaaagaaaugcaaucugaucugaaggagacaggccggagagccauuagcccgcgcgagaaaauccuggacgugauugaugacaccaucgaaauggagaccggacucaaggcgaugggccgggaaauuugucugagagagaagacaccugaaguuaucgaugccacggaggagauugacaaagaucuugaagaggcugggcgccgggaaaucagcccccagaagaauggaccugaggaggugaaaccccugggcgaagucgagaccgaccucaaggccacagggaacgaaucuagccccagagagaaaaccccugaagugacagaugcuaccgaggagaucgacaagaaucuggaagagacgggacgccggaagauuuccccgagagaaaacggccccgaggaagugaaaccugucgaugagauggagacagaccugaaugccaccgggcgggaaucuagcccccgcgagaagaccccugaaguuaucgaugccacagaggaaauugaccuugaggagaccgaaagagaggugagcccccaggaaaacggccucgaggaggugaaaccucugggagaaauggagacagaccugaaggcuacgggccgggauucuuucccgcgcgggaaaacccccgaagucaucgacgcgauugaggaaaucgagaucgaucucgaggaaacagagagagaaauuagcccucaggagaauggacuggaagaggugaagccccuuggcgagaugcaaaccgaccugaaggccacagggcgggaaaucuccccuagagagaaaacccccgaaguuauugaugcuacggaggaaaucgacaaggaucucgaggagaccggacgccgggaaauuagcccggaggaaaacggcccugaggaggugaaacccgucgacgaaauggagacagaucugaagaccacagggagagaaggaucuucccgcgagaaaacccgggaagugaucgacgccgccgagguuaucgagacagaucuggaagagaccgaaagagagauuagcccccaggaaaauggaccugaggaggugaagcccgucggcaagauggaaacggaccuuaaagagauccgcgaagagauuucucagcgggaaaaggugcucgcugaguuuuccgccaucagagagaaagaaauugaccugaaggagacagggaaacgcgauaucccuaucauggaaaagguuagcggaaaaauggcgguggucgaggagauggaagcugaccugaaggagaccggcaaggaaaacuucagagagcggggguccgaagagauuugcgugaccgaggaaaaaguggccgagcucaagcaaacaggaaaaaccgauaucucuccgcgcgaaaaugagcuggaagagacgagcacauccagacagaccgacacacaucuuaugcagagcggcucuaacgauuuuuccgccguccccagccuggacauucagaauaucucuagcgagguucucuccaugaugcacaccccuguggaagagaagcggaacucugaaaaagaggugagcucccauuucucucacuuuaagauuagcucccaaacacacgaaagcgauaagaccgagguccaggggauccagucucccgacgugccugagcaguucuccgauauuaaucugagcaaaucccugccccaagaacagaagccgcuugagaucaaaccugcucccuuuguucgcucuagauucaagcggccuaaacccaaccucgccagagcggcucugaagcgcgaaacgaccgagagcgagaaguacaucuacgagaaaaaguccgagaccaaaaagauggaaaccauugugaugcaggagaacaaugaacagacagacacccugccuucucaacaugaugaggccagccucaugaucucccgggagaaagacacgcugggccacagaaacgaagaggccgucauucuucccugcacacagaccgaacgcaaucugagcccgucuaacuccugugagccuaaggaagagagccagucugcucccgugcagaagaaugauuccguugugagcgucggaacaaacaaugugaacaccuuccaacaggagaugaaagaaucugucauccagaccgcccggcaagugagaggccggcuccagcgccccagaccuaauauucggaagacagggcagcgccagaucguugacaaaggagaggcuaagggcaucauuaaagaagggagaacgauccugccgaaggacgagaccgagaaaaaggugcugacagucagcaacucccaaauugagaccgagaucgaagugcccucuagcgccguuccugagcaucggauguaugaaaaucagucccaggugguccuuguggagaaccugcacgugaauaagacaaacgagaccauucgccaugaaaauaaacccuacguuccuagcuccgcgcagaugacgagacggaaguuucaaaaagccaagcccaaccucggacgcgcucacucuaaaaaggaggaaccuguccuggagaaggugacaaccgaucagagcaaagaaggcaagccggaggaccaccuccugcagaaaggcgccuccaauacccagcuucugcucaaggagaaagcugaacugcugacaucucuugaggugagcgccagaaaggauugcgucggguccaaggaaucugcccuggcuaaaaucgacgcggagcucgaagaggugggacccagccggagaguuggcgaggaaaccgugggggauaacuccccuagcucugucguggaggaacaauaucugaacaagcucacauccuguccccagccucugaaugagacgagcuacucuaaaaucgcccuugacggaaagaccacaauuuccagcaccucugaauaugagcgcaaccggggcgagagacgcucccauaaaaaguucaagcccaauguuacacgggggagaggaagcaaacgcgugcggggcaagaccuccaaaaaggaaccgagagcuagcaaagccaugcuggucacgcuccgcgccucucaggaggaagaugacgaugcugacgauuuugagagcgacuacgaggaagaguccuaucaccuggccccugaagaggugaacaaggcgcccguuuucgugcccgucggccugcggucuccugaacccgugagcgcucaaaucgaggagaccauggaagaacuugaaauuacagugaaugucccugauguugggugcaucgccgugguggagcaugaacugccgaacaccgacgucacaaccgaggagaugaaacaggaagagaaucucuccgugcccuuugaaaugacaacgucugagcacauucaggacgaaccuggaaccaacgauggcagcacagaggccgcuaucacccugcucaccaugggggaccugguucuucaguccgagauuucuagcgaacaaggagaugugggcgucuguaucaucccccacgugcauuccaaggacaagagccacauuccuucuucccuggauaauguuaaccauaaaaucgugcacgagugccaggaacugagcucucccgucauuacaacguccccggccagcuucgaggagaauaagaucgugcucgaagaacaguccucuagagaagagauuagccugauggaaaaagucaaggagaacgcgaccccuacacgcaauaccaucuccaaagugacaagcaaccuucggaucagaucucgccuggcuaagcccaagccuaaucucgagaaaacccuggggacgaacagacucgacgauuaccaggaaguuuccagccugugugugacaaagggagccgagauggaaacccaacgggagaccgagaaaaacgccucuaaggcuacagagcuugagaauaaaaaccugggccccgugaccacagccgaaaauaaggaccagagcaagcuggcuugcguccauggcauuaaagggaccuccaucucuagcgagguuaaccucacggaacgcaaugagaaccaggaagaguccucucaggaggugcacaugcugagcguggccccugucgcguccagcgaaacaggacccuguacccuuggccuggauagagggcucggagaaaauucuguggaagaaccgcaaauuaaggacuccaaaggcgauagcguucugacacucccugugcccgaguacacccccacguccaucccugaaguccagcaggagaacauuaucaauccgcaggaccugaccgugaaccuugucgccaaugugccccaagacggggaagaugagcaggcuuuuauccugacacugguugaaauuccugccaacgcuguggaggaguucaccgacgccacagcccaguuuaugcccaauccucuccugcccgcuccuauccuugucaagucugugaacaccgaagaacggggagauaugagcauuugccugcccgcgacauccguuggccaagacgccaugggccucucuaucagcgggagagauaauuccaaaaagccgccugacaaccuggaucucgugagccggaagcgcuuccaguguagacuggacaaaaacgaucacauucccccugcuaagaaacggucucuuacccugcgcgacgauugccaggaauauacgacagagguccauuccaaggaacugaccaauguguuugaggagaccggagaaagccacaaaggccaggacaucuuccucacaucuggguccacccugacaacgcccgagccgcaaagacaacagguggaagccgccuuucagagccggggaucucgcuccccugaugcuugcauggacaagaacguuccccaacuuccccaggacgagaugauugucagcgauaaggaagagagaaccgacgccgcgccuaaaucucagcagauggauagccggacauccagcuccaaggcuucucugagccgccccggcagacggccucucggguuccugucccugaucuguucuaaaaauagccucgaguccgacgaaccgaugcaagugcauucuaagaaacgccuuaagccccugaucccuggacugcgcaaaaagcucaagcggagcaaccccuucaaugagucccaggagaaaaaccgcgagagcucugaucugcuuccuucccccagcgugauuaccacacagucugagaauaucuccagcucugccacccaagucuccugcgaccagccucugcucaaggaaggcuacaaaagcgcccagaagagagcuccgcagggcgaggccacgaccguuucugaauacuuuuucaacgauauuuuuaucgagguggacgaaacagaguga

SEQ ID NO: 66413 - RNA, 627 nt, Artificial Sequence
  derived and/or modified sequence opt5 from BEAN1__Homo_sapiens__NP_001184154
augagauacgccugcagcuccucugaggacuggcccccuccgcuggauaucagcuccgacggcgauguggacgcuaccguccuccgggaacuguaucccgauucuccucccgggguuagccuuucccgccugagauggucugccaugauguacacaggcagcuucacguauugggugcgguccaugcucagccgccacaagcuggacgcgauucuuggaagacugggguacaccgcuacacucgagucugaauuuucccuggugcaggccaucagcaaagagaacgucaagcaaaugguguucaaaauuuuucugguucgggugucuugugaagccguccuccgcaccgcuggaacaagaaugcuggagccuggcaccgagaaacuugcccggacacauucccgccacagcucugaaaagagacuggugaagcccugcuccugucucgaggggguucagccuggaccgggcagcggcgggccccagcagggaccuuccgaaggcguggggucugagaccgcucuggccgagggaacggcgggccaacggagccuucccauggcccuguccccuagcgaagucucuaccgcucccaauucccucccgagcgggucuccugugcuguga

SEQ ID NO: 66414 - RNA, 1782 nt, Artificial Sequence
  derived and/or modified sequence opt5 from BEGAIN__Homo_sapiens__NP_001153003
auggagaagcugagcgcccuccaggaacaaaaaggcgagcugagaaagcggcuuuccuacaccacacacaaacuggaaaagcucgagacggaguucgacucuacccgccauuaucuggagaucgagcuuagacgggcucaggaagaacuggaaaaagugacagagaagcuccgccggauucagagcaacuacauggcccugcagagaaucaaucaagagcuggaagauaagcucuaucgcauggggcagcacuacgaggaagagaaaagagcgcugucccaugaaauugucgcucuuaacucucaucugcucgaggccaagguuaccaucgacaaacugagcgaggauaaugaacuuuaucggaaggacugcaaccuggccgcucagcuccugcaguguucccaaacauacggacgcgugcacaaagugucugagcugcccagcgauuuucaggaaagagucucccuccacauggagaagcacggcugcagccugccuucuccgcuuugucaucccgccuaugcugacuccgugccuaccugcguuauugccaaggugcuggaaaaacccgauccugcgagccucucuucccggcugagcgacgccucugcucgcgaucuugccuucugugacggggucgagaagcccggaccuagaccgcccuacaaaggcgauaucuacugcuccgacacagcucuguauuguccugaggaacggcgcagagaucggagacccagcguggacgccccuguuaccgacgugggguuucuccgcgcgcagaauagcacggauucugccgcugaggaagaggaagaggccgaggcugccgccuuccccgcuggauuucagcacgaagcguucccgagcuacgccggcucccugccuaccuccucuuccuauagcucuuuuagcgcuacauccgaggaaaaggagcaugcccaagccucuacccugacagcuagccagcaggccaucuaccucaacucccgggacgagcuguucgauagaaaacccccugcgaccacguaugaaggcagcccccgcuuugcuaaggccacagccgcugucgccgcuccccuugaggccgaaguggcgccuggguucggacggaccaugucuccguaccccgccgagacauuuagauucccugcuucccccggcccucaacaggcccugaugcccccgaaucucuggagccugcgcgcuaaaccugggaccgcccggcuucccggagaagacaugagaggccaguggcgcccucugucuguggaggauauuggggcguauuccuaccccgucagcgccgcuggacgggccuccccuugcucuuuuagcgagagauacuauggcggcgcugggggaucccccggcaagaaggccgacgggcgcgccucuccgcucuacgcuagcuauaaagcggauuccuucagcgaaggagacgaucugucucagggccaccuggccgagccuuguuuccuccgggcugggggagaccugucccuuagccccggcagaucugccgauccccugccuggcuacgccccguccgaagggggagacggcgaccggcucgggguucaacugugcggaaccgcuagcucucccgagccugaacagggcagccgcgauucccuggagcccagcucuauggaggccuccccugaaaugcaccccgcggcuagacuuagcccucagcaggccuuuccccggacagggggcuccggacucucuagaaaggacagccugacgaaagcccaacuguauggcacccuccugaacuga

SEQ ID NO: 66415 - RNA, 2487 nt, Artificial Sequence
  derived and/or modified sequence opt5 from BEND3__Homo_sapiens__NP_001073919
augaacagcaccgaguucacagaagacguggaggaaguccugaaguccaucacgguuaaaguggagaccgaagccgaggaugcugcccucgacugcucugugaauagcagaacauccgagaagcacucugucgauagcgugcugaccgcgcuucaggacuccucuaaacggaagcaacugguuagcgauggccuccuggacuccgugcccggggucaaacgcagacggcuuauuccugaagcucugcucgccggaaugcgcaacagagagaauagcucuccgugucagggcaacggggaacaggccggacggggccgcucccuggggaauguguggcccggagaggaggaaccuugcaacgaugcuacaacccccagcuacaagaagccucuguauggcaucucucauaaaauuauggagaagaaaaaucccccuuccggcgaccuccugaacguuuacgaacuuuuugagaaggccaaugcuagcaacucuccguccagccugagacuccugaaugaaccccagaaacgggauuguggguccacaggagccggcaccgacaacgauccuaauaucuauuuccuuauucaaaagauguuuuacaugcugaacacgcucaccucuaauaugagccagcugcacuccaagguggaccugcucagccuggaggucucucgcaucaaaaagcaagugucccccacagagaugguggcgaaauuccagccucccccggaauaucagcuuaccgccgcugagcugaagcagaucgucgaucagagccucucugggggagaccuggccugcagacuucugguucagcucuuuccugaacuguucagcgacguggauuuuucccggggcuguucugcuugcggguucgccgcgaaacgcaagcuggagagccuccaucugcaacuuauuagaaacuacguggaagucuauuaccccuccgugaaagacacagccguuuggcaggcugagugucugccucagcucaacgacuuuuucagccgguuuugggcccaacgcgagauggaagacucucagcccuccggacagguggcuagcuucuuugaggccgaacaggucgaucccggccacuuccuggacaauaaggaucaagaggaagcccuuucucuggacagauccagcaccaucgcuuccgaucaugugguugacacgcaggaucucacagaguuccuggacgaggcgucuagcccuggcgaauuugccguguuccugcuccaccggcuguuuccggagcuuuucgaccacagaaagcugggggaacaguacuccugcuauggagauggcgggaaacaggagcucgacccccaacgccugcagauuauccggaacuacaccgagauuuauuuuccugauaugcaggaagaggaggcuuggcugcagcaaugugcccagagaaucaaugacgaacuugaaggacucggccuggaugccgggucugagggagaucccccucgcgaugacugcuacgauagcuccagccugcccgacgauauuucugucgugaaggucgaggacuccuucgaaggcgagcggccgggcagacgcagcaaaaagaucuggcucgugccuaucgauuuugacaaacuggaaauuccccagccugacuucgagguucccggggcugauugucuucugucuaaggaacagcuccgguccaucuaugagagcucucugagcauuggaaacuuugccuccagacugcuugugcaucucuucccugagcuguuuacacacgaaaaucugcgcaagcaauacaacugcagcggcucucucgggaaaaagcagcuggaccccucccggaucaaacuuauuagacauuauguccagcugcucuacccgcgcgcgaagaaugaucggguguggacccuggaguucguuggaaaacuggacgaaagaugccggcgcagagauaccgagcaacggagaagcuaccagcagcagcgcaaggugcacgucccuggccccgaaugucgggaccuuacauccuaugcuaucaaccccgagagauuucgcgaggaguucgaagggccuccgcugcccccugaaagaucuagcaaggauuucugcaaaaucccccucgacgagcugguggugccuucccccgauuuuccuguucccucuccguaccuccugagcgacaaggagguccgggaaauugugcaacagucccuuucugugggcaauuucgccgcccgccugcucgucagacuguuuccugagcuguucacggcugaaaaccuucggcuccaguauaaucacagcggagccuguaacaaaaagcagcuggaucccacccgccugagacucauccggcauuacguggaggcuguuuauccuguggagaaaauggaagaggucuggcacuacgaaugcauucccuccaucgacgagcgcuguagacggccgaaucgcaagaagugcgauauucugaaaaaggccaaaaagguggaaaaauga

SEQ ID NO: 66416 - RNA, 1326 nt, Artificial Sequence
  derived and/or modified sequence opt5 from BEND4__Homo_sapiens__NP_001153019
auggaggaagagaugcagcccgccgaagagggcccuagcgugccgaagaucuacaaacaaagaucccccuauucuguccugaagaccuucccuagcaaacggcccgcucucgccaagcgcuacgaaagaccuacacugguugagcuuccccacgugcgggcgccuccgcccccucccccucccuuugcuccgcaugccgccguguccauuucuagcuccgagccucccccucagcaguuccaggcucaaucuagcuauccucccgggccuggacgcgccgcugccgcggccuccagcagcuccccgagcugcacgcccgcuaccucucagggccaccugagaacacccgcccagcccccucccgcuuccccggccgcgucuucuuccagcuccuuugccgcugucgugcgguacgggccuggagccgcugccgccgcuggcaccgggggaacaggcucugacagcgcgucccucgaacugagcgccgagucucgcaugauccuugaugcuuucgcccagcaauguuccagaguucugagccuccugaacugcggcgggaaacugcucgacucuaaucauagccaguccaugauuucuugugugaagcaggaaggaagcuccuauaacgagcggcaggagcacugccauaucggcaaggggguccacagccaaaccucugauaauguggacauugaaaugcaguacaugcagcgcaaacaacagacauccgccuuucugagaguuuucaccgauagccuucagaacuaucugcucucuggauccuuucccacgccuaaucccagcuccgcuucugaguacggccaccuggccgacguggauccucuuagcaccucccccguccauacacucgggggauggaccucuccggcgacaagcgaaucccacggccauccuucuagcuccacccugcccgaggaagaggaggaagaggacgaagagggcuacuguccccggugccaggaacuggagcaagaggugaucagccugcagcaggaaaacgaggaacuccgcagaaagcuggagucuaucccugugccgugucagacgguccuugauuaucugaaaaugguucuccaacaccacaaucagcugcuuauuccccagccugcugaccagcccacagaaggguccaagcaacugcucaacaauuacccuguguauaucaccagcaaacagugggaugaggccgugaacucuagcaagaaggacggacggcgccugcugagauaccucauucgguucgucuuuacaaccgaugagcugaaauauuccugcggccuugggaagagaaaacgcauccauuga

SEQ ID NO: 66417 - RNA, 1815 nt, Artificial Sequence
  derived and/or modified sequence opt5 from BEST1__Homo_sapiens__NP_001132915
auguucgagaagcugacccucuacugcgacagcuauauccagcugauucccaucuccuuugugcuuggcuucuacgucacacugguugugacgagaugguggaaccaauaugaaaaucucccuuggccggaucggcugaugucucuugugagcggguuugucgagggaaaagacgaacagggccgccugcucagacggacccugauucgcuacgccaaccuggggaaugugcucauccugagauccguuucuacagcuguguauaagcgguuccccagcgcccagcaccuuguccaggcgggauuuaugaccccugcugagcauaaacaacuggaaaagcucucccugccccacaacauguucugggugccuuggguuugguuugccaaucuuucuaugaaagccuggcugggcgggcgcauuagagaucccauccuccugcagagccugcucaacgagaugaauacacugcggacccaguguggacaucuuuacgcuuaugacuggaucuccauuccucugguguacacacaggucgugaccguggccgucuacagcuucuuucucacgugccugguuggccgccaauuccuuaacccggcuaaggccuaucccggccacgagcuggaucucguggugccugucuuuaccuuccugcaguuuuucuucuacgugggguggcugaagguugcggaacagcucaucaaucccuuuggagaggacgaugacgauuucgaaacaaacuggauuguggacagaaaucugcaggucucucuucuggccguggaugagaugcaucaagaccucccucggauggagcccgauauguauuggaacaaaccggaaccucagcccccuuacaccgcugccuccgcucaguuucgcagagccagcuucaugggcucuacauuuaauaucucccugaacaaggaggaaauggaguuccaacccaaucaggaagacgaggaggacgcgcacgccgggauuaucggacgguuucuuggccugcagagccacgaucaucaucccccucgcgcuaacucuagaaccaaacuccuguggccgaagcgggaaucccugcuccacgaggggcugcccaaaaaccacaaggccgcuaagcagaauguuagaggacaagaagacaacaaagccuggaaacuuaaggccguggaugcuuucaagagcgcgccucuguaucagcgccccggcuacuauuccgccccucagacgccccucucuccgacaccuauguuuuucccccuggagccuagcgcucccuccaaacugcacagcgucaccggcauugacacaaaggauaaaucucuuaagaccguguccagcggggccaagaaaucuuuugaacuccugagcgaguccgacggagcccugauggagcauccugaagucucucaggugcggagaaagaccguugaguucaaucucacagauaugcccgaaaucccggagaaccaccugaaagaaccucuugagcaaagccccacgaauauccauaccacacugaaggaccacauggaucccuacugggcucucgagaaccgcuccgugcugcaucugaaucagggccacuguauugcccuuugcccuaccccggcgagccucgcucugucucugcccuuucuccacaacuuccugggguuccaucacugucaguccacacuugaccugcggccugcccucgccuggggaaucuaccuggcuaccuuuacgggcauucuggggaaaugcagcggacccuuccuuacaucuccuugguaucaucccgaagauuuucucggcccuggcgaggggagauga

SEQ ID NO: 66418 - RNA, 1530 nt, Artificial Sequence
  derived and/or modified sequence opt5 from BEST2__Homo_sapiens__XP_005260020
augaccgugacauacacggccagagucgcuaacgcccgguucggcggguuuagccagcugcuccugcuuuggcgcggauccaucuauaagcugcucuggagagagcugcuuugcuuccugggcuuuuacauggcgcucucugcugccuaucgguucguucugaccgaagggcaaaagcgcuacuuugagaagcuggugauuuauugugaccaguacgccagccucauccccguguccuucguccugggauuuuaugugacacuuguugugaauagaugguggucucaguaccugugcaugccucucccggaugcucugaugugugucguggccggcaccguucacgggcgggacgaucgcggaagacuuuaccggcgcacacugaugagauaugcuggccucagcgccgugcugauucugcgguccgucucuaccgcgguguucaaacgcuuucccacaaucgaccauguggucgaagccggcuucaugaccagagaggaacggaagaaauuugagaaccucaauagcuccuacaacaaguauuggguuccuugcgugugguucagcaaucuggcugcccaggcucgcagagaggggcggauuagagauaacucugcccuuaagcugcuccuggaggaacuuaauguguuucgcggaaaauguggcaugcuguuccacuacgacuggaucuccgucccccucguguauacgcaaguugugaccaucgcgcuguacagcuauuuccuggccugccucauugggcggcaguuucuggauccugcucagggauacaaggaccaugaucuugaccuguguguccccaucuucacacuccugcaguuuuucuuuuacgccggcuggcuuaaaguggcugaacaacugauuaacccuuucggggaggaugacgaugacuuugagaccaauuuccucaucgacagaaacuuucagguuucuaugcuggccguggaugaaauguaugacgaucuggccguccucgagaaggaccuguacugggaugcugcggaagcccgcgcuccguauacagccgccaccguguuccagcuucggcagcccuccuuucaaggaagcacguucgacauuacacuggcuaaagaggauaugcaguuucagagacucgacggccuggauggcccuaugggggaagcccccggagacuuccugcaacgccuucucccugcgggcgcugggauggucgccggaggcccccuggggcggagacugucuuuccuccugcgcaaaaauuccugcgugagcgaggccuccaccggagcuucuuguagcugcgccguugugccggagggcgcugccccugaauguuccugcggcgauccccuucuggacccugggcuccccgagcccgaagcgccuccgcccgccggaccugagccccugacacugaucccuggccccgucgaaccguuuagcauugugaccaugccugggccccggggaccugcucccccuuggcuucccucuccgaucggcgaggaggaagagaaccucgccuga

SEQ ID NO: 66419 - RNA, 357 nt, Artificial Sequence
  derived and/or modified sequence opt5 from BET1__Homo_sapiens__NP_005859
augagacgggccggccugggggagggagugcccccuggcaacuacgggaauuauggauacgcuaacagcggcuauuccgccugcgaagaggaaaaugagcgccucaccgaaucucugagaagcaaggucacagcgaucaaaucccuuucuauugagaucgggcacgagguuaagacgcagaacaaacugcucgcugaaauggacagccaauucgauuccaccacaggauuucugggcaagaccaugggcaaacuuaagauucugucucgggggagccagacaaagcuccuguguuacaugaugcuguucucccucuuuguguucuuuaucauuuauuggaucaucaaacugcgcuga

SEQ ID NO: 66420 - RNA, 336 nt, Artificial Sequence
  derived and/or modified sequence opt5 from BET1L__Homo_sapiens__NP_001092257
auggccgacugggcuagagcccagagccccggcgcgguggaggaaauccuggaucgggagaacaagcgcauggcugacucccucgccucuaaagucaccagacuuaagagccuggcccuggauauugaccgggaugcugaagaccaaaaucgcuaccucgaugggauggacuccgauuucacaucuaugacgagccugcuuaccggauccguuaaaagauuuucuacaauggcccggagcggccaggacaaccgcaagcugcucugcgggauggcugugggacugaucguggccuucuuuauucuguccuauuuccucagcagagcgcggaccuga

SEQ ID NO: 66421 - RNA, 378 nt, Artificial Sequence
  derived and/or modified sequence opt5 from BEX1__Homo_sapiens__NP_060946
auggagagcaaggaaaagagagccgugaacucccugucuauggagaaugcuaaccaggaaaaugaggaaaaggagcaagucgccaacaaaggcgagccccucgcgcugccucuugacgcuggggaauacugcguuccgcggggaaaucgcagacgguuccgcgugagacagcccauccugcaguaucggugggauaugaugcaccgccucggcgagccucaggccagaaugcgggaagagaacauggagcgcauuggggaagaggugagacaacugauggaaaaacuucgggagaaacagcugagccauucccuccgcgccgucucuaccgaucccccucaccaugaccaccaugacgaauuuugucugaugcccuga

SEQ ID NO: 66422 - RNA, 483 nt, Artificial Sequence
  derived and/or modified sequence opt5 from BEX2__Homo_sapiens__NP_001161871
augcagaagaugguggucugcggcgccaaauguugcggggacgcuccccacguugagaacagagaagaggaaaccgcccggaucggaccuggcgugauggagagcaaggaggagcgcgcgcugaauaaccucauuguggagaaugucaaccaagaaaaugaugagaaagacgaaaaggaacagguggcuaacaaaggggagccgcuggcccuuccccugaauguuuccgaauacugugugccuagaggaaaccggcgcagauuccggguccgccagcccauccuccaguauagaugggauauuaugcaucggcugggcgagccucaagcccgcaugagagaagagaauauggaacggaucggggaggaggugcgccagcuuauggaaaagcugagagagaagcagcucucucacagccugcgggcuguuuccacagaucccccucaucacgaccaucacgacgaauuuugccugaugccguga

SEQ ID NO: 66423 - RNA, 363 nt, Artificial Sequence
  derived and/or modified sequence opt5 from BEX4__Homo_sapiens__NP_001073894
auggagagcaaggaggaacuggccgcuaacaaucucaacggcgaaaaugcccagcaagagaacgaagggggagagcaggcgcccacccagaaugaggaagaguccagacaccugggcgggggagaaggccagaaaccugggggaaacauccggcgcggcagagugcggcgccuugucccgaauuucagaugggcuauucccaaccggcauaucgagcacaaugaggcccgcgacgauguugaaagauuugugggccaaaugauggagauuaagcggaaaacacgcgaacagcagaugagacauuacaugcgguuccagacgccugagcccgacaaccacuaugauuuuugccugaucccuuga

SEQ ID NO: 66424 - RNA, 1353 nt, Artificial Sequence
  derived and/or modified sequence opt5 from BFAR__Homo_sapiens__NP_057645
auggaggaaccccagaaguccuacgugaacaccauggaccuggagagagaugaaccucucaaauccacaggcccgcaaaucucugucagcgaguucuccugccacuguugcuaugacauucugguuaaucccacgacccuuaacugugggcauucuuuuugccggcacugucuggcccucuggugggcuagcuccaagaaaacagaaugcccugagugucgcgagaagugggaaggauuccccaaagugucuauccugcuuagagaugccauugagaagcuguuuccugacgcgauccggcuccgcuucgaagauauucagcagaauaacgacaucgugcagagccuggcugccuuucaaaaguacggcaaugaucagaucccccuggccccuaacaccgggagagcuaaucagcagaugggaggcggguucuuuuccggaguccucacagcccugaccggcguggcuguugugcuucuggucuaucauuggagcucucgggaguccgagcacgaccuccuggugcauaaagccguugcgaaguggacagccgaagaggugguccuuuggcuggaacaacucggcccgugggcuagccuguaccgcgagagauuccugucugaacgggugaacgggcgccuccugcuuacccugacggaggaggaauuuuccaaaacccccuauacaauugagaauagcucucacagacgggccauccucauggaacuggagcgcgugaaggcucuuggagucaaaccuccccagaaccugugggaauacaaggccguuaauccuggcagaucccucuuccugcuguaugcgcucaagagcagcccccggcugucucuucuguaccucuaccuguuugauuauaccgacacauuccuuccguuuauucacaccaucugcccucugcaggaggauagcuccggggaggacauugugacgaaacuccuggaucugaaggaacccacauggaaacaguggcgcgaguuccucgugaaguacagcuuccugccuuaucaacuuaucgccgaauuugcuugggacuggcuggagguccauuacuggaccucuagauuccucauuaucaacgccaugcugcuguccgugcuugaacucuuuagcuucuggcggaucuggucuagaagcgagcugaaaacaguuccccagcgcauguggucccacuuuuggaaggugucuacccagggacuguucgucgcuauguuuuggccccucauuccucaauucguguguaauugccuguuuuauugggcccuuuacuucaacccgaucauuaauaucgaccugguugugaaagagcuccggagacuggaaacccagguccuguga

SEQ ID NO: 66425 - RNA, 1623 nt, Artificial Sequence
  derived and/or modified sequence opt5 from BFSP1__Homo_sapiens__NP_001155177
auguacgagaacgaaugcgagugucagcugcuccugaaggaaaugcuugagagacugaauaaagaagccgacgaggcucuccugcacaaccuucggcugcaacucgaggcccaguuccugcaggaugacaucagcgcggcuaaggaucgccauaaaaagaaucugcucgaagugcagaccuauauuuccauccugcaacagauuauccacacaacgcccccugccucuauugucaccagcggcaugagagaggaaaaacuucugacagagcgggagguugccgcucuccgcucccagcuggaagaggggagagaagugcuuucucaucugcaggcccaacggguggagcuccaggcucagaccacaacccuggaacaggccaucaagagcgcgcacgagugcuacgacgaugagauccaacuguauaacgaacagauugagacacuccgcaaggaaaucgaggaaaccgagagaguccuggagaaauccucuuacgacugucggcagcuugccguggcucaacagacgcugaagaaugaacucgaucgcuaucauagaauuaucgagauugaaggaaaccggcugaccagcgccuuuaucgagacaccgauuccccuuuucacccagucccacggcguuagccugucuacaggguccggaggcaaagaccucacccgcgcucugcaggauaucacggccgcgaagccuagacaaaaagcccugcccaagaaugugccucggcgcaaggaaaucauuacaaaagacaagaccaacggggcucucgaggaugcuccccugaaaggacuugaggacacaaagcugguccaggugguucucaaagaagagagcgaaucuaaguuugaguccgagagcaaagaagugucuccucugacccaggagggcgccccggaagauguccccgacggcgggcagaucuccaagggauucggcaaacuuuacagaaaggugaaggagaaagugcggagcccuaaggaacccgagaccccuacagagcuguauacgaaagaaagacacguccucguuaccggggacgccaauuacguggauccccgcuuuuacguguccucuauuacagccaagggaggcgucgcugugagcguugcggaggacuccgugcuguaugaugggcaagucgaaccgagcccugagucucccaagccuccccuggaaaacggacaggugggccuccaggagaaagaggacggccagcccaucgaucaacagccuauugacaaggaaaucgagccggauggggccgaacuggagggacccgaagagaaacgggagggcgaagagagagacgaagagucccgccggccuugcgcuaugguuacccccggggccgaggaaccuagcauccccgagccgccuaagcccgccgcugaucaggacggagccgaagugcuuggcacaagaucucgcagccugccugagaaagggcccccuaaggcgcucgcuuacaagaccgucgaaguggucgaguccauugagaaaaucucuacggaaagcauucagacauaugaggaaaccgccgugaucguugagaccaugauuggaaagacaaaauccgauaagaaaaagagcggcgaaaagucuuccuga

SEQ ID NO: 66426 - RNA, 1248 nt, Artificial Sequence
  derived and/or modified sequence opt5 from BFSP2__Homo_sapiens__NP_003562
augagcgagagacggguggucguugaccugcccaccuccgccucuagcuccaugccucuccagcgcagacgggcuucuuuccgcggcccgagaagcuccucuagccuggaauccccucccgccagccggacaaacgcgaugucugggcuugugcgcgcucccggaguguacgucggcacggccccuuccgggugcaucggaggccugggggccagagugacccggcgcgcucucggaauuagcucuguuuuucugcaaggccuuagauccagcggccuggccacagugcccgcuccugggcucgagcgggaucacggagccgucgaagaccugggcgggugucugguggaguauauggcgaagguucaugcccucgaacaggugucucaggagcuggagacccagcuucgcaugcaccuggaauccaaagcuacaagaagcggaaauuggggcgcccuccgggcuuccugggccucuagcugccaacaggucggggaggcggugcuggaaaacgcccgccuuaugcugcagaccgagacaauccaggcuggagccgaugacuucaaggagagauacgaaaaugagcaaccguuucggaaagcugccgaagaggaaauuaacucccucuauaaggugaucgaugaggccaaucugaccaaaauggaccuggagagccagauugaaucucucaaggaggaacugggcucccuuagcagaaacuacgaggaagaugucaagcugcuccauaaacagcuggcuggcugugagcuugagcagauggacgcgcccaucgggacgggacuggaugacauccucgaaaccauucgcauccaaugggagcgggauguugaaaagaauagaguggaggccggcgcucugcugcaggccaaacagcaagccgaaguggcucacaugucucagacacaggaggagaagcucgccgcggcucugcgcgucgaacuucauaacaccagcugccaggugcaaucccugcaggccgagacagaaucucuccgggcccugaaaagagggcuugagaauacccugcacgacgcuaagcacuggcaugauauggagcuccagaaccugggagccguugugggccgccuggaagcugagcuccgggaaauuagagccgaggcggaacagcaacagcaggagcgcgcccaucugcuugcucggaagugucagcugcaaaaagacgucgccagcuaucacgcucuccuggacagagaggaauccggguga

SEQ ID NO: 66427 - RNA, 303 nt, Artificial Sequence
  derived and/or modified sequence opt5 from BGLAP__Homo_sapiens__NP_954642
augagagcccugacccuccuggcccuucuggcucucgcggcucugugcaucgccggccaggccggggcuaagcccagcggagccgaguccucuaaaggcgcugccuucgugagcaagcaagaaggguccgaggucguuaaacggccucgcagauaccuuuaucaguggcugggagcgccggugcccuacccugacccccucgaaccucggcgcgaggugugugaacugaaccccgauugcgacgagcuggccgaucacauuggcuuucaggaggcuuauagacgguucuacgggccugucuga

SEQ ID NO: 66428 - RNA, 1107 nt, Artificial Sequence
  derived and/or modified sequence opt5 from BGN__Homo_sapiens__NP_001702
auguggccccuguggagacucgugagccugcuugcccugucccaggcucucccuuucgagcaacggggcuuuugggacuucacccuggaugacgggccguuuaugaugaacgaugaagaggccucuggagcggacacaagcggcguccuugaucccgacuccguuacgccuaccuacucugcuaugugccccuucgggugucacugccaucugcgcguggugcaguguagcgaucucggacugaaguccgucccuaaagaaaucucucccgacacaacccugcucgaucugcagaauaacgacauuagcgagcuuagaaaggaugacuuuaaaggccugcagcaccucuaugcccuggugcuuguuaauaacaagaucuccaaaauucaugaaaaggccuucagcccucugcggaagcuccaaaaacuguacaucucuaagaaucaccugguggagauuccgcccaaccucccuuccagccuggucgagcuucgcauccaugauaauagaauccggaaagugcccaaggggguguuuucuggacugcgcaacaugaauugcauugaaaugggcggcaacccucucgaaaauuccggguucgagcccggagcuuuugacggccugaaacuuaacuaucugagaaucagcgaggccaagcucacagggauuccgaaggaccugccugagacccugaaugaacuccaccuggaucacaacaaaauccaggcuauugagcuugaagaccugcuccgguacucuaagcuguaucgccuuggacugggccauaaucagaucagaaugauugagaacgggucccucagcuuccugcccacacugcgggaacuccaccuggauaacaauaaacuugcccgcguuccuuccggacugcccgaccucaagcugcugcaggucguguaccuucauucuaacaauaucaccaaagugggcgucaacgauuuuugucccaugggcuucgggguuaagagagcguauuacaauggaaucagccucuuuaacaauccugugccguacugggaggugcaacccgccacguuccggugcgucaccgaccgccuggcuauucaguucggcaacuauaaaaaguga

SEQ ID NO: 66429 - RNA, 570 nt, Artificial Sequence
  derived and/or modified sequence opt5 from BHLHA15__Homo_sapiens__NP_803238
augaagaccaaaaacagacccccucggcgcagagccccggugcaggacacagaggcuacgcccggcgaagggaccccugauggaagccugcccaauccuggccccgagccugccaaggggcuccggucccgcccggcgagagcugccgcccgggcucccggagaaggccgcagacggcgcccugggcccucuggaccuggcggcagacgggacagcuccauccaacgcagacuggagucuaacgaacgggagcgccagagaaugcacaaacuuaauaacgccuuccaggcucugcgggaggucauuccccauguuagagccgauaagaaacucagcaagaucgaaacacugacccuugcgaagaauuacauuaaaucccugacagccaccauccucacaaugucuagcucccgccugccggggcuggagggaccuggccccaagcucuaucagcacuaccaacagcagcagcaaguggcugggggagcccugggcgcuaccgaagcccagccucaggggcaucuucagcgguauagcacgcaaauucacucuuuuagagagggaaccuga

SEQ ID NO: 66430 - RNA, 708 nt, Artificial Sequence
  derived and/or modified sequence opt5 from BHLHA9__Homo_sapiens__NP_001157877
augcugagaggcgcccccgggcucggacugaccgcucggaagggcgccgaggacagcgcggaagaucuugggggaccuugcccggagcccggcggggacuccggagugcugggcgcuaacggcgccucuuguagccgcggggaagccgaggaaccugcuggaagacggcgcgccagacccguccgguccaaagcucgcagaauggccgcgaauguucgggagcgcaagagaauccucgauuacaacgaggccuucaaugcucugcggcgcgcccuuagacacgaccugggcgggaaacggcucucuaagauugcuacacugcgcagagccauccaucggauugcggcccugagccucgugcugagagcuuccccugcuccccgcggaccuugcggccaccuugaaugucaugggccggccgcccggggagauacgggcgacaccggcgccucucccccucccccugcugggcccagccuggcgagaccggaugccgcucgcccuuccgugcccagcgccccucggugcgccucuuguccuccccacgcuccccucgccagaccguccgcggucgcugagggacccggccuggcccaggccagcgggggaucuuggcgccggugcccuggcgcuuccagcgccgggcccccucccuggccgagaggauaucuucgcucugcuccuggcaugggccauccccgguccuga

SEQ ID NO: 66431 - RNA, 1644 nt, Artificial Sequence
  derived and/or modified sequence opt5 from BHLHB9__Homo_sapiens__NP_001135999
auggccggcaccaagaacaaaacaagagcucaggccaagacggagaaaaaggcggcuauccaagccaaagccggggcugaacgggaggccaccggagugguccgccccguugcuaagacaagagccaaggcgaaagccaagaccggcagcaaaacagacgcuguggccgaaaugaaggcuguguccaaaaauaaggucguggccgagaccaaggaaggggcgcugucugagccuaaaacacucggaaaggccaugggcgauuucaccccgaaagcugggaacgagagcacguccucuaccugcaagaaugaagccggaacagacgcuugguuuugggccggcgaggaagccaccauuaacagcugguucuggaauggcgaggaggcugggaacuccuuuucuacaaagaaugauaagcccgaaaucggagcgcagguuugugccgaggaacuggagccugcugccggcgccgacugcaaaccccggagcggggcugaagaggaggaagaggaaaacgugauuggaaauugguucugggagggcgaugacaccuccuuugauccuaaccccaagccugucagccgcaucgugaagccgcagcccguuuacgaaauuaaugagaaaaacagaccuaaggacuggucugaggugacgaucuggcccaaugccccugcggucacacccgcugugcuuggguuccggucccaggccccgagcgaagccucuccucccuccuauaucgugcuggcuagcgccgaggaaaacgcuuguucucucccugucgccaccgcgugccgccccuccagaaauacacggagcuguucccaacccauuccugagugccgcuuugauucugacccguguauccagaccauugaugaaaucagacggcagauucgcaucagagagguuaacggaauuaaacccuucgccugcccuuguaagauggagugcuacauggacagcgaagaguuugaaaaacuggugucccuucugaaaagcaccacagauccccucauccacaagaucgcucggauugccaugggcgugcauaacguccacccuuucgcucaggaguuuaucaaugaggugggcguugugacgcugauugaaucucugcucuccuuccccagcccggagaugcgcaaaaagaccgucaucacacugaacccucccucuggggacgaaagacaacggaaaauugagcuucaugugaagcacauguguaaagaaaccaugagcuuuccucucaauucccccggacagcagucuggccugaagauccuggggcagcuuacaaccgacuucguucaucacuauaucguggccaacuacuucagcgagcuguuucaccuccuguccagcggaaauugcaagacgagaaaccugguccucaaacugcuucugaauaugucugagaacccuacagcggcccgcgauaugauuaauaugaaggcucucgccgcucugaaacuuaucuucaaccaaaaggaagccaaagccaaucugguguccggcgucgcuauuuuuaucaacauuaaggagcauauccggaaggggagcaucgugguuguggaccaccucucuuauaauacccugauggcgauuuucagagaagucaaagagaucauugaaaccauguga

SEQ ID NO: 66432 - RNA, 1146 nt, Artificial Sequence
  derived and/or modified sequence opt5 from BHLHE22__Homo_sapiens__NP_689627
auggagagaggcaugcaccugggggccgcugccgcgggagaagacgaucucuuccugcauaagagccuuuccgcuucuaccagcaaacggcuggaggccgccuuucgcuccacacccccuggcauggaccucucucuggcuccgcccccuagagaacggcccgccagcuccucuagcuccccucuugggugcuucgagcccgcugauccugaaggagccggccugcuccugccgcccccugggggaggcggcgggggaagcgcgggcucugggggaggcgggggaggcggcguggggguccccggacugcucguuggcuccgccggggugggaggcgacccuagccugucuucccuucccgcuggggccgcucugugucucaaguacggagagagcgccucucgcggcuccguggcggagagcuccggcggggaacagucuccggaugacgauagcgacggaagaugcgagcugguccuucgggccggcguggcugauccucgcgccucccccggggcuggaggcgggggcgccaaagccgcugaaggauguagcaacgcgcaucugcacggcggggccucuguuccucccggaggccucgggggaggcgggggcggaggcuccagcucugggagcuccggaggcgggggaggcucugggagcggcuccggaggcagcagcuccucuucuuccagcuccucuaagaaaagcaaggagcaaaaggcucugagacugaauaucaacgcccgggagcgcagacggaugcacgaccucaaugaugcccuggacgaacuucgcgcugugauucccuaugcccauuccccuucugucagaaaacugagcaagaucgcgacgcuccugcuugcuaaaaacuacauucugaugcaggcccaggcccucgaggaaaugcggcgccugguggcuuaucugaaucaggggcaagccaucuccgcugccagccucccgucuuccgcggccgcugccgcugccgcggccgcucugcaccccgcccuuggagcuuacgagcaggccgccggcuauccuuuuagcgcugggcugcccccugcggccucuugccccgaaaagugugcucucuucaacuccguuagcucuagccugugcaaacaguguaccgagaagccguga

SEQ ID NO: 66433 - RNA, 726 nt, Artificial Sequence
  derived and/or modified sequence opt5 from BHLHE23__Homo_sapiens__NP_542173
augagcaucagacccccuggcgagccgcccuccccugggggagccgcuauggccgaacugaagucucucagcggcgacgcguaccuggcucuuucccacggguaugccgccgcugccgcuggacuggccuacggcgcggcccgggagcccgaagcugcccgcggguauggaaccccuggccccggcggggaucucccugcugccccggcgcccagagccccugcucaggccgcugagucuagcggagaacaauccggcgacgaggaugacgccuucgagcagcggcgcagacggcgcgggcccggaucugccgcugauggcagacggcgcccuagagaacagcggagccugcgccuuuccauuaacgcgagagagcggcgcagaaugcaugaccugaaugaugcccucgacgggcugcgggcugugauccccuacgcccacagcccgucugucagaaaacuguccaagauugccacacuccugcuugcuaaaaacuauauccugaugcaggcccaagcgcucgaugaaaugcgccggcugguugcuuuucuuaaucagggacagggccuggccgccccugugaacgcugcuccccucacgccuuucggccaggccaccgugugccccuuuagcgccggggcggcccugggacccuguccugacaagugcgcugccuucucuggcacaccguccgcucuguguaaacauugccacgagaagcccuga

SEQ ID NO: 66434 - RNA, 1239 nt, Artificial Sequence
  derived and/or modified sequence opt5 from BHLHE40__Homo_sapiens__NP_003661
auggagagaauccccagcgcccagccuccgcccgcuugccugccuaaggcccccggccucgaacacggggaccugccuggaauguaccccgcgcauauguaucaaguguacaaaucccggcgcggcauuaagagaucugaggauagcaaagaaaccuauaaacuuccucaccggcugaucgagaaaaagcgcagagaccggauuaacgaauguaucgcucagcucaaggaucugcuuccggagcaucugaaacucacaacgcuggggcaccuggagaaggccgucguucucgaacugacccuuaaacaugugaaggcccugacaaaucucauugaccagcagcaacagaaaaucaucgcucugcaguccggacuucaggccggcgagcugucugggcgcaacguggaaaccggacaagagauguucugcagcggcuuucagacaugugcuagagagguccuccaguaccuggccaagcacgaaaauacccgggaucugaaguccucucagcucgugacacaucugcaccgcguugugagcgagcuucugcaaggcgggaccuccagaaaacccagcgacccugcgcccaaggucauggauuucaaagaaaagccuucuucccccgccaaaggaagcgagggcccggggaagaacugcgugccuguuauucagcggacguuugcucacucuuccggagaacagagcggcucugacaccgauacagacuccggguauggaggcgagagcgagaaaggcgaucuccgcuccgaacaacccuguuucaagucugaccaugggagacgguuuaccaugggagagcgcaucggcgccauuaagcaggaaagcgaggaaccucccacaaagaagaauagaaugcagcuguccgaugacgaggggcacuucaccagcucugaccuuaucuccagccccuuucugggaccucacccgcaucagcccccuuucugccuccccuuuuaccugauuccucccucugcuacggccuaucugccgaugcucgagaaauguugguacccuacaagcgugcccguccuguacccuggccuuaacgcguccgccgcugcccugucuagcuucaugaaucccgauaagaucuccgcuccucuccugaugccccaacggcuuccgagcccucugcccgcccaccccucuguggacuccagcgugcuccugcaggcccugaaaccuauuccgccccucaaccuggaaaccaaggauuga

SEQ ID NO: 66435 - RNA, 1449 nt, Artificial Sequence
  derived and/or modified sequence opt5 from BHLHE41__Homo_sapiens__NP_110389
auggacgagggcaucccccaucugcaggaaagacaacuccuggagcaccgggauuucauugggcuugacuacagcucccuguauaugugcaagccuaaacgcucuaugaagagagaugacaccaaagauacauacaagcucccgcaccggcugaucgagaaaaagcgcagagaccggauuaacgaauguaucgcccagcuuaaggaucugcuccccgaacaccugaaacugacgacccucggacaccuggagaaggcugugguccuugagcugacacucaaacaucugaaggcccuuaccgcgcugacagaacagcagcaccagaaaauuaucgcucuccaaaauggcgagcgcagccugaaguccccuauccagucugaccuggaugccuuucacagcggguuccagaccugcgccaaggaaguucuccaauaucuguccagauuugagucuuggacaccccgggagccucgcugugugcagcuuauuaaccaucugcacgcuguggccacccaguuccuccccacgccucagcugcuuacccaacaggucccgcugagcaaaggaacaggcgcucccuccgccgcggggagcgccgcugccccuugccucgaaagagcuggacagaagcuggagccccuggccuacugugugccuguuauccaacggacccagcccucugcggaacucgccgcugagaaugacacagauaccgacuccggcuauggcggggaagccgaggcucgcccggauagagagaaaggaaagggcgccggggccagccgggugacgauuaaacaggaaccucccggagaggacucuccugcucccaagcgcaugaaacuggacuccagaggcgggggaagcggcggcgggcccggaggcggggcggccgcugccgccgcugcccuucugggaccugauccggcggcugccgccgcucuccugcggcccgacgccgcccuucugucuucccucgucgccuuuggcgggggaggcggcgcgccuuucccccagccugccgcugccgcugcccccuuuugccugccguucuguuuucugagcccuuccgcggccgcugccuacgugcaacccuuccucgauaagucugggcuggaaaaguaucuuuacccugcugccgccgcugcgcccuuuccucugcucuaccccggaaucccggccccugcugccgccgcugccgcggcugccgccgcugccgcggcugccgccgcuuuccccugccugagcuccguucugucucccccuccggagaaagccggcgcugccgcggccacacuucucccccaugaaguggcuccucugggggcuccccacccucagcacccccauggaagaacccaucugccuuuugcuggcccccgcgagccggggaacccugagagcuccgcccaggaagaccccagccagccuggcaaggaggcccccuga

SEQ ID NO: 66436 - RNA, 900 nt, Artificial Sequence
  derived and/or modified sequence opt5 from BHMT2__Homo_sapiens__NP_001171476
auggcccccgcuggcagaccuggggccaagaaaggaauccuggagcggcucgaaagcggcgagguggucauuggggacggauccuuccugaucacccuugaaaagcgcggcuacguuaaagcggggcuguggacaccggaggcugugauugaacaccccgaugccgugagacagcuccauauggaguuucugcgggccggaucuaacgucaugcaaacguucaccuuuagcgcuuccgaggacaauauggaaucuaaguauuucgagcacguggaagaggccguuugggcuguggagguccuuaaagaaagcgaucgcccuguggccguuacaaugugcaucggccccgagggcgacaugcaugauauuaccccuggggaaugugcggugagacuggucaaggccggagcuuccaucgugggcgugaacugccgguuugggcccgacacaucucucaagaccauggagcugaugaaagaaggacuggagugggccggccucaaggcucaccugaugguccagccucuuggguuccaugccccggauuguggaaaagagggcuuuguugaccugcccgaauacccuuucggccucgagagccgcguggcgacaagaugggauauccagaaguaugcccgggaggcuuacaaucugggggugcgcuauauuggaggcugcuguggguuugagcccuaccacaucagagccauugcugaagaacuugccccugagcggggauuccugcccccggccuccgaaaaacacggcagcugggggucuggacucgacaugcauaccaagccuuggauccgcgcuagagcgcggcgcgaguauugggaaaaccugcugcccgccuccggcagaccuuuuugccccagccucucuaagcccgauuucuga

SEQ ID NO: 66437 - RNA, 1221 nt, Artificial Sequence
  derived and/or modified sequence opt5 from BHMT__Homo_sapiens__NP_001704
augcccccugugggcgggaagaaagccaagaaaggaauccuggagagacucaacgcuggcgaaauugucaucggggacggaggcuucguuuuugcccuggagaagcggggguacgugaaagcgggaccguggacccccgaagcugccguggagcacccugaagccguccgccagcuucauagagaguuccugcgggcuggcagcaaugugaugcaaacauuuacguucuaugccuccgaggauaagcucgaaaaccgcggcaauuacguucuggagaagauuucugggcaggaagugaacgaggcugccugcgacaucgcgagacaggucgccgaugagggagacgcucuuguggccggcgggguuagccagacccccuccuaucugucuuguaaaagcgaaacagaggugaagaaagucuuucuccaacagcuggaaguguucaugaagaaaaauguggauuuucugauugcugaguacuucgaacacgucgaggaggccguuugggcgguggaaacccucaucgccuccggaaagccuguggcugccacaaugugcaucggccccgagggggaccugcauggagucccuccgggcgaaugugcugugcggcuuguuaaggccggcgccucuauuaucggggugaacugccacuuugaucccaccauuagccugaaaacagucaagcucaugaaagagggacuggaagcugcgcgccuuaaggcccaucugaugucccagccucucgcuuaucacacccccgacuguaauaaacagggcuucaucgaucugccugaguuucccuucgggcuggagccgagaguggccacgcggugggacauucaaaaguacgcccgcgaggcuuauaaccucggaguuagauacaucggcgggugcuguggauuugagccuuaccacauucgggccaucgcggaagaacuggcucccgaacgcggcuuccuuccucccgccagcgagaaacauggcucuuggggguccggacuggauaugcacaccaagcccugggugagagcccgggcucgcaaggaguauugggaaaaucucagaaucgccagcggccggccuuacaacccgucuauguccaaacccgacggguggggagucacaaagggcaccgcugagcugaugcagcagaaagaagccacaaccgagcagcaacuuaaggagcuguucgaaaaacagaaguuuaagagccaguga

SEQ ID NO: 66438 - RNA, 2925 nt, Artificial Sequence
  derived and/or modified sequence opt5 from BICC1__Homo_sapiens__NP_001073981
auggccgcucagggcgagcccggguaccuggccgcgcaaagcgacccuggauccaacucugaaagaagcaccgauuccccggugcccggcucugaggacgaucucgucgcuggggccacacugcacagcccugaaugguccgaggaacgguuccgcguugacagaaagaaacuugaggccaugcugcaggcugccgcugagggaaagggccggucuggggaagacuuuuuccagaaaaucauggaggaaacgaauacccagauugccuggcccagcaagcucaaaaucggagcgaaguccaagaaagauccucauauuaaggugagcggcaaaaaggaggaugugaaagaggccaaggaaaugaucaugucuguccuggacacaaaguccaaccgcgugacccuuaaaauggauguuagccacacagagcauucucacgugauuggcaaagggggaaauaacaucaaaaaggucauggaagagaccggcugccauauccacuuucccgacuccaauagaaacaaucaagcugaaaaauccaaccaggugucuauugccgggcagccugcuggaguugaguccgcccgggugcgcaucagagagcugcucccgcugguccugauguucgaacuccccauugcgggcauccugcagccugugcccgauccuaauagccccuccauucaacacaucucucagacauauaacauuagcguguccuuuaagcagcggagccgcauguacggggccaccgucaucguuagaggaucucagaauaacacguccgcugugaaagagggcaccgccaugcuucuggaacaucucgcuggcagccuggccucugccaucccggugagcacacaacuugacauugcugcgcagcaccaucuguucaugauggggcggaauggauccaacaucaagcacauuaugcagcgcaccggcgcccaaauccacuuuccugaucccucuaauccucagaagaaaagcacagucuaucuccaggggaccauugaguccgugugucuggcuagacaguaccugaugggaugccucccccugguucuuauguucgacaugaaggaagagaucgagguggacccccaauuuaucgcccagcugauggaacagcucgaugucuucauuagcaucaaaccuaagccgaaacagcccucuaaguccgugauuguuaagagcguggagcggaacgcccugaacauguaugaagcucgcaaaugucuucugggccucgagucuuccggggucacgaucgccacaagcccuucccccgcgucuugcccugcuggacuggccugucccagccuggacauucucgccuccgcuggccugggccuuaccgggcugggacuccugggcccgacaacccuuucucugaauaccagcacaacgccuaacucccuccugaaugcccugaacagcucugugagcccccuccaaagcccuucuuccgggacccccagcccuacacugugggcucccccgcuugccaauaccucuagcgcgacaggauuuuccgccaucccucaucugaugauccccagcaccgcucaggccacgcucacaaacauucugcugucuggcguccccaccuacgggcacaccgcuccuuccccgcccccuggccuuacacccguggauguucauaucaauagcaugcagaccgaaggaaagaaaauuuccgccgcgcucaacggccacgcccagucuccugacaucaaguauggggcuauuagcacauccucucugggagagaaagugcugagcgccaaucauggcgaucccuccauccaaacgucugggagcgagcagaccuccccuaagagcucucccacagaaggaugcaacgacgcuuucgucgaggugggcaugccgagauccccuagccacucugggaaugccggcgaucucaagcagaugaugugucccuccaaaguuagcugcgccaagcggcagaccguggaacugcuucaaggaacaaagaacucucaucugcacuccaccgacagacuccugagcgauccugagcuguccgcuacggagagcccccuugcggacaagaaagccccgggcucugaacgcgcugccgagcgggccgcugccgcgcagcagaauagcgaaagagcucaccucgccccucgcuccucuuacgucaacaugcaagccuuugauuacgagcagaagaagcugcuggcuaccaaagccaugcucaagaaacccguggugacagaaguucggaccccuacaaauaccuggagcgggcugggauucuccaagucuaugcccgcggagacgauuaaagagcuuagacgcgcuaaccaugucagcuauaagcccacaaugaccacaaccuacgaaggcuccucuaugagccugucccggagcaacucuagagagcaccucgggggaggcuccgaaagcgacaauuggcgcgaccggaacgggaucggcccuggaucucacuccgaguucgccgccagcaucggcuccccgaaaagaaagcagaauaagucuaccgaacauuaucugagcuccagcaacuacauggauuguauuucuucccugacagggagcaauggaugcaaccuuaauucuagcuuuaaaggcuccgaccuccccgagcuguucucuaagcuggggcucggaaaauauacggauguguuucagcaacaggagaucgaccugcagaccuuccuuacacugaccgaucaggaccucaaggaacugggcauuacaaccuuuggggcucgccggaaaaugcugcuugccaucagcgagcucaacaagaauagacggaagcuguucgaauccccuaacgcucgcacgucuuuucuggagggcggagccagcggcagacucccccggcaauaccacuccgauauugcgagcgugucugggagaugguga

SEQ ID NO: 66439 - RNA, 2508 nt, Artificial Sequence
  derived and/or modified sequence opt5 from BICD1__Homo_sapiens__NP_001003398
auggccgcugaggaagugcugcagaccgucgaccacuacaagacagagaucgaaagacucacgaaagagcugaccgaaacaacccaugagaagauucaagccgcggaguauggccuuguugugcuggaagagaaacucacacugaagcagcaguacgaugaacuugaggcugaguaugacagccugaaacaggaacucgagcaacugaaggaagccuucgggcaguccuuuucuauccaccggaagguggccgaggauggagaaacccgcgaggagacacugcuccaggaaagcgcuuccaaagaggccuacuaucugggcaagauucuugaaaugcagaacgagcugaaacaaucuagagcugucgugaccaauguucaggccgaaaacgagcggcucacggcggugguccaggaccugaaggagaauaacgaaaugguggagcuucagcgcaucagaaugaaagaugaaauucgggaguacaaguuccgcgaagccagacugcuccaagacuauaccgagcuggaggaagagaauaucacacugcagaagcucguuagcacccugaaacagaaccaaguggaauacgaggggcuuaagcaugagaucaaacgguuugaagaggaaacaguccugcucaauucccagcuggaggaugcuauucgccuuaaggaaaucgccgagcaccagcuggaggaagcucucgagacccugaaaaacgaaagagagcagaagaauaaccugcggaaagaacucucucaauacauuagccugaaugacaaccauaucuccauuagcguggauggacuuaaguucgccgaggacggcucugagcccaauaacgaugacaagaugaaugggcacauccacggaccucuggugaaacucaacggcgauuaucgcacgccgacacugagaaagggcgaaucccuuaaccccgucagcgaccuguuuucugagcucaauauuuccgaaauccagaaacugaagcagcagcugaugcaaguugagcgggaaaaagcgauccuccuggccaaccuucaggagagccagacccagcuggagcauacaaagggggcucucaccgaacaacacgagcgcgugcauagacugaccgaacacgugaaugccaugcggggacugcagucuuccaaggagcuuaaagcugagcucgacggcgaaaaggggagagauagcggagaggaagcccacgacuacgaggucgauauuaacggccuggaaauccuggagugcaaauaucgcguggccguuacagaggugauugaccucaaggcugaaaucaaagcgcugaaggagaaguacaauaaauccgucgaaaacuauacggaugagaaggccaaauacgaaucuaagauucagauguaugacgaacaggugaccagccuugagaaaacaaccaaggaauccggggagaagauggcucauauggaaaaagagcugcaaaagaugacaagcaucgccaaugaaaaccacucuacccucaauacggcccaggaugagcugguuacauucuccgaggaacuggcucagcuuuaccaucacgugugucucugcaacaaugagaccccuaaccgggucaugcuggacuacuauagacaaagccgcgugacccggucuggaagccugaaaggccccgaugacccuagaggccuccugucuccccgccuugcccggagaggggucuccagcccuguggaaacacgcaccuccagcgagccgguugcgaaggagucuacagaggcuuccaaagagcccagcccuacgaagacccccacaaucucuccugugauuaccgcucccccguccagcccuguccuggauacauccgacauccggaaagaacccaugaauauuuacaaccucaaugccaucauuagagaccagaucaagcaucugcagaaggccguggaucgcucucugcagcuuagccggcaaagagccgcugcccgggagcucgcgccuaugaucgacaaagauaaggaagcccugauggaggagauucugaaacucaagucccugcuuucuaccaaacgcgaacagaucgcuacgcugagagccguucucaaggcuaacaagcagaccgccgagguggcgcuggccaaccugaaaaauaaguaugaaaacgagaaagcuauggucacagaaaccaugacaaagcuccggaaugagcucaaagcccugaaggaggacgcugccaccuuuagcucccugagagccauguucgcuacgcgcugugaugaauacgugacacagcucgacgagaugcaacggcagcuggcggccgcugaagaugagaagaaaacccuuaacacacugcucagaauggccauucagcagaagcuggcccugacccaacgccuugaagaccuggaguuugaucacgagcagagcagacggucuaaaggaaagcucggcaaauccaagaucgggagccccaagauugugucuucccugcuucccccuuaucgccacagcgcucauaauuga

SEQ ID NO: 66440 - RNA, 2568 nt, Artificial Sequence
  derived and/or modified sequence opt5 from BICD2__Homo_sapiens__NP_001003800
augagcgcccccuccgaggaagaggaauacgcuagacuggugauggaggcccagccugaauggcuccgggcggaggucaagcgccugucucacgagcuugcugaaaccacaagagagaaaauccaagccgccgaauauggccuggcuguucucgaggagaagcaccagcugaaacuucaguucgaggaacuggaaguggacuacgaggccauucggagcgaaauggagcagcucaaggaggcuuuugggcaagcccacacgaaccauaaaaagguggcggccgauggagaaucccgcgaggaaucucugauccaggagagcgcuuccaaggaacaguauuacgucagaaaagugcuggagcuccagaccgagcugaagcaacuucggaauguucugacaaacacccagucugaaaaugagcgccucgccagcguggcucaggaacugaaagagauuaaccagaaugucgaaauccaaagaggccggcuucgcgacgauauuaaggaguauaaauucagagaggcccggcugcuccaggacuacuccgaacuggaggaagagaacaucagccugcagaagcaagugucuguucuccgccagaaucagguggaguuugaagggcugaagcacgagaucaaaagacuugaagaggaaacagaguaucugaacucccagcucgaggaugcgauucggcugaaggaaaucagcgagcgccaacuugaagaggcccuggaaacccucaaaacagagagagagcagaaaaauucucugcggaaggaacugucccauuacaugagcauuaacgacucuuucuacaccucccaccuccacgucagccuggauggacuuaaguuuuccgacgaugcugccgagccgaauaacgacgcugaagcccuggugaauggcuucgagcaugggggacucgccaaacugccccuugauaacaagacgucuaccccuaagaaagaaggccuggcucccccuagccccucccucgugagcgaccugcugucugagcucaauaucuccgagauucagaagcugaaacagcaacuuaugcagauggaaagagagaaggcgggccugcucgccacacugcaggauacccagaaacaacuggaacacacacgcgggagccuuucugagcagcaggagaaggucacccggcucacggaaaaccugagcgcucugagacgccuccaggccuccaaggagcggcaaacagcccuggacaacgaaaaagacagagauucucaugaggacggagauuauuacgaaguugacaucaauggcccugagauucuugcuugcaaguaucacguggccguggcggaggcuggggaacugcgcgagcagcucaaagcccugcggagcacccacgaagccagagaggcucagcaugccgaagagaagggacgcuacgaggcugaaggccaagcccugacagagaaagucucccuucucgaaaaggcgagccggcaggauagagagcugcuggcccgccucgaaaaggagcugaaaaaggugucugacguugcuggggagacccagggaucccuuagcguggcccaggaugaacuggucaccuuuucugaggaacucgcuaaccuguaucaccauguguguaugugcaauaacgagacaccgaaucggguuaugcuggacuacuauagagagggccaaggcggggccggacggacgucccccggcgggcgcaccagcccugaagcgagaggacggagaucccccauccuucucccuaaaggccugcuggcccccgaggcugggcgcgccgauggaggcacaggcgacucuagcccguccccugggucuagccuccccuccccucugagcgauccccggagagaacccaugaacaucuacaaucuuauugcuaucauucgcgaccagaucaagcaccuucaggccgccguggacagaaccacagagcucucucggcagcgcauugcuucccaagaacugggaccugcggucgauaaagacaaggaggcccugauggaggaaauccuuaagcucaaaagccugcugucuaccaagagagagcagaucacgacacuccggaccgugcugaaagcuaacaagcagaccgccgaagucgcccuugcuaaucugaaauccaaguacgagaacgaaaaagccauggugacagagaccaugaugaagcuccgcaaugagcugaaggcgcugaaagaagaugcugccacauucagcucucuuagagccauguuugcuacgcggugugacgaguauauuacccagcuggaugaaaugcaacgccagcucgccgcggcugaggacgaaaagaaaacacugaacagccuccugagaauggccauccagcaaaagcuggcccugacccagcggcucgagcugcuggagcuugaucaugaacagacacgcagaggccgggcuaaagccgcuccgaagaccaagcccgccacgccuuccguuagccauaccugcgcgugugccucugacagagcugaggggacaggacuggccaaucagguguucugcuccgaaaaacacagcauuuacugugauuga

SEQ ID NO: 66441 - RNA, 588 nt, Artificial Sequence
  derived and/or modified sequence opt5 from BID__Homo_sapiens__NP_001187
auggacugcgaagugaacaauggcagcucccugagagaugaauguaucaccaaccuccuggucuucggguuucuucagucuugcagcgacaauuccuuccggcgcgagcuggaugcccucggacacgaacugcccguucuugcuccucaaugggagggcuacgacgaacugcagacagaugggaacagaucuagccauucccggcucggacgcauugaggccgacucugagagccaggaagauaucauuagaaauaucgcgcggcaccuggcucaggugggcgacuccauggaucgcagcauuccgcccgggcuggugaacggacucgcccugcaacuuagaaauacgucucgguccgaggaagaccgcaacagagaucuggccaccgcucucgagcagcugcuucaggccuauccucgggacauggagaaggagaaaacaaugcugguccucgcucugcugcucgccaagaaaguggcgagccauacccccucucugcuucgcgauguuuuucacacaaccgugaauuucaucaaccagaaucugagaacauacguccggucccucgcccgcaacggcauggacuga

SEQ ID NO: 66442 - RNA, 1365 nt, Artificial Sequence
  derived and/or modified sequence opt5 from BIN1__Homo_sapiens__NP_004296
auggccgagaugggcagcaagggggugaccgcuggaaaaaucgccuccaacguccagaagaaacugacaagagcgcaagaaaagguucuccagaaacugggcaaggcugacgagacgaaggaugaacaguucgagcagugcgugcaaaauuuuaacaaacagcuuaccgaagggacacggcugcagaaggaccuccgcaccuaccuggccucugugaaagccaugcacgaggcuagcaagaaacuuaaugagugucugcaggaagucuaugagcccgauuggccuggaagagacgaagccaacaagauugcugagaauaacgaucuccuguggauggacuaccaucaaaagcugguggaucaggcccuccugacaauggacaccuaucuuggccaguucccggauaucaaaucccggauugcgaagcgcgggagaaaacugguugacuacgauucugcccggcaccauuaugagagccuccagacagcuaagaaaaaggacgaagccaaaaucgcuaaggccgaggaagaacugauuaaggcgcaaaaaguguuugaagagaugaaugucgaucuucaggaggaacugcccucccucuggaacucucgcgugggauucuacguuaauaccuuucagagcaucgccggccuggaggaaaacuuccacaaggagauguccaaacugaaucaaaaccucaaugacgugcuggucggccuugaaaagcagcaugggagcaacacguuuaccgugaaagcucagccuagaaagaagucuaaacuguucucccggcuccgcagaaagaaaaauagcgacaacgcccccgcuaagggaaacaaaucuccuuccccucccgauggcagcccggccgccacacccgagauccgggugaaucacgagccugaacccgcugggggagcgaccccuggcgccacacugcccaagucuccgucccagccugcugaggccagcgaagucgccgggggaacccaacccgcugccggcgcgcaggagccuggcgaaacggcugccuccgaggccgcuucuagcucccuucccgccguugugguggagacauuucccgcuaccgucaacgggacaguggaaggaggcagcggggccggacgccuggaccucccuccgggcuucauguuuaagguucaggcgcagcacgauuauaccgccaccgacacagaugagcugcaacugaaagcuggggacgugguccucgugauucccuuccagaauccugaggagcaggaugagggauggcugaugggcguuaaggaaucugacuggaaccagcauaaagagcuugaaaagugcagaggcguguuucccgagaauuucacggaacgggucccuuga

SEQ ID NO: 66443 - RNA, 1620 nt, Artificial Sequence
  derived and/or modified sequence opt5 from BIN2__Homo_sapiens__NP_001276936
auggugcugcagaagcucggcaaagccgucgagaccaaggacgaaagauucgagcaaagcgcuuccaacuuuuaccagcagcaggccgaagggcacaaacuguauaaggaucuuaaaaauuuccugucugcgguuaaggugaugcaugagagcuccaagcgggugucugaaacacuccaagagaucuacagcuccgagugggacggacacgaagaacugaaagcuauugucuggaacaaugaucuucugugggaagacuaugaggagaagcucgccgaucaggccgugcgcacgauggaaaucuacguugcucaguuuucugagauuaaagaaagaaucgccaagcggggccgcaaacugguggacuaugauagcgcuagacaucaccuggaggccguccagaacgcgaagaagaaagacgaagccaagaccgcuaaagccgaggaggaguucaauaaggcucaaacaguguuugaggaucucaaccaggaacugcuugaggaacugcccauucucuacaauucccggaucgggugcuauguuaccaucuuccagaacauuagcaaucugcgcgacguguuuuacagagagaugucuaaacuuaaccauaaucuguacgaggucauguccaagcucgaaaaacagcacagcaacaagguguucguggucaagggacugucuuccagcucucggcgcucccugguuaucagcccuccggugagaacagccaccguguccucuccccucacaagcccuaccucccccagcacgcugucucuuaaauccgagagcgaaucugucagcgcgaccgaggaucuggccccugacgcugcccaaggcgaagauaauuccgagauuaaggagcuccuggaagaggaagagaucgagaaagaagggucugaggcuagcuccagcgaagaggacgaaccccuuccugccuguaacggaccggcccaggcucagcccucuccuacaaccgagcgggcgaagucccaagaggaagugcugcccagcucuacaaccccuucccccggcggcgcccucagcccguccgggcagccuucuagcuccgcuacggagguugugcugcgcacaagaaccgccucugaaggaagcgagcagcccaaaaagcgggccuccauucagcgcacaagcgcuccucccucuagacccccuccgccccgggccaccgcguccccuagacccagcucuggcaauaucccuuccagccccaccgcuucugggggaggcagcccgacauccccucgcgccagccuggggacgggaaccgccucuccccggacaucccucgaagucagcccuaaccccgagccucccgagaagccggugagaaccccugaagcuaaagagaacgaaaauauucacaaccaaaaucccgaggaacugugcacaucccccacccuuaugacgucucagguugccagcgagccuggcgaggcuaagaaaauggaagacaaggagaaagauaacaagcugaucuccgccaauucuagcgaaggccaggaccagcuccaaguguccauggucccggagaacaauaaccugacagcgcccgagccucaggaagaggugucuaccagcgaaaauccccagcuuuga

SEQ ID NO: 66444 - RNA, 762 nt, Artificial Sequence
  derived and/or modified sequence opt5 from BIN3__Homo_sapiens__NP_061158
augagcuggauccccuucaagauuggccagccuaaaaagcaaaucgugccgaaaaccgucgagagagacuuugaacgggaguacgggaagcugcagcagcucgaagaacagacacgcagacugcaaaaagauaugaagaaguccacggacgccgaucuugcuaugucuaaaagcgccguuaagauuucccuggaccuccugucuaacccccuuugcgaacaggaucaggaccugcucaauauggugaccgcgcuggauacagcuaugaaacggauggacgccuucaaccaggagaaggugaaucaaauccagaaaaccgucauugagccucugaagaaguuuggaagcguguuccccucccucaacauggccguuaaacgcagagaacaggcucugcaggauuaucggcgccuucaagccaagguggagaaauacgaagagaaggagaaaacaggcccuguccuggcuaagcuccaccaggccagagaggagcugcggcccgugcgcgaagacuuugaggcgaaaaauagacagcuucuggaagagaugccucgguucuaugggucucgccucgauuacuuucaaccgagcuucgagucccugaucagagcccagguuguguauuacagcgaaaugcauaagaucuuuggagaccugucucaccagcucgaucagcccggccauuccgacgagcaacgggaacgcgagaacgaagcuaagcugagcgagcuuagagcccugucuauugucgcugacgauuga

SEQ ID NO: 66445 - RNA, 1857 nt, Artificial Sequence
  derived and/or modified sequence opt5 from BIRC2__Homo_sapiens__NP_001243092
augcacaagaccgccagccagagacuguuccccggcccuuccuaccaaaacaucaaaucuauuauggaggacagcacaauccucuccgauuggacgaauagcaacaagcagaaaaugaaguaugacuuuagcugcgaacuguaccggauguccaccuauucuacauucccggcuggggugcccgucagcgagcgcucccuugccagagcgggauuuuacuauaccggcguuaaugauaaagugaaguguuucugcugugggcugaugcucgacaacuggaagcugggagauagcccuauucagaaacauaagcagcuuuaccccucuugcuccuuuauccaaaaucuggugagcgcuucucucggcuccacaagcaaaaacaccucuccuaugcggaauagcuucgcccacagccugucccccacacuggaacauucuagccucuuuuccgggagcuauucuucccugagcccuaacccgcuuaauucucgcgccgucgaggacauuagcuccucuagaaccaaccccuacagcuacgcuauguccacggaagaggcccgguuccugaccuaucacauguggccucucacauuucugagccccucugagcuugcucgcgccggauucuacuauaucggcccuggcgauagaguggcguguuuugccugcgggggaaagcuguccaauugggaacccaaagacgaugcuaugagcgagcaucggcgccacuucccgaacuguccuuuucucgaaaauucucuggagacccugagauucuccaucagcaaccucuccaugcagacacacgccgcucggaugcgcaccuucauguacuggcccucuagcguuccugugcagcccgagcagcuggccuccgcgggcuuuuauuacgucgggagaaaugacgaugugaagugcuucuguugcgacggaggccuucgguguugggaaucuggggaugaccccuggguugagcaugccaagugguuuccucgcugcgaguuccugauuagaaugaaaggacaagaauuuguggacgaaauccagggccgguauccgcaccuccuggagcagcuucugagcacguccgauacaaccggcgaggaaaacgcugaucccccuauuauccauuucgggcccggagagucuucuuccgaagacgccgucaugaugaacacaccuguggugaaguccgcucucgagaugggcuuuaauagagaccuggucaaacagaccguucaaucuaagauucugaccacaggggaaaacuacaaaacggugaaugauaucguguccgcccuccugaacgccgaggacgagaagcgcgaagaggaaaaagagaagcaggcugaagagauggcgagcgaugaccuuucucugauucggaagaauagaauggcccucuuccagcaacugaccugcguccuucccauccuggauaaccuccugaaagcuaaugugaucaacaagcaggagcacgacauuaucaaacagaagacacagauuccgcugcaagcccgcgaacucaucgauaccauucugguuaaaggaaaugccgcugccaacaucuuuaagaauugucuuaaggagaucgacagcacacuguacaaaaaccucuucguggacaagaauaugaaauauauuccuaccgaagaugucuccggccugagccuggaggagcagcuucggagacuccaggaggaacgcacgugcaagguguguauggacaaagaaguuucuguggucuuuauccccugcgggcaccugguggucugucaggagugcgcgccuucccugcggaagugucccauuugcagaggaaucauuaagggcacagugcgcaccuuccucagcuga

SEQ ID NO: 66446 - RNA, 1815 nt, Artificial Sequence
  derived and/or modified sequence opt5 from BIRC3__Homo_sapiens__NP_892007
augaacaucguggagaauagcauuuuccuguccaaccucaugaagucugccaauaccuuugaacugaaauacgaccuuagcugcgagcuguauagaauguccacauacucuacguuccccgcuggcgucccuguuagcgaacggucccucgcccgcgcgggguuuuauuacaccggagugaacgauaaggugaaauguuucugcuguggccugaugcuugacaauuggaagagaggggauucuccgacagagaaacacaagaagcuguaucccagcugccgguuuguccagucccucaacagcgugaauaaccuggaagcuaccucucaaccuacauuccccuccagcguuaccaauucuacacauucccugcucccuggaaccgagaacagcggcuacuuucgcgggucuuauuccaauagccccuccaacccugucaauucuagagccaaccaggacuucagcgcccugaugcgguccagcuaccacugugcuaugaauaacgagaacgcccgccuucugacguuucagaccuggccgcucacauuccugucucccaccgaucuugcuaaagccggauuuuacuauaucggcccuggcgacagaguggcgugcuucgccugugggggaaagcuguccaauugggaacccaaagauaacgcuaugagcgagcaucuccggcacuuuccuaagugccccuucauugaaaaucagcugcaagacacaucucgcuacaccgugagcaaccuguccaugcagacgcaugccgcuagauucaaaacauuuuucaauuggccgucuagcguucucgugaacccugagcagcuggccuccgcgggcuuuuauuacgucgggaauagcgaugacgugaaguguuucugcugugauggaggccuucggugcugggagucuggggacgaucccugggugcagcacgccaagugguuuccucgcugcgaauaucugaucagaauuaaaggacaagaguucauccggcagguccaggcuuccuacccccaccuccuggaacagcuucugagcaccucugacucccccggcgacgagaacgccgaaagcuccaucauucauuuugagccuggcgaggaucacucugaagacgcuaucaugaugaauacaccgguuauuaacgccgccguggagaugggguucagccgcucccucgugaagcaaaccguccagagaaaaauccuggcuaccggagaaaauuaucggcuggugaacgaucucguucuggaccuucugaaugcggaggaugaaauuagagaggaggaacgcgagcgggccacagaagagaaggaaucuaacgaccuccugcuuauccgcaaaaauagaauggcucuguuucagcaucucacgugugugauucccauccuggauagccugcucaccgccggcaucauuaacgagcaagagcacgacgucaucaagcagaaaacacagaccucccugcaggcccgggaacuuauugauacaauccuggugaaggggaacauugcugccaccguuuucagaaauagccuccaagaggcggaagcugugcuguacgagcaccuguuuguccagcaggacaucaaguacaucccuacggaggaugugucugaccuucccgucgaggaacagcuccgccggcugcaagaagagagaacaugcaaaguguguauggacaaggaaguuuccauuguguucaucccuugcggacaucuggucguguguaaagauugcgcccccagccuccgcaaguguccgauuugccggucuaccaucaaaggcaccguuagaacauuucuguccuga

SEQ ID NO: 66447 - RNA, 414 nt, Artificial Sequence
  derived and/or modified sequence opt5 from BIRC5__Homo_sapiens__NP_001012270
augggcgcccccacccugccuccggcuuggcagcccuuccucaaggaccacagaaucagcacauuuaaaaacuggccuuuccuggaggggugcgccuguacgcccgaacggauggcggaggcuggauuuauucauugcccuaccgaaaaugagcccgaucuugcccaauguuucuuuugcuucaaggaacuggagggcugggagccugacgaugacccgaugcagcgcaaacccacaaucagacggaagaaccuccgcaaacugagacggaagugugccgugccuuccucuagcuggcuucccuggauugaggcuuccgggcgcucuugccuggucccugaauggcuccaccauuuucagggacuguuccccggcgccaccagccugccgguugggccucucgcuauguccuga

SEQ ID NO: 66448 - RNA, 14574 nt, Artificial Sequence
  derived and/or modified sequence opt5 from BIRC6__Homo_sapiens__NP_057336
auggugaccggcgggggcgcugcucccccuggcaccgucacggaaccgcugcccagcguuaucgugcuguccgccgggagaaagauggccgcugccgccgcugccgcuucuggaccuggcugcagcuccgccgccggggccggagcugccggcgugucugaauggcugguccuucgggacggcuguaugcacugcgaugcugacgggcugcauagccuguccuaccaccccgcccugaacgcgauucuugccgugaccucucgcggaacaaucaagguuauugauggcaccagcggggcuacacugcaggccuccgcucugagcgccaagccuggaggccaagugaagugucaguauaucucugccgucgacaaggugauuuucguugaugacuacgcuguggggugcagaaaagaucugaauggaauccugcugcuggacaccgcgcuucagacacccgucuccaagcaggaugacguggugcaacuggaacugccugucaccgaagcccagcagcugcuuagcgcuugucuggagaagguugauaucucuuccacggaaggcuaugaccucuuuauuacccagcugaaagauggccugaagaacacaagccaugagaccgccgccaaucacaaaguggcuaagugggccacagugaccuuccaucucccccaccacguccugaaaucuaucgcguccgcuauugugaacgagcuuaagaagaucaaucaaaacguugccgcccugcccguggcuagcuccgucauggaccggcucucuuaccugcuuccuagcgcccgccccgaacugggggugggaccuggcagauccguugaccggagccucauguauucugaggcuaaucgcagagaaacguuuacauccuggccccaugugggguaccggugggcccagccggauccuauggcgcaggccggauucuaucaccagcccgcuagcucuggcgacgaucgcgccaugugcuuuaccuguagcgucugccugguguguugggagccuacagacgagcccugguccgaacaugagagacacucucccaacugcccuuucgucaaaggggaacacacccaaaaugugccgcugagcguuacccucgcuacaucccccgcccaguuuccuuguacggauggaaccgaccggauuagcugcuucggcucuggcuccugcccccauuuucuggcggccgcuacaaagcgcgggaaaaucuguauuugggaugugagcaaacuuaugaaaguccaccugaaguucgagaucaacgccuacgacccugcuaucgugcagcaacucauucugucuggagaucccuccagcggcguugacuccagacggccgacccuugccuggcuggaagauucuagcuccugcucugacaucccuaaacucgagggggacagcgaugaccugcuggaggauuccgacagcgaagaacacucucgcuccgauagcgugacaggacacaccucucagaaggaagccauggaggucucccucgacauuacggcucugagcauccuucagcagcccgaaaagcugcaaugggagauuguggcgaaugugcucgaggauacaguuaaagaccuggaagaacugggcgccaacccuugucuuaccaauucuaagagcgagaagaccaaggagaaacaucaggaacagcacaacauccccuuuccuugccuccuggcugggggccugcucacauacaagucccccgccaccagcccgaucucuuccaauagccacagaucccuggauggacuuucucggacacagggcgagagcauuuccgagcaagggucuacggacaacgaaagcuguaccaacuccgagcucaauucuccucucgucagacgcacacugcccgugcugcuucucuauagcaucaaggaauccgaugagaaagccggaaagauuuucagccagaugaacaauaucaugucuaaaucccugcaugacgauggcuuuaccgugccccagauuaucgagauggaacuggacagccaggagcaacuccugcuucaggacccuccggucacauacauccagcaguucgcugaugccgcggcuaaccugaccucucccgacuccgaaaaguggaauagcguguucccuaaacccgggacgcucguucaaugccugcggcugccuaaguuugccgaggaagagaaccuuuguauugauucuaucacccccugcgccgacgggauccaccuccuggugggccugagaacauguccugucgagucccucagcgcuaucaaucagguggaagcccugaacaaucuuaacaagcucaauagcgcgcucugcaaccgccggaaaggggagcuggaaagcaaucuggcuguugugaacggcgccaauauuucugucauccagcaugagagccccgccgaugugcaaaccccgcuuauuauccagccugaacagagaaacguuuccggaggcuaucucgugcuguacaagaugaacuaugcuacacgcaucgucacccuggaggaggaacccauuaaaauccagcacauuaaggacccucaagauacgaucacaucucucauucugcuucccccggacauccuggauaaucgggaggacgauugugaagaaccuaucgaagacaugcagcucaccagcaaaaacggguucgagagagagaagacauccgauauuucuacccugggacaccuggugaucaccacacagggcggguacgugaagauucuugaccugagcaauuuugaaauccucgccaaagucgagcccccuaagaaagaaggaacggaggagcaggacaccuucguuuccgugauuuauugcucuggcacagaucgccugugcgcuuguaccaaagggggcgaacuccauuuucugcaaaucggaggcacaugcgacgauaucgacgaggccgauauucuuguggacgggagccuguccaaaggaaucgaacccagcucugagggcuccaagccccucagcaacccuucuuccccggggauuagcggagucgaucugcugguggaccagcccuucacccuugaaauccugacgucccucguugagcugacacgguuugagacccucaccccuagauucucugcgacagugcccccuuguugggucgaagugcagcaggagcaacagcagcgccggcacccccaacaucugcaccagcagcaucacggcgaugccgcucagcacaccagaacauggaaacuucaaacggacagcaauuccugggaugaacauguuuuugagcuggugcucccuaaggccugcauggucgggcacguggacuucaaguuuguucugaacagcaauauuaccaacaucccgcagauccaggugacacugcuuaaaaauaaggcucccggccugggaaaagucaacgcccucaauauugaaguggagcagaacggcaagccuucucugguggaccucaaugaggaaaugcaacauauggaugucgaggaaucccagugucugcggcuuugccccuuccuggaggaccacaaagaagauauccugugugggccuguuuggcucgccagcggacuggaccuuucuggccaugcugggaugcugacccucacaagccccaagcuggugaagggaauggcgggcggcaaauaccgcuccuuucucauucacgugaaggccgucaacgagagagggaccgaggaaaucugcaauggaggcaugcggccggugguuagacugccuucucuuaaacaccagagcaacaagggguacucccuggcuucucugcucgccaaaguggccgcuggaaaggaaaagagcuccaacgucaaaaaugaaaacacgagcggcacccgcaagucugagaaucugcgggggugugaucuucugcaggagguguccguuacaauuagacgcuucaaaaagaccagcaucuccaaagaaagagugcaacggugcgccaugcuccaguucucugaguuucaugaaaagcugcucaacacacugugucgcaagaccgacgauggacagauuacagagcacgcgcagagccuuguccuggacacccugugcuggcucgcuggcgugcauuccaauggccccgggucuagcaaagaaggaaacgagaaucugcuuuccaagacgagaaaauuccugagcgauaucguccgggugugcuuuuucgaggccggccgcucuaucgcccacaagugugcuagauuucucgcccugugcauuuccaacgggaaaugugaccccugccaaccugcguucggacccguucuccugaaggcccuucuggauaauaugagcuuucugccugccgccacaaccggcgggucuguguauugguacuucguccuccugaacuaugugaaagacgaagaucuugcuggauguuccaccgccugcgcuagccugcucacagccguuucucggcagcugcaggaccgccugaccccgauggaggcgcuccuucaaacgagauacggccuguauagcucccccuuugacccugugcuguucgaucucgaaaugucuggcagcuccuguaagaaugucuacaacagcuccaucggggugcagucugacgagauugaucugagcgacgugcuuuccggaaauggcaagguuucuagcugcacagccgcugaaggguccuuuaccucucugacaggacuccuggaggucgagccccugcacuucaccugugugagcacauccgauggcacccggaucgaacgcgacgaugccaugagcucuuuuggggugacgccugcugucggaggccucuccagcggcaccgugggggaggccucuacagcccuuuccagcgcugcgcagguugcccugcagucucugucccaugcuauggccagcgccgaacaacagcuccaggugcugcaggagaaacaacagcagcuucugaagcuccagcaacagaaagcuaagcuggaagccaaacugcaccagaccacagcggcugccgccgcugccgcguccgccgucggacccgugcauaacagcguuccgucuaauccuguggcugcccccggcuucuucauucacccuagcgacgucauucccccuacccccaagacgacaccgcucuuuaugaccccuccccuuacacccccuaacgaggcuguguccguugugaucaacgccgagcuggcucaacuguucccggggucugucauugaucccccugccgugaaucucgcggcccauaacaagaauagcaacaaauccagaaugaauccccugggaucuggccuugcucuggccaucagccacgcuucccacuuucuccagccucccccucaucagucuauuaucauugaacggaugcacagcggggccagacgcuucgugacccuggacuuuggacggccgauccugcucaccgauguccuuauccccacaugcggcgaccuggccucccugagcauugauaucuggacgcucggcgaggaaguugacgggagacgccuggugguggcuaccgacauuucuacacauucccuuauccugcacgaucucauuccucccccugucugucgguucaugaagaucaccgugauuggaagauauggcagcacaaacgcgcgcgccaaaaucccccugggguuuuacuacggacacaccuauauccugccgugggagucugagcucaaacuuaugcaugacccucugaaaggcgaaggggaguccgcuaaucagcccgaaauugaucaacaccuggccaugaugguugcccuccaggaggacauccagugccgguacaaccuggcuugccauagacuugaaacgcugcuccagagcauugaucugcccccucucaauuccgccaacaaugcgcaauauuuccuccgcaagcccgacaaggccguggaggaggauucucgggucuuuagcgcuuaccaggacuguauccagcuucagcugcaacugaaccucgcccacaaugcugugcagagacugaaaguugcccuuggagcgucccggaagaugcugagcgaaacaucuaacccugaggaucucauucagaccuccagcaccgaacagcugcgcacaaucaucagauaucugcucgacacccuucugucucugcuccaugccagcaauggccacuccgugccggcuguccugcaaucuacauuccacgcccaggcuugcgaggaacuuuuuaaacaucuguguauuagcggcacgcccaagauccggcuccacaccgggcugcugcucgugcagcuuugcggaggcgagcgcuggugggggcaauuccuguccaacguccugcaggagcucuacaauucugaacagcugcuuauuuucccucaggauagaguguuuaugcugcucagcuguaucggacaacggucccugagcaacucuggcguucuggagucccuccuuaaccugcuggacaaucuccugagcccccuucagccucagcugcccaugcauagacgcacagaaggggugcucgacauuccgaugaucuccuggguggucaugcugguuucucggcugcucgauuauguggccaccguggaggacgaagcugccgcggccaaaaagccucugaacggaaaucaguggagcuucaucaacaauaaccuucacacacaaucccugaauagaucuagcaagggcuccagcucucucgaucgccuguacucccggaaaauuagaaagcagcuuguccaccauaaacagcagcugaaccuccugaaggcuaaacaaaaggcccugguggagcagauggagaaggagaagauucagagcaauaagggaucuuccuacaaacuccugguugagcaagcuaaacuuaaacaggccaccagcaagcacuuuaaagaccugauucgccuccggagaacggccgaauggucucgcuccaaccuggauaccgaggugacaaccgcgaaggagagccccgaaaucgagccucuucccuucacacuggcucaugaaagaugcauuucugucgugcagaagcucguccuguuucugcucagcauggacuucaccugucacgccgaucugcuucuguuugugugcaaaguucucgcucggaucgccaaugccacacgcccuacgauucaucugugugagaucgugaacgaaccccagcuugagagacugcuccugcugcucgucgggaccgacuucaaucggggagauaucuccuggggcggggcuugggcccaauauagccugacaugcaugcuucaggacauucuggcgggagagcuccuggccccgguggcugccgaagcuauggaggaaggcaccguuggggaugacgugggcgccaccgcgggagauuccgacgacucucuucagcagagcuccguccaacugcucgagacaaucgaugaaccucugacgcacgacauuaccggcgcgccgccccugucuagccucgagaaggauaaagagaucgaccuggaacuucugcaggaucucauggagguggacauugauccucuggacaucgaucuugaaaaggacccgcuggcugccaaaguguuuaagcccaucuccucuacaugguacgauuauuggggagcugacuacggaaccuauaacuacaauccuuauauuggcgggcucggaauccccguugccaagccucccgcuaacacagagaaaaacggcagccagaccgucuccgugagcgugucucaggcccuggacgcgcgccuggaagucgggcucgagcaacaggccgagcugaugcuuaagaugauguccacgcuggaagcugauagcauucuccaggcccugacaaauaccucuccuacccuuucccaaagccccacaggcaccgacgauucucugcucggaggccugcaggcugccaaccagacaucccagcugaucauucaacucagcucuguuccgaugcugaauguguguuucaacaaacucuuuuccaugcugcaagugcaccauguccagcucgagagccugcuucagcuguggcucacccugagccucaauuccucuagcacggggaacaaggaaaauggagccgacaucuuccuuuacaacgcgaauagaaucccugugauuucccugaaccaggcuucuaucaccagcuuucucacaguucuggccugguaccccaauacacuccugcggaccuggugccuugugcugcacucccugacgcucaugaccaacaugcagcucaauucuggcagcuccagcgccauugggacacaggagucuaccgcucaucuucuggucuccgauccuaaccucauccacgugcugguuaaauuccucagcggaacaucuccccauggcaccaaucagcacuccccgcaaguggggccuacagccacccaggcuaugcaggaguuccugacgagacugcagguccaccuuagcuccacaugcccccaaaucuuuucugaguuccugcucaagcugauccauauucuuagcaccgagcgcggcgccuuucagaccggacagggcccccuggacgcgcaagugaagcuccuggaguucacacucgagcagaacuuugaaguggucuccguuucuaccaucagcgccgugaucgaguccgugacauuccugguccaccauuauauuacguguagcgauaaagugaugucucgguccgggagcgacucuagcguuggagcuagagccugcuuuggcgggcuguucgcuaaccuuauccgcccuggagaugccaaggcgguguguggcgagaugacccgggaccagcugauguuugaucuccugaaacuugucaauauucuggugcagcucccccuguccggcaacagagaauacucugcccggguuagcgugacaaccaauacaaccgacuccgucagcgaugaggaaaaggugucugggggaaaagacggcaacggguccagcacguccguucaaggaucuccugcuuauguggccgaccugguccucgcuaaucagcagaucaugagccagauucuguccgcccuuggccugugcaacucuagcgcuauggccaugaucaucggggcguccggacuccaccugaccaagcacgagaauuuccauggcggccuugaugccauuucugugggggacggacuguuuacaauccucaccacacugagcaagaaggcuuccaccguccacaugaugcugcaaccgauucucacguacauggccuguggcuauauggggcgccagggaagccuggccacaugccagcuuucugaaccccugcucugguucauccugagagugcuugauaccuccgacgcucugaaggccuuucaugauaugggcgggguucagcucauuuguaacaauauggugacaagcacccgggcgaucgucaacaccgcucgcucuaugguguccacaaucaugaaauuccuggacagcggaccuaauaaggccguggauucuacgcugaaaacccggauucuugccagcgagcccgacaacgcugagggcauccacaauuucgccccucugggcacaauuaccuccagcucccccacagcucaaccugccgaaguucuucugcaggcgaccccgccccauagacgcgccagaucugcugccuggagcuacaucuuucucccugaggaggcuuggugcgaucugacgauucaccuucccgccgcggugcugcucaaggagauccacauucagccucaucuggccucccuggcuacaugucccucuagcgucuccguggaaguuucugccgacggggugaacaugcucccgcugagcaccccugucgugaccuccggacuuacauauaucaaaauccaacuggucaaggcugagguggccagcgccguuugccuccggcugcaccgccccagagaugcuucuacccuuggccugucccagauuaagcuccuggggcugacagcguucggaacgaccagcucugccacagugaauaaccccuuucucccuuccgaggaccaggucagcaaaaccucuaucggcuggcugcggcuucugcaucacugucucacacacauuuccgaucuggaagggaugauggcuagcgccgccgcucccaccgccaaccuucugcagacgugcgcggcucuccugaugucuccuuacugcggaaugcauuccccgaauaucgaggugguucuggugaagauuggccuccaaagcaccagaaucggccugaaacuuaucgacauucugcuccgcaacugugccgccuccgggagcgaccccacagaucucaauucuccucugcuguucggacggcuuaacggccugagcuccgacucuaccaucgauauucuguaccagcucgggacaacccaggaccccggaacaaaggauagaauccaggcucugcuuaaaugggucagcgacuccgcccgcguggcugccaugaagcggucuggcagaaugaauuauaugugcccuaacagcuccaccguggaauacgggcugcucaugcccagcccgucucaucugcauuguguugcggccauucuguggcacuccuaugagcuucucgucgaguacgaucugccugcucugcucgaccaagaacuguuugagcuucuguucaauuggagcaugucucuccccugcaacauggugcugaagaaagccguggauucccugcuuuguagcaugugccauguccacccuaauuauuuuucucuccugaugggauggaugggcaucacgcccccgccugugcagugucaccaucgccuguccaugacagacgauagcaagaaacaggaccucuccucuagccugaccgacgauuccaagaacgcucaggcgccccuugcgcugaccgaaagccaccucgccacacuggcuucuuccagccaaucucccgaggccaucaaacagcugcuugacagcggccucccuucccugcugguucggucucucgcuagcuucugcuuuucccauauuuccucuuccgaaagcaucgcccagucuauugauaucucccaggacaagcugagacgccaccaugugccccaacaguguaauaagaugccuauuacggccgaucuugucgcuccgauccugcgguuccucaccgagguggggaacagccacaucaugaaagacuggcugggaggcuccgagguuaauccccuguggacagcgcuucucuuucugcugugccacucugggagcaccuccggaucucauaaccucggcgcccagcaaacaagcgcuagauccgccagccugucuuccgccgcuaccacagggcuuaccacgcagcagcgcaccgccauugaaaaugcgacaguggcuuucuuucugcaguguaucagcugccacccuaacaaccaaaagcucauggcccagguccugugugagcuguuccagaccucuccccagcggggaaaucuuccuacauccggcaacauuagcggcuucaucagacgccucuuucugcaacugaugcucgaagaugagaaagugaccauguuccugcagucucccugcccucuuuacaaggggagaauuaaugccacgucccauguuauccagcacccgauguauggagcuggccacaaauuucggacacugcaucuccccgugagcaccacacugagcgacguccuggaucgcguguccgacaccccuucuauuacggccaaacuuaucagcgaacagaaggaugacaaagagaagaaaaaccacgaggaaaaggagaaagugaaggcugaaaauggguuccaagauaacuacuccgucguuguggccucuggacucaaaagccaguccaagagagcggugucugccacacccccucggcccccgagcagacggggccgcacaaucccugacaagauuggguccaccucuggagcugaggccgcuaauaaaaucauuacaguccccguguuucaucuguuccacaagcugcucgccggccagccccugccugcggaaaugacccuugcccaacugcucacacugcuguacgacagaaaacuuccccagggcuaucggagcaucgaucucaccguuaagcuggggucccgcgugauuacggacccuagccugucuaaaacagauuccuacaagagacuccauccggagaaggaccacggagaucugcuugcuagcugccccgaggacgaagcccugaccccuggcgaugaguguauggacgggauccucgaugaaucucugcuggagaccugccccauccaguccccucuucaggucuuugcuggaaugggcgggcucgcccugauugccgagcggcugcccaugcucuauccggaagugauccaacagguuagcgcuccuguggucacaucuaccacacaggagaaacccaaggacuccgaucaguucgaaugggugacgauugagcaaagcggcgaacuggucuacgaggcgccugagaccguggccgcugaacccccucccaucaaauccgccguucagacaaugagcccgauucccgcccacucucuugcugccuuuggacuguuccuccgccugccuggcuaugcggaggugcugcuuaaggaaagaaaacaugcucagugucuccugcggcugguccucggggugaccgacgauggagagggcagccacauccugcagucccccucugccaacguucuuccuacacugccguuucaugugcuccgcagccuguucuccaccacgccccugaccacagacgacgggguccuucucagacggauggcccuggaaaucggagcucugcaccucauucuggugugccuuucugcccugagccaccauuccccucgcgugcccaauucuagcguuaaccaaaccgagccucaggucuccagcucucacaaucccacauccaccgaggaacagcaacucuacugggcuaagggcacgggguuuggcacaggaagcaccgccucuggcugggauguggagcaggcgcugacaaagcagagacuggaagaggaacaugugaccugucuucuccagguccuggccuccuauaucaacccugugagcuccgcuguuaauggggaggcccaaucuagccacgagacccggggacagaacuccaaugcucugcccagcgugcuccuggaacuucugucucaguccugccucauuccggccaugagcucuuaccugcgcaacgacuccguccuggauauggcgagacaugugccucuuuaccgggcccugcucgagcugcucagagcuaucgccagcugugcugccaugguuccccugcuucugccucucucuacagaaaacggcgaggaggaagaggaacagagcgagugccaaacguccguggggacccugcuggcgaaaaugaagacaugugucgacaccuauacaaaucgccuucggucuaaaagagaaaacgugaagaccggagugaaacccgaugccagcgaccaggagccggagggccugacgcuccugguuccugauauucagaagacagcugaaaucgucuacgccgcuaccaccucccuccgccaggccaaucaagagaagaaacugggggaauauagcaagaaagccgcuaugaagcccaaaccccuuucugugcugaagucccucgaggaaaaguacguggccgucaugaaaaagcugcaguucgacacauucgagaugguuagcgaggaugaagacggcaaacugggauuuaaggugaacuaucacuacaugucccaggugaaaaaugcgaacgaugcuaauucugccgcccgggcuagacgccuugcccaggaggcggucacccugagcacaucccucccucugucuagcuccagcucuguguucguucggugcgacgaagagagacucgacauuaugaaggugcugaucacgggccccgcugauaccccuuaugccaacggguguuuugaguucgacgucuacuuuccgcaagauuaccccuccagcccuccccuugugaaucuggagacaaccggaggccacucuguucgcuucaacccuaaucuguauaacgacgggaaagugugccucuccauccugaauacauggcauggacggcccgaggaaaaguggaacccgcagaccagcucuuuucuucagguccugguguccgugcaaagccucauucuggucgccgagccuuacuucaaugaacccggcuaugagagaucucgcgggacgccuagcggcacccaguccagccgggaguacgauggaaacaucagacaggcuacaguuaagugggccaugcucgaacagauucggaaccccuccccuugcuuuaaagaggugauccacaagcauuucuaucugaaaagaguggaaauuauggcucaaugugaggaauggaucgccgacauccagcaguacucuagcgauaagcgcgucggccggaccaugucccaccacgcggccgcucuuaaaagacauacagcccagcugcgcgaggagcugcucaagcugcccugcccggaagggcuugaccccgauaccgacgaugcuccugagguuuguagagccacaaccggagcggaagagacgcugaugcacgaccaagugaagcccucuagcuccaaagaacucccuucugauuuucagcuguga

SEQ ID NO: 66449 - RNA, 843 nt, Artificial Sequence
  derived and/or modified sequence opt5 from BIRC7__Homo_sapiens__NP_071444
augggccccaaggacagcgccaaaugccugcacagagggccucagccgucccauugggcugccggagauggccccacccaagagcggugugggccucgcucucucggaagccccgugcugggccuugacacaugcagagcgugggaucacgucgacgggcagauccugggacagcuccggccucugacggaagaggaagaggaagagggcgcuggcgccacccuuucccgcgggcccgccuucccuggaaugggcucugaggaacugagacucgcuagcuuuuacgauuggccgcugacagccgagguucccccugaacugcucgcugccgcgggguucuuucauaccggacaccaggacaaggugcgguguuucuuuugcuauggcgggcugcaauccuggaaacgcggagaugaccccuggacagagcaugccaagugguucccuucuugucaguuucuucugagaagcaaaggccgggauuucgugcacuccguccaggagacccacagccagcuccugggcucuugggaccccugggaggaaccggaagaugcugccccuguggcucccuccguuccugccagcggguaccccgagcuucccacaccucgcagagaagugcaaucugaguccgcgcaggagccgggagcccgggacgucgaagcucagcugcgcagacuccaggaggaacggaccugcaaggugugucuggaucgcgccguuagcauuguguuuguccccugcggccaucuggugugugcugagugcgccccugggcuccaacugugucccaucugcagagccccugugcggucuagaguccgcacguuccuuuccuga

SEQ ID NO: 66450 - RNA, 846 nt, Artificial Sequence
  derived and/or modified sequence opt5 from BIVM__Homo_sapiens__NP_001153068
augggcgccgggaaccugcccccuaucacccaggaggaagcucuccacauucugggauuccaaccgcccuuugaggacaucagauucggcccuuuuacagggaauacgacccuuaugcggugguuccgccagauuaacgaucauuuucacgugaagggaugcagcuacguccuguauaaaccccauggcaagaauaaaacagccggggaaaccgcguccggagcucucucuaagcugacaagaggccuuaaagacgagagccuggccuacaucuaucacugucagaaccauuacuucugcccuauuggcuuugaagccacccccguuaaggcuaauaaggccuucucccgggggccucucucuccgcaggagguggaguauuggauccugaucggagaaagcucccgcaaacaccccgcuauucacuguaagaaaugggccgauaucgugacagaccugaacacccaaaauccugaguaccucgauauuagacaucuggaacggggccuucaguaucgcaagacgaaaaagcccaccuuuuucucuagccaggucgggggaaaccugcacugcaucauugcguuucagagacucaauuggcaacgguucggccuguggaacuuuccuuucgggacaauccgccaggagucccagcccccgacccaugcccagggaauugcuaagagcgagucugaagacaauaucuccaaaaagcaacacggcagacuuggccggagcuucucugccuccuuucaccaggauagcgcuuggaaaaagaugucuuccauccaugagcgcagaaacagcggguaccagggauacuccgacuaugauggcaaugacuga

SEQ ID NO: 66451 - RNA, 264 nt, Artificial Sequence
  derived and/or modified sequence opt5 from BLCAP__Homo_sapiens__NP_001161292
auguacugccugcaguggcuccugcccgugcuucugaucccuaagccgcucaaccccgcccugugguucagccacuccauguuuaugggcuucuaucuucugucuuuucuccuggagagaaaaccuuguaccauuugcgcucuggucuuccucgccgcgcuguuucuuaucuguuacagcugcugggggaauuguuuccuguaucauugcuccgacucuccccucccugaaagcgcucacgaucccggaguugugggcacauga

SEQ ID NO: 66452 - RNA, 327 nt, Artificial Sequence
  derived and/or modified sequence opt5 from BLID__Homo_sapiens__NP_001001786
auggugacccugcuccccaucgagggccaggaaauucacuucuuugagauccuggaaagcgagugcguccuuuacacaggguggauugaaagagccuccggaucuagcaucuauccugaggcuaaggcccggcugccgcucgaggcgcugcuuggcuccaacaaagaacccaugcugccuaaggagacgguucucucucugaaacgcuacaaucuggggagcuccgcuaugaagagaaacgugcccggacaugugcuccaacggccuucuuaucugacccgcauucaggucacacuucuguguaauagcuccgccgaagcccucuga

SEQ ID NO: 66453 - RNA, 1518 nt, Artificial Sequence
  derived and/or modified sequence opt5 from BLK__Homo_sapiens__NP_001706
augggccuggugagcuccaagaaacccgacaaggagaaaccuaucaaggaaaaagauaaggggcaguggucuccgcucaaggucagcgcccaagacaaagaugcucccccucugcccccucuuguuguguucaaccaccugacacccccuccgcccgacgagcaucucgaugaagacaagcacuuuguggucgcccuguacgauuauaccgcgaugaaugacagagaucuucagaugcugaaaggagagaagcuccaggugcugaaaggcacgggggacugguggcuggcucggucccucguuaccggacgcgaaggcuacgugccuucuaacuucgucgccagaguggagagccuggagauggaacggugguuuuuccgcucccaggggagaaaggaggccgaacggcaacuucuggcucccauuaauaaggccggaucuuuucucauccgcgagagcgagacaaacaaaggcgcuuucucccugagcguuaaggaugugaccacacagggcgaacuuauuaaacauuauaagaucagaugccuggacgaagggggauacuauauuucuccucggaucaccuuucccucccuccaggcccugguccagcacuacagcaaaaagggcgaugggcugugucaacgccucacacugccgugcgugagaccugcgccccagaauccuugggcccaggacgaaugggagaucccccggcagucucuucgccuggugagaaaacucggauccggccaauucggggaagucuggaugggauauuacaagaacaauaugaagguugcuauuaaaacccugaaggagggcacgaugagccccgaggccuuucuuggcgaagcuaacgugaugaaagcccugcagcaugagcggcucgugcgccuguacgcggucgugaccaaggaaccuaucuauauuguuacagaguacauggccagagggugucugcucgacuuccugaaaaccgaugaaggaucucggcuuucccugccgagacucaucgacaugagcgcucagauugccgagggcauggcuuauaucgagcgcaugaacuccauucaccgggaucugagagccgccaauauccuugugucugaagcucugugcuguaagaucgcggacuuugggcucgcccgcauuaucgauagcgaguacacagcucaagaaggagccaaguuccccauuaaauggaccgccccugaggcuauccacuuuggcgucuucacgauuaaggccgacgugugguccuucgggguucugcugauggaaguggucacauauggacgggugcccuacccuggcaugagcaaucccgaggucaucagaaaccucgagcgcggcuaucggaugccgagaccugauaccugucccccugaacuguaccgcggggugaucgcggagugcuggcggucuagacccgaggagcgcccuacauuugaguuccuucaguccguucuggaagacuuuuacaccgcuaccgagcggcaguaugaacuccagcccuga

SEQ ID NO: 66454 - RNA, 1368 nt, Artificial Sequence
  derived and/or modified sequence opt5 from BLMH__Homo_sapiens__NP_000377
augagcuccucuggccugaacagcgagaagguggccgcucucauccagaaacuuaauuccgacccccaauucguccuggcccagaacguugggaccacacacgaucugcucgacauuugccugaagagagcgacggugcagcgggcucagcauguguuucaacacgccgucccucaggaaggaaaaccgaucaccaaucagaagucuagcggccgcuguuggauuuucuccugccuuaacgugaugagacugcccuuuaugaaaaagcucaauaucgaggaguucgaguuuucucagagcuaccuguucuuuugggauaagguugaacgguguuauuucuuucuguccgccuucguggacacagcucaacgcaaagagccugaggaugggagacucguccaguuucugcuuaugaaccccgccaaugacggaggccagugggauaugcuggugaacauuguugaaaaguacggggugaucccuaaaaagugcuuccccgagagcuauaccacagaagcuacccggcgcaugaaugacauccucaaccauaaaaugagagaguuuuguauucggcugcgcaaucuuguccacucuggagccacaaagggcgagaucuccgcgacccaggaugugaugauggaagagauuuucagaguggucugcaucugucugggcaacccuccggaaacguucaccugggaguaccgggacaaggauaaaaauuaucaaaagauugggcccaucacaccucucgaauuuuaccgcgagcauguuaaaccccuguucaacauggaggacaagauuugccuggugaaugauccuagaccccagcacaaauauaacaagcucuacaccguggaauaccugagcaacauggucggaggccggaaaacacuuuauaauaaccagccgaucgacuuucugaagaagaugguggccgcuucuaucaaagacggggaggccguuugguucggaugugaugugggcaagcacuuuaauuccaaacucgggcugagcgacaugaaccuuuacgaucaugaacuggucuucggagugucucucaagaauaugaacaaagcugagcgccugaccuuuggcgaaucccugaugacgcacgccaugacauucaccgcgguuagcgagaaggacgaucaagacggcgccuuuacaaaguggagaguggaaaauuccuggggagaagaucaugggcacaaaggcuaucucugcaugaccgacgagugguucucugaauacgucuaugagguggucguggaucggaagcacguuccugaagaggugcuggcuguccuugagcaggaacccauuauccugccugccugggaccccaugggggcucucgccgaguga

SEQ ID NO: 66455 - RNA, 4254 nt, Artificial Sequence
  derived and/or modified sequence opt5 from BLM__Homo_sapiens__NP_001274175
auggccgcugugccccagaacaaucugcaagagcagcucgaaagacacagcgcccggacccugaacaauaaacuuucccugucuaagccuaaguucagcggcuuuacauucaaaaagaaaacguccucugacaacaaugucagcguuaccaacguguccguggcgaagacaccgguccuccgcaauaaggaugugaacguuaccgaggacuuuucuuucagcgaaccccugccuaauacaaccaaccagcagagagugaaagacuuuuucaagaaugcucccgccgggcaagagacacagcggggaggcuccaaaagccuucugccugauuuucuccagacccccaaggaagucgugugcacgacccagaacacaccuaccguuaaaaagucucgcgauacagcccugaagaaacuggaguucuccagcucuccggacucccucagcaccaucaaugauugggacgauauggacgauuuugacacgucugagacauccaagagcuucgugacacccccucaaucccauuuugucagagugucuaccgcucagaaaagcaagaaagggaagcggaacuucuuuaaagcccagcuguacaccaccaauacagugaagacggaucuucccccucccuccagcgaaucugagcagauugaccugaccgaggaacaaaaggacgauuccgaguggcucagcucugacgucaucuguauugaugacggaccgaucgcugaaguucacauuaacgaggaugcccaggaaagcgacucccugaaaacacaucuugaggaugaacgcgacaacucugagaagaaaaagaaucuggaggaagcggagcuccacagcaccgaaaaagugccuugcaucgaguucgaugacgaugacuaugacacagauuucgugcccccuucccccgaagagaucauuagcgccucuuccucuucuuccaagugucugagcacccugaaggaccucgauacguccgacagaaaagaggauguccugucuacaagcaaggaccuucuguccaaacccgaaaagaugucuaugcaggagcucaacccugaaaccagcaccgauugcgacgcucggcaaaucucccugcagcagcagcuuauucaugugauggagcacaucuguaaacugauugauacaaucccggacgauaagcucaagcugcuggacugcggcaaugaacuccugcaacagcgcaacauuagacggaaacuucugaccgagguugauuuuaauaagagcgacgccucucuccuggggucccuuuggcgcuacagacccgacagccuggauggaccuauggagggcgacucuugucccacaggcaacuccaugaaagaacucaauuucagccaucugccuucuaacagcgugucccccggggauugccugcucacgaccacacugggaaagaccggcuuuagcgcuacacggaaaaaucuuuucgagcgcccgcuguuuaacacccaccuccagaagucuuucgucuccagcaauugggccgaaacgccuagacuggggaagaaaaacgaguccucuuauuuucccggaaaugugcugaccagcacagcgguuaaggaccagaacaaacacaccgccuccaucaaugaucuugagcgggaaacacaaccuucuuacgacaucgauaacuucgacauugaugacuuugaugacgaugacgacugggaggauaucaugcauaaccucgcugccagcaaguccucuaccgcugccuaucagcccauuaaagaaggcagaccuaucaagagcguguccgagcgccugagcucugccaaaacggacugucugcccgucuccagcacagcucagaauauuaacuucucugaauccauccagaauuacaccgauaagagcgcgcaaaaccucgccucucggaaucugaagcacgagagauuucagucccuuagcuucccgcacacaaaagagaugaugaagaucuuucauaaaaaguucgggcugcacaacuuccgcaccaaucagcucgaagcuauuaacgccgcccugcugggagaggacugcuuuauccuuaugccuaccggcggcgggaaaucccucuguuaucagcugcccgcuugcgugagccccggagucacagugguuauuucuccucugcggagccucaucguggaucaaguccagaagcugacgucccuugacauuccggccaccuaccugacaggcgauaagaccgacucugaagcgacaaauaucuaccuccagcugagcaaaaaggaucccaucauuaaacugcuuuaugugaccccugagaagaucugcgcuuccaacagacucauuucuacgcuggaaaaucuguacgagcgcaaacuccuggcccgguucguuaucgacgaggcccauugugugagccaaugggggcacgauuuuagacaggacuauaagcgcaugaacaugcuucggcagaaguuccccuccgucccugugauggcucugacagccaccgcuaaucccagagugcagaaagacauucucacccaacugaagauccugcgcccucagguuuuuagcaugagcuucaaccggcauaaucuuaaauacuauguccuccccaagaaaccgaagaagguggccuuugauugccuggaauggauuagaaaacaccacccuuacgacuccggaaucaucuauugucugagccggcgcgagugcgauacaauggcggacacccuccagagagauggccuggccgcucuugccuaccaugcugggcugucugacuccgcccgggaugaagugcagcaaaaguggauuaaccaggacggaugucaggucaucugcgcgacaauugccuucggcaugggcaucgauaaacccgacgugagauuuguuauucacgcuagccucccuaagucuguggagggguacuaucaggaauccggacgcgccggccgggauggggagaucagccauugucugcuguucuacacguaucacgacgucaccagacuuaaacgccugaucaugauggagaaggauggaaaccaccauacaagagaaacccacuuuaauaaccucuacuccauggugcauuauugcgagaauauuacagaaugucggcgcauccaacugcucgcuuacuucggcgagaacggguuuaaucccgacuucugcaaaaagcacccggacguuucuugugauaacugcugcaagaccaaagacuauaagacgagagaugugaccgacgaugucaaaagcauugugcgguucguucaggagcauuccagcucucagggcaugcgcaauaucaagcacgugggaccuuccggcagauuuacaaugaacaugcuggucgacauuuuccuugggagcaaaucugccaagauccaaagcggaaucuuuggcaagggguccgccuacucucggcacaaugcugaacgccuguucaaaaagcucauucuggauaaaauccuggacgaggaucuuuacauuaacgcgaaugaccaggccaucgcuuaugugaugcugggaaacaaggcccagaccgugcucaauggcaaccugaaagucgauuuuauggaaacagagaauagcuccucuguuaagaagcagaaagcccucguggcuaaggugagccaaagagaagagauggucaaaaagugucugggggagcuuaccgaagugugcaaaucccugggcaagguuuucggagugcauuacuuuaacauuuucaacacagucacccucaagaaacuggccgagagccugucuuccgaccccgaagugcuucugcagaucgauggcguuacggaggacaagcucgaaaaauauggggcggaggugaucagcguccugcagaaguacuccgaguggacaucuccugcugaagacagcucccccggaauuucucucagcuccagccggggccccgggcgcucugccgccgaggaacuggaugaggaaaucccuguguccagccacuauuuugcuucuaaaaccagaaaugagcggaagagaaagaaaaugccggccucccagcgcagcaagcggagaaaaaccgcgucuagcggauccaaggcuaaaggcgggucugccacaugucgcaagauuagcuccaaaaccaagagcuccucuaucauuggcagcuccucugccagccauacgucccaagcuacaucuggagccaacagcaaacuuggcaucauggcucccccuaagcccauuaaucggccuuuccugaagcccuccuacgccuuuagcuga

SEQ ID NO: 66456 - RNA, 1302 nt, Artificial Sequence
  derived and/or modified sequence opt5 from BLNK__Homo_sapiens__NP_001107566
auggacaagcugaacaaaaucaccgugcccgccagccagaagcucagacaacugcagaaaaugguccacgauauuaagaauaacgagggcgggaucaugaauaaaauuaagaaacuuaagguuaaggcuccuccguccgugccccggcgcgacuacgccucugaaagcccugcggaugaggaggaacagugguccgacgauuucgacucugauuaugaaaaccccgacgagcauagcgauuccgagauguacgugaugccugcugaagagaaugccgacgauucuuaugaacccccuccggucgagcaggagacaagacccgugcacccugcccugcccuuugcucggggagaauacaucgacaaccgcagcucccaaagacauagcccucccuucucuaaaacgcucccguccaagccuagcuggcccucugagaaagcccggcugaccuccacacuuccugcucugaccgcccuccagaagccccagguucccccuaagccgaaaggccugcuggaagaugaggcggacuaugugguccccguggaagacaaugaugagaacuacauucacccuacagagagcuccucucccccucccgaaaaggggcgcaauagcggagccugggagaccaaauccccgccucccgcugccccuucuccccucccuagagcuggcaagaaacccacaaccccgcugaagacgaccccuguugccagccagcaaaacgcguccagcgugugcgaagagaaacccauccccgccgaacggcaucgcgggucuucccacagacaggaggcuguccagagcccuguguuuccgcccgcccagaagcaaauccaccagaagccuauuccccuuccucgguucacagagggaggcaaucccaccguggacggcccucugcccucuuuuagcuccaacucuacaaucagcgaacaggaggcugggguccucuguaaaccgugguaugccggagccugcgaucgcaaguccgcugaagaggcgcugcauagaagcaauaaagacggcucuuuccuuauucggaaguccagcgggcacgauucuaaacaaccuuacacccugguuguguuuuucaacaagcgcguguacaauauccccgucagauuuauugaagccacgaagcaguaugcucucggacggaaaaagaacggcgaggaguacuucggguccguggccgaaaucauuagaaaccaucagcacagcccucugguucugaucgacucccagaauaacacaaaagauucuacccgccucaaguaugccgugaaagucagcuga

SEQ ID NO: 66457 - RNA, 288 nt, Artificial Sequence
  derived and/or modified sequence opt5 from BLOC1S2__Homo_sapiens__NP_001269365
augagacugccccgcaagagccucgagguggccaccuccgaagacuacaaacugcuugagaacaugaauaagcugacaucucucaaauaucuggaaaugaaggauaucgcuauuaacaucagccggaaucuuaaagaccugaaccagaaguacgccggccuccaaccuuaucuggaucagauuaaugucaucgaggaacagguugcggcucuggagcaggccgccuacaagcucgacgcuuauuccaaaaagcuggaggccaaauacaagaaacuugaaaagagauga

SEQ ID NO: 66458 - RNA, 609 nt, Artificial Sequence
  derived and/or modified sequence opt5 from BLOC1S3__Homo_sapiens__NP_997715
auggccagccagggcagacggcgcagaccccugcggcgcccugagaccguggucccgggggaagcuacagagacggacuccgaaagaucugccagcuccucugaggaagaggagcucuaccugggacccagcggcccuacccgggggcgccccacaggacuuagaguugcgggcgaagcugccgagaccgauuccgaaccugagcccgagccugaaccgacagccgcuccccgggaccugccuccccucguggugcaacgcgagucugccgaagaggcuugggggaccgaagaggccccugcgcccgccccggcuagaagccugcuucagcugcggcucgccgagucccaggcucgccuggaucacgacgucgccgcggccgugagcggaguuuauagacgggcuggccgcgauguggccgcucuggccucuagacucgccgcugcgcaggccgcuggccuggccgccgcucauuccguccggcuugccagaggggaccugugcgcgcucgcugaacgccuggauaucguggccggaugucggcuucugccugacauuagaggcguucccgggacagagccugaaaaggaucccggaccccgcgccuga

SEQ ID NO: 66459 - RNA, 654 nt, Artificial Sequence
  derived and/or modified sequence opt5 from BLOC1S4__Homo_sapiens__NP_060836
auggagggcagcuucuccgacgggggagcccugcccgaaggccucgcugaggaagccgagccucagggggcggcuuggucuggagauagcggcaccgugucccaaucucacagcuccgccucugggccgugggaagacgagggagccgaggauggcgcucccggcagagaccugccucuucugcggcgcgccgcugccggguacgcggccugccuccugcccggagcuggcgccagaccugaagucgaggcucuugaugccagccuggaagaccuccugacacggguugaugaguuuguggggaugcuggacaugcuccgcggagauuccagccauguggucucugagggcgugcccagaauccacgcgaaggccgcugaaaugcggcgcauuuauuccagaaucgaccggcuggaggccuucguucgcauggucgggggaagaguggcucggauggaagaacaggugacgaaagccgaggccgagcuuggcaccuuuccucgcgcuuucaagaaacugcuccauacaaugaacguuccgagccuguuuucuaaguccgcgcccagcagaccucagcaggccggcuacgaggcucccgugcuuuuccggaccgaagauuauuuuccuuguugcucugagcgcccccaacuguga

SEQ ID NO: 66460 - RNA, 372 nt, Artificial Sequence
  derived and/or modified sequence opt5 from BLOC1S5__Homo_sapiens__NP_001186251
auggagaagagaggccugcgggaaaugcgcgugcucgagaaccugaaaaauaugauccacgaaaccaacgagcauacacuucccaagugcagagacacgaugcgggauagccugucccagguccuccaacgccugcaggccgcuaaugacucuguuuguagacuucagcagcgggaacaagagcgcaaaaagauucacagcgaucaucugguggccuccgagaaacagcacaugcuccagugggacaacuucaugaaggaacagccuaauaagagagcggagguggaugaggaacaucggaaagcuauggagcgccugaaggaacaauacgccgagauggaaaaagaccuggccaaguuuucuaccuucuga

SEQ ID NO: 66461 - RNA, 519 nt, Artificial Sequence
  derived and/or modified sequence opt5 from BLOC1S6__Homo_sapiens__NP_036520
augagcgugcccggcccuuccucuccggacggggcccugaccagacccccuuacugccucgaggcuggagaacccacaccuggccugagcgauacgucccccgacgaggggcuuaucgaagaucugaccauugaggacaaggccgucgaacagcucgcggagggacugcuuucucacuaucugccugaucuccaacggagcaaacaggcucugcaggagcugacacagaaccaaguugugcuccuggacacccuugaacaggagaucuccaaguucaaagaaugucauucuaugcuggauauuaaugcccucuuugccgaggcuaagcacuaccaugccaaacuggugaacauccgcaaggagaugcuuaugcugcacgaaaagacaagcaaacucaagaaaagagcucugaagcugcagcagaaacggcaaaaggaggaacucgagcgcgaacagcagagagagaaggaguucgaacgggagaaacagcugaccgcccgcccggcgaagagaauguga

SEQ ID NO: 66462 - RNA, 891 nt, Artificial Sequence
  derived and/or modified sequence opt5 from BLVRA__Homo_sapiens__XP_011513776
augaacgccgagcccgaaagaaaguucggcguggucguugugggggugggacgggcuggcagcguccgcaugagagaccugcggaauccucacccguccucugccuuucucaaccugaucggguucgugagccgcagagagcuuggauccauugauggcguucagcaaaucucucuggaagacgcgcucagcucccaggagguggaagucgcuuacauuugcucugagagcuccagccaugaggauuauauccggcaguuucugaaugccgggaaacacgugcuuguugaauaccccaugacccugucucucgccgcugcccaggagcugugggaacuggcugagcaaaagggaaaagugcuccaugaggaacacgucgagcugcuuauggaagaguucgccuuucugaagaaagaaguggugggcaaggaccuccugaagggcucccuucuguucacagcggggccucucgaggaggaacgcuuuggauuccccgccuuuagcggcauuucuagacugacguggcuggucucccucuucggggagcugagccuuguuucugcuacccuggaggaacggaaagaagaucaguauaugaagaugacagugugucucgagaccgagaaaaaguccccucugagcuggaucgaagagaaaggacccggccuuaagcgcaacagauaccuguccuuucauuucaagucugggagccucgaaaaugugccuaacgucggagugaauaaaaacaucuuucugaaggaccagaauauuuucguucagaaacugcucggccaauucuccgagaaggaacuggccgcugagaaaaagcggauccuucacugccugggccucgccgaggaaauucagaaauauuguugcagccgcaaguga

SEQ ID NO: 66463 - RNA, 621 nt, Artificial Sequence
  derived and/or modified sequence opt5 from BLVRB__Homo_sapiens__NP_000704
auggccgugaagaaaaucgcuauuuucggcgccaccgggcagacaggacugacgacccucgcgcaagcuguccaggccggcuacgagguuacagugcuggugagagacagcucccggcuucccucugaagggccucgcccggcccacgucgugguuggagaugugcugcaggcugccgacgucgauaagaccguggcuggccaggacgccguuaucgugcuccuggggacaagaaacgaucuuagccccaccacagucauguccgagggagcgcggaauauuguggccgcuaugaaagcccauggcguggacaaggucguugcuugcaccucugccuuucugcucugggauccuacgaaagugcccccucgccugcaagcggugaccgacgaucacaucagaaugcauaagguccugcgggaaagcggccucaaguauguggccguuaugcccccucacauuggggaccagccgcugacaggagcuuacaccgugacacuugauggccgcgggcccuccagagucaucucuaaacaugaccugggacacuucaugcuccggugucugaccacggaugaguaugacggccacagcacauacccuucccaucaguaucaguga

SEQ ID NO: 66464 - RNA, 1203 nt, Artificial Sequence
  derived and/or modified sequence opt5 from BLZF1__Homo_sapiens__NP_003657
augaccacaaagaaccuggagacgaaagugaccgucacaagcucccccaucagaggcgccggggacggaauggaaaccgaggaaccuccgaagucuguugaggugacaagcggcgugcagucccggaaacaccauucucuccaaagccccuggaagaaagcugucccuuccgaaucucccggggugcugcagcuuggaaagaugcugaccgagaaggccauggagguuaaagcggugcgcauucucgucccuaaggcugccaucacacacgauauucccaauaaaaacaccaaggugaaaagccugggccaucacaagggggaguuccuuggacaguccgaaggcguuaucgaaccuaauaaggagcugagcgaggugaaaaacguccucgaaaagcugaaaaauucugagagacggcugcuccaggacaaggaaggccuguccaaccaacuucgcgugcagacggaggugaauagagaacugaaaaagcuccuggucgccagcguuggggaugaccuucaguaccauuuugagcggcuggcucgcgagaaaaaccagcucauucuggaaaaugaggcccugggaagaaacaccgcucaacucucugaacagcuggagcggauguccauccagugcgauguguggcgcagcaaguuccuugccucuagagugauggcggacgaacugacaaauucccgggccgcucuccagcgccaaaacagagaugcccacggcgcuauccaggaccugcuuagcgagcgggagcaguuucgccaagaaaugauugccacccagaagcugcucgaggaacugcuggucucccuccagugggggagagagcagacauauucuccgagcgugcaaccccacuccaccgcggaacuggcccuuacgaaucauaaacuggcuaaggccguuaacagccaccuccugggaaaugugggcaucaacaaccagaaaaagauuccuucuacagucgaguucuguuccacccccgcugagaaaauggccgaaacagugcuucggauccuggauccuguuaccugcaaggagagcucucccgacaauccguuuuucgaaagcuccccuaccacacuccuggccacgaagaaaaacauugggagauuucaucccuacacccgcuaugagaauaucacauucaacuguugcaaucacugucggggagagcugauugcucucuga

SEQ ID NO: 66465 - RNA, 492 nt, Artificial Sequence
  derived and/or modified sequence opt5 from BMF__Homo_sapiens__NP_001003942
auggagcccagccagugcguggaggaacuggaagacgaugucuuccaaccugaggacggcgaaccgguuacccagcccgggucccuccugucugccgaucuuuuugcucagagccugcucgacuguccucuguccagacuucagcuguucccccucacacacugcuguggaccuggccugcggcccacgucucaagaggauaaggccacccagacacugagcccugcguccccgucucagggggugaugcuccccugcggagugaccgaggaaccucagcgccuguuuuacggcaacgcuggguauagacuuccccugccugccagcuuccccgccguccucccgaucggagagcaaccucccgaaggccaguggcagcaucaggcugagcaccaacagaaucagaaccgggugugguggcaaauucugcuuuuucugcauaaucucgcccugaacggcgaggaaaaucgcaacggggcuggaccuagauga

SEQ ID NO: 66466 - RNA, 981 nt, Artificial Sequence
  derived and/or modified sequence opt5 from BMI1__Homo_sapiens__NP_005171
augcacagaaccacacggaucaagauuacggagcugaacccccaucucaugugcgugcuguguggcggguacuucaucgacgccaccacaauuaucgaaugccuucacagcuuuuguaaaaccugcauuguccgcuaucuggagacauccaaguacuguccuaucugcgauguucaggugcauaaaaccagaccgcuccugaauauccggucugacaagacacuucaagauauuguguauaaacugguccccggacucuucaagaacgaaaugaagcgcagacgggacuuuuacgcugcccacccuagcgcggaugcugccaauggcuccaacgaggaccgcggggaaguggccgaugaggacaaaagaaucauuaccgaugacgagaucauuucucugagcaucgaguucuuugaucagaaucggcuggaccgcaagguuaacaaagauaaggagaaauccaaggaagaggugaaugacaagagauaucuccggugucccgcugccaugacggucaugcaucugcgcaaauuccuuagaucuaagauggacauuccuaacaccuuucagaucgaugugauguacgaggaagaaccccugaaagacuauuacacacucauggauaucgcuuacauuuauaccuggcggcgcaauggaccucugccgcuuaaguacagaguucggcccacaugcaaaagaaugaagaucagccaccagcgcgacggccugaccaacgccggggaacucgaguccgauagcggaucugacaaagccaauuccccugcgggcggcauucccagcacgucuuccugucugccuagccccucuacaccggugcaauccccucacccccaguucccucauaucagcuccaccaugaacgggacaucuaauagccccuccggaaaccaccagagcucuuuugcuaaucggcccagaaaguccagcgucaacggcucuagcgccaccuccucuggguga

SEQ ID NO: 66467 - RNA, 1275 nt, Artificial Sequence
  derived and/or modified sequence opt5 from BMP10__Homo_sapiens__NP_055297
augggcagccuggugcucacccugugcgcccuuuucugucuggcugccuaccucgucuccgggucucccaucaugaaccuggagcagagcccucuugaagaggacaugucccuguuuggagauguuuucucugaacaagacggcguggauuuuaauacacuccugcagagcaugaaggacgaguuccugaaaacgcucaaccuguccgauauuccgacccaggacucugcgaagguggaucccccugaauauaugcuugagcuguacaauaaauuugcuacagacagaaccagcaugcccuccgccaacaucauucggagcuucaagaaugaggaucucuuuucucagccugucuccuucaacgggcugcgcaaauauccccuucuguuuaaugugagcaucccucaccaugaagagguuauuauggccgaacucagacuguacacacuggugcaacgggaccgcaugaucuaugauggagucgacagaaagaucaccauuuucgaggugcucgagucuaagggcgauaacgaaggggagcggaauaugcugguucuuguguccggagaaaucuacggcacaaacagcgagugggaaaccuuugacgucacggacgcuauucgcagauggcagaaaucuggcuccagcacccaccagcuggaggugcauaucgaguccaagcacgaugaagccgaggacgcuucuagcgggcggcucgaaauugauacauccgcccagaauaaacauaacccgcugcuuaucguguucagcgacgaucaaucuuccgacaaggagcgcaaagaggaacugaaugagaugauuagccacgaacagcuccccgagcuggauaaccugggacucgacucuuuuagcuccggcccuggggaagaggcgcugcuucagaugagaucuaauaucaucuaugauagcaccgcccggauucgcagaaacgcuaagggaaacuacugcaagcggacaccccuguacaucgacuucaaagaaauuggcugggauuccuggaucauugccccucccggguaugaggcuuacgagugucgcggagucugcaauuauccgcucgccgaacaccugaccccuacgaagcaugcgaucauccaggcccuuguucaccugaaaaacagccaaaaggcuucuaaagccuguugcgugcccacaaagcucgagccuauuuccauccuguaccuggacaaaggcguggucaccuauaaguucaaguacgaaggcauggcugugagcgagugugggugcagauga

SEQ ID NO: 66468 - RNA, 1179 nt, Artificial Sequence
  derived and/or modified sequence opt5 from BMP15__Homo_sapiens__NP_005439
auggugcugcucagcauccugcggauucuuuuccugugcgagcucguccuguuuauggaacacagagcccagauggcugagggcgggcaauccucuaucgcccuucuggcggaagcucccacccucccucugauugaggaacugcucgaggagagcccgggagaacagccccgcaagccuagacugcuuggccauucccugcgguacaugcucgagcuguaucgcagaucugccgacagccacgggcauccccgggaaaaccgcacaaucggagccacgaugguuagacuugugaaaccucugaccaauguggcucggccccaccgcggcacauggcauauucagauccucggguucccucugagaccgaaccggggacuguaccagcucguccgcgccaccgugguuuauagacaccaucugcaacuuacacgguuuaaucuguccugucacguggagcccuggguccagaagaacccuaccaaucacuuccccucuagcgagggcgauuccagcaaaccuucucucauguccaacgcuuggaaggaaauggacaucacacagcuggugcagcaacgcuuuuggaauaacaaaggccaucggauucuuagacugagauucaugugccagcagcagaaggauagcgggggacucgagcuguggcacggcaccucuucccuggacaucgccuuucuccugcuuuacuucaaugauacgcacaagagcauucgcaaagcgaaguuucugccccgggggauggaagaguucauggaaagagagucucuccugcgccggaccagacaagccgacggaaucuccgcugagguuacagccagcuccucuaaacauagcggcccggaaaacaaucaguguucccuucacccuuuucagauuagcuuccgccaacuggggugggaucauuggaucauugcucccccuuuuuauacccccaacuacugcaagggaacaugucuccgggugcugagagacggccucaauucucccaaccacgccaucauccagaaucugauuaaccagcuggucgaucaguccgugccucgcccgagcugcgugcccuauaaauacgucccuaucucuguucuuaugauugaggcgaacggcagcauccuguacaaggaauaugaggggaugauugccgaauccuguaccugccgguga

SEQ ID NO: 66469 - RNA, 2193 nt, Artificial Sequence
  derived and/or modified sequence opt5 from BMP1__Homo_sapiens__NP_001190
augcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacaccgcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugaaaaacggcccgcccuccagccuccccgcggcagaccucaucaacugaaguuucgggugcagaaaagaaaccgcacaccccaguga

SEQ ID NO: 66470 - RNA, 1191 nt, Artificial Sequence
  derived and/or modified sequence opt5 from BMP2__Homo_sapiens__NP_001191
augguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcuga

SEQ ID NO: 66471 - RNA, 1989 nt, Artificial Sequence
  derived and/or modified sequence opt5 from BMP2K__Homo_sapiens__NP_060063
augaagaaauucagcagaaugcccaaguccgaaggcgggucuggaggcggggccgcuggaggcggggccggaggcgcgggcgcuggggccggaugcggcagcgggggauccucugugggcguccggguuuuugccguggggcgccaccaggugacccuggaagagagccucgcugaaggaggcuucuccacagucuuucuggugagaacgcauggcgggauccggugugcccuuaaacgcauguacguuaacaauaugccugaccugaacgugugcaagagagagauuaccaucaugaaagaacucucuggacacaagaauauugucggcuaucuggauugugcugugaacagcaucuccgacaauguuugggaggugcuuauucugauggaguacugccgggccgggcaagucgugaaccagaugaauaagaaacuccagacaggauucaccgaaccggaggugcugcagaucuuuugugauacaugcgaagcggucgcccgccugcaucaauguaagacccccaucauucacagagaccucaaaguugagaacauccugcuuaaugauggcgggaacuaugugcugugcgacuucggaagcgcuacaaauaaguuucucaacccucagaaagauggcgugaaugucguggaggaagagauuaagaaguacaccacgcugucuuaucgggcccccgaaaugaucaaccuuuacggcgggaaaccuauuaccacaaaggcugacaucugggcccugggaugucuccuguauaaacugugcuucuuuacccuccccuucggcgagucccagguugcgauuugugaugggaauuuuacaaucccugacaacagccgcuacucuagaaacauccauugccugauucgguucaugcuugaaccggaucccgagcaccgcccugacaucuuucagguguccuacuucgccuucaaguuugcuaaaaaggauugccccgucagcaauauuaacaauucuuccaucccuagcgcccugcccgagccgaugaccgcuuccgaagccgccgcuagaaaaucucaaauuaaggcgcggaucacggacacaaucggaccuaccgagacaagcauugcuccccgccagagaccuaaggccaacuccgccaccaccgccacacccagcgugcucacgauccagucuuccgcuacccccguuaaagugcuggccccuggcgaguucgggaaucaccggccgaagggcgcgcuuagacccggaaacggcccugagauucugcucgggcagggacccccucaacagcccccgcagcaacaucgcguccugcagcagcugcagcaaggcgacuggcggcuccagcagcugcaccuucagcauagacacccucaccaacagcagcagcaacagcagcagcaacagcagcaacagcagcagcaacagcagcagcaacagcagcagcaacagcagcaacaucaccaucaccaucaccaccaucugcuccaggaugcuuauaugcagcaguaccaacacgccacacagcagcagcaaaugcugcagcagcaguuucuuaugcauagcguguaucaaccccagccuucugccagccaguaccccaccaugaugccucaguaucaacaggcuuucuuucagcaacagaugcuggcccagcaccagcccucccaacagcaggcuucuccggaauaccucacaagcccucaggaguucucccccgcccuggucagcuauaccucuucccugcccgcgcaaguggggacgaucauggacagcucuuacuccgccaaucgcagcguugcugauaaagaggccauugcuaacuuuacaaaucagaagaacaucuccaauccuccggacaugucuggauggaaccccuucggcgaagauaauuuuagcaaacucaccgaggaagaacugcuugaccgggaguucgaucugcucagauccucuaaggggcaccugaaggccuacuuugcgagccaguga

SEQ ID NO: 66472 - RNA, 1320 nt, Artificial Sequence
  derived and/or modified sequence opt5 from BMP3__Homo_sapiens__XP_006714354
auggccggagcuagcagacuccuguuccuguggcuugggugcuuuugugugucccuggcccagggagagcggcccaagccuccguuccccgaacuccgcaaagcggucccuggcgacagaaccgcugggggaggccccgauucugagcugcaaccucaggacaagguuagcgaacacaugcuucggcuguacgaucgcuauuccacagugcaggccgccagaacgcccgggucucucgagggaggcagccagccuuggcggccgcgccugcugagagaaggcaacaccgugcgguccuuucgcgcugccgcugccgagacacucgagagaaaagggcuguacaucuucaaucuuaccucucugacaaagagcgaaaacauucucuccgcgacccuguauuuuugcaucggagagcuuggcaauauuagccugucuugucccgucuccgggggaugcagccaucacgcccaacggaaacauauccagauugaccucucugcuuggacacugaaguucucccgcaaccagagccagcugcucggccaccugucuguggauauggccaagucccauagagacaucaugagcuggcuuuccaaagauaucacccaacugcuccggaaggcuaaagaaaaugaggaguuucugauuggguucaacaucacgucuaagggacgccagcuuccuaaaagacggcugcccuuuccugaacccuacauucucguuuaugccaaugacgcggccaucagcgagccggaauccguggucagcucucugcagggccacagaaacuucccuaccggcacagugcccaagugggauucccacauucgcgcugcccugagcaucgagcggagaaagaaacgcucuaccgggguucuccugccucuucagaauaacgaacugcccggagcugaguaccaauauaagaaagacgaggugugggaggaacggaagcccuacaaaacacuccaggcccaggccccugaaaagagcaaaaauaagaagaaacaaagaaagggcccgcaucgcaaaucccagacccugcaguuugaugagcagacgcuuaagaaagcucggagaaagcaauggauugaaccccgcaacugugcgcggagauaccugaagucucucaaaccuagcaaucacgccacaauccaguccaucguccgcgcugugggggugguccccggcauuccugagcccugcuguguuccggagaagaugagcucucuguccauccuguucuuugacgaaaacaaaaauguggugcucaaggucuauccuaacaugaccguggagagcugcgccugucgguga

SEQ ID NO: 66473 - RNA, 1227 nt, Artificial Sequence
  derived and/or modified sequence opt5 from BMP4__Homo_sapiens__NP_001193
augauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucgguga

SEQ ID NO: 66474 - RNA, 1365 nt, Artificial Sequence
  derived and/or modified sequence opt5 from BMP5__Homo_sapiens__NP_066551
augcaccugaccguguuccuccugaagggcaucgucggguuucuuuggagcugcuggguucuggugggauacgccaaaggcgggcucggagacaaccaugugcacuccucuuucauuuauagacggcugcgcaaucaugagagacgggaaauccagcgcgagauucuuagcauccugggccucccccacagaccucggccguuuucccccgggaagcaggcuucuagcgccccucuguucaugcuggaucucuacaacgcgaugacaaaugaagagaaccccgaagaguccgaguauucuguccgcgcuagccuggccgaagagacgagaggagcccggaaaggcuacccugcuucccccaauggcuauccucgccggauucaacuuagcagaaccacaccgcugaccacacagucucccccucucgccucccugcaugacaccaacuuucuuaaugaugcugacauggugaugagcuucguuaaccugguggaacgcgauaaggacuuuucucaccagagacggcacuacaaagaguuccgcuuugaucucacacaaaucccccauggggaggccgucaccgcggccgaguucagaaucuauaaggaccgguccaauaacagauuugaaaaugaaacgauuaagaucagcauuuaccagaucauuaaagaguacaccaaccgcgaugcugaccuguuccugcucgauacacggaaggcccaggcucuggacgugggauggcuuguuuuugauaucaccgugacaucuaaucacugggucauuaacccucagaauaaccugggccuccaacugugugccgaaaccggggacggaagauccaucaacgugaaaagcgcgggccuuguggggcgccagggaccccaguccaagcagccguucauggucgccuucuuuaaggcuucugagguucugcuccggagcgugagagccgcuaauaaacgcaagaaccaaaaucggaacaaauccagcucucaucaggacuccagcagaaugucuagcgugggcgauuauaauacguccgagcagaagcaagccugcaaaaagcacgaacuguacgucucuuuccgcgaccugggcuggcaggauuggaucauugccccugagggguaugcugcguuuuacugugacggagaaugcagcuucccccucaacgcccacaugaaugcuacaaaccaugccaucgugcagacccugguucaccuuauguuuccugaucaugugcccaaacccuguugcgccccuacaaagcugaaugcuauuuccguccucuauuucgacgauagcucuaacgugauccugaaaaaguaccggaauaugguugugagauccuguggcugccacuga

SEQ ID NO: 66475 - RNA, 1542 nt, Artificial Sequence
  derived and/or modified sequence opt5 from BMP6__Homo_sapiens__NP_001709
augcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacuga

SEQ ID NO: 66476 - RNA, 1296 nt, Artificial Sequence
  derived and/or modified sequence opt5 from BMP7__Homo_sapiens__NP_001710
augcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauuga

SEQ ID NO: 66477 - RNA, 837 nt, Artificial Sequence
  derived and/or modified sequence opt5 from BMP8B__Homo_sapiens__XP_011540326
augaccgcccugcccggcccucucuggcugcuugggcuggcucucugcgcccugggaggcgggggaccgggccuuagacccccucccggguguccucagcggcgccugggagcgagagagcggcgcgacgugcaaagagaaauccucgcuguccugggccugcccggccggccucgcccgagagcucccccugccgccagccggcuccccgccuccgcuccucuguucaugcuugaucuguaccacgccauggcgggggacgaugacgaggauggagcccccgcugaacgcagacucggccgggccgaccugguuaugucuuuugugaacaugguggagcgcgauagagcucuugggcaucaggaaccgcacuggaaggaguuccgguuugaccugacacagauuccugccggagaggcggucacggccgcugaguuccgcaucuauaaagugcccagcauucaucuccugaauagaacccugcacguuuccauguuucaggugguccaagaacagucuaaccgggaaagcgaucucuucuuucuggaccuucagacacugagagccggcgaugagggguggcucgugcuggacguuaccgcugccuccgauugcuggcuucugaagcgccauaaagaccucggacugcggcuguacguggagacagaagacggcgagaccuggacaggcuggggguggaccaaggauucuagacuccagauguggaaacugcgccuuagccggacgccuuggguccugucccuccacgcccccggacccgcucaagcgccugccgaaagaccgcugcuuugucugcuccagggccacugccccuga

SEQ ID NO: 66478 - RNA, 2058 nt, Artificial Sequence
  derived and/or modified sequence opt5 from BMPER__Homo_sapiens__NP_597725
augcugugguucagcggcgugggggcccucgcugagagauacugccggcgcucccccggaaucaccuguugcguccugcuucugcucaacuguucuggcguuccuaugagccuggccuccucuuuucuuacagggagcguggcgaagugcgaaaaugagggagaagugcugcagauuccguucaucacggacaaccccuguauuaugugcgucugucucaauaaagaggugaccugcaagagagaaaaauguccuguucugucccgggauugcgcucuggccaucaagcaacgcggcgccuguugcgagcagugcaaaggguguacauaugagggaaacaccuacaauucuagcuuuaaguggcagucccccgcugaaccuugcgugcucagacagugucaagagggcgucgugacagaaagcggcguucggugcgugguccacuguaagaacccccuggagcaucuugggaugugcuguccuaccugcccgggauguguguucgagggcgugcaguaucaggaaggggaggaauuucagcccgagggaucuaaaugcacaaaguguuccugcaccggcgggcgcacgcaaugcgucagagaaguuuguccuauucugagcugcccccagcaccucucucauaucccucccggacaguguugcccgaaaugucugggccagcggaagguguucgaccuuccuuuuggcuccugccuguuccgcagcgauguguacgacaaugggucuuccuuucucuaugauaacuguaccgccugcacauguagagacagcaccgucgugugcaaacggaaguguucccaccccggaggcugcgaucaagggcaggagggaugcugugaggaaugccugcugcgcguuccucccgaggacaucaagguguguaaauucggcaauaagauuuuucaggauggggaaauguggucuagcaucaacugcacaauuugugcuugcgucaaaggaagaaccgagugucggaauaagcaaugcauccccauuuccagcuguccucagggcaaaauccucaaccgcaagggcugcuguccgauuugcacggaaaaacccggggugugcacaguuuucggagacccucauuacaauaccuuugauggcagaacauucaacuuccaggggaccugucaguaugugcugaccaaggacuguucuucccccgccagcccuuuucaaguccuugugaagaaugaugcgcggagaacacgcucuuucagcuggacgaaauccgucgagcuggugcucggagagucucggguuagccugcagcagcaccuuaccgugagauggaacggcucccgcaucgcccugcccugccgggcuccgcacuuucauaucgaccucgacggguaccugcugaaggucacaaccaaagccggccucgaaauuagcugggauggagacucuuucguggagguuauggcugccccucaccugaagggcaaacuuugcgggcuguguggaaacuacaauggccauaagagagaugaccucaucgggggagauggcaacuuuaaguucgacguggaugacuuugcggaauccuggcgcgucgagagcaaugaguucugcaaccggccccagagaaaaccugugcccgaacugugucaagggacagugaagguuaaacuucgcgcccaccgggagugccagaagcugaaaucuugggaauuucagaccugucacuccacggucgauuaugcuacauucuacagaagcugcgugaccgacaugugugagugcccugugcauaagaauugcuauugugaauccuuucucgccuacacccgcgcuugccagcgggagggcauuaagguccacugggagccccaacagaacugugccgccacacagugcaaacauggagcuguguaugauaccuguggcccggggugcaucaagacaugugacaauuggaacgaaauuggaccuugcaauaaacccuguguugcgggcugccacugucccgccaaccuggugcugcauaaggggagaugcaucaaaccuguccucugcccgcagcgguga

SEQ ID NO: 66479 - RNA, 1599 nt, Artificial Sequence
  derived and/or modified sequence opt5 from BMPR1A__Homo_sapiens__NP_004320
augccccagcuguacaucuauauuagacuccugggcgccuaccuuuucaucauuagccgggugcaagggcagaaccuggacuccaugcuccacggaaccggcaugaagucugauagcgaccagaaaaaguccgagaauggggucacacuggcuccugaagauacgcuuccguuucugaaaugcuauuguucuggacauugccccgacgaugccaucaacaauaccuguauuacaaacggccacugcuucgcgaucaucgaggaagacgaucagggggagaccacacucgcuagcggauguaugaaguacgaaggcuccgacuuucaaugcaaagauucuccuaaggcccagcugcgcagaaccauugaguguugccggacaaaucuguguaaccaguaucuccagcccacccugccucccguugugaucggcccuuucuuugacgggagcauucgcuggcuugugcugcucaucuccauggccgucugcauuaucgcuaugauuaucuucagcucuuguuuuugcuacaagcauuauugcaaauccaucagcucuagacggcgcuacaauagagaucuggagcaagacgaagccuucauuccggugggagagucccuuaaggaucugaucgaccagagccagucuuccggcagcggguccggacucccccugcugguucagcggacgauugcuaaacaaauccagauggugcgccaggucggcaaggggagauacggagaaguguggaugggcaaauggcggggcgagaagguugccgugaaggucuuuuucaccacagaggaagcgucuugguuucgcgagaccgaaauuuaucaaacagugcucaugagacacgagaacauccugggguucaucgccgcugacauuaaaggaaccggcagcuggacgcagcuuuaccugaucacagauuaucaugaaaaugggucccucuacgacuuucugaagugugccacccuugauacacgggcucugcucaaacuggccuauagcgcggccugcggacugugucaccuccacaccgagauuuacggcacccaggggaagccugcuaucgcccaucgcgaccugaaaucuaagaacauucuuaucaaaaagaauggauccugcuguaucgcugaucugggccucgccgugaaguucaacagcgacacaaaugaggucgauguuccccugaacacgagagugggcaccaaacgguauauggccccugaagugcuugacgagucucugaauaagaaccacuuccagcccuacauuauggcugauaucuacagcuuugggcucauuaucugggaaauggcgagacgcugcauuacaggaggcaucgucgaggaauaucaacugccguacuauaacauggugccuuccgaccccucuuacgaggauaugcgggagguugugugugucaaaagacugcgcccuauugugagcaaucgguggaacuccgacgaaugccucagagccguucugaaacuuaugagcgaguguugggcucauaaucccgccucucgccugaccgcccuccggaucaagaagacacuggcuaagaugguggaaucccaggacgucaaaaucuga

SEQ ID NO: 66480 - RNA, 1509 nt, Artificial Sequence
  derived and/or modified sequence opt5 from BMPR1B__Homo_sapiens__NP_001243721
augcugcucagaagcgccggcaagcugaacguggggaccaaaaaggaggacggagaauccacagcucccacgccucggccgaaaguccuucgcugcaagugucaccaucacugccccgaggauucuguuaauaacaucuguagcaccgacggcuacugcuucacaaugauugaagaggaugacuccgggcugccuguggugaccucuggaugucucggccuggaagggagcgauuuucagugcagagacacacccaucccucaucaacggcgcuccauugaguguugcaccgagagaaaugaauguaacaaagaucuucaccccacacugccuccgcucaagaaucgggacuucgucgauggacccauccaucaccgcgcccugcugauuucugugaccguuugcagccuccugcuugugcugaucauccucuuuuguuauuucagauacaagcggcaggagacgcgcccuagauauuccauuggccuggaacaggacgagaccuacauucccccuggcgagagccuucgggaucugaucgaacagucucaauccagcgggucuggauccggccucccccugcugguccagcgcacaaucgcgaaacagauucagauggugaagcaaaucgggaaaggaagauauggcgagguuuggauggggaaguggcggggagaaaaaguggcugucaagguguuuuucaccacagaggaagccagcugguuucgcgagaccgagauuuaccagacggugcucaugagacacgaaaacauccugggcuucaucgccgcugacauuaagggcacagggucuuggacccagcuuuaucugaucacagauuaccaugagaauggaucccucuacgacuaucugaaaagcaccacccuugacgccaaguccaugcugaaacucgcuuacucuagcgucuccggccugugccaucugcacacagaaauuuuuagcacgcaggggaagccggccaucgcgcaccgggaucucaaaucuaagaacauucugguuaaaaagaauggaaccugcuguaucgccgaccuuggccuggcugugaaguucaucuccgauacaaacgagguggacauuccucccaauaccagagucgggacaaaacgcuauaugccucccgaagugcucgaugagagccugaaccggaaucacuuucaaucuuacaucauggccgacauguauagcuucggacuuauucugugggagguugcuagacgcugcguguccggcggcaucgucgaagaguaccagcuccccuaucaugaucuggugccuucugacccgagcuacgaagauaugcgggagauuguuuguaucaagaaacugagacccuccuuuccuaaccgcuggagcucugacgaaugccuccggcagauggggaagcugaugaccgaguguugggcccacaaucccgcguccagacuuacggcccugcgcgugaaaaagacacucgcuaagaugagcgagucucaagauaucaaacuguga

SEQ ID NO: 66481 - RNA, 3117 nt, Artificial Sequence
  derived and/or modified sequence opt5 from BMPR2__Homo_sapiens__NP_001195
augaccagcucccugcagagacccuggcgggugccuuggcucccguggacaauccugcuugucucuacggccgcugccagccaaaaccaggagcgccugugcgcguucaaggaccccuaccagcaggaucucggcauuggggaauccagaaucucucacgagaauggaaccauucuguguagcaaaggcuccacaugcuaugggcuuugggaaaagucuaaaggagacaucaaccugguuaagcaaggcuguuggagccauauuggggauccucaggagugccacuacgaagaguguguggugaccacaacacccccuuccauccagaauggaaccuaucgguuuugcuguugcagcaccgaccucuguaacgucaauuucacggagaacuuucccccuccggauaccacaccccugucuccuccccauuccuucaaucgcgacgaaaccaucauuaucgcucuggccagcgugucuguucucgccgugcugauugucgcucuuugcuuuggcuacagaaugcugacaggcgaucggaaacaggggcuccacuccaugaacaugauggaggccgcugccagcgaaccuucucuggaccuugauaaucugaagcuccuggagcugaucggacgcggcagauauggggcgguguacaagggaucccucgacgagcggcccguugccgugaaagucuucagcuuugcuaaccgccaaaauuucauuaacgaaaagaauaucuauagagugccgcugauggagcaugauaacauugcccgguuuaucgugggcgacgaacgcgucaccgcugaugggagaauggaguaccuucugguuauggaauacuauccuaauggaucccucuguaaauaccugucucuucacacgagcgacuggguguccagcugccggcuggcccacucugugacacgcggccucgcguaucugcauaccgagcugcccagaggcgaccacuacaagccugccaucucccaucgggaucucaacagcagaaacguccuggugaaaaaugacgggacaugcguuauuucugauuucggacuuagcaugcgccugaccggcaaccggcucgugagacccggggaggaagacaaugcugccaucuccgaggucggaaccauucgcuauauggcucccgaagugcuggagggcgccguuaaccuucgggauugugaaucugcccugaaacagguggacauguacgcucucgggcugaucuauugggagauuuuuaugagaugcacagaucuguucccuggagagagcgucccggaauaccagauggcguuucagacggaggugggcaaucaccccaccuucgaagacaugcaaguccucgugucccgcgagaagcagcggccuaaauuccccgaagccuggaaggagaacagccuggcuguuagaucucuuaaagagacaaucgaagauuguugggaccaggaugccgaggcccgccugaccgcucaaugcgccgaggagcggauggcggagcucaugaugaucugggaaagaaauaaguccgugagcccuacagucaaccccaugucuaccgcuaugcagaaugagcgcaaccugucccacaaucggagagugccgaaaauuggcccuuaccccgacuauagcuccucuagcuacaucgaagacuccauucaucacacggauucuaucguuaagaacauuagcuccgagcauagcaugucuuccacaccucugaccaucggggaaaagaaucggaacagcaucaauuaugagcgccagcaggcccaagcccggauucccucuccugagaccuccgugacaagccuuucuaccaacacaacgaccacaaacaccacaggacucacccccagcacgggcaugaccacaaucuccgaaaugccguacccugacgagaccaaucugcacacaaccaacgucgcucagagcauugggcccacgcccgugugucugcagcucacagaagaggaucuggaaaccaauaaacuugacccuaaggagguggauaagaaccugaaggagucuuccgacgaaaaucucauggagcauagccugaaacaguuuuccggaccggauccccugucuagcacauccucuagccuucucuauccucugaucaagcuggccguugaagcuaccggccaacaggacuucacccagacagccaacgggcaggcgugccucauucccgauguccugccuacgcaaaucuacccccuuccuaaacagcagaaucugcccaagagaccgaccucccucccucugaacacaaagaacucuaccaaagagcccagacugaaguuuggcagcaaacacaaguccaaucuuaaacagguggaaacaggaguggccaagaugaauaccauuaacgcugccgagccucacgucgugacgguuacaaugaauggcguggcugggcgcaaccauagcgucaauucucacgccgcgaccacccaauaugccaacggaacagugcucuccggccagaccacaaacaucguuacgcaucgggcucaggagaugcugcaaaaucaguucaucggggaagacaccagacugaacauuaauagcucucccgaugagcacgaaccgcuccugcgcagagagcagcaggccggacacgacgagggcgugcuugaucggcuggucgaccgcagagaacggccucucgaagggggccgcacaaacuccaauaacaauaacagcaaucccuguucugaacaagacgugcuggcucagggaguuccuuccaccgccgccgaucccggccccagcaagccuagacgggcucagcgcccgaacucccuggaccuuagcgcgacaaaugugcucgaugggucuagcauccagauuggagaguccacccaagacggcaaaucugggagcggagaaaagaucaaaaagagagucaaaacgcccuacucccugaagcgguggcgcccuucuaccugggugauuagcacagagucccuggauugcgaggugaacaauaacggcucuaauagagccguccauagcaaguccagcaccgcuguuuaccucgccgaagggggcacagccaccacaauggugucuaaagacaucggaaugaacugucuguga

SEQ ID NO: 66482 - RNA, 3849 nt, Artificial Sequence
  derived and/or modified sequence opt5 from BMS1__Homo_sapiens__NP_055568
auggaggccaaggaccagaaaaagcaccggaaaaagaacagcggccccaaagcugccaagaagaaaaagagacugcuccaagaucugcagcuuggggacgaagaggaugcgcgcaaaagaaauccuaaggcuuucgccgugcaguccgccguccggauggcucgcucuuuucauagaacccaggaccugaaaacaaagaagcaccauaucccgguuguggaucggacgccccucgaaccucccccuauuguggucgugguuaugggacccccuaaagugggcaagagcacccugauccaaugccuuauucgcaacuucacaagacagaaacugaccgagauccgggggccggucacaauuguguccggaaagaaacgcagacucaccaucaucgaauguggcugcgacauuaauaugaugaucgaucuggccaagguugcugaccuggugcucaugcugauugaugccucuuuuggguucgagauggagacauuugaguuccuuaacaucugucagguccacggauuucccaaaauuaugggcgugcugacccaucucgacagcuucaagcacaauaagcagcugaaaaagacgaaaaagcggcuuaaacaccgcuuuuggaccgaaguguacccuggcgcgaagcuguucuaucucuccgggaugguccauggagaauaccaaaaccaggagauccacaaucugggcagauuuauuacaguuaugaaguuccggccccugaccuggcagacaucucauccuuauauccucgccgaucgcauggaggaccugaccaaccccgaagauaucagaacgaauauuaaaugcgaccggaaggugagccuuuacggguaucugagaggagcucaccucaaaaacaagucccagauccacaugccgggcgugggggacuuugccgucagcgauauuucuuuccugccugaccccugugcccuuccugagcaacagaaaaagcgcugccugaaugaaaaggagaaacucguguacgcuccccuguccggaguuggcggcgugcuguaugauaaggacgcggucuacguggaucucgggggaagccauguuuuccaggacgaagugggccccacacacgagcugguccaaucucuuaucuccacccauagcacaauugaugccaaaauggcuucuucccgggugacccuguuuagcgacuccaagccucucgggucugaggauaucgacaaccagggacugaugaugccgaaagaagagaagcagauggaucuuaauaccggcagaaugcgccggaaggccaucuucggggacgaagacgagagcggagauuccgacgaugaagaggacgaugagaugagcgaagacgauggccuggagaacgggucuuccgacgaagaggcugaagaggaggaaaaugccgagaugacagaucaguacauggccgucaaaggcauuaagagacgcaaacucgaacuggaggaggacagcgaaauggaucugcccgcuuuugcggacucugaugacgaccucgagcggagcuccgccgaagagggagaagcugaggaggccgaugaaucuagcgaggaagaggacuguacggccggcgaaaaggggaucuccggaagcaaagcugccggcgaggggucuaaggcgggccuguccccugcuaacugccaaagcgauagagugaaccuugagaaaucucugcucaugaagaaggccgcccugcccaccuucgacuccggacacuguacagcugaagagguuuuugccagcgaagaugaguccgaagagucuagcucccugucugcugaggaagaggacagcgaaaaugaggaggccauucgcaaaaagcuguccaaaccuagccaggugucuuccggccagaagcucgggccccagaacuucaucgaugaaaccagcgacauugagaaucugcugaaagaagaggaagauuauaaggaggagaacaaugacucuaaggaaacauccggagcgcucaaauggaaggaggaucugagccggaaagccgcugaagccuuucuuagacaacagcaggcugccccgaaccugcgcaagcucaucuacggcaccgucacggaggacaaugaagaggaggaugacgacacacuggaggaacuugggggacuuuuccgggugaaccagccugauagagaaugcaaacauaaggcggacucucucgauuguagccgguuucugguugaggcuccccacgacugggaucuggaagaggugaugaacuccauccgcgacugcuucgucaccggcaagugggaggaugacaaagaugccgccaaggugcucgcugaagacgaggaacuguauggggauuuugaggaccuugagaccggcgacgugcacaaaggaaagagcggcccuaauacacaaaaugaagauauugagaaagaaguuaaggaggaaaucgaccccgaugaggaggaaucugccaagaaaaagcaucuggacaaaaagagaaaacucaaggagauguucgaugccgaauacgacgagggggaauccaccuauuuugaugaccugaaaggagagaugcagaagcaggcucagcugaaccgggcggaguucgaagaucaagacgaugaggccagaguccaguacgaaggcuuccgcccugggauguaugugcggauugagaucgaaaaugugcccugcgaguuuguccagaacuucgacccgcacuacccuauuauccuuggaggccucgggaauagcgagggcaacgugggauacguucaaaugagacugaagaaacaucgcugguauaagaaaauucugaaguccagagaucccaucaucuuuucugugggcuggcggcgcuuccagacaauuccccucuacuauaucgaagaccacaacgggagacagcggcugcuuaaauacacgccucagcacaugcauuguggagcugccuuuuggggcccgauuacaccccaagggaccggauuccuggccauccagagcgucuccggcauuaugccugacuuucgcaucgcugccaccggggugguucucgaucuggacaagucuaucaagauugugaaaaagcugaaacuuacaggcuuccccuauaagaucuuuaaaaauaccagcuucauuaagggaauguuuaacuccgcgcucgaggucgcuaaguucgaaggcgccgugaucagaacgguuucugggauucggggacagaucaaaaaggcccugcgcgcuccugagggcgccuuuagagcgagcuucgaggauaaacugcucauguccgacaucguguucaugcggaccugguaccccgucagcauuccugcuuuuuauaaucccgugacaucucugcuuaagccggugggggaaaaagauaccugguccggaaugcgcacaaccggccagcugagacucgcccacggcguccggcugaaggccaacaaggacagccuguacaaaccuauccuuagacaaaagaaacauuucaauucucugcacauucccaaggcucuccagaaagcccugccuuuuaagaacaagcccaaaacgcaggcuaaggccgggaaaguuccgaaggaucgccggagaccugcggugauccgcgagccccaugaacggaaaauucucgcccugcuugacgcucuguccacagugcacagccagaagaugaaaaaggccaaggagcaaagacaccuccauaauaaagaacacuuccgcgcuaagcagaaagaggaggaagagaagcugaaacggcagaaggaucugagaaagaaacuuuuucgcauccaaggacagaaggaacggagaaaccagaaaucuucccugaagggcgccgaggggcagcuccaauga

SEQ ID NO: 66483 - RNA, 2028 nt, Artificial Sequence
  derived and/or modified sequence opt5 from BMX__Homo_sapiens__NP_001712
auggacaccaagagcauccuggaggaacuccugcuuaaaagaucccagcaaaagaaaaagaugucucccaacaauuacaaagagcggcuguucgugcucacaaagacgaaccugagcuauuacgaauaugauaagaugaaacgcggcuccagaaaggggucuauugagaucaaaaagauucggugcgucgaaaaaguuaaucuugaggagcagaccccuguggaacgccaguacccguuucagaucguguauaaggacggacugcucuacgucuaugccagcaacgaggaauccagaucucaauggcugaaggcucugcagaaagagauucggggcaauccccaccuccuggugaaguaccauagcggguucuuuguugauggaaaauuccuuuguugccagcaguccuguaaggccgcgccuggcugcacacugugggaggcuuacgccaaccuccacaccgccgugaaugaagagaaacaucgcguccccacauuuccugacagagugcugaagaucccccgggcuguuccugugcuuaaaauggaugccccguccucuuccaccacacuggcucaauaugacaacgaaagcaagaagaauuacgggucucagcccccuuccagcucuaccucccucgcccaguaugauagcaacuccaaaaagaucuacggaucucagcccaauuucaacaugcaauauauuccucgcgaggacuuucccgauugguggcaggucagaaaacuuaagagcuccucuucuuccgaagacguggcgagcucuaaucagaaagagcggaacgugaaucacacgaccagcaagaucuccugggaguucccggaaucuagcuccagcgaggaagaggaaaaccuggaugacuacgauugguuugccggcaacauuucucgcucccaaagcgagcagcuccugagacagaagggcaaagagggggcuuucaugguccggaauagcucccagguuggaauguauacagugagccuuuuuagcaaggccgugaacgacaaaaagggcaccgucaaacauuaccacgugcacacaaaugcugaaaacaagcuguaccucgccgagaauuauuguuucgacucuaucccuaagcugauucauuaccaccaacauaacagcgcggggaugaucacccgccuuagacaccccguuuccacgaaagccaauaaggugccugauucugucagccugggaaacggcauuugggaacucaaacgggaggaaaucacacugcugaaggagcucggguccggacaguuuggcgugguucagcugggcaaauggaaggggcaguaugacguggcugucaagaugaucaaagagggaagcaugucugaagaugaguucuuccaagaagcccagaccaugaugaagcugucccaccccaaacuggugaaguuuuacggcgucugcagcaaagaguaucccauuuacaucgugacagaguauauuucuaaugggugucuccugaacuaccuuagaucccauggaaagggccuggaaccuagccagcuccuggagaugugcuacgacguuugugaagggauggcuuuccuggagucucaccaguuuauccaucgcgaucucgccgcccggaauugccugguggacagagaucuuugugucaaagugagcgacuucggaaugacccgcuauguucuggaugaccaauacguguccagcgucggcaccaaguuuccggugaaguggucugcucccgaaguguuccacuauuuuaaauacuccagcaaguccgauguuugggcguucggcauucucaugugggaggucuuuucucuggggaaacagccuuaugaccuguacgacaacagccagguggugcuuaaggucucccagggacaucggcucuauagaccccaccuggccucugauacaaucuaccaaaucauguacagcugcuggcacgagcugccugaaaaacgccccacguuccagcagcuccuguccucuauugagccgcuucgggaaaaggacaagcauuga

SEQ ID NO: 66484 - RNA, 2964 nt, Artificial Sequence
  derived and/or modified sequence opt5 from BNC1__Homo_sapiens__NP_001288135
augagaugccggaacauguucuuuagcuucaaggccucccuguguggcugcggggcugccaccgcgcccucucucacagcuaucagcuguacgcugaauugcuccugucagucuuuuaaaccuggaaagauuaaccaccgccaaugcgaccaguguaaacauggcuggguggcccacgcccuuagcaagcugagaaucccgcccauguacccuaccucccaggucgagauuguucagucuaaugugguguucgauaucagcucccucaugcuguaugggacacaagcuauucccguccggcuuaaaauccugcucgaccgccuguuuagcgugcugaagcaggaugaaguucuccagauccugcaugcccuugacuggacccugcaggauuacauuagaggauaugugcuccaagacgcuucuggcaagguccuggaucacugguccaucaugacaagcgaggaagagguggccacccuucagcaguuccugcgguuuggggaaacaaaaucuauuguugagcucauggcgauccaggagaaggaagaacaauccauuaucauuccucccagcaccgccaacguggacauccgcgcuuucaucgaaucuugcucccauagaagcuccucucugccuacgccggucgauaaaggaaaucccagcuccauucacccuuuugagaaccugaucagcaauaugaccuucaugcuccccuuucaguucuuuaacccucugcccccggcccuuauuggcucucugccugagcaguacaugcucgaacaaggccacgaccagucccaggaucccaagcaggaggugcaugggccuuuccccgacagcucuuuccugacaagcuccucuacccccuuucaaguggaaaaagaucagugucuuaauugcccugacgcuaucacaaagaaggaggacagcacccaccuguccgauagcagcuccuauaacauugucacgaaauucgaacggacacagcucagcccggaggccaagguuaaacccgagcgcaauucucugggaaccaagaaaggcagaguguuuuguacagcgugcgaaaagaccuucuacgacaaagggacccugaagauccauuauaacgccgugcaccucaagaucaaacacaagugcacaauugagggauguaauauggucuuuuccagccugcggucccgcaacagacauucugcuaauccuaacccccggcuucacaugccuaugaaccgcaauaacagagauaaagaccugcggaauagccucaaccuggccuccucugaaaauuacaagugccccggcuucacggugaccagcccggauuguagaccucccccuuccuaccccgggagcggagaggacucuaaaggccagccugcuuuucccaacaucggccaaaaugggguucuuuucccgaaccugaagacagugcagccuguccuccccuuuuaucgcucccccgccaccccugccgaaguggcuaauacaccggggauucugcccagccugccucuccugucuuccagcauccccgagcagcuuauuucuaacgagaugccuuucgaugcgcugcccaagaaaaagagccggaaauccagcaugccuaucaagaucgaaaaagaggccguugaaauugcuaaugagaagagacauaaccucucuuccgacgaagauaugccccuucagguggucagcgaggacgagcaagaagccugcuccccgcagucucaccgcgugagcgaggaacagcauguccaguccggcgggcugggaaagccuuuucccgagggcgagcggccuugucacagagaaucugugaucgagagcuccggggccauuucucaaacccccgaacaggcuacgcacaauagcgagcgcgaaacagagcagaccccggcccugaucaugguuccucgggagguggaagauggaggccaugagcacuacuucacccccggcauggaaccucaaguccccuuuuccgacuauauggagcuccagcagagacugcuggcgggaggacucuucagcgcucugucuaaccgcggcauggccuuccccugccuugaagacuccaaagagcuggagcauguggggcagcacgcccucgcucggcaaauugaagagaauagauuucagugugauaucugcaagaaaacauucaagaacgccuguagcguuaaaauucaccauaagaacaugcacgugaaggaaaugcauaccugcacagucgagggauguaaugcuacguuuccuucucgccgguccagagaccggcacagcucuaaccugaaucugcaucagaaagcccuuucccaggaagcgcucgagagcuccgaggaucacuuccgcgccgcuuaccugcugaaggacguggccaaagaggcuuaucaagauguggccuuuacccagcaggcgagccagacaucuguuaucuucaagggcaccagcagaauggggucccucgucuacccgaucacacaagugcacucugccagccuggaguccuauaacucuggcccccuuagcgaaggaaccauucuggaccucuccacgaccucuagcaugaaauccgagucuucuucccauagcucuugggauuccgacggcgugagcgaggaagggacaguccugauggaggauuccgacggaaauugcgaaggcucuagccuggugccuggggaggaugaauaccccaucugcguucuuauggagaaggcugaccagucccucgccagccugccuucuggacugcccauuaccugucaccucugccagaaaacauacuccaacaagggcaccuuucgggcucauuauaagacggugcaccugagacaacuucauaaauguaaggucccugggugcaauacaauguucagcucugugcgcagccggaacagacacucccagaauccgaaccugcacaaaucucucgccagcucccccucucaucugcaguga

SEQ ID NO: 66485 - RNA, 3300 nt, Artificial Sequence
  derived and/or modified sequence opt5 from BNC2__Homo_sapiens__NP_060107
auggcccaccugggccccaccccuccgccccauagccucaacuacaaguccgaggacagacugucugaacaggauuggccugcuuauuucaaagugcccugcuguggggucgacacaagccaaaucgaguccgaagaggccgaaguugaugugcgggagcgcgagacgcagagagaccgggaaccuaagcgcgcgagagaucuuacccugcgggacucuugcacagauaauagcaugcaguuuggaacccgcacaaccacagcugagcccggcuucauggggaccuggcagaacgccgacacgaaucuccuguuuagaaugucccaacaggccauucgguguacccuugugaacugcacaugugaaugcuuccagccuggaaaaaucaaucugcgcaccugugaucagugcaagcacggcugggucgcucaugcccucgacaaacugucuacacaacaccuguaccauccgacccagguggagauuguucagagcaacguggucuuugauaucuccagccucaugcuguaugggacgcaggcugugcccguuagacuuaagauucugcucgaccggcuguucucugugcuuaagcaagaggaaguccugcacauccuccacggacugggcuggacacugcgcgauuacgugagaggcuauauccuccaggacgccgcggggaaagugcuggaccggugggccauuaugucccgcgaggaagagaucauuacccuucagcaauuucugagauucggagaaacaaagagcaucgucgagcucauggcuauucaggagaaagaaggccaggccguugcugugccuucuuccaagaccgauagcgacauccggaccuuuauugagucuaauaacagaacacgcucccccagccugcuugcccaucuggaaaauuccaacccuucuagcauccaccauuucgagaauauccccaacucccucgcguuucugcugccguuccaguacauuaauccugugagcgcuccccuccuggggcuuccucccaacggacugcuccuggaacaacccggccuucggcugagagagccuucucucuccacgcagaaugaguauaacgaaagcucugagagcgaagucuccccgacccccuacaaaaacgaucagacaccuaaucgcaacgcccugaccucuaucacaaauguggagcccaagaccgaaccugccuguguuagccccauucagaacuccgcuccggugagcgaccugacgaagacagagcacccuaaaucuuccuuucggauccacagaaugcgccggauggggagcgccucuagaaagggacgcgucuucugcaaugccuguggcaaaaccuucuacgauaagggcacccucaaaauucauuauaacgcugugcaccugaagaucaaacaucggugcacaaucgaggggugcaauaugguguuuuccagccuuagaucccgcaaccggcacucugcgaaucccaacccuagacugcauaugcccaugcuccggaauaaccgcgacaaggaucugauuagagccaccagcggagcugccacaccuguuaucgccuccacgaagucuaaucuggcucuuaccagccccggccggccgccuaugggguucacaaccccuccccucgaccccguccugcaaaacccgcugcccucccagcucguguuuagcggacugaaaacaguccagccugugcccccuuucuacagaucucuucugacccccggcgaaaugguuuccccucccacgagccucccgaccucuccuauuauccccacauccgggaccauugagcagcacccucccccgccuagcgaacccguggucccugccgugaugauggcgacacacgagcccucugcugaucuggcccccaagaaaaagccucgcaaaagcuccaugccgguuaagaucgagaaggaaaucauugacaccgccgaugaguuugacgacgaagaugacgaucccaaugacggaggcgcuguggucaacgauaugagccaugacaaccacugucauucucaagaggaaauguccccuggcaugagcgugaaagauuucuccaagcacaaucggacgagaugcaucucucgcacagagauuagacgggccgacagcaugaccuccgaggaucaggaacccgagcgcgacuaugaaaacgagucugaaagcuccgagccuaaacugggggaggaaucuauggagggagaugaacacauccauagcgagguguccgaaaagguucuuaugaauagcgagagacccgacgagaaccacucugaaccuucccaucaggaugucauuaaagugaaggaggaauuuacagacccgaccuacgacauguucuauaugagccaguacggccucuauaaugggggaggcgcuucuauggccgcgcugcacgaguccuuuaccagcucucugaacuacgggagcccccaaaaguucuccccugagggcgaucucuguuccagccccgacccuaaaaucugcuacguguguaagaaaucuuuuaagagcuccuauucugucaaacugcauuaccggaaugugcaccuuaaggaaaugcacguuugcacaguggccggauguaacgcugccuuccccagccgcagaucccgggaucgccauucugcuaauauuaaccugcacagaaagcuccugacgaaagagcuggacgauaugggccuugacagcucccagccgucucucagcaaggaucugcgggacgaauuucuggucaaaaucuauggggcccagcauccuaugggacucgaugugcgcgaggacgcguccagccccgccggcaccgaagauucucaccugaauggguacggaagaggcauggcugaggacuauaugguucuugaucuguccacaaccagcucucuccaauccagcuccucuauccauagcucccgggagagcgacgccgggucugacgaaggcauucugcuggaugacaucgauggagcuuccgacagcggcgagucugcccacaaggccgaagcucccgcgcuuccugggagccucggagccgagguguccggcucucugauguucagcucccugucugggagcaacggaggcauuaugugcaauaucugucacaaaauguacuccaacaaggggacacucagaguccauuauaaaaccgugcaucugcgcgaaaugcacaagugcaagguucccggcuguaauaugauguucagcucugugcgguccagaaaccgccacagccagaacccuaaucuucacaaaaacauuccguuuacguccgucgauuga

SEQ ID NO: 66486 - RNA, 687 nt, Artificial Sequence
  derived and/or modified sequence opt5 from BNIP1__Homo_sapiens__NP_001196
auggccgcuccccaggacgugcacgucagaaucugcaaccaagagauuguuaaguucgaucuggaagugaaagcccucauccaggacauucgggauuguagcggcccucuguccgcgcuuaccgagcugaauacaaaggugaaagaaaaguuucagcagcuccgccauagaauccaagaccuggagcagcuugcuaaagaacaggauaaggagucugagaagcagcugcuccugcaagaagucgagaaccacaaaaagcagaugcugagcaaucaggccuccuggcggaaagccaaccucacgugcaagauugcuaucgacaaucuggaaaaagccgagcuucugcaagggggagaucuccugcgccagagaaagaccacaaaggagucucuugcucagaccagcuccacaaucaccgaaucucugaugggcauuagccggaugauggcccagcaagugcagcaguccgaggaagcgaugcagagccucguuacaucuucccgcaccauccuggacgccaacgaggaguucaaaagcaugucugggacgauucaacugggaagaaagcucaucaccaaauacaaucggcgcgaacugacagauaaacuucugauuuuucucgcucuggcccuuuuccuggcuaccgugcucuauaucgucaagaagagacuguuuccguuccuguga

SEQ ID NO: 66487 - RNA, 1308 nt, Artificial Sequence
  derived and/or modified sequence opt5 from BNIP2__Homo_sapiens__NP_004321
augcugugcggcuuccaggaggacgccacacccccuccgcccccuagaccccggcgccuccacagacggcugccucgccccgaagagguggggaugcuuagccugccuccgggacuccugaccgucuccggcucugcugccgcggcugaugccguuccccuuagaccuggggacugggccggagugagcacggcugaucggggcgaacgcgcuccccuggggccugccuuuugugaccucgccgugucccccaccucuccggcguggagaggagaggaagaugagggcgccaaggcuagcuccggcgacaucgggucucuggauuaccaagaguucgucguggacauugaaagccggcugcgcauggagggaguugaacucaaagaggaguggcaggaugaagacuuuccuaucccccugccugaggaugacuccauugaagccgauauccuugcuauuacaggccccgaggaccagcccgggagccuggaagugaacggaaauaagguccggaaaaagcucauggccccugacaucucucugacccuugauccguccgacggcagcgugcugucugaugaccucgaugaguccggggagaucgaccuggauggacuggacacacccagcgaaaacucuaaugaguucgaaugggaggaugaccucccuaaacccaagaccacagaaguuauuagaaagggcuccaucaccgaguauacggcggccgaggaaaaagaggauggccgcagauggcggauguuucgcauuggggaacaggaccauagaguggacaugaaggcuaucgagccuuacaaaaaggucauuagccacggaggcuauuacggggauggacugaacgccaucgugguguucgcugucugcuuuaugcccgaauccucucaaccgaauuaucgguaccuuauggacaaccuguucaaauauguuauuggcacccucgagcugcuuguggccgagaauuacaugaucguguaccugaacggggccacaaccagacgcaagaugccuagccucggauggcugcggaaguguuaucagcagaucgauagacgccugcggaaaaaucucaagucccugauuaucguccaucccagcugguuuauuagaacacuucuggcugugacccgcccuuucaucucuuccaaauuuagccagaagauucgguacguuuucaaccucgcggaacuggccgagcuugugcccauggaauaugucggcaucccugagugcaucaaacaaguggaccaggagcugaauggcaagcaggaugaacccaaaaacgagcaguga

SEQ ID NO: 66488 - RNA, 780 nt, Artificial Sequence
  derived and/or modified sequence opt5 from BNIP3__Homo_sapiens__NP_004043
augggcgacgccgcugccgaucccccugggccggcgcugcccugcgaguuccucagaccuggauguggcgcuccccugagcccuggggcccagcuuggacggggcgcccccaccuccgcuuuuccuccgcccgccgcugaagcccacccugcggcccgcagagggcugcggucuccccaacucccuagcggagcuaugucccagaacggcgcccccggcaugcaggaggaaucucugcaggggagcuggguggagcuucauuucuccaauaacggaaauggcgggucugucccggcuagcguuuccaucuacaacggagacauggaaaagauucugcucgaugcccaacacgagagcggcagaucuuccagcaaaucuucccauugcgacagcccuccccgcucucagacaccucaggauacgaaucgggcguccgagaccgacacacacagcaucggggaaaagaacuccucucagagcgaggaagaugacauugagcgcagaaaagagguggaauccauccugaagaaaaauagcgauuggauuugggacuggucuucccggcccgagaacauucccccuaaggaauuucuguucaagcauccgaaacgcaccgccacacucagcaugagaaauaccucugugaugaagaaaggaggcaucuuuagcgcugaguuccugaaggucuuucuucccucccugcuccugucucaccuucuggccaucggccucgggaucuauauuggacggcgccugacaaccagcacguccaccuucuga

SEQ ID NO: 66489 - RNA, 660 nt, Artificial Sequence
  derived and/or modified sequence opt5 from BNIP3L__Homo_sapiens__NP_004322
augagcucccaccugguggagcccccuccgccccuccauaacaauaacaauaacugcgaagagaaugaacagucucugccucccccugccggccuuaacagcuccugggucgagcugcccaugaacucuagcaaugggaaugacaacggaaauggcaagaacgggggacucgaacacguuccuuccucuagcuccauccauaauggcgauauggagaaaauucugcuugacgcucaacacgagagcgggcagucuuccagcagaggaucuucccauugugauagcccgucuccccaggaagacggccagaucauguucgauguggagaugcacaccucccgggaccacagcucccaaucugaagaggagguggucgaaggcgagaaggaaguggaggcccugaaaaagagcgcggauuggguuuccgacuggagcucucgcccugaaaacauucccccuaaagaguuucauuucagacaccccaagcgguccgugagccucucuaugcgcaagagcggggcuaugaaaaagggaggcaucuuuuccgccgaguuccugaaagucuuuauuccgucucuguuccucagccaugugcuggcccuugggcugggaaucuacaucggcaagagacucuccacaccuagcgcuucuacguauuga

SEQ ID NO: 66490 - RNA, 1032 nt, Artificial Sequence
  derived and/or modified sequence opt5 from BNIPL__Homo_sapiens__XP_011507538
augggcaccauccaggaggccgggaagaaaacagacgugggagucagagaaauugcugaggcccccgaacugggcgcggcucuccggcacggggagcuggaacuuaaggaggaguggcaagaugaagaguucccucgccugcucccggaagaggccggaacgagcgaggaccccgaagauccuaaaggcgacucccaggccgcugccgggacccccucuacacuggcucuuugcggacagagaccuaugcggaagcgccugagcgcccccgagcucagacugucccugaccaaaggcccuggcaacgauggggcgucuccgacacagagcgcccccuccucuccugacggaagcuccgaucucgaaaucgacgagcuggaaacccccagcgauucugagcaacuugacuccggccaugaguuugaaugggaggaugaacugccucgggcugaggggcucggaacaagcgaaaccgccgagcgccugggcagaggguguaugugggacguuacgggagaggauggccaccauuggcggguguuccgcaugggccccagagaacagcggguggacaugaccgucauugagccguacaagaaggugcuuucucacgggggauaucauggcgacgggcugaaugcuguuauccucuuugccuccugcuaccugccucgcagcucuauucccaacuauacauacgugauggaacaccuguucagauauauggucggaacccucgagcugcuuguggcggaaaauuaccugcucguucaccuguccggcgggacaagccgggcccaggugccuccccuuuccuggauccgccaguguuauagaacccuggaucggagacuccgcaaaaaccugcgggcucuggucguggugcaugccacgugcucuaaguuuacaagaaaaauccgcuuccucgacagccugggagagcuugcucaacugauuucccucgaucagguccacauccccgaggccguucggcagcuggacagagaucuucauggcagcggcgggaccuga

SEQ ID NO: 66491 - RNA, 3348 nt, Artificial Sequence
  derived and/or modified sequence opt5 from BOC__Homo_sapiens__NP_001288790
augcugagaggcaccaugacagccuggcgggggaugcgccccgaggugacgcucgcuugccugcuucuggccaccgcgggauguuucgcugaccucaacgaagucccucagguuacagugcaaccggccagcaccgugcagaagcccggcgggacagucauccugggaugcgugguugagccucccagaaugaaugugaccuggcggcuuaacggcaaagaacugaauggguccgaugacgcccucggaguccugauuacacacggcacccuggugaucacggcucucaacaaucauaccguuggccgcuaccaguguguggccagaaugccugcuggggccgucgcgucugugcccgccacagugacccuggcuaaccuucaggauuuuaagcuggacguccaacacguuauugagguggaugaaggaaauacagccgugaucgcuugccaucucccugagagccacccgaaagcccagguccgguauuccgugaagcaggaguggcuggaagcgucucgcggcaacuaccuuauuaugcccagcgggaaucugcagaucguuaacgccucccaagaggacgaaggaauguauaaaugugcugccuacaauccugugacccaggaggucaagacgucuggcagcuccgauagacuccgggugcgcagaagcacagcugaggccgcccggaucauuuaucccccugaagcucagaccaucauuguuacaaaggggcagucucugauccuggagugcguggcguccggcauucccccgccucgcgucaccugggccaaagacggaagcucugugaccggcuacaacaagacaagauuccuccuguccaaucuucugaucgauacgaccagcgaagaggacucugggacauaucgguguauggcugauaacggagucggccaacccggggccgccgugauucucuacaauguucagguguuugaaccucccgaggucaccauggagcugucccagcuugugauccccuggggacaaagcgcuaaacugacaugcgaaguucgcggcaacccuccgcccuccgugcucuggcugagaaacgccgucccucugaucucuagccagcggcucagacugucccgccgggcgcuuagagugcugagcauggggcccgaggacgaaggaguguaccaguguauggcugagaaugaaguuggcucugcccaugccgucgugcagcuccgcaccucccggccuagcauuacgcccagacuguggcaagaugcugagcuugccacaggcaccccgccugugucucccagcaagcuggggaacccugagcagaugcuccgcggacagcccgcucugccucggcccccgaccuccgucggcccugccucuccccagugccccggggaaaaaggacaaggcgcgccugccgaggcuccgaucauucugagcucccccagaacaagcaagaccgacucuuaugaacucguguggcgcccucggcacgagggguccggcagagcccccauccuguacuauguugugaagcaccgcaaacaggucacaaauagcucugacgauuggacgauuuccggaaucccugcuaaccagcaucggcuuacccugacaagacucgaccccggcagccuguacgaaguggagauggccgcguauaauugugccggggagggacagaccgcuaugguuacauuccggaccggccgcagaccuaagcccgaaaucauggccuccaaagagcaacagauucagcgggaugacccgggggcuucuccucagagcuccucucaacccgaucacggaagacugagcccucccgaagccccggaccgcccuacgaucuccaccgccagcgagacaucuguguacgucaccuggauuccccggggcaacgggggcuuuccuauccaguccuucagaguggaguauaagaaacuuaagaaaguuggagauuggauucucgcuacaagcgcgaucccucccucucgccuguccguggaaaucaccggccuggagaaggggacgagcuacaaguuuagaguccgggcccucaauaugcugggagaaucugagcccagcgcuccgucccgccccuacguggugagcggcuauucugggagagucuacgaacggccuguugccggacccuauauuacauucaccgacgccgugaacgagacaaccaucaugcuuaaauggauguacauuccugcuuccaauaacaauacccccauccauggcuuuuauauuuacuaucgcccuacagauagcgacaacgauuccgacuacaagaaagacaugguggagggggauaaguacuggcacucuaucagccaucugcagccggaaacguccuaugacauuaaaaugcaaugcuucaaugagggcggagaaucugaguuuagcaacgucaugaucugcgaaaccaaggccagaaaguccucuggccagcccgggcggcucccucccccuacacuggcgcccccgcagccuccccugcccgagaccaucgagcgcccugugggaacaggcgcuaugguugccagaagcuccgaucuucccuaccucauugugggggucgugcugggaagcaucguucugauuaucgugaccuucauuccuuuuugucucuggcgggccuggucuaaacagaagcacacgacagaccugggcuucccgcgcuccgcucugcccccuagcugccccuauaccauggucccucuugggggccuccccggacaccaagccucuggccagccguaccuguccgggaucagcggcagagcgugugcuaauggaauccauaugaaccgggggugcccuucugccgccgugggauaucccggcaugaaaccucagcagcacugucccggcgaacugcaacagcaguccgauaccagcucccuucucagacagacacaucuggggaacggauacgacccucaaagccaccagauuacccgcggccccaagucuagcccggaugagggguccuuccuguauacacucccugacgauucuacgcaccagcugcuucaaccccaucacgacugcugucagcggcaggaacagcccgcugccguuggacaaagcggcgugagacgcgcuccugauuccccgguccuggaggccgugugggaucccccuuuucauucugggcccccuugcugucucggacuggugcccgucgaagagguugacagcccugacuccugccaggugucuggcggcgacugguguccgcagcaccccgugggggcguacgucggacaggagccuggcaugcaacugagccccgggccucuugugcggguuuccuucgaaacacccccgcucaccaucuga

SEQ ID NO: 66492 - RNA, 519 nt, Artificial Sequence
  derived and/or modified sequence opt5 from BOD1L2__Homo_sapiens__NP_001244893
auggccgacggcgggggaggcgggagcggaggcgcugggcccgccuccaccagagcgucuggaggcggcgggccuaucaacccggcuagccugcccccuggagauccccagcucauugccaucauugugggccaacugaagucccgggggcuuuucgacucuuuucgcagagauugcaaagccgacgucgauacaaagccugcuuaccagaaucugagccagaaagccgacaacuucguuuccacgcaccucgauaagcaggaguggaaucccccugcuaacgacaaucaacugcaugauggacuucggcagucuguggugcagagcggccgcuccgaagccggggucgacagaaucagcucucaggugguugauccgaaacugaaccacauuuuucggccccaaaucgagcagaucauucaugaguuccucguggcgcagaaggaagccgcugucccugcccugcccccugaacccgagggacaggacccgccugcucccucccaagauaccagcuga

SEQ ID NO: 66493 - RNA, 639 nt, Artificial Sequence
  derived and/or modified sequence opt5 from BOK__Homo_sapiens__NP_115904
auggaggugcugagacggagcuccgucuucgccgcugaaaucauggacgccuuugaucgcucucccaccgacaaggagcucguugcgcaggcuaaagcccugggcagagaauacgugcacgcccggcuucugcgcgcugggcucagcugguccgccccugagagagcugccccggugcccggacggcuggcggaagucugcgccgugcuucugcgccucggcgaugagcuggagaugauuagaccuucuguuuaucggaacguggcucgccaacugcauaucagccuccaguccgaacccgucgugacagacgccuuccuggcuguugccgggcacaucuuuucugcgggaauuacguggggcaagguggucagccuuuacgccguggcugccgggcuggcuguggauugugucagacaggcccagccugccaugguucaugcucucguggacugccugggagaguucgugcggaaaacccuugcgacauggcugcgcagacggggcggcuggaccgauguccucaagugugugguuuccacagaccccgggcugcgcagccacuggcugguggccgcucucugcucuuuuggaagauuccugaaagccgccuuuuucguccuucugccugaacgguga

SEQ ID NO: 66494 - RNA, 306 nt, Artificial Sequence
  derived and/or modified sequence opt5 from BOLA3__Homo_sapiens__NP_001030582
auggccgcuuggagccccgccgcggcugccccucugcucagaggcauccgggggcugccgcuucaccaucgcauguucgccacccagacagagggagaacugagagugacgcaaauucucaaggagaaauuuccccgggcuaccgccaucaaggucacagacauuuccggcaccaaacgcagaaaccagcgggaugcuuggaucgccgacauuuaccugugcccucagacacuuaccacacccuggcugcaccgcuguugcugucucagaccuuggaugaauuucaccgauaucauccugcccuga

SEQ ID NO: 66495 - RNA, 525 nt, Artificial Sequence
  derived and/or modified sequence opt5 from BOLL__Homo_sapiens__NP_001271287
augaccgagcuggaauaccccaagggcagcuccaucaugccugccgcugggacaauguaucucacgaccucuacaggauacccguauaccuaccacaacggcguggccuauuuccauacacccgaggucaccagcguuccucccccuuggcccuccagaucugugugcagcuccccugugauggucgcgcagccgauuuaccaacagcccgcuuaucacuaccaggccacaacccaguaccugccugggcaauggcaguggucugugccccagccuagcgccuccagcgcucccuuucuuuaucugcagccgucugaaguuaucuaccaaccuguggagauugcccaggacggaggcugugugcccccuccccucucccugauggaaacgagcguccccgagccuuauucugaucaugggguucaggcuaccuaccaccagguguaugccccguccgcgaucacaaugcccgccccugucaugcaacccgagccuauuaaaaccguguggagcauccauuacuga

SEQ ID NO: 66496 - RNA, 2241 nt, Artificial Sequence
  derived and/or modified sequence opt5 from BOP1__Homo_sapiens__NP_056016
auggccggcagcagaggggcuggacggaccgccgcgcccuccgugcgcccugagaagagacggucugaaccggagcuggaacccgagccugaacccgagccuccccuccugugcacaagcccucuuucccacucuacgggcagcgacuccggggucucugauagcgaggaauccguuuucagcggacuggaggacucuggcuccgauagcucugaagacgaugacgagggggaugaggaaggagaggacggcgcucucgaugacgaaggccauuccgggaucaaaaagaccacagaggaacaggugcaagccagcaccccguguccccgcacagagauggccucugcuagaauuggagaugaguacgccgaagacuccagcgaugaggaagacauccggaacaccgugggcaaugucccucuggagugguaugacgauuuuccccacgugggguacgaccuugauggacgcagaauuuauaaaccucugcggacacgcgacgaacucgaucaguuccuggacaagauggaugaccccgauuacuggagaaccguucaggacccgaugacgggccgggaucugcgccucaccgacgaacagguggcucuggucagacggcuucaauccgggcaguuuggagacgugggcuucaacccuuaugagcccgccguugacuuuuucucuggcgaugugaugauccauccugucacaaaucgccccgcggauaaacggagcuuuauucccucccugguggaaaaggagaaggugagcagaaugguccacgccaucaaaaugggguggauccagccuagacgcccgcgggaccccaccccuucuuucuacgaucucugggcucaggaagaccccaacgccguucugggaagacauaagaugcacgugccugcucccaaacuugcccugccgggccacgcggaguccuauaauccucccccugaauaccuccugagcgaggaggaacgccuggccugggagcaacaggaacccggggagcggaagcucucuuuucugccuagaaaauuccccagccuucgcgcugugccggccuacggacgguuuauucaggagagauucgaacgcugccuggaucucuaucuguguccucggcagagaaagaugcgcgucaacguggaccccgaggaucuuauccccaagcugccucggccgagagaccuccaacccuuuccuacaugccaggcucugguuuaccggggccauuccgaucuggugcgcugucucucugucagccccgggggacaguggcugguguccggcagcgacgauggcucucuuagacugugggaaguugccaccgcccggugcgugagaacggucccugucgggggaguggugaaauccguugcuuggaaucccagcccugcggugugucucgucgccgcugccguggaggacucuguucugcuucugaaccccgcccucggcgaccgccugguggcuggguccacagaucaacugcucagcgccuucgucccgccugaggagcccccucugcagcccgcgcgguggcuugaggcuuccgaagaggaaagacaggugggacugcgccucagaauuugccacggcaagccggugacccagguuacauggcaugggcggggcgacuaucuggccgucgugcuggccacccaaggacacacccaggugcuuauccaccagcucucucgcagacggagccaguccccuuuccgcagaucucauggccaaguccagcggguggcuuuucaccccgcccgcccuuuccugcugguugcuagccagagauccgugcggcucuaccaucugcuucgccaggagcugacgaaaaagcucaugcccaauuguaaaugggucagcucucuggccgugcaccccgcgggggauaacguuauuugcggauccuaugacagcaagcuggugugguuugaucuugaccucucuacaaaaccuuacagaaugcugcggcaucacaagaaggcccugagagcugucgccuuccacccgcgcuauccccucuuugcuuccggcagcgaugacgggucugugaucguuugucauggaaugguguacaaugaucugcuucaaaacccucugcucguccccgugaaagugcugaagggccacguccugacccgggaccuugggguucucgaugugauuuuccauccuacacagcccuggguguuuagcuccggcgccgacggaaccgucagacuguucacauga

SEQ ID NO: 66497 - RNA, 1905 nt, Artificial Sequence
  derived and/or modified sequence opt5 from BORA__Homo_sapiens__NP_001273675
auggagagauuccuguuucccgccccugaccucccggcucggagcccccuggugaacggcuccucucagggggucggaguugaggaacgcggcaccagaaagagcgggcacgugggacuuggcgccacaccucccucccauucuauccaagggagccggcugcaccucaaucugccugaaguggauuccuuucccccucauccggcgaaauucucucuuugcgcuaugggagacgucaaggagagcaaaaugcagauuacgcccgaaaccccuggccgcauccccgugcugaacccuuucgagucccccagcgauuacucuaaucuccacgagcagacacuggccuccccgagcguuuuuaagucuaccaaacugccuacacccggcaaguucagaugguccauugaccagcucgccgugaucaacccugucgaaauugaucccgaggacauccaucggcaagcucuguaucuuagccacucucgcaucgauaaggacguggaagauaaaagacagaaggccauugaggaguuuuucaccaaagacguuaucgugcccuccccuuggacagaucacgaagggaagcagcugagccagugucauuccucuaaaugcaccaauauuaacagcgacuccccggucggaaagaagcucacgauccacagcgagaaaucugaugcugccugucaaacccugcuuucccugcccguggacuuuaaucucgaaaacauucugggcgacuacuuccgggcggaugaguuugccgaccagagcccugggaaucugucuagcuccucucuccgcagaaagcuguuccuugauggaaacggcagcaucuccgacagccugcccucugcuuccccugggagcccccauucuggagugcagacaucccucgaaauguuuuauagcauugaucuguccccggucaaaugccggucuccucuucagacccccagcuccggccaauucucuagcuccccuauccaggccagcgcuaagaaauacucucugggcuccaucacaagccccucuccuauuuccagccccaccuucucuccgaucgaguuucagauuggggagacgccucucagcgaacaacgcaaguucacaguucacucccccgacgccagcucuggaaccaauuccaacggcaucacaaaucccuguauuagaagcccuuauaucgaugggugcuccccgaucaaaaacuggucucccaugcggcugcagauguacagcggaggcacccaguaucgcaccuccgugauucagaucccuuuuacacuggagacgcaaggggaagacgaggaagauaaggagaauauucccucuaccgacgugagcuccccugcgauggaugccgcuggaauccaccucagacaguucucuaacgaggccagcacacauggcacccaccuggucgugacagcuauguccguuacccagaaccagagcucugccuccgaaaaggagcuugcccugcuccaagacguggaacgggagaaagacaauaacacggucgauaugguggaccccauugaaaucgcugaugagacaaccuggaucaaggagccuguugacaauggcagccugcccaugaccgauuuugugucugggauugcguucuccaucgaaaacagccauauguguaugucuccgcuugccgaguccagcgucauuccuugcgaauccagcaauauccagauggacucuggauacaacacacagaauuguggcagcaacauuauggauaccgugggggcugaguccuacugcaaagagucugacgcccagacaugugaagucgagagcaagucccaagccuuuaauaugaaacaggaucacacgacccagagaugcuggaugaagacagcuucucccuuccagugcagcuccccuuga

SEQ ID NO: 66498 - RNA, 780 nt, Artificial Sequence
  derived and/or modified sequence opt5 from BPGM__Homo_sapiens__NP_001280014
augagcaaguacaaacugaucaugcucagacacggcgagggggccuggaacaaggaaaaucgguucugcuccuggguggaccagaaacugaacucugagggaauggaagaggcucgcaauuguggcaagcaacuuaaagcccugaacuuugaauuugaucucgucuucaccagcguucugaauagauccauucauacagcguggcuuauccuggaggagcucgggcaggaaugggugcccguggagucuagcuggcggcugaacgaacgccacuauggagcucugauuggccucaauagagagcagauggcccugaaccauggggaggaacagguccggcuuuggcgcagauccuacaaugugacgccuccgcccaucgaggaaucucacccuuauuaccaagagauuuauaacgaccggcgcuacaagguuugcgaugugccccuggaccagcucccuagaagcgaaucccugaaggauguccuugagcggcugcuccccuauuggaaugagcgcaucgccccugaagugcugagaggaaaaaccauccugauuagcgcucauggcaacucuucccgggcccuccugaagcaccuugagggcaucagcgacgaagauauuaucaauauuacacugccgaccgggguucccauccuccuggagcuugacgaaaaccugcgcgcugugggaccucaccaguuccucggcgaucaggaggccauucaagcggccaucaaaaaggucgaggaccaggggaaagugaagcaggcuaagaaauga

SEQ ID NO: 66499 - RNA, 771 nt, Artificial Sequence
  derived and/or modified sequence opt5 from BPIFA1__Homo_sapiens__NP_057667
auguuccagaccggcgggcugaucguguuuuacggacuccuggcccaaacaauggcucaguucggcgggcuucccgucccucuggaccagacgcucccgcugaacguuaaucccgcccuuccucugagccccaccggacucgcgggcucccugacaaacgcucugucuaaugggcuccugagcggaggccuucugggcauucucgagaaccugccucuucuggauauccucaagcccgggggaggcaccuccgggggacugcugggcgggcuccugggaaaagugacaucugugauuccuggccuuaauaacaucauugacaucaaggucaccgauccgcagcugcucgaacugggccuugugcaaagccccgacgggcacagacuguauguuacaaucccucucggaauuaaacuccaggugaauacgccccuggucggcgccucccugcugcggcuugccgugaagcuggauaucaccgcugagauucucgccguucgcgacaaacaggaaagaauccaucuggugcuuggggauugcacccacucuccuggaagccugcagauuucccuccuggacggccuggggccccucccgauccaaggacugcuugauagccugacaggcauucucaacaagguccugccugagcuggugcagggcaauguguguccccuugucaacgaaguucuccgggggcuggacaucacccuggugcaugauaucgugaauaugcucauucacggacugcaguuugucaucaagguguga

SEQ ID NO: 66500 - RNA, 750 nt, Artificial Sequence
  derived and/or modified sequence opt5 from BPIFA2__Homo_sapiens__NP_542141
augcugcagcucuggaagcuggugcuucugugcggcguccucaccgggacaagcgagucccugcuugacaaccugggaaaugaucucucuaacguuguggacaaacuggaacccgugcugcacgagggccucgaaacggucgauaauacccugaaggggauccuugagaaacugaagguggaccucggaguucugcagaaaagcuccgccuggcagcuugcuaagcagaaggcccaggaagcggagaaacugcucaacaaugugauuucuaagcugcugccuacaaacaccgauaucuucggccucaaaauuagcaauucccugauccuugacgucaaggcugagccgauugaugacgggaaaggacugaaccucucuuuucccgugacagccaauguuaccguggccggcccuaucaucggccaaauuaucaaccugaaggcuagccuugaucugcucacagccgucaccauugaaacggacccccagacccaucagccuguggcugugcugggggagugugccuccgaucccacaagcaucucucugucccuccuggacaagcacagccagauuaucaauaaauucgucaacucuguuauuaauacccuuaaguccacagugagcucucugcuccaaaaagaaaucugcccucugaucagaauuuuuauccauucccuugaugugaacgucauucaacaggugguugacaauccgcagcacaagacccaacugcagacgcucaucuga

SEQ ID NO: 66501 - RNA, 657 nt, Artificial Sequence
  derived and/or modified sequence opt5 from BPIFA3__Homo_sapiens__NP_001035904
augaugugcccccuguggagacuccugaucuuccuuggccugcucgcccugccucuugcuccgcacaagcagcccuggccugggcuggcccaagcgcaucgggacaacaaaagcacccucgcucgcauuaucgcccagggacugauuaagcacaaugccgaguccagaauccagaacauucauuuuggcgaucggcugaaugcuucugcccagguggcucccgggcucgucggauggcugaucagcggccgcaaacaccaacagcagcaggaauccagaucuuucgacaacaauaucguuaagaugugugcccauaugagcauugugguggaguuuuggcuugaaaaagaugaguucgggcggcgcgaccuggucaucggaaagugcgaugcggaaccuuccucugugcacguugccauucucacagaggcuauucccccuaagaugaaccaauuucuguacaaucuuaaagagaaccugcagaaggugcucccgcacauggucgaaagccagguguguccccugaucggcgagauccugggccagcucgacguuaaacugcuuaagucccugauugaacaagaggccgcucaugagccuacgcaccaugaaaccagccagcccucugccugccaggcgggggaguccccuagcuga

SEQ ID NO: 66502 - RNA, 1455 nt, Artificial Sequence
  derived and/or modified sequence opt5 from BPIFB1__Homo_sapiens__NP_149974
auggccggccccuggaccuucacacugcucugcgggcugcuugcugccacgcugauccaggcgacccucagcccuacagcugugcugauucuuggaccgaaggucaucaaagagaagcugacccaagaacucaaagaccacaacgccacauccauucugcagcagcugccccuccugucugccaugagagagaagccugcuggcgggauccccguucuuggaagccuggugaauaccgugcucaaacauauuaucuggcugaaggucaucacagccaacauucuucagcugcaagugaagccuuccgcuaaugaucaggaacuccugguuaaaaucccccuggacaugguggccggcuuuaacaccccucucgucaagacgauuguggaguuccacaugaccacagaagcgcaggccaccauccggauggauacaucugcuagcgggccgacccgccugguucuuuccgacugugccacgucucauggaagccugcggauucagcuccugcacaaacuuuccuuucuggugaaugcucucgccaagcaagucaugaaccugcuggugcccagccucccuaaucuggugaaaaaccagcuuugccccgucaucgaggcgucuuucaauggcauguacgccgaucugcuccagcugguuaaggugccuauuucccuuagcaucgacagacuggaguuugaucuccuguaucccgcuaucaagggcgacacaauucagcuguaccucggggccaaacugcuugauucucaaggaaaggugaccaaaugguucaacaauuccgcugccagccugacaaugccgacccucgacaacaucccuuuuucucugauugucucccaggaugugguuaaggccgcuguggcggccguccugagccccgaagaguucauggugcuucucgacuccguucugccugaaucugcucaucgccugaaaagcuccaucggccucauuaaugagaaggccgccgauaaacuggggagcacccagaucgugaagauccuuacacaagacacgcccgaguuuuucauugaccagggacacgcuaaggucgcccagcugaucgugcucgaagucuuucccucuuccgaggcgcugagaccucuguucacccuuggcauugaagcuagcucugaggcccaguuuuauacaaaaggggaucaacucauccugaaccugaauaacauuagcuccgaccggauccagcucaugaacucuggaaucggcugguuccagccggaugugcugaagaauauuaucaccgaaauuauccacagcauucuucugcccaaccagaauggcaaacuccgcuccgggguuccugugagccuggucaaggcccugggauucgaggcugccgagucuucccuuacaaaagacgcucucgugcugacccccgccagccuguggaagccuucuucccccguuagccaauga

SEQ ID NO: 66503 - RNA, 1377 nt, Artificial Sequence
  derived and/or modified sequence opt5 from BPIFB2__Homo_sapiens__NP_079503
auggccugggcuagcagacugggccuccugcuugcccugcuccugcccguggucggggcguccaccccuggaacaguugugcggcuuaacaaggcugcccugucuuacgugagcgagaucggcaaagccccgcuccagcgcgcucugcaagucacggugccccacuuccuggacugguccggggaagcccuccagccuacccggauuagaauccugaauguucaugugccccgccuucaccugaaguuuauugcuggauucggcgucagacuccuggccgcggccaacuuuacauucaaaguguuucgggcuccugagccccuugaacugacccucccuguugagcugcuggccgauacacgcgugacccagucuagcaucagaacaccggucguguccauuucugcuugcagccucuucuccgggcaugccaaugaauuugacggaagcaacucuaccucccacgcgcugcuugugcugguccagaagcauaucaaagccguucucagcaauaagcugugucuuucuaucuccaaccuggugcaaggcgugaauguccaccucggcacgcugauugggcugaaccccgugggaccugagagccagauccgguauucuaugguuuccgugcccaccgucacaagcgauuacauuucccucgaggugaaugcuguucuguuccuucugggcaagccuaucauucuccccaccgacgccacaccguuugugcugccucgccacgucgggaccgaaggaucuauggcuacggugggccuuagccagcagcuguucgauuccgcccuccugcugcuccaaaaagccggggcucugaaccuugacaucacaggacagcugagaagcgaugacaaucuccugaacaccucugcgcugggccggcuuauucccgaggucgcccgccaguuuccugaacccaugcccgugguucucaaggugagacugggcgcuacaccugucgccaugcugcauaccaauaacgccacccuccggcugcagccguucguggagguucuugcuacagccuccaauagcgcguuucaaucucuguucagccucgauguggucgugaaccugcgccugcagcuuuccgugucuaaaguuaagcuccaggggacgaccagcguccugggagacgugcaacugacaguggcuuccagcaacgucggcuucaucgauaccgaccaggugagaacacucauggggaccguuuuugagaaaccccugcuugaucaccugaaugcccuccuggccaugggaaucgcucugccuggcguggucaaccuucauuauguggcccccgaaauuuucguuuacgagggguauguggucaucucuuccggacucuuuuaccagagcuga

SEQ ID NO: 66504 - RNA, 1524 nt, Artificial Sequence
  derived and/or modified sequence opt5 from BPIFC__Homo_sapiens__NP_777592
augugcaccaagacaauccccgugcuguggggcuguuuccuccuguggaaccuuuacgucagcuccucucagacgauuuauccugggaucaaagccagaauuacccaacgggcucuggacuacggaguucaggccggcaugaagaugaucgagcagaugcucaaagaaaagaaacugccggaucuuagcggguccgagucucuggaauuucucaagguggacuaugugaauuacaacuucagcaauauuaagaucuccgcguuuucuuuccccaacacaagccuggcuuuugucccuggagugggcaucaaagcccugaccaaucacgggacagccaacauuuccaccgauuggggauucgagagcccccucuuucaggacacaggcggcgcugaucuguuccuuucugggguuuauuuuaccggaaucauuauccugacgcgcaaugacuucggccauccuacccucaagcugcaagauugcuacgcccagcuuucccacgcucaugugagcuuuucuggggaacuguccguccucuauaacagcuucgccgagcccauggagaaaccuauucugaagaaucugaacgaaaugcucuguccgaucauugcgucugaggugaaagcccugaaugcuaaccuuuccacacuggaaguucucaccaagaucgacaauuacacacugcuugauuacagccugaucuccucucccgagauuaccgagaacuaucucgaccugaaucugaagggaguguuuuacccucucgaaaaccugacggaucccccuuucagccccgucccguucgugcuuccugagagauccaacagcaugcuguauaucggcauugccgaauacuuuuucaaaucugcuuccuuugcccacuucacagcggggguguuuaaugucacccucagcacagaggaaaucucuaaccauuucguucagaauagccagggacugggcaacgugcuuucccggauugccgagaucuauauccugucucaacccuuuauggugcgcauuauggcuaccgagccucccaucauuaaucuccagcccggcaacuucacccuggacaucccugccagcauuaugaugcugacacagccgaaaaauuccacggucgaaaccaucgugagcauggauuuuguugcuucuacauccguggggcucgucauccugggacagagacuugugugcagccugucucucaaccgguuccgccuggcccugcccgaguccaauagaagcaacauugaaguucuucgguuugagaauauccucuccucuauucugcacuucggcgugcugccucucgccaacgcuaagcugcaacagggguuuccccuuagcaauccucacaaguuccuguucgucaacuccgacaucgaagugcucgagggauuucugcugauuucuaccgaccuuaaauacgagacaagcuccaagcagcaacccagcuuccaugucugggaaggccucaaucugaucucucgccaguggagagggaaauccgcgccguga

SEQ ID NO: 66505 - RNA, 1464 nt, Artificial Sequence
  derived and/or modified sequence opt5 from BPI__Homo_sapiens__NP_001716
augagagagaacauggcccggggccccugcaaugcuccucgcugggccagccugauggugcucgucgcgaucgggaccgcuguuacagccgccgugaacccgggaguggucgugagaauuucccagaagggccuggacuacgcuucucaacaggggacggccgcccuucagaaagaacugaagcggaucaaaauucccgauuauagcgacuccuucaagaucaaacaccucggaaagggccauuacucuuuuuauagcauggauauucgcgaguuccagcugccuuccucucaaaucagcaugguucccaauguggggcuuaaguuuuccaucagcaacgcuaauauuaaaaucucuggaaaguggaaagcgcagaagagauuccugaaaauguccggcaacuuugaccucagcauugaaggcaugucuaucuccgccgaucugaagcuggggagcaauccuaccucuggaaagcccacaauuaccuguuccagcugcuccucucacaucaacagcguccaugugcacauuuccaaaagcaagguuggcuggcucauccagcuguuccauaaaaagaucgagucugcccuucggaauaaaaugaacucccaggugugugaaaaggucacaaauagcgugucuagcgagcugcaaccuuacuuucagacccucccggugaugacaaaaauugacuccgucgcugggaucaacuauggacugguugcucccccugccaccacggcggagacccuugaugugcagaugaagggcgaguucuacucugaaaaucaccacaaucccccucccuuugccccgccugugauggaguuccccgcugcccaugaccgcauggucuaucuggggcucagcgauuacuuuuucaacacagcuggacugguguaccaggaagccggcguucugaagaugacccucagagacgauaugauuccuaaagaguccaaguuucggcugacaaccaaauucuucggcacguuucuucccgaaguggccaagaaauuccccaacaugaagauccaaauucacgucagcgcuucuacaccuccgcaucuguccgugcagcccaccgggcucacauuuuauccugcgguugacgugcaggccuucgcuguccugcccaacagcucucuugccucccuguuucucaucggaaugcacaccaccggcagcauggagguguccgccgaaucuaaucgccuggucggggagcugaagcucgauagacugcuucuggaacucaaacacagcaacaucggaccuuuccccguggagcugcuucaagacauuaugaauuacaucguuccgauucuggugcucccucgggucaacgagaagcugcagaaaggcuuuccccugccuacacccgcucgcgugcagcucuauaauguugugcugcagccucaucaaaacuuccuucuguuuggggccgacgucguguacaaguga

SEQ ID NO: 66506 - RNA, 762 nt, Artificial Sequence
  derived and/or modified sequence opt5 from BPNT1__Homo_sapiens__NP_001273078
augagcaucugcuccucucuggccagaaaguuccccaaacucaccauuaucggcgaggaagaccugccuagcgaggaaguggaucaggagcuuauugaagacucccaaugggaggagauccugaagcagccgugucccucucaguacagcgcuauuaaagaagaggaucucgucguuuggguggacccucuggaugggacaaaggaauauacggagggacuucuggacaacgugaccguccucaucggcaucgccuacgaggggaaagcgauugcuggagugaucaaucagcccuauuacaacuaugaagccggcccugaugccguucuggggcggacaauuuggggagugcugggccucggcgcuuuuggguuccaacugaaggagguccccgccggaaagcacaucauuaccacaacccgcucccauucuaauaaacuugugacagacugcguugcugccaugaacccugaugcggugcugagagucggcggggccggaaauaagaucauucagcucaucgaaggcaaagcuagcgccuacguguuugcuuccccgggguguaagaaaugggauaccugcgcccccgaggugauccugcacgcggucggaggcaaacuuacggacauucauggcaacguucugcaguaucacaaggacgugaagcauaugaauagcgccggggugcucgcuacccugcggaacuacgauuacuaugccucucgcgucccugaauccaucaagaaugcucuggugcccuga

SEQ ID NO: 66507 - RNA, 8712 nt, Artificial Sequence
  derived and/or modified sequence opt5 from BPTF__Homo_sapiens__NP_004450
augagaggccggcgcgggagacccccuaagcagccggccgcucccgccgccgaacggugcgcuccugcgcccccucccccuccgcccccucccacaagcggaccuaucggcgggcugcgcuccagacaccggggaucuagccgcggcagaugggccgcugcccaagcugaaguggcccccaaaacacggcucuccucuccgcgcgggggaagcuccucuagacggaagccucccccuccgcccccugccccgcccagcacguccgccccuggccgcggcgggagaggaggcgggggaggccggaccgggggaggcggcgggggaggccaucuggcucgcacgaccgccgcuagacgggccgugaacaagguuguguacgacgaucacgagagcgaagaggaagaggaggaagaggacauggugucugaagaggaggaagaggaagauggggacgccgaggaaacacaggauuccgaggacgaugaggaagacgagauggaagaggaugacgaugacagcgauuaucccgaagagauggaggacgacgaugacgaugccucuuacugcaccgaauccagcuucagaucucauuccacauauagcuccaccccuggacgccggaagcccagagugcaccgcccgcggucuccuauucuugaggaaaaagacauucccccucuggaguuucccaagagcuccgaagaucucauggugccuaaugagcauauuaugaacguuaucgcuauuuacgaggugcugagaaauuucggcacgguccuucgccugagccccuuucgguucgaagacuuuugcgccgcucucgugucucaggagcaguguacccugauggccgaaaugcacguugugcugcucaaggccguccugagagaggaggauacauccaacaccacauucgggccggcugaccuuaaagauagcgucaauucuacccuguauuuuaucgacggaaugacguggccugaagugcuccgcgucuacugcgagagcgauaaggaauaucaccauguucugcccuaccaagaggcggaagacuaccccuauggcccuguggagaacaaaaucaaggugcuucaguuccuggucgaccaguuucucacaaccaauauugcccgggaggaacugauguccgagggcgugauccaguacgaugaccacuguagaguuugccauaaacugggggaucuccuguguugcgaaacauguucugcuguguaucaccuugagugcgucaagccgccccuggaagaggugccugaggacgaauggcaaugugagguuugcguggcccacaagguccccggagugaccgauugcgucgccgaaauucagaaaaacaagccuuacauccgccaugagcccauuggcuaugaccggagcagacggaaauacugguuccucaaucgcagacugaucauugaagaggauaccgagaacgaaaaugagaagaaaaucugguauuacuccacaaaggugcagcuugcugaacugaucgacugucucgauaaagacuacugggaggccgagcugugcaagauucuggaagagaugcgggaagagauccacagacauauggauauuacggaagaccucaccaacaaggcgcgcgggagcaauaaaucuuuucuggcugccgccaacgaggagauccuugaauccauucgggcuaagaaaggagauaucgacaauguuaagagcccugaggaaacagagaaagacaagaacgaaaccgagaacgauucuaaggacgccgagaaaaauagagaagaguucgaagaucagucccuggagaaggacagcgaugacaaaacacccgaugacgauccggaacaaggcaaguccgaggagccuaccgaagugggggacaaaggcaacucugucagcgcuaaucucggagauaacacgacaaaugccaccuccgaggaaaccucucccagcgagggccgcuccccuguggggugucugagcgagacacccgacucuuccaacauggcggaaaagaagguugccagcgagcuuccgcaggaugugccugaggaacccaauaaaaccugcgaaucuuccaacacaagcgcuacgaccacaucuauccagccuaaucuggagaacagcaauuccagcucugagcucaacuccagccaauccgaaucugccaaggcugccgacgaccccgagaauggagaaagagagagccacacccccgucuccauucaggaagagaucgugggcgauuuuaaaucugaaaaguccaacggggaacuguccgagucuccuggagcgggcaaaggggccagcggcuccacacggauuaucacccgccugagaaauccggacagcaagcucucucagcugaagucccagcaaguggcugccgcugcccaugaagccaacaaacuuuucaaggagggaaaagaaguucuggucgugaacagccagggcgagauuucucggcucuccacgaagaaagaggugaucaugaaggggaauaucaacaauuauuucaaacugggacaggaaggcaaguaccgcgucuaucacaaccaguacagcaccaauucuuuugcucugaacaagcaccaacauagagaggaucacgacaaacggcgccaucuugcgcacaaguucugucucacacccgccggggaauuuaaauggaauggauccgugcacggcagcaagguucugaccauuuccacacugagacucaccaucacgcagcuggagaacaauauuccuagcucuuuccuucaucccaacugggcuagccaccgggccaauuggaucaaagccgugcagaugugcuccaagccucgcgaguuugcucuggcccucgcgauucuggaaugugcugucaagcccgugguuaugcugccuaucuggagagagucucuugggcauacacggcuccacagaaugaccagcauugaacgcgaggaaaaagagaaggugaaaaagaaagagaagaagcaggaagaggaagagacaaugcaacaggccaccugggucaaauauaccuucccggugaagcaucagguuuggaaacagaagggcgaagaguaccgggugacaggauauggcgggugguccuggaucucuaaaacgcacgucuacagauuugugcccaagcugccuggaaacaccaaugugaacuaccgcaagagccuggagggcaccaagaauaacauggaugaaaacauggacgaguccgauaagcggaaaugcucuagaagccccaagaaaaucaagauugaaccugacuccgagaaagaugaagucaaggggagcgacgccgcuaagggagccgaucaaaaugagauggacaucucuaaaauuaccgagaagaaagaccaggauguuaaggaacuccuggacuccgauagcgacaaacccuguaaggaggaaccgauggagguggaugacgauaugaagacagagucucacgugaacugccaggaauccagccaagucgacgugguuaauguguccgagggcuuccaucuucgcaccucuuauaaaaagaaaacgaagucuuccaaacuggaugggcuccuggaacggagaaucaagcaguuuacacuggaggaaaagcagcgccuugagaaaauuaagcucgagggcggaaucaaaggcaucgggaagaccagcaccaacucuuccaaaaaucugagcgaaucuccugucauuacaaaggcgaaggagggaugucagagcgacuccaugcggcaagaacagucucccaacgcuaauaacgaucagcccgaggaccugauccagggcugcagcgaauccgauucuagcgugcucagaauguccgacccuagccacaccacaaauaaacuguaccccaaggaccggguucuugaugacgugucuauucgcuccccugagacgaaaugcccgaagcaaaacagcaucgagaaugauauugaagagaaagucuccgaccuggccucuagagggcaggaacccagcaaguccaagaccaaaggaaacgauuucuuuaucgacgauucuaagcucgccagcgcugacgauaucggcacacugauuuguaaaaauaagaaaccucugauccaggaggaauccgacaccauuguguccucuuccaagagcgcccuucauucuuccguucccaaaagcacaaacgaucgggacgcuaccccucucucucgcgccauggauuucgagggcaagcuggggugcgacagcgaguccaauucuacgcuggaaaacagcuccgacaccgugagcauccaggauuccucugaggaagacaugauuguccaaaacagcaaugaguccaucucugagcaguuuagaacacgggaacaggauguggaggugcucgaaccccugaagugugagcuugucagcggagaauccaccggcaacugcgaggacagacugccgguuaaagggacagaggcgaauggaaagaaaccuucucaacagaagaaacucgaggaacgccccgugaacaaguguagcgaucagaucaagcugaaaaauaccacagacaagaaaaacaaugaaaaccgggaguccgaaaagaaaggccagagaaccagcacguuccaaauuaaugggaaggauaacaagccuaaaaucuaucugaagggagagugccuuaaagagauuucugaaucccgcguggucagcggcaauguggagcccaagguuaacaauaucaacaaaauuaucccugaaaaugacauuaagucucugacagugaaggaguccgccauccggcccuucaucaacggcgaugucauuauggaagacuuuaaugagagaaacagcucugagaccaaaucccaccuccugagcuccagcgaugcugaagggaacuaccgcgacucucucgagacccugccgagcacaaaggaauccgacucuacccagacgacaaccccuagcgccuccugucccgagucuaauagcgugaaccagguugaggauauggaaaucgagacauccgaagugaaaaaggucaccucuagccccauuacauccgaggaagagagcaaucuuucuaacgacuucaucgaugagaauggacugccuauuaacaaaaaugaaaacgugaauggcgaguccaagcggaaaaccgucaucacggaagugaccacaaugaccagcacaguugcuaccgagucuaagacggugaucaaggucgaaaaaggggacaagcagacagugguuuccagcaccgagaacugcgccaaauccacagugaccaccacaacgaccacagucaccaagcucucuacaccgagcaccggaggcuccguggauauuaucagcgugaaagagcaaucuaagacgguugucacaaccaccgugacagacucccugaccacaacagggggaacccuggugacaagcaugaccgucucuaaggaauauagcacaagagauaaagugaaacuuaugaaauuuucccgccccaagaaaaccagaucuggcacggcccugccuagcuaccggaaguucguuaccaaguccucuaaaaagagcauuuuugugcuccccaaugacgaucugaaaaagcucgcucgcaaaggcgggaucagagaggucccuuauuucaacuacaaugcgaagcccgcccuggacauuuggccuuacccgagcccccggccuacauuuggaaucaccuggcgcuauagacuucagacagucaagagccuggcuggcguuucucucaugcugcggcugcuuugggccucccugagaugggaugacauggccgcuaaagcgcccccugggggaggcaccacacgcacggaaaccagcgagacagaaaucaccaccacagagauuaucaagcggagagauguggggcccuacggaauccgcuccgaguauuguauccggaaaauuaucugcccgauuggcgucccugaaacgcccaaggagacccccacaccucagagaaaaggccuccggucuagcgcgcugcgccccaagagaccugaaaccccgaaacagacagggcccgugaucaucgagaccuggguugcugaggaggaacucgaacugugggagauucgggccuucgccgaacgcguggagaaggagaaggcucaagccgucgaacagcaggcgaaaaagagacuugagcagcaaaaaccuacggugaucgcuacauccaccaccucucccacaagcuccaccacaagcaccauuucuccugcccagaaggugauggucgcccccaucuccggaagcguuacgacaggcaccaaaauggugcugacaaccaagguggggucuccggcuacggucaccuuucagcaaaacaagaauuuccaucagacauuugccaccugggugaaacagggacaguccaacagcggcguugugcaaguccagcagaaggugcuggggauuaucccuucuuccacaggaaccagccagcaaacauucaccucuuuucagccccggacggcuacaguuaccauccgcccuaacaccagcggcuccggcgggacaaccagcaauucccaggugauuacaggaccccagaucagaccuggcaugacggucauucggacaccccuccaacagucuacacuggggaaagccaucauucgcaccccggugaugguccagccuggagcgccccaacaggugaugacacagaucaucagaggccagcccguuagcaccgccguguccgcuccuaacacggugucuagcaccccggggcaaaagucccuuacaucugccaccagcacauccaauauucagagcucugcuucccagcccccucggccccagcaaggacaggucaaacugaccauggcccagcucacgcagcugacacaaggccacggcgggaaccagggacucaccguugugauccagggccaggggcaaacaaccggacagcugcagcuuauuccucaaggcgugaccguccugcccgggccuggacagcagcugaugcaggccgcuaugcccaauggcacagugcaaagauuccucuucacgccgcuggcgaccacagccaccacagcuagcaccacgacaaccaccguuucuacaaccgccgccggcacaggggaacagcgccaguccaaacuuagcccucagaugcaagugcaccaggacaagacgcugcccccugcucagucuuccagcgucggacccgccgaggcgcagccgcaaaccgcucagccuucugcccagccccaaccccagacacagccucagucccccgcccaaccugaagugcagacccagccggagguccagacacaaaccacggugagcagccauguucccuccgaggcucagccuacccacgcccagucuagcaaaccccagguggcggcccaaucccagccucagucuaacguccaaggccagagccccgugcggguucaguccccuucucagacaagaauccgcccgagcacccccucccaacucagcccugggcagcagucucaggugcaaacaaccacaucccagcccauuccuauccagccccauaccagccugcagauuccgucucaaggacagccucagucccagccccaagucgugaugaagcacaaugcugugaucgaacaccucaaacagaagaaaagcaugacgcccgccgagcgggaagagaaccagagaaugaucguuuguaaucaagucaugaaguacauucuggacaagaucgauaaagaagagaagcaggcugccaaaaagcgcaaacgggaggaauccguggagcagaagagaucuaagcagaacgcuacaaaacuuagcgcccugcuguuuaagcauaaagaacaacuccgcgcggagauucugaagaaacgggcccuucuggacaaggaucuccagaucgaggugcaggaggaacugaaaagagaccucaagauuaagaaagaaaaggaucugaugcagcuugcucaagccaccgcugucgccgccccuugucccccuguuaccccggcucccccugcgcccccugcgcccccucccucucccccucccccgccugcugugcagcacacaggccugcugagcacgcccacccuccccgccgccagccagaaacgcaagcgggaggaagagaaagacuccagcucuaaguccaagaaaaagaaaaugaucagcacaaccucuaaggagaccaagaaggauaccaagcuguauugcaucuguaaaacaccuuacgacgaaagcaaguucuauauugggugcgauagaugucagaauugguaccauggccgcugcgugggaauccuucaauccgaggcugaacugauugacgaguacgucuguccccagugccagucuaccgaagaugccaugacggugcucaccccucugacagagaaagacuaugagggccugaagagaguucuccggagccuucaagcgcacaaaauggccuggccguuucuggaacccguggacccuaacgaugcucccgacuacuauggggucaucaaggagccuauggaucuggccaccauggaggagcgcgugcagagacgguacuaugaaaagcucacagaguucguugcugacaugaccaaaauuuuugauaauuguagauacuauaaccccuccgacagcccuuucuaccagugcgccgaggugcuggagagcuuuuucguccagaaacuuaaaggauuuaaggcgucccggagccauaauaacaaacugcaauccacggccucuuga

SEQ ID NO: 66508 - RNA, 321 nt, Artificial Sequence
  derived and/or modified sequence opt5 from BPY2__Homo_sapiens__NP_004669
augaugacccuggugcccagagcccggacacgcgcuggccaggaccacuacagccauccuugcccgagauucucccaaguccuccugacggaggggaucaugaccuauugucuuacaaagaaccugucugauguuaauauucuccaccggcugcuuaaaaacggaaaugugcgcaacacccugcuccagagcaaggugggccugcugacauacuaugucaaacucuaccccggggaagugacccugcuuacaagaccuuccauccagaugcggcugugcuguauuaccggaucuguuagccgccccagaucccagaaguga

SEQ ID NO: 66509 - RNA, 2301 nt, Artificial Sequence
  derived and/or modified sequence opt5 from BRAF__Homo_sapiens__NP_004324
auggccgcucugagcggcgggggaggcgggggagccgagcccggccaggcucucuucaacggggacauggaaccugaggcuggagccggcgccggcgcugccgcuuccucugccgcggauccggccauccccgaagagguguggaauauuaagcaaaugaucaaacugacccaggaacacauugaggcucugcuggacaaguuugggggagagcauaacccucccagcaucuaccucgaagccuaugaggaauacacauccaaacuggaugcgcuucagcagagagagcaacagcugcucgagucucugggcaaugggacggacuucagcgucuccucuagcgccuccauggauaccguuacaagcagcuccucuucuucccugagcgugcucccuucuucccugagcguguuucagaaccccaccgacgucgcgcgguccaauccuaagucuccgcagaaacccauugugcgcguuuuccuuccuaacaagcaaagaacagugguccccgcccggugcggagugaccguucgcgauagccugaagaaagcucucaugaugagaggccugaucccugaauguugcgccguguaucggauccaggacggggagaagaaacccauuggaugggauacagacaucuccuggcuuaccggcgaggaacugcacgucgaagugcucgagaaugugccgcugacgacccauaacuuuguccgcaagacauucuuuacccuggcuuucugugauuuuugcagaaaacuccuguuccagggcuuucggugucagacaugcggguacaaguuccaccaacgcuguagcaccgagguuccucuuaugugcgugaauuaugaccagcuggaucuccuguuugugucuaaguucuucgaacaucaccccauuccucaggaggaagccucccuugccgagacggcucugacaagcggaucuagccccuccgcgcccgccucugacagcaucggcccucaaauucucaccuccccgagccccucuaaauccaucccuauuccccagccuuuuagacccgcugacgaagaucaccggaaccaguucgggcagcgcgacagaucuagcuccgccccgaauguccauaucaacacaaucgagccugugaauauugaugaccugauccgggaucaaggauuucgcggcgacgggggaagcaccaccggccuguccgccacacccccugcuucucuccccggcagccugacgaacguuaaggcccuucagaaauccccugggccccagagagagcggaagucuagcuccagcucugaagauagaaaucgcaugaaaacccugggacggagagacuccagcgaugacugggagauuccggauggccagaucacaguggggcaacgcauuggaucuggcuccuucgggaccgucuacaagggcaaauggcacggagacguggcgguuaagaugcucaacgugacagcuccuacgccccagcagcugcaggccuuuaagaacgaagucggcgugcuucggaaaaccagacaugucaauauccuucucuucaugggguauagcacaaagccccaacuggccaucgugacccaguggugugagggaucuagccuguaccaccaccuccauauuaucgaaaccaaauuugagaugauuaagcugaucgacauugcucgccagacagcccagggcauggauuaccuucacgcuaaauccaucauccaucgggaccucaagagcaacaauauuuuccugcacgaggaucugaccguuaagaucggggacuuuggacuggccacagugaaaucuagaugguccggcagccaucaauucgaacagcuuuccgggucuauucucuggauggcgccugaggucauccgcaugcaggauaagaacccguauagcuuucaauccgacguguacgccuucggcauuguucuguaugaacugaugacgggacagcuccccuacucuaauaucaacaaucgggaucagauuaucuuuauggugggcagaggguaucugagcccugaccuuuccaaaguccgcucuaacugccccaaggcuaugaaacggcugauggccgagugucucaagaagaaaagagaugagcggccucuguucccccagauccuggcuagcauugaacuucucgcccgcucccugccuaagauccacagaagcgcgucugagcccucccugaaucgggccggauuccaaaccgaagacuuuagccucuacgcuugcgccucuccgaaaacaccuauucaggcuggcggguauggagccuuccccgugcacuga

SEQ ID NO: 66510 - RNA, 1779 nt, Artificial Sequence
  derived and/or modified sequence opt5 from BRAP__Homo_sapiens__NP_006759
augagcgugucccuggucguuaucagacucgagcuggccgaacacucucccgugccugcuggcuucggguuuagcgccgcggcuggagagauguccgacgaagagauuaagaaaaccacacuugccucugccguggcuugccuggaaggcaagagcccgggggagaaagucgccaucauucaucagcaccucggacggcgcgagaugacggaugugaucauugaaaccaugaaguccaaccccgacgagcugaaaacaaccguugaagagagaaagucuagcgaggcuuccccuacagcccaacggagcaaggaucauucuaaagaauguaucaaugcggcccccgacuccccuagcaagcagcuucccgaucagaucucuuucuuuuccggcaacccuagcguggagauuguccacgggaucaugcaucuguacaaaaccaauaagaugacaucucucaaagaagacgugcgcagauccgcuaugcugugcauucugaccguuccggccgcuaugacgagccacgaucucaugaaguucguggcccccuuuaacgaggucaucgaacagaugaagauuauccgggacuccaccccuaaucaauauauggugcugauuaaauuccgcgcgcaggccgaugcugacucuuuuuacaugacauguaacggaagacaguucaauagcaucgaggaugacgugugccagcuugucuauguugagcgggccgaagugcugaaguccgaggauggcgcuagccuccccgugauggaccugaccgaacuuccuaaauguacagucugccuggagcgcauggacgaaucugugaacggcauccucaccacgcuguguaaucacuccuuucauagccaaugccugcagagaugggaugacacaaccugucccguuugccgguacugucagacaccggagccuguggaggaaaacaagugcuucgagugcgggguccaggaaaaucucuggauuugucugaucugcggacacauuggcugugggcgcuaugugucuagacaugccuacaaacacuuugaggaaacccaacacaccuaugccaugcagcuuacaaaccaucggguuugggauuacgcuggagacaauuacgugcaccgccuggucgcgagcaagacggauggcaaaaucgugcaguaugagugcgagggggacaccugucaagaagagaagauugaugcccuccagcuggaauacuccuaucuucugacaucucagcucgagagccagagaaucuacugggagaacaagaucguccggauugaaaaagacaccgcugaggaaaucaauaacaugaagacaaaauucaaggagaccauugaaaaaugcgauaaccuggagcauaagcugaaugaccuccugaaggagaaacaauccguggaaagaaaguguacgcagcuuaacacaaaaguugccaagcugaccaaugagcucaaagaggaacaggaaaugaacaagugccugcgcgccaaucaggugcuucugcaaaacaagcucaaagaggaggaacggguccugaaggagaccugugaucagaaagaccugcagaucacagaaauucaggagcaacucagagacgugauguuuuaucuggaaacccagcagaagaucaaucaccuucccgcugagacacgccaggagauccaagaaggacagauuaacaucgccauggcgagcgcuucuuccccugccagcucuggcggcuccgggaaacugcccagccggaagggaagauccaagcgcggcaaauga

SEQ ID NO: 66511 - RNA, 2466 nt, Artificial Sequence
  derived and/or modified sequence opt5 from BRAT1__Homo_sapiens__NP_689956
auggaccccgagugcgcccagcugcucccugcucugugugccgugcuugucgauccgagacaacccguugcggacgauaccugccuggaaaagcuccuggacugguucaaaacagugacggagggcgaaagcuccgugguccuucugcaggagcacccuugucucguggaacugcugucucauguucucaaggugcaggaucugagcuccgggguccuuucuuuuagccugcggcucgcuggaaccuucgccgcccaggagaacugcuuucaauaccugcagcagggcgagcuucugcccggacucuucggggaaccuggcccccuggggcgcgcuacaugggccgugccuaccguuagauccggauggauccagggccugcggucucucgcucaacacccgagcgcccugcgcuuucuugcggaccauggcgccguggauacaauuuucucccugcagggggacagcucucucuuugucgcuuccgccgcuagccagcugcuugugcacgugcuggcccucucuaugagaggaggcgcggaggggcagcccugucugccuggaggcgauuggcccgccugcgcucagaaaaucauggaccaugucgaagagucccuguguagcgccgcuaccccuaagguuacacaagcccucaaugugcugaccacgaccuucgggcggugccagucucccuggacagaggcccuuugggugcgccuguccccgagagucgcuugucuccuggaacgggauccuauucccgcggcccacagcuuuguggaccuucugcucugcguugcucgcuccccuguguucucuagcuccgauggaagccugugggagaccgucgccagagcccugucuugucucggccccacacacaugggcccccuggcucuugggauccugaaacucgaacauugcccucaagcccugcggacccaggcguuucaggugcugcuucagccgcucgcuugcguucugaaggccacggugcaagcccccggaccucccggccugcucgacgggacagcugacgaugccaccacagucgacacccugcuugcuuccaagagcucuugugccggacugcucugccgcacccuggcgcaccuggaggaacuucagccucucccccagagaccgagcccuuggccccaggccucccugcugggcgcuacagugacgguccuccggcugugugaugggucugccgcuccugccagcuccgugggaggccaucuuugcggcacccuggcgggguguguucgcgugcaaagagccgcucucgacuuccugggaacacugagccagggcaccgggccccaggagcuugucacacaggcccucgcugugcugcuggagugccucgaaucuccuggauccagccccaccguucugaaaaaggccuuucaagccacgcuucgguggcugcucucuuccccgaaaacaccuggcuguagcgaucuggggccccugauuccccaguuccuuagagaacucuucccugugcugcagaagcgccugugccacccguguugggagguccgggacuccgcucucgaguuucugacccagcuuucuagacacuggggcggacaagcggauuuccgcugcgcccugcucgcuagcgaagugccccagcuggcccugcagcuucugcaagacccugaguccuaugugcgggccucugcuguuaccgccaugggccagcucagcucccaggggcugcaugcgcccacaagcccugagcacgcugaagccagacagucucucuuucuggagcuucugcauauccucuccgucgauagcgaaggauucccccgccgggccgugaugcaaguguuuaccgaguggcugagagacggccacgcugaugccgcgcaggacacagaacaguucgucgcuacggugcugcaggccgccucucgcgaccuugauugggagguucgggcucaagggcuggagcucgcccugguguuucucggacagacccugggcccucccagaacacauuguccguacgcugucgcccuuccugaaguggcgcccgcccagccucugaccgaggcucuccgcgcccugugccacguugggcuguucgacuuugcuuucugcgcccuuuuugauugugaccggcccguggcccagaaauccugcgaucugcuccuguuccucagagacaagaucgcuagcuauucuagccugcgggaagcgcgcggcuccccgaacacagccagcgcugaggccacccuuccuagauggcgggccggagagcaagcucagcccccuggcgaucaggaacccgaggccguccuggcgaugcugagaucucucgaccuggaagggcuucgcuccacgcuggcugagagcuccgaucacguggaaaagucuccccaaagccuccugcaggacaugcucgccaccggaggcuuucugcagggggaugaggccgacuguuacuga

SEQ ID NO: 66512 - RNA, 5592 nt, Artificial Sequence
  derived and/or modified sequence opt5 from BRCA1__Homo_sapiens__NP_009225
auggaccugagcgcccucagaguggaggaaguccagaacguuaucaaugcuaugcaaaagauucuggagugccccaucugucuugaacugauuaaagagccuguguccaccaagugcgaucacaucuucuguaaauuuugcaugcucaagcugcuuaaccagaaaaagggcccgucucaguguccccugugcaagaaugacauuacaaaacggagccuccaggaauccacgcgcuucucucaacugguggaggagcugcucaagaucaucugugccuuucagcuggauaccgggcuugaauacgcgaacagcuauaauuucgcuaaaaaggagaacaauuccccugaacaucugaaagacgaggucucuauuauccagagcaugggauacagaaaccgggccaagcgccuccugcaguccgagcccgaaaauccuagccuucaagagacaucucuguccgugcagcucagcaaccugggcaccguuagaacacugcggaccaagcagcgcauucagccccaaaaaacaucuguguauaucgaacucggguccgauagcucugaggacaccgucaauaaggccacguacugcuccgugggagaucaggaacugcuucagauuaccccucaaggcacaagagacgagaucagccuggauuccgcuaaaaaggccgcuugugaguuuucugaaaccgacguuacaaacaccgagcaccaucagccgagcaauaacgaucucaauacgacagaaaaacgggccgcggagcgccaccccgaaaaguaucagggguccagcgugucuaaccugcaugucgagccuugcggaaccaacacacacgccuccagccuucagcacgagaauucuagccugcuccugaccaaagacagaaugaacguggaaaaggcugaguucuguaauaaguccaaacaacccggccuggcccggucucagcauaaccgcugggcuggcagcaaggaaaccugcaaugauagacggacaccuuccacggagaaaaagguggaccucaacgccgacccccugugcgaacgcaaagaguggaauaagcagaagcuuccguguagcgagaacccuagagauaccgaagacguccccuggauuacacugaauucuuccauccagaaaguuaacgagugguuuagccggucugaugaacuccugggguccgacgauagccacgacggagaguccgagucuaaugcgaagguggccgaugugcuugacguccugaacgaaguggaugaguacagcggcuccucugaaaaaaucgaccuccuggcuagcgauccucaugaggcccugauuugcaaguccgaaagaguucacagcaaaucuguggaguccaauaucgaggacaagauuuucgggaagaccuaucgcaaaaaggcuagccuccccaaccugucucacgucacagaaaaucuuaucauuggagccuuugugaccgagccccaaaucauccaggaacggccucugacgaacaaacucaagagaaaacgccggccgacauccggccugcaucccgaggacuucauuaagaaggccgaucuggcuguucagaaaaccccugaaaugaucaaccaggggaccaaucaaacagagcagaacggacaggugaugaauauuaccaacagcggccacgagaauaagacaaaaggcgacucuauccagaacgaaaagaaucccaacccuauugagagccuugaaaaagaguccgcguuuaagacgaaagccgaacccaucagcucuuccaucagcaauauggagcucgagcugaacauucauaauuccaaggcuccgaagaaaaacagacugcgccggaagucuagcaccagacacauccaugcccucgaacuggucgugucccgcaaucuuucuccucccaacuguacagagcugcaaauugauagcugcuccucuagcgaagagaucaaaaagaaaaaguacaaucagaugccuguccggcacuccagaaaccuccagcugauggaggggaaggaacccgccaccggagcuaaaaagagcaacaaaccuaaugagcaaacaucuaagcgccacgacuccgauaccuuccccgaacugaaacuuacgaacgccccgggcagcuuuaccaaguguucuaauacauccgagcucaaggaauucgugaacccuagccugccccgggaggagaaagaagagaagcuggaaaccguuaaagugucuaauaacgcggaggaccccaaggaucucaugcuguccggggaaagaguccuucagacagagcggagcguggaguccagcucuauuagccugguuccuggaaccgacuacggcacgcaggaauccaucucucuccuggaggugagcacacuggggaaagcuaagaccgaaccgaauaagugcgucucccagugugccgccuucgagaaccccaaaggacuuauucauggcugcucuaaggauaaucgcaacgacacagaaggcuuuaaauauccucucgggcacgaggugaaucauagcagagagaccuccaucgaaauggaggaaucugagcuggaugcucaauaccugcagaacaccuucaaggugagcaaacggcaguccuuugcccccuucagcaauccuggaaacgcugaggaagagugugccacauuuucugcgcacuccggcagccucaagaaacagucucccaagguuacguucgaaugcgagcaaaaggaagagaaucaggggaaaaacgaguccaacaucaagccuguccagaccgugaauauuacagccggauuucccguggucggccagaaagacaagccgguggauaacgcuaaauguagcaucaaggggggcuccagauucugccugucuagccaauuucgcggaaaugaaaccggccuuauuacaccuaacaagcacgggcugcuccagaaucccuaucggaucccuccccuguucccgauuaaauccuuuguuaagaccaaaugcaagaaaaaccugcuugaggaaaauuucgaggaacauagcaugucuccugagagagagaugggaaacgaaaauauccccuccacggugagcacaaucucucgcaacaauauuagagagaacgucuuuaaggaagccagcuccucuaauaucaacgaggugggcagcuccaccaaugaaguugggucuagcauuaacgagaucggauccagcgacgagaauauucaggcugaacucggccggaaccgcgggccuaagcugaacgccaugcugagacucggcgugcugcaacccgaggucuacaaacagucucuucccggauccaauuguaagcacccugaaaucaaaaagcaggaguaugaggaagugguucagaccgugaacacagacuucagcccguaccugaucuccgauaaucucgagcaacccaugggcucuagccaugcgucccaggucugcucugaaaccccugacgaucugcuggacgauggggagauuaaagaagacacaagcuucgccgagaacgauaucaaggaguccagcgcuguguuuucuaaguccgugcagaaaggagaacuuagccggucucccuccccuuucacgcacacccaucuggcccagggcuaucgcagaggggcuaagaaacucgagagcucugaagagaaucugagcuccgaagacgaggagcuccccuguuuucaacaccugcuuuucggaaaggucaacaauauuccuucucagagcacacggcacuccaccguugccacagaaugccugagcaaaaacaccgaggaaaaucuccugucccugaagaacucucuuaaugauuguagcaaccaggugauccuggccaaggcuucccaggagcaucaccucucugaagagacgaaaugcagcgcgucccuguuuucuagccaauguuccgagcucgaagaccugaccgccaauacaaacacccaggauccguuccuuauuggcagcucuaagcagaugcgccaucaguccgagagccaaggggugggccugucugacaaagaacucgucuccgaugacgaggagagaggaacaggccuggaagagaauaaccaggaagagcagagcauggacucuaaccugggggaagcugccuccggaugcgagagcgagaccuccgugagcgaagauuguucuggccuuagcucccaaucugacauccugacaacccagcagcgggauacgaugcagcacaaucucaucaagcugcaacaggagauggccgaacucgaggcuguucuggaacagcaugggagccagcccuccaacucuuacccuagcauuaucuccgacucuagcgcccuugaggaucugcgcaaucccgagcaauccacaagcgaaaaagcggugcugaccucucagaaguccagcgaguacccuauuucucagaaccccgaaggacucuccgcugacaaauuugaggucagcgccgauuccucuaccagcaagaauaaggaaccgggcguggagagauccagcccuucuaaaugccccucccuggacgaucggugguauaugcacagcuguucugggagccuucagaacagaaauuaccccucccaagaggaacugaucaagguuguggacgucgaggaacagcagcucgaggagucuggcccucacgaucugacagaaaccagcuaucucccccgccaagaccuggagggaacgccuuaccuugaauccggcauuucucuguucagcgacgauccggaguccgaccccagcgaagaucgggccccugagucugcuagaguggggaacauccccuccagcacauccgcccugaaaguuccucagcucaagguggcggagucugcucagagccccgccgccgcucauaccacagacaccgccggauauaaugcuauggaagaguccgucucucgcgaaaaaccggagcugacagccagcaccgaacgggugaacaagagaauguccaugguggucagcggccuuacgccugaggaguuuaugcugguuuacaaguucgcgcgcaaacaccauauuacccucacaaaucugaucaccgaagagacaacccacguggugaugaagacggaugccgaauuugucugcgagcggacacucaaauauuuccuggggaucgcuggaggcaagugggugguuucuuacuuuugggugacccaguccauuaaagaaagaaagaugcuuaacgagcacgacuucgagguccgcggcgaugugguuaaugggcggaaccaucaaggacccaagagagcccgggaaagccaggaccgcaaaaucuucagaggccuggagauuugcuguuacgggccuuuuacaaauaugcccaccgaucagcuggaauggauggugcagcucugcggagcuucugucgugaaggagcuguccagcuucacccuuggcacagggguccacccuaucgugguugugcaacccgacgccuggacggaggauaacggauuucaugccauuggccagaugugugaagcuccggucgugacccgggaguggguucuggacucuguggcgcucuaucagugccaggaacuggauacauaccucaucccucaaaucccccacucccauuauuga

SEQ ID NO: 66513 - RNA, 10257 nt, Artificial Sequence
  derived and/or modified sequence opt5 from BRCA2__Homo_sapiens__NP_000050
augcccaucggaagcaaggaacggccuaccuucuuugaaauuuucaaaacccggugcaacaaggccgaccucgggcccaucucccucaauugguuugaagaacugucuagcgaggcucccccuuacaacuccgaacccgccgaggagucugaacacaaaaauaacaauuaugagccuaaccuuuucaagacgccccagcgcaaaccuagcuacaaucaacuggcguccaccccgauuaucuuuaaggaacagggacucacacugccccuuuaucagucuccugugaaggagcuggauaaauucaagcucgaccugggcagaaacguucccaauagccggcauaaaucccugcgcaccguuaagacaaaaauggaucaggcugacgaugugagcuguccucuccugaacucuugccuuuccgagagccccguggugcugcaauguacccacgugacaccgcagagagacaagucuguugugugcgggucccucuuucauaccccuaaguucgucaaaggacggcagacgcccaagcacauuagcgaaucucugggcgccgagguggauccugacauguccuggagcuccucucuugccacaccgcccacacugagcuccaccguucucaucgugcgcaaugaagaggcuagcgaaacagucuuuccucaugauaccacggccaacgugaaaucuuacuucuccaaucacgacgagagccugaagaaaaacgauagauuuaucgcuucugugacagacagcgagaauaccaaccagcgggaagccgcgucccacggguucggaaagacaucuggcaacagcuuuaaagucaauuccuguaaggaucauauuggcaagagcaugccgaacguucuggaggacgaaguguaugagaccguggucgacaccucugaagaggauuccuucagccucugcuucucuaaaugucgcacaaagaaucugcaaaaagugagaacguccaagacccggaaaaagaucuuucacgaggccaacgcugacgaaugcgaaaaguccaaaaaucagguuaaggaaaaauacuccuucgugucugaggucgaacccaacgauacagacccucuugauagcaauguggccaaccagaagcccuuugaguccgggucugacaaaauuagcaaggagguugugccuucccuggcuugugaauggagccagcucacccugucuggacuuaauggcgcccaaauggagaagaucccccugcuccauauuuccagcugcgaucagaacaucucugaaaaagaccugcuggauacagagaauaagcgcaaaaaggacuuccucaccuccgagaacagccugccgagaauuucuagccuuccuaaauccgaaaagccccugaaugaggaaacggucgugaacaagcgggaugaggaacagcaccucgagagccacacagacuguauccuggcggucaaacaagccaucucugggaccuccccuguggcuagcuccuuucagggaauuaagaaaucuaucuuccgcauuagagagagccccaaggaaaccuuuaaugccuccuucucuggccauaugacagacccuaacuuuaaaaaggagaccgaagcuagcgaguccgggcuugaaauccacacaguuugcucucagaaagaggauagccugugccccaaccucauugacaauggauccuggccggccacgaccacacagaacagcguggcccugaagaaugcuggccugaucucuacccucaagaaaaagacaaacaaauucaucuaugcgauucaugaugagaccuccuacaagggcaaaaagaucccuaaggaccaaaagagcgaacugauuaauuguucugcccaguuugaggcuaacgccuucgaagcgccccuuacguuugcuaaugccgauuccgggcugcuccacagcucugucaagcgguccugcagccagaacgacuccgaggaacccacccugagccugacaucuagcuucggaaccauccuuagaaaauguucccgcaaugagacaugcucuaacaauaccgugauuagccaggaucucgacuacaaggaggcgaaauguaacaaggaaaagcugcagcuguucaucacgccugaggcugauucccucucuugccugcaggaaggccagugugagaaugacccgaaaagcaagaaaguuuccgauaucaaggaggaagugcuugccgccgcuugccaucccguccagcacucuaaaguggaguauagcgacacagauuuucaaucccaaaagagccugcucuacgaccacgaaaacgccucuacccugauucugacaccuaccuccaaggacgugcuuagcaaucucguuaugaucucucgggggaaagaguccuauaagaugagcgauaaacugaagggaaacaacuacgaauccgacgucgagcugaccaaaaauauucccauggagaagaaccaggaugugugugcucucaaugaaaacuauaaaaauguggagcugcuuccucccgaaaaguacaugagagucgccucuccuagccgcaaggugcaguucaaccaaaauacaaaccugcggguuauccagaaaaaucaggaggaaacgaccuccauuagcaagaucacagugaaccccgacucugaggagcucuuuuccgauaaugaaaacaauuucgucuuucaaguggcgaacgagagaaauaaccuggcccugggcaacaccaaagaacuucaugagacagaccugaccugcguuaaugaaccgauuuucaagaacagcacgauggugcuguauggggauacaggagacaaacaggcuacccaggucucuaucaagaaggaucugguguacguucucgccgaggagaauaaaaacagcgugaagcagcacaucaaaaugacccugggccaagaccuuaaguccgauauuucucugaauaucgacaaaauuccugaaaagaacaaugauuacaugaacaagugggcuggccuccuggggcccaucagcaaucauuccuuuggaggcucuuuccgcacagccagcaacaaagagauuaagcuguccgaacacaauaucaaaaagagcaaaauguuuuucaaggacaucgaggagcaguauccuaccucucuugcgugugucgaaauugugaacacacucgcccuggacaaucagaagaaacuguccaagccccagagcaucaacacgguguccgcucaccuccaaucuagcgucguuguguccgauugcaaaaauucucauauuaccccgcagaugcuguuuagcaagcaggacuucaacuccaaucacaaccuuacaccuagccagaaagccgagaucaccgaacugucuacaauucucgaggaauccgggagccaauuugaguucacccaguuccggaagcccucuuacauccugcagaaguccacguuugaggugccugaaaaccaaaugaccauccugaaaacaaccagcgaggaaugcagagaugcugaccuucaugucauuaugaaugcccccucuaucggacagguggauagcuccaagcaguucgagggcacaguugaaauuaaacgcaaguuugccgggcugcucaaaaacgacuguaauaagucugcuagcggcuaucugaccgaugagaacgaggugggauuccggggcuuuuacuccgcgcacgggacaaaacucaaugucagcaccgaagcccugcagaaggcugugaaacuuuucuccgacaucgagaacauuucugaagagacgagcgccgaaguucaucccaucucccugucuagcuccaaaugccacgauucuguggucagcauguuuaagaucgagaaucacaacgacaaaacaguguccgagaagaauaacaaaugucaacucauucugcagaauaacaucgaaaugaccaccggaacauucguugaggaaauuaccgagaauuauaagagaaacacggagaaugaagauaacaaguacacagccgcuagccgcaacucucauaaucuggaguuugacggcuccgacagcucuaaaaacgauaccgugugcauccacaaggacgaaacagaucuucuguucaccgaccagcauaauauuugucucaaacuguccgggcaguuuaugaaggagggaaacacacaaaucaaagaagaucucagcgaccugaccuuccuugaggucgccaaggcgcaggaggcuugccacggcaauacgucuaacaaggaacagcugaccgccacaaaaaccgagcagaauauuaaggauuucgaaacauccgacaccuuuuuccaaacggccagcgggaaaaacaucuccguggcuaaggagagcuuuaauaaaaucgugaacuucuuugaucagaagccugaagaacuccauaauuucucucugaacagcgagcugcacuccgacauucggaagaauaaaauggauauccuuucuuaugaagagacagacauugucaagcacaaaauccugaaggaaagcguuccggugggcaccggaaaccagcucgugacauuucagggccaacccgagagagaugagaaaauuaaggagccuacccugcucggguuccauaccgccuccggcaaaaaggucaagaucgcgaaagagucucuggacaaggugaaaaaucuuuuugacgaaaaggagcagggcacaagcgaaaucacguccuucucucaccagugggcuaaaacccugaaguaccgggaggccuguaaggaucuggagcucgccugcgaaacaauugagaucaccgcugcccccaaauguaaggaaaugcaaaacagccugaacaaugacaaaaaccuuguuuccauugagacaguggucccucccaagcugcucagcgauaaucugugccgccagaccgaaaaccucaaaacgucuaaguccaucuuucugaaggugaaaguucaugagaauguggagaaggaaacagcuaaaagcccugccaccuguuacaccaaccagucuccguauuccgucauugagaauagcgcgcuugccuucuacacauccugcucuagaaagaccagcgugucccagacaagccugcuggaagcuaaaaaguggcuccgggaggggaucuuugacggacaacccgaaagaaucaacacggccgauuaugucggcaauuaccuguaugagaacaauucuaacuccaccauugcugagaaugacaagaaccaccuuagcgaaaaacaggauacauaccugucuaauagcuccaugucuaacagcuauuccuaccacucugacgagguguacaacgauagcggguaucucuccaagaauaaacuggacagcggcaucgaaccuguucucaagaacguggaggaucagaaaaauaccucuuucuccaaggucauuagcaacgugaaagacgccaaugccuacccccagacaguuaacgaagauaucugcguggaggagcuggucaccuccucuagcccuuguaagaauaagaacgcugcgauuaaacuuuccaucucuaauagcaacaauuucgaagugggacccccggccuuucgcauugcuuccggcaagaucgugugcguuagccaugagacgaucaaaaaggucaaagacauuuucaccgacucuuuuuccaaggugaucaaggaaaacaaugagaacaaaagcaagauuugucaaacaaaaaucauggccgggugcuaugaggcccuggaugacucugaagauauucugcacaauucccucgacaacgaugaguguagcacccauucucacaagguguucgcugacauccaguccgaagagauccugcagcauaaccagaauaugagcggacuugaaaaagucucuaagauuagcccuugcgaugugucccuggagacaagcgacaucuguaagugcuccauuggcaaacuccacaagucuguuagcuccgccaacaccugugggaucuuuucuacagcgagcggaaaauccgugcaagucucugaugcuagccugcagaaugccagacagguguucuccgagauugaagacagcacgaagcaagucuuuucuaaaguccucuucaaguccaacgagcacagcgaucagcugaccagagaagagaauacagccauccgcacccccgaacaucuuaucucucagaagggcuuuuccuacaacgucgugaauagcucugcuuucuccggguuuagcaccgccucuggcaaacagguuuccauucuggagagcagccugcacaaggugaaaggaguccucgaggaguucgaccugaucagaacagagcauucccuucacuauucucccacgagccggcaaaacguguccaagauucugccucgcguggacaaaagaaaucccgaacacugcgucaacucugagauggaaaagaccuguagcaaggaguuuaaacucuccaauaaccugaauguugagggcgggucuagcgaaaacaaucauuccaucaaggugagcccuuaccugucucaguuccagcaggauaaacaacagcucgugcuuggaacaaaggucucccugguggagaacauucacguucugggcaaagaacaggcgagcccgaagaacgugaaaauggagaucgggaagaccgagacauucucugacguccccgugaagaccaauauugaaguuugcuccacguauagcaaagauuccgagaacuacuuugaaacagaggcuguggaaaucgccaaggccuucauggaggacgaugagcucaccgacucuaaacugccuagccaugcuacccacucccuuuuuacaugccccgaaaaugaggaaaugguccugucuaacagccggaucggaaagcgcagaggcgagccucucauucuggugggcgaacccuccaucaaacggaaucugcucaacgaguucgaucgcauuaucgagaaucaggaaaagagccuuaaggccucuaaauccaccccggacgggacaauuaaggauagacggcuguuuaugcaucacgucagccuggagccuaucaccugugugcccuuccgcacgacaaaagaaagacaagagauccagaacccuaauuuuaccgcucccggacaggaguuccucucuaagagccaccuguacgagcaucuuacacuggagaaauccucuagcaaccucgccguuuccggccacccuuuuuaucaggugagcgcgacccggaaugaaaagaugagacaucugauuacgaccgggcgccccacaaagguguucgucccgccuuuuaaaaccaagucucacuuccaccggguugagcaaugcgugagaaacaucaaucuggaagagaaccgccagaaacagaauauugacggacauggcuccgaugacagcaagaacaaaaucaacgauaaugagauucaccaauuuaacaagaauaacuccaaucaggccgcugccgugacauucaccaagugugaagaggaaccccucgaccuuaucacaucucugcagaacgcucgggacauccaggauaugagaauuaaaaagaaacaacgccagcgggucuucccccagccugggagccuguaccucgccaagaccuccacgcugccgagaaucucucuuaaagccgcugugggaggccagguucccagcgcgugcucccauaagcaacuguauacauacggcgugucuaaacacuguauuaagaucaauagcaagaacgccgaguccuuucaguuccauaccgaagacuauuuugggaaagagagccucuggaccggaaagggcauucagcuggcugaugggggauggcugaucccuucuaaugacggcaaagccgggaaggaggaguucuaccgcgcccucugcgauacacccggagucgacccuaaacuuauuucccggaucuggguguauaaccacuacagauggaucauuuggaagcuggcugccauggagugugcguuucccaaggaguucgcuaaucggugccugagcccugagcgcguccuccugcagcuuaaauacagauaugauaccgaaaucgaccggucucgcagauccgccauuaagaaaaucauggagcgggaugacacagccgcuaagacgcuggugcucuguguuagcgauauuaucucucugagcgccaacaucuccgagaccagcuccaauaaaacaucuagcgcggacacccaaaagguggccauuaucgaacugacagacggcugguacgcugucaaggcccagcucgauccgccccuucuggcugugcugaaaaacggcagacucaccguugggcagaagauuauccugcacggagccgagcuugugggcuccccugacgcuugcacgccccuggaagccccugagucucucaugcugaaaauuagcgccaauuccacccgccccgcccggugguauacaaagcugggguuuuucccggauccuagacccuuuccccucccucuuucuagccuguucuccgacggaggcaacgucggguguguggaugugaucauccaacgcgcuuaccccauucaguggauggagaaaaccagcucuggacuguauaucuuucggaacgagagagaggaagagaaggaagccgcuaaguacguugaggcccagcagaaacgccucgaggcccuguucacaaagauucaagaagaguuugaagaacaugaagagaauaccacgaaaccuuaucuuccgucccgggcucugacaagacagcagguccgcgcgcuccaggacggcgccgagcuguacgaagcugugaagaacgccgccgaucccgcuuaccuggagggcuauuucagcgaagaacaacucagagcccuuaauaaccaccggcagaugcugaaugacaaaaagcaggcgcagauccaacuggaaauucgcaaagccauggagucugcugagcagaaggaacaggggcucuccagagaugugaccacagucuggaagcugcggaucguuagcuacucuaaaaaggagaaagacuccgugauucuuagcaucuggcgcccuucuuccgaucuguauagccuccugaccgaaggaaagagauaccggaucuaucaucuggccaccuccaaaagcaagucuaagagcgagagagcuaacauucaacucgccgcgaccaaaaagacgcaguaccagcagcuucccguguccgacgaaauccuguuccaaauuuaucagccucgcgagccccugcacuuuucuaaauuccucgauccggacuuucagccuagcugcuccgaggucgaccugaucggcuucgugguuucuguggucaagaaaaccgggcuugcccccuuuguguaccugagcgaugaaugcuacaaucuccuggcuauuaaguucuggaucgaccugaacgaggauaucauuaagccucauaugcucaucgccgcuuccaaucuucaguggcggcccgaaagcaaaucuggacugcugacacucuuugccggcgacuucuccguuuuuagcgcuucuccuaaggaggggcacuuccaagagaccuuuaacaaaaugaagaauacaguggaaaacauugauauccuguguaaugaggccgaaaacaaacuuaugcacauucugcaugcgaaugaccccaagugguccaccccgacgaaggauugcacaagcggaccuuauaccgcccagaucauccccggcaccggcaacaaacuccugaugucuucccccaauugugagauuuacuaucagagcccucugucccucugcauggcuaagagaaaaucugucagcacaccgguguccgcccagaugaccagcaagucuuguaaaggggaaaaggagaucgacgaucaaaagaacugcaaaaagcgccgggcucuggacuuccuuuccagacugccccucccucccccugugagccccauuuguacauuugucucuccugccgcccagaaagcguuccagcccccgcggagcugcggaacgaaguacgagaccccuaucaaaaagaaagaacugaacagcccccagaugacaccuuucaagaaguuuaaugagauuucucuucuggaaagcaacuccaucgcugaugaggaacucgcccugaucaauacccaagcucugcucagcggcucuacaggggagaaacaguucauuuccguuagcgagucuacccgcacggcccccaccuccagcgaagacuaucugagacuuaagcggcgcuguacaaccucccugaucaaagagcaggaaucuagccaagccuccacagaggaaugcgagaagaacaaacaggauaccauuacaaccaagaaguacaucuga

SEQ ID NO: 66514 - RNA, 876 nt, Artificial Sequence
  derived and/or modified sequence opt5 from BRCC3__Homo_sapiens__NP_001018065
auggccgugcaggucguucaagcugugcaggccgugcaccuggagagcgacgcguuccucgucugccugaaccaugcucuuuccaccgaaaaggaggaagugaugggccuguguaucggggagcucaaugaugacacaagaucugauagcaaauuugccuacacgggaaccgaaaugcggacaguugccgagaagguggacgcuguccgcauugugcacauccauuccguuauuauccugagacggucugauaaacgcaaggacagaguggagauuagccccgaacagcuuuccgccgcuucuaccgaggccgaacggcuggcggagcucacaggccgcccuaugagagucguggggugguaucacagccauccgcacaucaccguguggcccucccacgucgauguucggacacaggccauguaccaaaugauggaccagggauucgugggccugaucuuuagcugcuucauugaggauaaaaacaccaagacggggcgcgugcuguauaccuguuuucagucuauccaggcucaaaaguccagcgaauacgagagaauugaaaucccuauucauaucgucccccacgugacaauuggaaaaguuugccucgagucugccguggaacugccuaagauccuuugucaggaggagcaggacgcuuaucggcgcauccauucccugacccaccucgauagcgucacaaaaauucacaauggcucuguguucaccaagaaccugugcucccagaugagcgccguuuccggcccccuucugcaauggcucgaagacagacuggagcagaaucagcaacaucugcaggaacuccagcaggagaaagaggaacugaugcaagagcuuucuagccuggaauga

SEQ ID NO: 66515 - RNA, 3570 nt, Artificial Sequence
  derived and/or modified sequence opt5 from BRD1__Homo_sapiens__NP_001291737
augagacggaagggccgcugccacagagggagcgccgcucggcaucccuccucuccuuguagcgugaaacacuccccgacccgcgagacacugacguacgcccaggcgcaaagaauggucgaaaucgagauugaaggacggcuccaucgcaucucuauuuucgacccccuggagaucauucuugaagaugaccugaccgcucaggagaugagcgagugcaacuccaauaaggaaaacucugagagaccucccguuugucuccggacaaaacgccacaagaauaacagagugaaaaagaagaaugaagcccugccuagcgcccauggcacccccgcuuccgccagcgcccuuccugagccgaaagugcggaucgucgaguauucucccccuuccgcgccccgcagaccucccguguacuauaaguuuaucgaaaaauccgccgaggaacuggauaacgagguugaauacgacauggaugaggaggacuaugccuggcucgaaauugugaaugagaagcggaaaggggauugcgucccggcugugucucaguccauguucgaauuucugauggaccgcuucgagaaggaaagccacugugagaaccagaagcaaggagagcagcagucucugaucgaugaagacgccguuugcuguauuugcauggauggcgagugucaaaauuccaacgugauccucuuuugcgacauguguaaucuggcuguccaccaagaaugcuacggggugccuuauauucccgagggacaguggcuuugcagacauugucugcagagccgggccagaccugcggauugcgugcucugucccaacaaaggcggcgccuucaagaaaacagacgacgaucgcugggggcacgucguuugcgcucuguggauccccgaagugggauuugccaauaccguguucauugagccuaucgacggcguccggaacaucccgcccgcuagauggaaacuuacauguuaccugugcaaacagaagggggugggagccuguauucaaugccauaaagccaauuguuacaccgcuuuucacguuacgugcgcgcagaaggccggccucuauaugaagauggagccugugaaagaacugaccgggggaggcacaaccuucuccguccgcaagacagcuuacugugaugugcacacgcccccuggcugcacccggagaccccugaacaucuauggggacguugagaugaagaacggagugugccgcaaggaaucuagcgucaaaacagugcgguccaccagcaaggucagaaagaaagcuaagaaagccaagaaagcucucgccgagccgugugcggugcugccuacaguuugcgcucccuacauuccuccccagcgccuuaaucggaucgccaaccagguggccauucagagaaagaagcaguuugucgagcgcgcucauucuuauuggcugcucaaacggcuguccagaaauggcgccccucuucugcggcgccuccagagcucucugcaaagccagagauccucucagcagcgggaaaacgaugaggaaaugaaggcugccaaagagaagcugaaauacuggcaaagacuccgccacgaccuggaacgggcgagacuucugaucgagcuccugcgcaagagagagaaacuuaagcgggaacaggugaagguugaacagguggccauggagcugcgccucacaccccugaccguccugcucagaagcgugcuggaucagcuucaagacaaagauccggcucggaucuucgcccagccugugucccugaaggagguucccgacuaucucgaucauauuaaacaccccauggacuuugcuaccaugcgcaagagacuggaagcccagggguacaaaaaucugcaugaguucgaggaagacuucgaucuuaucauugacaacuguaugaaguacaaugcgcgggauacggucuuuuaucgcgccgcugugagacuccgggaccagggaggcgugguccugcgccaagccagacgggagguggauagcaucgggcuggaagaggcuucuggaaugcaccucccugaaagaccggccgccgcuccccgccggccuuucuccugggaggacguugauagacugcuugaccccgcgaaccgcgcccaccugggccucgaggaacagcugcgggagcugcuugauaugcucgaccugaccugcgcuaugaaaagcucuggcuccagaagcaagcgcgccaagcugcucaaaaaggaaauugcccugcuucggaauaaacugucccagcaacauucucagccucuccccacagggccuggacuggagggcuuugaggaagauggggcugcccugggacccgaggcgggcgaagagggggacaagagcccgccuaaacuugaacccuccgaugcucucccucugcccucuaacagcgagaccaauuccgagccgccuacacugaagcccguggaacucaacccugagcagagcaagcuguucaaaagagucaccuuugacaaugaaucucacuccgccuguacgcagagcgcccuugugucuggccgcccucccgagcccacacgggcuuccagcggagacguuccggccgcggcugccucugccguggcugaacccgccagcgaugucaacagacggaccuccgugcuguucugcaagagcaaaucuguuuccccucccaagagcgcuaagaauaccgagacacaaccuaccagcccccagcucggcacaaaaacguuucugucugugguccugccucgccuugagacccuccugcagccgagaaagcggagccgcuccacauguggggacucugaaguggaggaagagagccccggaaaaagacuggaugccggccucaccaacggguucggaggcgcgcgguccgaacaggagccugggggcggacugggcagaaaggccacaccccgccggagaugcgcuucugagagcuccaucucuagcuccaacagcccucuuugugacucuuccuuuaaugcccccaaaugcgggcgcggaaagccggcucuggugcggagacauacccucgaagaucgcagcgagcugaucucuuguauugaaaacggcaauuacgccaaggccgcucggaucgcggccgaggucgggcaauccagcauguggauuuccacggacgcugccgccagcguucuggagccucuuaaaguggugugggcuaagugcucuggauaucccagcuaccccgcccugaucauugauccuaaaaugcccagagucccuggccaccacaacggggugaccaucccggcgcccccucucgacguucugaagauuggcgaacauaugcagacaaaauccgaugagaaacucuuccuggugcuguuuuucgacaauaagcgcucuuggcaguggcuucccaagagcaagauggucccucucggaaucgaugaaaccaucgacaaacugaagaugauggagggcagaaacuccucuauucggaaagcugugcgcaucgccuuugauagagccaugaaucaccugagccggguucauggggaacccacauccgaccuuucugacauugauuga

SEQ ID NO: 66516 - RNA, 2406 nt, Artificial Sequence
  derived and/or modified sequence opt5 from BRD2__Homo_sapiens__NP_001106653
augcugcagaacgugacaccccacaauaagcucccuggcgaggggaacgccggacugcuuggccuggggccggaagcugccgcgcccggaaaaagaauccggaagccuagccuccuguacgagggcuucgaaucccccaccauggcuucugucccugcccuucaacugacgcccgccaauccuccgcccccugagguuagcaaccccaaaaagccugggcgcgugaccaaucagcuccaguaucugcauaaaguggucaugaaggcucuguggaagcaccaguuugccuggcccuucagacaaccgguggacgcuguuaaacucggacugccugauuaccauaagauuaucaaacagcccauggacaugggcacaauuaagcggcgccuugaaaacaauuauuacugggccgcguccgagugcaugcaggauuuuaacaccauguucacaaauuguuauaucuacaacaaaccuaccgacgauauugugcugauggcccagacacucgagaagaucuuucugcaaaaggucgcuucuaugccccaggaggaacaggaacuugugguuaccauccccaaaaauagccacaagaaaggcgccaagcuggcugcccuccagggguccgugacgucugcgcaucaagucccugccgugagcuccgugagccacaccgcucuguauacaccgcccccugagauucccaccacaguccugaacaucccucaccccucuguuauuuccagcccgcuccugaaaucucuucauuccgccggaccuccccugcucgcugugaccgccgccccucccgcucagccucuggcgaagaaaaagggcgugaagagaaaagccgacacgacaacccccacaccgaccgcuauccuugccccugggagccccgccucucccccuggaucccuggagccgaaggcugcccggcuucccccuaugcgcagagaaagcggccggcccauuaaaccuccccgcaaggaucugccugacucccagcaacagcaccagucuagcaaaaaggggaagcuguccgagcagcucaaacauugcaauggaauccugaaggaacuucugagcaaaaagcacgcggcuuacgccuggcccuucuacaaaccggucgaugccucugcucucggccugcacgacuaucaugauauuaucaagcacccuauggaccuuuccaccgugaagagaaaaauggagaaccgggauuaccgcgacgcccaagaauuugcugccgacguuagacugauguucagcaauuguuauaaguacaaucccccugaucaugacguggucgcgauggcccggaaacuccaggauguguuugaguuccgcuaugcuaagaugcccgacgagccgcuggaaccuggcccccugccuguuucuacagccaugccucccgggcucgcuaaaagcuccucugagagcuccagcgaagagucuuccagcgaaucuuccagcgaggaggaagaggaagaggaugaagaggacgaggaagaggaagaguccgagucuagcgauuccgaagaggaaagagcccaccggcuggcggagcuucaggaacagcugagagccgugcaugagcaacucgcugcccugucucagggacccaucagcaagccgaagcgcaaacgggagaagaaagaaaagaaaaagaaaagaaaggcugagaagcaccgcggccgggccggggccgacgaagaugacaaaggacccagagcuccucggcccccucagcccaagaaauccaagaaagcgagcggcucugggggaggcuccgccgcucugggcccuagcggguuuggaccgucuggcggguccggaacgaagcuccccaagaaagccaccaagacagccccucccgcucucccuaccggcuacgauagcgaggaagaggaggaaucucgccccaugagcuaugacgagaaaagacagcugucccuggacauuaacaagcucccgggggaaaaacugggccgcgucgugcacaucauucaagcccgggagccuagccuuagagauucuaaccccgaagagaucgagauugacuucgaaacacugaagcccuccacccuccgcgagcuggaacgguacguccugagcugccuuagaaagaaaccucggaagcccuacacgaucaaaaagccugugggaaaaacaaaggaggagcucgcgcuggaaaagaaacgcgagcuggaaaagagacuccaggauguuuccggccagcugaacucuaccaaaaagccgcccaaaaaggcuaaugagaaaaccgaaagcuccucugcccagcaaguggccgucagccggcuuuccgcuucuagcuccagcucugacuccagcagcuccucuucuuccagcuccagcucugauacaagcgacuccgauucuggguga

SEQ ID NO: 66517 - RNA, 2181 nt, Artificial Sequence
  derived and/or modified sequence opt5 from BRD3__Homo_sapiens__NP_031397
augagcaccgccacaacgguggcucccgccggcaucccugcgaccccggggcccgucaacccucccccucccgagguuuccaauccuucuaagccgggaagaaaaacaaaccagcugcaauacaugcagaaugugguggucaagacccucuggaaacaccaguucgcuuggcccuuuuaucagccuguggacgccauuaagcugaaccuucccgauuaccauaaaaucauuaagaauccuauggacaugggcacaaucaagaaacggcuggaaaacaauuauuacuggagcgccuccgagugcaugcaagauuucaacaccauguuuacaaauuguuauauuuacaacaagcccaccgacgauaucguucucauggcucaggcccuggagaaaaucuuccuucagaagguggcucagaugccgcaagaggaagucgagcugcucccucccgccccuaaagggaagggacgcaagcccgcggccggcgcucagucugccgggacgcaacagguggcugccguuagcuccgugucucccgcgaccccuuuucagagcgucccgcccacagugucccagaccccugugauugccgcuacacccgucccuaccaucacggccaauguuacaagcgugcccgugccgccugcugccgcgcccccucccccugcuacccccauugucccggugguuccucccacacccccuguggucaaaaagaaaggagugaagagaaaagcggacaccaccacaccgacgaccucugccaucacagcuucccggagcgagucucccccuccccuguccgauccuaagcaggccaaaguuguggcccgcagagaaagcggcggccggcccauuaagccucccaagaaagaccuggaggauggggaagucccgcaacacgcuggaaagaaaggcaagcucucugagcaucugcgcuauugcgacuccauccuuagagagaugcugagcaaaaagcacgccgcguacgcuuggccuuucuacaagcccguggaugccgaagcccucgagcugcaugacuaucacgauauuaucaaacacccuauggaccuuuccaccgucaagcggaaaauggacgggcgcgaauaccccgaugcucagggauuugccgcugacgugagacugauguucucuaacuguuauaaguacaauccgccugaucaugagguuguggccauggcgcggaaacuccaggacgucuuugaaaugcgcuucgccaagaugcccgaugagccuguggaggcucccgcccugcccgcuccugccgcgccgaugguuagcaagggcgccgaauccagcagaucuuccgaggaaagcucuagcgacuccgggucuagcgauuccgaggaagaacgggcuacacgccuggccgagcuccaggaacaacugaaagcugugcacgagcagcuugccgcccugagccaggcucccgucaacaagccuaaaaagaaaaaggaaaagaaagagaaggagaaaaagaaaaaggacaaagaaaaggagaaggaaaaacauaaggugaaagcggaggaagagaagaaagccaagguggcucccccugccaagcaggcccaacagaaaaaggcucccgccaaaaaggccaauucuaccacgacagcuggaagacagcucaaaaagggcggcaagcaggccuccgccagcuaugauucugaggaagaggaagaggggcugccuauguccuacgacgaaaaacggcaacuuagccuggauaucaacagacucccgggagagaagcugggccgcguuguccacauuauccagucccgggagcccucucugagagacagcaacccugacgaaauugagaucgauuuugaaacccucaaacccaccacacugcgcgagcuugaacgguaugugaaguccugccugcagaaaaagcagagaaagccuuucucugcuagcgggaaaaagcaagccgcgaaauccaaggaggagcucgcucaggagaaaaagaaagaacuggaaaagcgccuucaggacgugagcggacaacugucuuccagcaagaaacccgcccggaaggagaaaccgggcucugccccuuccgggggacccagcagacucucuagcuccucuagcuccgaaagcggcuccucuagcuccucuggcagcuccucugauagcuccgacagcgaguga

SEQ ID NO: 66518 - RNA, 4089 nt, Artificial Sequence
  derived and/or modified sequence opt5 from BRD4__Homo_sapiens__XP_011526156
augagcgccgaguccggccccgggaccagacugcggaaccucccugugaugggagacggccuggaaacaucucagaugagcacgacccaagcucaggcccagccgcagcccgcgaaugcugccuccacaaacccucccccucccgagaccucuaauccuaacaagccgaaacgccaaacaaaucagcuucaguaccugcucagagucguucugaagacccuuuggaaacaccaguucgccuggcccuuucaacagccuguggaugcugugaagcugaaccuccccgacuauuacaaaaucauuaagacaccuauggauauggggaccaucaagaaacggcuggaaaauaacuauuacuggaaugcccaggagugcauucaggacuucaacacgauguuuaccaauuguuauaucuacaacaagcccggagaugacauuguccugauggcugaagcccucgagaaacuguuccuucaaaagaucaaugagcugccgacagaagagaccgaaaucaugauugugcaggcgaaaggccgcgggagaggacggaaggagacaggcaccgccaagccuggcguuagcacggugcccaacacaacccaggcuuccacaccuccccaaacccagaccccucagcccaauccgcccccuguccaggccacaccccauccuuuucccgcugugacgccggaucucaucguucaaaccccugugaugacagucgugcccccucagccccugcagaccccucccccggugccuccccagccccaaccuccgcccgccccugcgccccagccuguccagucucaucccccuauuaucgccgcuacaccccagccgguuaaaaccaagaaaggggugaagcgcaaagccgacacgacaaccccuaccacaauugaucccauccacgagccucccagccuuccgccugaacccaagaccacaaaacugggacaaagacgggaguccagccgcccugugaagccucccaagaaagacguccccgauucucagcagcacccggcucccgaaaaguccagcaaagugucugagcagcucaagugcuguuccggcauucugaaagaaauguucgccaagaagcaugccgcuuaugcguggccuuuuuacaaacccguugacguggaggcccuggggcuccacgauuacugcgacaucaucaagcacccuauggacaugagcacgauuaaaucuaagcuggaggcuagagaauaucgggaugcccaagaguucggagccgacguccgccuuauguuuuccaacuguuacaaauauaaucccccugaucaugaagugguugcuauggccagaaagcugcaggacguguucgagaugcgguuugcgaagaugccggaugaacccgaggagccugucguggcugucagcucccccgccgugccucccccgaccaaaguuguggccccucccucuagcuccgacuccucuuccgauagcucuagcgacuccgauucuagcacagacgauuccgaagaggaacgcgcucagagacucgccgagcugcaagaacagcuuaaggcuguccacgagcagcuggccgcgcucagccagccccaacagaacaaaccuaagaaaaaggagaaggacaaaaaggagaaaaagaaagaaaagcauaaacggaaggaagagguggaggaaaacaagaaaucuaaggccaaagagcccccuccgaagaaaaccaagaagaauaacuccagcaauucuaacguuuccaaaaaggaacccgcuccuaugaaaagcaagcccccucccacauacgaguccgaagaggaggacaaaugcaagccgaugucuuaugaagagaagagacagcugagccuggauaucaauaaacucccuggcgaaaagcuggggcgcgugguccacauuauccagucccgggagcccucucuuaaaaacagcaauccugacgaaauugagaucgauuucgagacccugaagcccuccacgcucagagaacuggagcgcuacgugaccagcugucuucggaaaaagagaaagccucaagccgaaaaaguggacguuaucgcuggaucuuccaagaugaaaggcuuuuccucuuccgagagcgaaucuagcuccgagucuagcuccagcgauuccgaggacucugaaacagagauggcccccaagagcaaaaagaaaggccacccggggcgcgaacagaagaagcaucaccaucaccaucaccagcagaugcaacaggcgccugcccccgucccccagcaaccuccgcccccuccccagcagccucccccuccgcccccuccccagcaacagcagcagccucccccgccuccuccuccgcccuccaugccccaacaggcugcccccgcuaugaaaucuagcccuccucccuucauugccacccaggugcccgugcuggagccccagcucccgggauccgucuucgauccuaucggccacuuuacacaacccauucugcaucugccucagcccgagcucccuccccaucugccgcagccucccgaacacucuacgcccccucaccuuaaccagcacgccgugguuagcccgcccgcucugcauaaugcgcucccucaacagcccucccggccuagcaacagagccgcugcccugcccccuaagcccgcccgcccgccugcugugucucccgcccugacccagacaccucuucucccccaaccgccuauggcgcagccuccccagguccugcuggaggacgaggaaccucccgcucccccgcucaccuccaugcagaugcaacuguaucuucagcagcugcagaaagugcaacccccuacaccccuccugccuagcguuaaggugcagucucagcccccuccgccccugccucccccuccccacccguccguccagcaacagcuucagcaacagccuccucccccuccgccuccccagccccagcccccuccccaacagcagcaucagcccccgccucggcccgugcaccuccaaccuaugcaguucagcacccauauccagcagcccccgccuccccaagggcagcagcccccucaucccccuccgggacagcaacccccucccccucagcccgccaaaccucagcaaguuauucagcaccaccacucuccgagacaucacaaguccgaucccuacagcaccggccaucugcgcgaagccccuagcccccugaugauccacagcccucagaugucucaguuucaaagccucacacaccagucucccccgcagcagaaugugcaaccuaagaaacaggagcugcgggcugccagcgucgugcagccccagccccuuguggucguuaaggaggagaaaauccauagcccuauuaucagauccgaacccuucucuccuagccugcggccggaacccccuaagcaccccgaguccauuaaagcgccugugcaucucccccaacgcccggaaaugaagccuguggacgucgggagacccgugauccggccucccgagcagaacgcuccucccccgggagcccccgauaaggacaaacagaagcaagagccuaaaacgcccguugccccuaagaaagaucugaagauuaagaauaugggcucuugggcuagccuggugcagaaacacccgaccacacccuccagcaccgccaagucuuccagcgacucuuuugaacaguucagacgcgcugcccgggagaaagaagagagagaaaaggcgcuuaaagcccaggcugagcacgccgagaaggaaaaggagcgccucagacaagaacggaugcgcuccagagaggacgaggaugcucuggaacaggcccggcgcgcccaugaggaagcuagacggcgccaggagcagcaacagcagcagagacaagaacagcagcaacagcagcagcaacaggcggccgcugucgccgccgcugccacaccucaggcgcagagcucccaaccccagucuaugcuggaccagcagcgggagcucgcucgcaaaagagagcaagaacggagacgccgggaggccauggccgcuaccaucgauaugaacuuucagagcgaccugcuuuccauuuucgaagagaaccuguuuuga

SEQ ID NO: 66519 - RNA, 1959 nt, Artificial Sequence
  derived and/or modified sequence opt5 from BRD7__Homo_sapiens__NP_001167455
augggcaagaaacacaagaaacauaagagcgacaaacaccuguacgaggaauauguggagaagccccucaagcugguccuuaaaguugggggaaacgaagugaccgagcuguccacaggcucuagcgggcaugauuccucucucuucgaagacaagaaugaucacgacaaacauaaggauagaaaacggaagaagcgcaaaaagggagagaaacagaucccuggcgaggaaaaggggagaaaacggcgcagagugaaggaggacaaaaagaagcgggaucgcgacagagucgaaaacgaggccgagaaagaucugcagugccacgcuccggugcggcuugaccugcccccugaaaagccccucacgagcucccuggccaaacaggaggaaguugagcagaccccucugcaggaagcgcucaaucaacugaugcgccagcuucagagaaaggaucccucugccuuuuucagcuuuccugugacagacuucauugcuccgggauacuccaugaucauuaaacaccccauggauuuuagcaccaugaaggagaagaucaaaaacaaugacuaucagucuauugaggaacugaaggacaacuucaaacucauguguacaaaugccaugaucuacaacaagccugagaccaucuauuacaaagcugccaagaagcugcuucauuccggcaugaaaauucugagccaagaacggauccagucucucaagcaguccauugauuuuauggcugaccugcagaaaacacgcaagcaaaaagauggcaccgacacgagccagucuggggaggauggaggcugcuggcagagagaacgggaggacuccggggaugccgaggcgcacgccuucaagagccccuccaaggaaaauaaaaagaaagacaaggauaugcuggaggacaaauuuaagucuaacaaucucgaacgcgagcaagaacagcuggauagaaucgucaaagagagcggaggcaaacuuacccggagacuggugaacucccagugugaguucgaacgccggaagccugacgggacaaccacacucggacugcuucaucccguugacccgauugugggcgagccuggcuauugccccgucagacuggggaugaccacgggacgccuccagagcggcgugaauacacugcaaggguuuaaggaagauaagcggaacaaagugaccccuguccuguaccucaauuacggacccuauucuuccuacgcuccccacuaugacagcacauucgccaacaucucuaaggaugacagcgaucugauuuacuccaccuauggcgaggacucugaucuuccuagcgacuuuuccauccacgaguuccuggcuaccugucaggauuacccguauguuauggccgacagccuccuggaugugcuuacaaaagggggacauucuagaacgcugcaggaaauggagaugucccuccccgaagacgagggccacacccgcacacuggauaccgcgaaggaaauggagcagaucacagagguggaaccucccggccggcuggacagcucuacccaagacagacucauugcccugaaggcugucacgaacuucggggugccuguugagguguuugauuccgaagaggccgaaaucuuccagaaaaagcuggacgagacaacccgccuucuccgggagcugcaggaagcucagaaugagagacugagcacccgcccgccgccuaacaugauuugccuucucggacccuccuaccgggaaaugcaucuggccgagcaagucacaaauaaccugaaagaacucgcccaacaggugaccccuggcgauaucguuucuacauacggggugagaaaggcuaugggaauuagcauccccuccccugucauggagaauaacuuuguggaccugacggaggauaccgaggaacccaaaaagacagacgucgcggaauguggccccgggggcucuuga

SEQ ID NO: 66520 - RNA, 2601 nt, Artificial Sequence
  derived and/or modified sequence opt5 from BRD8__Homo_sapiens__NP_001157798
auggccaccggcacagggaagcacaaacugcucagcacgggacccaccgagccuugguccaucagagaaaagcugugccuugcuucuagcgugaugcgguccggcgaccagaacugggucucuguuagccgcgccauuaaaccguucgcggagcccgggagaccucccgauugguuuucccaaaagcauugugcuucucaguacagcgaacugcucgagacaaccgaaacaccuaaacggaagcgcggagagaagggcgaggugguggaaaccgucgaggacgugaucguuagaaaacugacagccgaacggguggaggagcuuaagaaagucauuaaggaaacccaggagcgcuauagacggcugaaacgcgaugccgaacucauccaggcugggcacauggacuccagacuggaugagcugugcaaugacauugccacgaagaagaaacucgaagaggaggaagcugaggugaagcggaaagccaccgaugcggccuaccaagcucgccaggccguuaagacacccccuagacggcugccgaccgugaugguccgcagccccaucgacucugcuuccccuggaggcgauuauccccuuggcgaccugacaccuaccacgauggaagaggccacaagcggggugacccccggaacacucccgucuaccccugugaccuccuuccccggcaucccugauacacugccucccgggagcgcgccccuugaagccccgaugacgcccgucaccgacgauucuccucagaaaaagaugcugggacagaaagcuacacccccucccuccccgcuccugagcgagcugcucaagaagggcucccugcuuccuaccucucccagacugguuaacgagagcgaaauggccguggcuuccgggcaucucaauagcacaggagugcugcuugaggucggcggcgugcugccuaugauucacgggggagaaauccaacagacccccaacacgguugccgccucuccugcugcguccgugagccagcccgacaauugugucccgauggaggccgugggcgacccucauacaguuaccgugucuauggauagcuccgaaauuucuaugaucauuaacagcaucaaagaggagugcuuucgguccggggucgcugaagcccccgugggaagcaaggcccccucuauugacggcaaagaggaacucgaucuggcugagaagauggacaucgccgucuccuacaccggggaggaacuggauuucgagacagugggagacaucauugcgaucauugaagauaaaguugacgaucacccugaggugcucgacgucgcugccguggaagccgcucugagcuuuugugaggagaaugaugacccgcagucucuucccggcccuugggaacaccccauccaacaggagagagacaagccuguuccccugccugcccccgaaaugaccgugaagcaggagcgccucgauuucgaagagacagagaacaaaggcauucaugaacuggucgacauccgggagccguccgcugaaaucaagguggagccugccgaacccgagccugugauuagcggggcggagaucguugccggagucgugcccgcuacguccauggaaccgccugagcuuagaucucaagaucuggacgaagaacucggcagcaccgccgcuggggagauuguggaagccgaugucgcgaucggaaaaggcgacgagacaccccugaccaaugugaagacagaagccuccccugagucuaugcugagccccucccacgggagcaaccccauugaagauccucucgaggcugagacccagcauaaauuugaaaugucugacucccugaaggaggaaagcggcacgaucuucggaucucagaucaaggaugccccgggcgaggacgaagaggaggaugggguuuccgaagcugccagccuugaggaacccaaagaggaagaccagggagagggcuaucugucugagauggauaaugaaccucccgugagcgaguccgacgacggguuuagcauucacaacgccacccuccaaucucacacacuggcugauuccaucccuagcucccccgcgucuagccaguucuccgucugcucugaagaccaggaggccauucaggcucaaaagaucuggaaaaaggccauuaugcugguguggcgcgccgcugccaaucaucgguacgcgaacguuuuucuucagccugugaccgaugacaucgcuccgggauaucacagcauuguccagagacccauggaucucuccacaaucaaaaagaauaucgagaacggccugauucgcucuaccgccgaguuccagcgggacaucaugcugauguuucaaaacgccgugauguacaauagcuccgaucaugacguuuaccacauggcuguggagaugcagagagauguccucgaacagauucagcaauuccuggccacgcagcuuaucaugcagacaagcgagucugggauuuccgcuaagagccugcgcggccgggacucuaccagaaaacaagaugcguccgaaaaggacggaggcacacgcgggcggagaugugccaucgaggccgauaugaaaaugaagaaauga

SEQ ID NO: 66521 - RNA, 1248 nt, Artificial Sequence
  derived and/or modified sequence opt5 from BRE__Homo_sapiens__NP_004890
augagccccgagguggcccugaacagaaucuccccuaugcucucuccguucauuagcuccgucguucggaauggcaagguggggcuggacgcuaccaacugccuucgcaucacagaucugaaaucuggauguacgagccucacccccggcccuaauugcgacagauuuaagcugcacauucccuacgccggggaaacacuuaaaugggauaucauuuucaacgcgcaguauccugagcugcccccugacuuuaucuucggagaagaugcugaguuucucccggaccccuccgcccugcaaaaucuggccucuuggaacccuagcaaucccgaaugucuccugcuuguggucaaggagcuggugcagcaguaccaucaguuccaaugcucccggcuccgcgagagcucuagacugauguuugaauaucagacccuucuggaggaaccucaguacggcgagaacauggagaucuaugcugggaaaaagaauaacuggacaggagaguucuccgcccgguuucuccugaagcugcccguugauuucagcaauauuccgaccuaccuccugaaagacgugaacgaagauccuggcgaagacgucgcucugcugucuguguccuuugaggauacagaagccacccagguuuaucccaagcucuaccugagcccucgcaucgagcacgcgcuuggcgggucuuccgcccugcauauucccgcuuuccccggaggcgggugucucaucgacuacgugccucaagucugccaccuucugacgaauaaagugcaguaugugauucagggauaccauaagagacgggaguauaucgccgcuuuucucagccacuucggcaccggggucguugaauacgaugccgagggauucacaaaacugacccuucugcucauguggaaggacuuuuguuuccuggugcacauugaccuuccgcuguuuuucccccgcgaucagccuacacucaccuuucaauccguguaucauuucacgaacucuggccagcuguacagccaggcgcaaaagaauuaucccuacuccccuagaugggacggcaacgaaauggccaaacgggcuaaggggugccagggaagccgcgaugccuguucucccugggagcagguccuggcuuuugccguggccaaaacaggcugcaagcuccugcagccgcaaagaaacuggccuuccagccgggggcccccuuggcgcgcuucugaaggagagagaaccgcgcaguga

SEQ ID NO: 66522 - RNA, 1755 nt, Artificial Sequence
  derived and/or modified sequence opt5 from BRF1__Homo_sapiens__NP_001229715
auggccgugagcagacaccugacccggggccgcaagauggcucaugucaucgccgcgugccucuaccugguuuguagaacagaggggacgccccacaugcuucuggaccucuccgaucugcuucaggugaacguguauguccugggaaaaaccuuccuccugcuggcucgggaacucugcauuaaugccccugccaucgacccgugucuguacauuccccgcuuugcucaucuucuggaguucggcgaaaagaaccacgaggugucuaugacagcccucagacugcuucaacggaugaaacgcgauuggaugcauaccgggagacggccuagcggacugugcggcgcugcccuccugguugcggcccgcaugcacgacuuuagacggacagugaaggaagucaucuccgugguuaaagugugugagucuacccugcgcaagagacucacagaguucgaagauacccccacgagccagcugaccauugacgaguuuaugaagaucgaucuugaagaggagugcgacccucccuccuauacagcugggcagcggaaacugcgcaugaagcagcucgaacaaguccugucuaaaaagcuggaggaaguggagggagaaaucagcuccuaccaggaugccauugagaucgagcuugaaaauagcagaccuaaagcuaagggcggccucgccucucuggcgaaggacggguccaccgaggauacagccagcucucuguguggagaagaggacaccgaagaugaggagcucgaagcugccgcuucccaccugaacaaagaccuuuaucgggagcugcucggcggggccccgggaagcucugaagccgcuggcucccccgaguggggagggagaccucccgcgcugggcagccuucuggacccucuccccacggccgcuucccugggcauuucugauagcauccgcgaaugcauuuccagccagucuuccgacccgaaggaugccagcggggacggagagcuggaucucucuggcaucgacgaucuggagauugaccggagagaucuuagcaugccucgcugugccaaagcuaagucccagccccauuucccugugcuggcccaauacauccucaaugaaucugaggcgcgggucaaagcugaacuguggaugagagagaacgccgaguaucugcgcgaacagcgggagaaggaagccagaaucgcuaaagagaaggaacuugggauuuacaaggagcacaaacccaagaaaagcugcaagcgccgggagcccauccaggccuccacagcuagagaagccauugagaaaaugcucgaacagaagaagaucagcucuaaaauuaauuacuccguucugcgcggacugagcucugcgggcgggggauccccucaucgggaggacgcccaaccggaacacagcgcuuccgccagaaagcucucucggcgcagaacccccgcuagccgguccggcgccgauccugugacaucugugggcaaaagacugcgcccccuugucagcacccagccugcgaagaaaguggccaccggggaggcucugcuccccuccagcccgacacugggagccgagccugcucggccccaggccguucugguggaaucuggcccugucuccuaucacgccgacgaggaagcugacgaggaggaacccgaugaggaagacggggagccuugugugagcgcgcuucaaaugaugggaucuaacgauuacggcugcgacggggaugaagacgauggcuauuga

SEQ ID NO: 66523 - RNA, 1260 nt, Artificial Sequence
  derived and/or modified sequence opt5 from BRF2__Homo_sapiens__NP_060780
augcccggcagagggcggugcccugacuguggaagcaccgagcugguggaagauucccacuacucucagagccaacucgucugcuccgacuguggcugcguugugacagagggggugcugacgaccacauucucugaugaaggaaaccuucgcgaggucaccuauagcagauccacaggcgaaaaugaacaggugucucggagccagcagcgcgggcugagacggguucgcgaccucuguagagugcugcaacuuccgcccaccuuugaggauacagccgucgcuuacuaucagcaggccuaccggcauuccggaauccgcgcggcuagacugcagaagaaagaggugcucguuggcugcugugugcugauuaccugccggcaacacaacuggccucugacgaugggcgccaucuguacccuccuguaugccgaccuugaugucuucagcucuacauacaugcagauugugaagcugcucgggcuggacgugcccucccuuugccuggcugagcucgucaaaaccuauuguagcucuuuuaagcuguuccaggccuccccuagcguucccgcuaaauacguggaagauaaggagaagaugcugucucgcacaaugcagcucguggagcuggccaaugaaaccuggcuugucacgggaagacauccucugccggugaucacagcggccaccuuucucgcuuggcaaucccugcagcccgccgaccggcuuagcugcucccuggcucgcuucugcaaacucgccaacguugaucugccuuaccccgcgucuagcagacugcaggagcuccuggccgugcuucugcggauggcugaacaacucgccuggcugagaguccuucgccuggacaagcgguccgugguuaaacacauuggcgaucuccugcagcauagacagagccuggugcgcucugcuuuucgggacgggacagccgaggucgaaaccagagagaaggagccucccggauggggccaggggcaaggagaaggcgaggugggcaauaacucccucgggcugccgcagggaaaacgcccugccagccccgcgcuucugcucccucccuguaugcugaagucucccaagcggaucugcccugucccgcccgugagcaccguuacaggcgacgaaaauaucuccgauucugagauugaacaguaucugagaacgccucaggaggugcgcgacuuccaacgggcucaggccgcuagacaggccgccaccagcguccccaacccucccuga

SEQ ID NO: 66524 - RNA, 756 nt, Artificial Sequence
  derived and/or modified sequence opt5 from BRI3BP__Homo_sapiens__NP_542193
augggcgccagagcuagcgggggaccccuggcccgggcgggccuccugcuucugcuccugcuucugcuccugcuggggcuccuggcuccuggagcccagggcgcccgcgggagaggaggcgcugagaagaacuccuaccggcgcaccgugaauacauucucucaaagcgucuccucucuuuuuggcgaagacaacguuagagccgcucagaaauuccuggcccggcucacggagcgcuuugugcuggggguggauauguucgucgaaacccuuuggaagguguggacagagcugcucgacguucugggacuggaugugagcaaucucucccaguauuuuucuccggcgagcgucuccagcucucccgccagagcucugcuucuggugggcguugugcuccuggccuacugguuccuuucccugacccucggguuuacauucagcguccugcacgugguguuuggacgguucuuuuggaucguccgcguugugcuguucucuauguccugcguguauauucuccauaaauacgaaggcgagccugagaacgcuguccugccccuuuguuuugugguugccguguauuucaugaccgggccuaugggauucuacuggagaagcucucccuccggcccuagcaauccguccaaccccucugucgaagagaagcuggaacaccucgagaaacaggugcggcugcuuaauauccgccugaacagaguucucgagagccuggaccgguccaaggauaaguga

SEQ ID NO: 66525 - RNA, 297 nt, Artificial Sequence
  derived and/or modified sequence opt5 from BRI3__Homo_sapiens__NP_001152963
auggaccacaagccccugcuccaggagagaccuccggccuacaaccuggaagccggccaaggggauuaugccugcggaccccauggcuacggggcgaucccugcugcucccccucccccuccguaucccuaccuugugaccggcauuccuacacaccauccccgggucuauaauauccacagccgcacgguuaccagauacccugccaacuccauugugguggucggagggugucccgugugccggcaucagcgcucuagcuggcuguauacauacccgcucagaguuuguaccuga

SEQ ID NO: 66526 - RNA, 2286 nt, Artificial Sequence
  derived and/or modified sequence opt5 from BRINP1__Homo_sapiens__NP_055433
augaacuggagauucguggagcugcucuacuuucuguucaucuggggccggauuagcguccagcccucccaccaagaaccugccgggaccgaccagcauguuucuaaggaguuugauuggcuuaucagcgaccgcggaccguuccaccauuccagaucuuaucugagcuuuguggaacggcaccgccagggcuucacaacgagauacaaaauuuaucgggaguuugcucgcuggaaggugagaaauaccgccaucgaacggcgcgaucucgucagacaucccgugccucugaugcccgaguuccagcgguccauucgccuucuggggagacggccuacaacccaacaguuuaucgacacaaucauuaaaaaguacggaacccaccuccugaucucugcgacacugggcggggaggaagcucucaccauguauauggauaaaagccgccuggacagaaaguccggaaacgccacgcagagcguugaggcccuucaccagcuggcuucuuccuacuucguggaucgggacggcaccaugagacgccuccaugaaauucaaaucagcacaggcgccauuaaggucaccgagacacggaccgggccccugggaugcaauucuuaugauaaccuugacuccgugagcucuguucugcuccaguccacggagagcaaacugcaccuucagggccuccagaucauuuuuccucaauaccugcaggaaaaguucgugcaguccgcucuuucuuacaucauguguaauggggagggagaauaucugugccaaaacagccaguguagaugccagugugccgaggaauuuccgcagugcaauugucccaucacagauauucaaaucauggaguacacccucgcgaacauggccaaauccugggcugaggccuauaaggaccuggaaaauagcgaugaguucaaaucuuucaugaagcgccuuccuuccaaccauuuucugacaauuggcagcauccaccagcacugggggaaugacugggaccuccagaaccgguacaagcugcugcagucugcuaccgaagcccaaagacagaaaauucagcgcaccgcgcggaaacucuucggacugagcgucagaugccgccauaaucccaaccaccagcuuccucgggagagaacaauccaacaguggcuggcccgcgugcagucccuccuguauuguaaugaaaacggcuuuuggggcacguuccuugagucucagcggagcugcgugugucauggguccaccacacugugccaaagacccaucccgugcgucauuggaggcaacaauagcugugcuaugugcucucucgccaacaucucccugugugggagcugcaauaaaggauacaagcuguaucggggccgcugugagccucagaacguugauucugaaagauccgagcaguuuauuagcuucgaaaccgaccucgauuuucaagaccuggagcuuaaauaccugcuccagaagauggauucccggcuguacgugcacacaaccuucaucucuaaugaaauuagacuggacacguuuuucgauccccgcuggcggaaaagaaugagccuuacacucaaguccaacaagaaucgcauggacuuuauccauauggugaucgggaugucuaugagaauuugccagaugcggaacagcucccuggauccuauguucuuugucuaugugaaucccuucagcggaucucacuccgagggcuggaacaugcccuucggcgaguuuggguacccucgcugggaaaagaucagacugcagaauagccaauguuauaacuggacccuccugcuuggaaaucgguggaagaccuucuuugagacaguucacauuuaccugcgcucuagaacccggcucccgacacugcugcgcaacgaaacgggccaggggcccguggaccuuuccgauccuagcaaaagacaguucuauaucaagauuucugacguccagguguuuggauacagccuccgguucaaugcugaccugcugcgcuccgccguucaacaggugaaccagagcuauacccagggcgggcaauuuuacucuuccagcuccgucaugcuccugcuucuggauaucagagaccggauuaacagacucgcucccccuguggcccccggcaaaccgcagcuggaucuguucucuugcaugcuuaagcaucgccucaagcugacaaauagcgagaucauccgggucaaccacgcgcuggaccucuacaauaccgagauucugaaacaguccgaucaaaugacagccaagcuguguuga

SEQ ID NO: 66527 - RNA, 2352 nt, Artificial Sequence
  derived and/or modified sequence opt5 from BRINP2__Homo_sapiens__NP_066988
augagauggcagugcggcacccgguuccgcgggcugagacccgccguggcuccuuggacagcccuccuggcgcuuggacugccgggcuggguccucgcuguuagcgccacggccgcugccguggugcccgagcaacacgcuuccgucgccgggcagcauccucuggacuggcuucugaccgaucggggacccuuucaccgcgcgcaggaauacgccgacuucauggagagauaucggcagggcuuuacaacccgcuacagaaucuaucgggaauuugcucgcuggaaggugaacaaucucgcccuggagagaaaagauuucuucucucugccucucccccuggcuccugaauuuauucggaacauccgccuucuggggagacggccgaaucuccaacagguuacagagaaccugauuaagaaauacggaacccauuuccuucugagcgccacacucggcggcgaggaaucccugaccaucuuuguggacaagcagaaacuggggcgcaagacggagaccacaggaggcgcgucuauuaucgggggaagcggcaauuccaccgccgucucucucgaaacacugcaccagcuugcugccagcuauuucaucgauagagaguccacccugcggagacuccaucacauucaaaucgcuacgggggccauuaaggugacagagacccgcacaggaccccugggcuguagcaacuacgacaaucuugauucuguuuccagcgugcugguccagucuccugaaaacaaagugcagcuccugggccuccaggugcugcugcccgaguaucuucgggaaagauuugucgccgcugcgcuguccuacauuaccugcagcucugagggggaacucguuuguaaggagaaugacugcugguguaaaugcuccccuaccuuccccgaguguaacugcccggaugccgacauccaagcuauggaagauagccugcuucagauccaggacuccugggccacacacaaucgccaauuugaggaaucugaggaguuccaggcccugcucaagcggcugccugaugacagauuccugaacagcacggcuauuucccaguuuugggccauggacaccagccuccagcaucgcuaccaacagcugggagcgggccuuaaagugcuguucaagaagacacaccggauccucagacgccuguuuaaucuguguaaacggugccauagacagccccgcuuccggcuuccuaaggaaagaucucucuccuauugguggaaccggauccagagccugcuguacuguggggagucuaccuuucccggaacauuccucgaacaaagccacuccuguaccugccccuaugaucagucuagcugccagggcccuauuccgugcgcucugggggagggacccgccugugcccacugcgcuccugacaauuccacgcgcuguggcagcugcaaccccggcuacgugcuugcccaggggcuguguagaccugaagucgcugagucucucgaaaacuuucugggacuggagacagaucuucaagaccucgagcugaaauaucugcuccagaagcaggauucccggaucgaagugcauagcauuuucaucucuaaugacaugagacugggcuccugguuugaucccagcuggcgcaaacggaugcuucugacccucaaguccaacaaauacaagccggggcugguucacgugaugcuggcccuuucucuccagauuugccugaccaagaauagcacacuggagccugucauggcgaucuaugugaaccccuucggaggcucccauucugaaagcugguuuaugccuguuaaugagggguccuuccccgacugggagagaaccaacguggaugccgcugcccaaugucagaauuggacaaucacgcucggcaaccgcuggaaaaccuuuuucgaaacaguccacguguaccugagaagccggauuaagucucuugacgauuccagcaaugagaccaucuacuaugaaccucuggagaugacagaccccucuaaaaaccucggauacaugaagauuaauacccugcaggucuucggcuauucccugccguuugacccugaugcuauccgcgaccuuauucuccaacuggauuaccccuauacgcaggggagccaggacucugcccugcuccagcugaucgaacuuagagaucgggugaaccaacugagcccucccggaaaaguucgccucgaccuguucuccugccugcuuagacaucggcugaagcucgcgaauaacgaggugggccgcauccagagcucucugagagccuuuaauuccaagcucccgaaccccgucgaguacgaaaccgggaaacuguguagcuga

SEQ ID NO: 66528 - RNA, 2301 nt, Artificial Sequence
  derived and/or modified sequence opt5 from BRINP3__Homo_sapiens__NP_950252
augaucuggagaagccgggccggcgcugagcuguucucccucauggcccugugggaauggauugcgcuuucucugcacugcugggugcucgcugucgccgccguuagcgaccagcaugcuaccucccccuuugauuggcugcuuucugacaaggggccuuuccaccgcagccaagaguacacagauuuuguggacagaucccggcagggauucucuacgcgcuauaaaaucuacagagaauuuggccgguggaaggugaacaaucuggccgucgagcgcagaaacuuccucgggagcccgcugccccuggcuccugaauuuuuccggaauauucgccuccugggaagacggcccacccuucagcagaucacagagaaccugauuaaaaaguauggcacccauuuucuccuguccgccacacuugggggagaggaaagccugaccaucuucguggauaaacgcaagcucucuaagagagcggagggcuccgacagcacaaccaauucuuccagcguuacgcuggaaacccugcaccaacucgccgcuucuuacuuuaucgaucgggacuccacacugcgcagacuucaucacauucagaucgccagcaccgcuauuaaagugacagagacccggacgggcccucugggguguuccaacuaugauaaucucgacucugucagcuccgugcugguucagagccccgagaacaagauccagcuucaaggacugcaagugcuccugccugauuaccugcaggaaagauucguccaggccgcgcucucuuauauugccugcaauuccgagggcgaauuuaucuguaaagagaacgacugcuggugucacugcgggccgaaguuccccgaauguaauugcccuagcauggauauucaagcuauggaggagaaccugcuucgcaucacagaaaccuggaaagccuacaauucugacuucgaggaaagcgacgaguuuaagcuguucaugaagcggcuccccaugaacuacuuucugaauacauccaccaucaugcaucuuuggaccauggauucuaacuuccagagacgcuaugaacagcuggagaacagcaugaaacaacucuuucugaaggcucagaaaauugugcacaagcuguucucccucagcaaacggugucauaagcagccucugaucucucuucccagacagcgcacauccacguacuggcugacccggauucagagcuuucucuauugcaaugagaacggacugcugggcucuuucuccgaagagacacacagcuguaccugcccgaaugaccagguggucugcacagccuuucuuccuuguaccguuggggaugccuccgcuugccucacgugugcgcccgacaacagaacacgcugcggaaccuguaauaccggcuacaugcugucucagggccugugcaaaccugaaguggccgagagcacagaucacuauaucggguucgaaaccgaccuccaggaucuggagaugaaguaccuucugcaaaagacagaccggagaauugaggugcaugcuaucuuuaucuccaacgauaugcgccucaauucuugguucgaccccagcuggcggaaaagaaugcugcugacgcuuaaguccaacaaauauaagagcucucucguccacaugauucugggacugucccuccagaucugucugaccaaaaauagcacacuugaacccgugcuggccguuuacgugaacccuuuuggcgggucucauuccgagagcugguucaugccggucaaugaaaacucuuuccccgauugggagcggaccaagcucgaccugccucugcagugcuacaauuggacacuuacccucggaaacaaguggaaaacguuuuucgagaccgugcacauuuaucugcgcagcagaaucaaguccaauggccccaacgggaacgaaagcauuuacuaugagccucuggaauuuaucgaccccucucggaaucucggauacaugaaaaucaacaauauucagguuuucggcuauuccaugcauuuugauccggaggccaucagagaccugauucuucaacuggauuacccuuauacacagggcagccaggacuccgcucuccugcagcugcuugaaauccgcgaucgggugaacaagcucucucccccugggcaaagacgccuggaccuguucagcugucuccugagacaccggcuuaaacuguccaccucugaggucgugcgcauucagagcgcccuccaggcguuuaaugcuaagcugcccaacacaauggauuacgacaccacgaagcugugcuccuga

SEQ ID NO: 66529 - RNA, 3750 nt, Artificial Sequence
  derived and/or modified sequence opt5 from BRIP1__Homo_sapiens__NP_114432
augagcuccauguggucugaguacaccaucggcggggugaagauuuauuuccccuacaaagccuauccuagccagcuggcuaugaugaacuccauccucagaggacuuaauucuaagcaacacugccugcuggaaagcccgacaggcuccgggaaaucucucgcccugcuuuguagcgcgcuggcuuggcagcagucccucagcggaaagcccgccgacgagggcgucucugaaaaagccgagguucagcuguccugcuguugcgcuugucauagcaaggauuuuacgaacaaugacaugaaccaagggaccucucggcacuucaauuacccuuccacacccccuagcgaacgcaacggaaccucuuccacaugccaggauagccccgagaagaccacacuggccgcuaaacucuccgccaagaaacaggcgucuauuuauagagacgagaaugaugacuuucagguggaaaagaaacggauccgcccucuggagaccacgcaacagauuagaaagcggcauuguuucggcaccgaagugcacaaccuugaugccaaggucgacagcggcaaaacagugaagcucaauuccccgcuggagaaaaucaacagcuuuucuccccagaagccucccgggcauugcucccgcuguugcuguagcaccaaacagggaaauucucaagagagcuccaacacaaucaagaaagaucacaccggcaagucuaagauuccuaaaaucuacuucgggacgagaacacacaagcagauugcucagaucacccgggaacugcgcagaacagccuauagcggaguucccaugaccauucuuuccagccgggaccauaccugcgugcacccggaggucgugggcaauuuuaaccgcaaugaaaaaugcauggagcugcucgaugggaagaacggaaaaucuuguuacuucuaccauggcguucacaagaucuccgaccaacacacacugcagacguuucagggcaugugcaaggcuugggauauugaggaacuggugagccucgggaaaaagcugaaagccuguccuuauuacaccgcgagagagcuuauccaggacgccgacaucauuuucugccccuauaacuaccugcucgaugcucaaauccgggaaucuauggaccugaaucuuaaggagcaggucgugauucuggaugaagcccauaacaucgaggacugugcucgcgaauccgccagcuauuccgugacagagguccagcucagauuugcccgggaugagcuggacucuaugguuaauaacaauauucgcaaaaaggaucacgaaccucugagagcugugugcuguagccucaucaacuggcuggaggcgaaugccgaauaccuuguggagcgggacuaugaauccgcuugcaagaucuggucuggaaacgagaugcugcucacccugcauaaaaugggcauuacaaccgccacguuccccauccuucaggggcacuuuagcgccguccugcaaaaggaggagaaaauuucccccaucuacggaaaggaagaagcuagagaggugccuguuauuagcgccucuacacagaucaugcucaaaggccuguucauggugcuggauuaccucuuccgccaaaauucccgguuugcggacgauuauaagaucgcuauucagcagaccuacagcuggaccaaccagaucgacauuucugacaagaaugggcugcuuguccugccgaaaaacaagaaaagaucccgccagaagacagccgugcauguucucaauuucuggugucugaaccccgccguggcuuuuagcgauaucaauggaaaaguccagaccauugugcugacaucuggcacgcuuagcccuaugaaguccuucagcucugagcucggcgucaccuuuacaauccaacuggaagccaaccacauuaucaaaaacucccagguguggguugggaccaucggaagcggccccaaggggcggaaucugugcgcuacauuccagaacaccgagacguuugaguuccaagacgaagugggagcccuccugcuuuccgucugucagaccgugucucagggcauucugugcuuucucccuagcuauaagcugcuggaaaaacuuaaggagagauggcucuccacagggcuguggcacaaucuggagcucguuaaaaccgugaucgucgaaccccagggcggagagaagacaaacuucgaugaacugcuucaaguguacuaugacgcgauuaaauacaagggcgagaaggauggggcccugcucguggcuguuugccgcggaaaagucucugaaggccuggacuuuagcgaugacaaugcccgggcugugaucaccauugggaucccguucccuaacgugaaggaucugcaggucgagcuuaaaagacaguauaaugaccaucacuccaagcuccgcggacugcugcccggccggcagugguacgagauccaagccuacagagcgcucaaccaggcccuggggcgguguauucgccauagaaaugauuggggcgcucuuauccugguggacgaucgguuuagaaacaauccuucucgcuauauuagcggacucuccaaauggguucggcagcagauccaacaccacagcacguucgaaucugcccuggagucccuggcugaguucagcaagaagcaucagaaagugcuuaacgucucuauuaaggacagaacaaauauccaggacaacgaauccacccucgaagugacaagccugaaauacucuaccucccccuaucugcucgaggccgccagccaccuguccccugagaauuuuguugaagaugaggcuaagaucugcgugcaagaacuucagugucccaaaauuaucaccaagaacagcccgcugccuucuagcauuaucucccgcaaggagaaaaacgaccccgucuuccucgaggaagcgggcaaggccgagaaaauugugaucucuagaagcacaucccccacguuuaauaagcagaccaaacggguuucuuggagcuccuucaacucucuggggcaguacuuuacaggaaagaucccuaaagcuaccccggaacugggcagcuccgagaauagcgccucuuccccuccccgcuucaagacagaaaagauggagagcaaaaccgugcuucccuuuacggauaagugcgagucuuccaaccugacagucaauaccagcuucggguccuguccucaaucugaaaccauuaucagcucccucaaaauugacgccacacugaccagaaagaaccauagcgagcacccccucugcucugaagaggcucuggauccugacaucgaacuuucccuggugagcgaggaggauaaacagucuacaagcaaucgggacuuugaaacggaggccgaagaugaguccauuuauuucacccccgaacucuacgacccggaggauacagacgaggaaaagaacgaucuggcggagaccgaccgcggaaauagacuggcuaacaauucugacuguauccuugccaaggaucuguuugaaauucggacaaucaaagagguggacagcgcccgcgaggucaaggcugaagauugcaucgacaccaaacucaacggcauucugcauaucgaggaauccaagauugaugacaucgaugggaauguuaaaacgaccuggauuaacgagcucgaacugggcaagacacacgagaucgagaucaagaauuucaaaccuucucccagcaagaacaaaggaauguuuccuggcuucaaguga

SEQ ID NO: 66530 - RNA, 228 nt, Artificial Sequence
  derived and/or modified sequence opt5 from BRK1__Homo_sapiens__NP_060932
auggccggccaggaggaccccgugcaaagagaaauccaccaggauugggcuaaccgggaguacauugaaaucauuaccagcuccaucaagaaaauugccgacuuccuuaauucuuuugauaugagcugccgcuccagacucgcgacacugaacgagaagcugacggcucuggaacggcgcaucgaguauaucgaggccagagucaccaaaggggaaacacucaccuga

SEQ ID NO: 66531 - RNA, 873 nt, Artificial Sequence
  derived and/or modified sequence opt5 from BRMS1__Homo_sapiens__NP_001020128
augcccgugcagccuccgagcaaggacaccgaggaaauggaggccgaaggcgauuccgcugccgagaugaacggggaagaggaggaaucugaggaagagagaagcggaucccaaacagagucugaagaggaaagcuccgagauggacgaugaagacuacgagcggcgcagaucugagugcgucagcgaaaugcuggaucucgagaaacaguucuccgaacugaaggagaaacuuuuucgggaacgccugagccagcucagacugcggcuugaggagguuggcgcggaacgcgcucccgaguauacggaaccucucgggggacuccagagaucucugaagauccggauucaaguggccggcaucuacaaaggguucugucuggacgugauucgcaauaaguaugagugcgaacuccagggagccaagcagcaccuggaguccgagaaacuucugcucuacgauacccugcagggcgaacuucaagagagaauccagcggcuggaagaggaccgccagagccucgaucugucuuccgaguggugggacgauaagcugcaugcuagaggcagcucucgguccugggacagccugcccccuuccaaacgcaagaaagcuccccuggucucugggccuuauauuguguacaugcuucaggaaaucgauauccuggaggacuggacagccauuaagaaggccagagcggccguuagcccgcaaaaacggaaguccgacgauagacgcacccaccggccccucagaguguguccugcucgccugcuuuggugcuguugggcccugccccuccaucuggcucuggccuggacaccuccccucccgagcucucggccugcgcagcuguggcccugguccuga

SEQ ID NO: 66532 - RNA, 972 nt, Artificial Sequence
  derived and/or modified sequence opt5 from BRMS1L__Homo_sapiens__NP_115728
augcccgugcacagcagaggcgacaagaaagagaccaaccaucacgaugaaauggaggucgacuacgccgaaaaugagggguccucuagcgaagaugaggacacagaguccucuagcguuuccgaagauggagacucuagcgagauggaugacgaagauugcgagcggcgcagaauggagugucuggacgaaauguccaaccucgagaagcaguucacggaucugaaagaccaacuuuauaaggaacggcugagccagguggaugcuaaacuccaggaggugaucgccggcaaggcgccugaauaccuggagccgcuugcuacccugcaggagaauaugcaaauucgcacaaaggucgccgggaucuauagagaacucugccuggagucugugaaaaacaaguacgaaugugagauucaggccucccggcagcauugcgaaagcgagaaacugcuccuguaugacaccguucagucugagcuugaagagaagauccgcagacuggaagaggaccggcacuccauugauaucacaagcgaacucuggaaugacgagcugcaaucucgcaaaaagagaaaggaucccuuuuccccugacaaaaagaaacccguggucgugagcggaccuuacaucguuuauaugcuucaggaucuggacauucucgaggauuggaccacaauccggaaggcuauggccacccugggcccccaucgcgugaaaacggaaccuccggucaagcuggagaaacaccuccacuccgcuagaucugaagaggggcggcuguacuacgacggagagugguauauucgcggccagaccaucuguauugauaagaaggacgaaugccccacaagcgccgugaucaccacaauuaaccaugaugaggugugguucaaaagaccugacggcuccaagagcaaacuuuacaucucucagcugcaaaaggggaaauauuccaucaagcacagcuga

SEQ ID NO: 66533 - RNA, 1200 nt, Artificial Sequence
  derived and/or modified sequence opt5 from BRS3__Homo_sapiens__NP_001718
auggcccagagacaaccccacagcccuaaccagacccugaucuccauuacaaaugacacggagucuagcuccucuguggucagcaacgauaauaccaacaagggcugguccggggacaauucuccgggaaucgaagcucucugcgccauuuacaucacauaugcgguuauuaucagcgugggcauccuggggaacgcuauucuuaucaaaguguucuuuaagaccaaauccaugcagacaguccccaauauuuucaucaccagccuggccuuuggagaucuccugcuucugcucacaugugugccuguugacgccacccauuaccuggcugagggcuggcuguucgggcggauuggaugcaaggugcucucuuuuauccgccugacguccgucggcgugagcguuuucacccuuacaauucugucugccgauagauauaaagcuguggucaagccccucgaacggcagccuuccaacgccauccugaagaccugugugaaagcgggcugcguguggaucgucagcaugauuuuugcccuucccgaggcuaucuucucuaauguuuacacauuucgcgacccuaacaagaauaugaccuucgaauccuguacgagcuauccgguguccaaaaagcugcuccaagagauucacucucugcugugcuuucucguguucuacaucauuccccugagcaucaucuccgucuauuacagccuuauugccagaacacuguacaaaucuacccucaacaucccuacagaggaacagucccaugcucggaagcagauugagagccgcaagagaaucgcccggaccgugcugguucuuguggcgcuguuugcccucuguuggcugcccaaucaucugcucuaucuguaccacucuuucaccagccagacauaugucgauccuuccgcuaugcacuucauuuuuacgaucuucucucgcgugcuugccuuuagcaacuccugcguuaaucccuucgcucuguacuggcucagcaaaucuuuucaaaagcacuucaaagcccagcuguuuuguugcaaggccgaaagaccggagccucccguggcugacaccucccuuacaacccuggcggucauggggacagugccuggaaccggcagcauccagaugucugagauuuccgucacgagcuucacaggguguuccgugaaacaggccgaagaucgguuuuga

SEQ ID NO: 66534 - RNA, 2337 nt, Artificial Sequence
  derived and/or modified sequence opt5 from BRSK1__Homo_sapiens__NP_115806
augagcuccggcgccaaggaagggggaggcgggucucccgcuuaccaucugccucacccgcacccccauccuccccagcacgcccaauaugugggaccuuacagacucgagaaaacccugggcaaggggcagacaggacuugucaaacugggcguucauugcaucacgggccagaagguggcgauuaaaaucgugaaccgggagaagcucagcgaauccguccugaugaagguggagcgcgaaauugcuauccuuaaacugauugagcacccccacguucucaagcugcaugacguguaugagaauaaaaaguaccuguaucucguccuggaacacgugucugggggagagcuuuucgauuaccugguuaaaaagggcagacucaccccuaaggaagcccggaaauuuuuccgccagaucgugagcgcccuggacuuuugucauuccuauucuaucugccacagagaucuuaagccggagaaccugcuccuggacgagaaaaauaacauucggaucgcugauuucgggauggccagccugcaagucggagacucccuccuggaaacaagcuguggcucuccccacuacgcuugcccugaggugauuaagggggaaaaauacgauggacgcagagccgacaugugguccuguggcgugauccuuuuugcgcugcucgucggcgcccugcccuucgaugacgauaaucuucggcagcugcucgagaagguuaaacgcgggguguuucauaugccucacuucauucccccggacugccagagccugcugagaggaaugaucgaaguggagccugagaagcggcucucucuggaacagauucaaaagcaucccugguaucuuggcgggaaacacgagccugaucccugucuggaacccgcuccuggacgcagagucgccaugcggucccucccgagcaacggcgagcuggaccccgacgugcuugaaucuauggcuucccuggggugcuuucgcgauagagagcggcuccauagagagcugcgcagcgaagaggaaaaucaggagaagaugaucuacuaucugcuccuggaccggaaagaaagauacccuuccugugaggaucaggaccuucccccucgcaacgauguugaucccccgcggaagagaguggacucuccuaugcugagccgccacggaaaacggagacccgagcgcaaguccauggaaguccucagcaucaccgacgccggcggcgggggaucuccugugcccacacggagagcgcuggagauggcccagcacucccaacgcagccggucuguuagcggcgcuuccaccgggcugucuagcuccccucuuagcucucccagauccccgguguucagcuuuucuccugaacccggagccggcgaugaggcucgcgggggcggaucccccacaagcaagacccagacgcucccuucccggggcccgagagggggaggcgccggggagcagcccccucccccuucugcccggagcaccccucugcccggacccccgggcuccccuagaucuagcgggggcacaccccugcauuccccucuccacacaccccgcgcuagcccgaccggaaccccuggcacgacacccccucccucucccgggggaggcgucgggggagcggccuggcgguccagacugaauagcauucgcaacucuuuccuuggcuccccuagauuucaucggcgcaaaaugcaagugccgaccgcugaagagaugagcucucugacacccgaaagcuccccugagcucgccaagagaagcugguucgggaauuucaucucucuggacaaagaggaacagauuuuucugguccuuaaggauaaaccccucuccagcaucaaggccgacauugugcacgcuuuccuguccaucccuucucugagccacuccguucucucucagaccagcuuucgggccgaguauaaggcguccggcggacccucuguguuccagaaaccuguccgcuuucaaguggacaucagcuccagcgaaggcccggagcccucuccuagacgggauggguccggaggcgggggaauuuacagcguuaccuucacacugaucucuggccccucccgcagauuuaagcggguggucgaaacgauucaggcucagcuucugagcacccaugaccagccuucugugcaagcccucgccgaugagaaaaacggggcucagacacgccccgccggcgcuccgccuagaucccugcagcccccucccggacggcccgacccugaacugagcuccagcccgagacgcgggcccccuaaggauaaaaagcuccuugccaccaauggcacaccccugccuuga

SEQ ID NO: 66535 - RNA, 2211 nt, Artificial Sequence
  derived and/or modified sequence opt5 from BRSK2__Homo_sapiens__NP_001243556
augaccagcacaggcaaggacgggggagcccagcacgcucaauacgugggccccuauagacuggagaaaacgcucgggaagggacagaccggccuggucaaacuugggguucauugcgugacaugucagaagguggccaucaaaauugucaaccgggaaaagcuguccgagucugugcucaugaagguugaacgcgagaucgcgauucugaaacuuaucgaacacccucaugugcugaagcuccacgaugucuacgagaauaaaaaguaucuguaccuggugcucgagcauguuagcggaggcgaacuguucgacuaucuugugaaaaagggcagacugaccccgaaggaggcucggaaauuuuuccgccagauuaucuccgcccucgauuuuugccacucucacagcaucugucauagagaccugaagcccgaaaaccuucugcucgaugagaaaaauaacauucggaucgccgacuucgggauggcuucccugcaagucggagauucucugcucgagacaagcugcggcuccccucacuacgccugucccgaagugauucgcggggagaaguaugacggaagaaaagcugauguguggagcugcggcgucauccuguuugcccuucugguuggggcgcucccuuucgacgaugacaaucugcggcagcuucuggaaaaggugaaacgcggaguguuucauaugccccacuucauuccuccggauugucagucucuccugagaggcaugaucgaggucgacgccgcucggcgccugacccucgaacacauucagaagcauaucugguacaucggcgggaagaacgagcccgagccugaacaacccauuccuagaaaagugcagauccggucccugcccagccuugaggacauugauccggacguucuggauucuaugcacucccucggaugcuuucgcgacagaaauaagcugcuucaggaucugcucagcgaagaggaaaaccaggagaaaaugaucuacuuccugcugcucgaccggaaggagagauauccuucucaagaagaugaggaccugcccccucgcaaugaaauugauccuccccggaaaagaguggacucccccaugcuuaaccgccauggcaagcggagaccggagcgcaagagcauggaaguccuguccgugacagaugggggaucucccguuccugcccggagagcuaucgagauggcccagcacggccagcgcagccgguccaucagcggggcgucuuccggacucagcaccucuccccugagcuccccuagagugacgccccauccgucuccucgcggcagcccccugccuacccccaaaggcacaccuguccacacccccaaggaguccccggccgggacaccuaaucccacgcccccuagcucuccguccgugggaggcguccccuggcgggcuagacuuaacagcauuaaaaauucuuuucucggguccccucgguuccaccgcagaaagcugcaagugcccaccccugaagagaugagcaaccugacacccgaauccucuccugagcucgccaaaaagagcugguuuggaaauuucaucucccuggagaaggaggaacagauuuucguugugaucaaagacaagccccuuucuagcauuaaagcugacaucguccaugccuuucuguccaucccgagccucucucacuccgugauuagccagaccucuuuccgggccgaauacaaggcuacaggcgggccugcgguuuuucagaaacccgugaaguuccaagucgauaucaccuauaccgagggcggagaagcccagaaggagaacggcauuuacuccgugacauuuacgcugcugagcgggccuucuagacgcuucaaacgggugguugagaccauccaggcucagcuucucagcacacaugaucccccggccgcccaacaccuguccgacaccacaaacuguauggaaaugaugaccggaagacugagcaagugcggcucuccucucuccaacuuuuucgacgucauuaaacagcuguuuagcgaugagaagaaugggcaggcugcccaggcgcccuccacgccugcuaaacgcucugcccacggaccccuuggcgacagcgccgcugccgggcccggcccuggaggcgaugcugaauauccgacagggaaggacaccgccaaaaugggacccccuaccgcgagacgggagcaacccuga

SEQ ID NO: 66536 - RNA, 363 nt, Artificial Sequence
  derived and/or modified sequence opt5 from BRWD1__Homo_sapiens__NP_001007247
auggccgagcccagcuccgcuagacggccugugccgcugaucgaaucugagcucuacuuccugauugcccgcuaucuuagcgcgggccccugcagacgggcugcccagguccugguucaagaacucgagcaguaccagcugcuuccuaagcgccuggacugggaagggaacgagcacaauagauccuaugaggaacucgugcugucuaacaaacacguggcccccgaucaucugcuccagaucugucaacggauuggaccuaugcuggacaaggagauucccccuagcaucucccgcgucaccucucuucugggcgcugggagacagagccuccugcggacagccaaaggaacgcuuaucuga

SEQ ID NO: 66537 - RNA, 5409 nt, Artificial Sequence
  derived and/or modified sequence opt5 from BRWD3__Homo_sapiens__NP_694984
auggccgcugcccccacccagaucgaggcggaacuguacuaucucauugcuagauuccugcaaagcggcccuugcaacaaguccgcccaggugcuuguccaggagcuggaagagcaccagcucaucccgcggcgccuggacugggaagggaaagagcauagacggucuuuugaggaucuuguugccgcuaaugcccacauucccccugacuaccugcucaagaucugugaacgcauuggaccccugcuggauaaagagaucccucaaagcgugcccggcgugcagacacuccugggggucggaagacagucccuucugcgggacgcuaaggauugcaaaucuacgcucuggaacggcagcgccuucgcggcccugcaucgcgggagaccuccggaacuucccgugaauuauguuaagccucccaacguggucaauaucaccuccgcucggcagcugacaggauguucucgcuuuggccacauuuucccuagcuccgccuaccaacauaucaagaugcacaaaagaauucucggccaccugagcucuguguauugcguugcuuuugaccgguccgggcgcagaaucuucaccggaagcgaugacugucuggugaagauuugggccacagaugacggccggcuccuggcgacccuucgcgggcauucugccgagaucuccgauauggcugucaacuacgagaauacacugauugccgcuggaagcugcgacaaaguggugagagucuggugucuccggaccugcgcccccguugccgugcugcagggccacucugcuuccaucacgagcauccaguuuuguccguccaccaaggggacaaacagauaucuuaccucuacaggagcggauggcaccauuugcuucuggcaguggcaugugaaaacgaugaaguuucgcgaccggccugucaaguucacagaaagaagccgccccggcgugcaaaucuccuguagcucuuuuuccagcgggggaauguucauuaccacaggcucuaccgaccacguuauccggauuuacuaccuggggagcgaggugccugaaaaaaucgccgagcucgaaucccacaccgauaaggucguggcuguucaguuuugcaauaacggagacucucugagauucgugagcggcucccgcgaugggacagcccggaucuggcaguaucaacagcaggaguggaaaagcauuguccuggacauggccacgaagaugaccggaaauaaccuccccucuggcgaggauaaaaucacaaagcugaaagugaccauggucgcuugggacagauacgauacaaccgugauuacggccguuaauaacuuccuucugaagguguggaauuccaucacaggccagcuccugcauacccuuagcgggcacgacgaugaagucuuugugcuggaggcgcaucccuucgaccaacgcauuauccucucugcuggacacgauggcaacaucuuuauuugggaccuggaccgggggaccaagaucagaaacuauuucaauaugauugaaggacagggccauggggccguuuuugauugcaaauucuccccugacggcaaccacuuugccuguacagauagccacggacaucugcuccuguucggcuuugggugcuccaaguacuaugagaaaaucccggaccagauguucuuucacaccgauuaccgcccccuuauucgggacgcuaauaacuaugugcuggaugaacagacacaacaggccccucaucucaugcccccucccuuccuggucgacguggauggaaauccgcacccuacgaaguuucagagacuggugcccggccgggagaacuguaaagacgagcagcuuaucccucaacucggguacguugcuaauggagauggcgaagucguggagcaggugauugggcagcagaccaacgaccaagaugaaucuauccuggacggcaucauucgcgagcugcagagagaacaggaccuccggcugaucaaugagggagaugucccccaccuuccugugaacagagccuacagcguuaauggcgcgcugcgcucccccaacauggacauuucuagcuccccgaauauccggcucagacgccauagcucucaaauugagggggugagacagaugcacaacaaugccccucggucccagauggcuacagaacgcgaucugauggccuggagcagacgggucgugguuaacgagcugaacaauggagugucucgcguccaggaagagugcagaaccgcuaagggcgacaucgagaucucccuuuauacaguggaaaagaaaaagaaacccagcuacaccacgcaacggaacgauuaugagcccucuugugggcgcagccucagacggacccagcgcaagagacagcauacauaccagacccgguccaauauugaacacaacagccaagccucuugccagaauuccggaguucaggaggacagcgauuccucuagcgaagaggacgagacagugggcaccuccgaugcgucugucgaagacccugugguggaguggcagagcgaauccucuagcuccgauagcucuuccgaguauagcgacuggacggccgaugcugggaucaaccugcaaccgcccaaaagacagacacgccagaccacacggaagauuuguucuuccagcgacgaagagaaucugaagucucucgaggaaagacaaaaaaagccuaaacagacccgcaagaaaaagggcggacuggucuccaucgccggcgagcccaacgaagagugguucgcuccucaguggauucuugacaccaucccccggagaagcccuuucguuccccagaugggggaugaacugaucuacuuucgccaaggacaugaggccuaugugcgggccgugagaaaguccaaaauuuacagcgucaaucuccagaagcagccguggaacaaaauggaccugcgcgagcaggaauucgugaagaucguuggcauuaaauacgagguggggccucccacacugugcugucuuaagcucgcuuuucuggauccuaucucuggaaaaaugacgggcgaaagcuucuccauuaaguaucacgacaugcccgaugucaucgacuuucuggugcuccaccaauucuacaaugaggcgaaggagcggaacuggcagaucggggauagauuucggucuauuaucgacgaugccuggugguucggcaccguugaaagccagcagccguuucaaccugaguaucccgacuccucuuuccagugcuacagcgugcauugggauaauaacgaacgcgagaaaauguccccuugggacauggaacccauucccgagggaacagcuuuuccugacgaggucggcgccggggugccgguuucucaggaagagcugaccgcccuucuguauaagccccaggaaggagaguggggcgcucacagcagagaugaagagugugagcgggugauccaagggauuaaucaucuccugucccuggacuucgccagcccuuuugcgguccccguggaucuuucugcuuacccucucuauugcacaguggucgccuaccccaccgaccugaacacgauccgcagacggcuggaaaacagauucuaccgccggauuuccgcccucaugugggagguuagauauaucgaacacaaugcucgcacauucaacgagccugauagcccgaucgugaaagccgcgaagauugugaccgacguccugcuucgguuuaucggagaucagucuugcaccgacauucuggauacauacaauaaaaucaaggcugaagagagaaacuccaccgacgccgaggaagauacagagauuguggaccucgauagcgacggccccggcacguccucugggcgccggguuaaguguagaggacgcagacagagccugaaaugcaauccugacgccuggaagaaacaauguaaggaacugcuuucccugaucuaugagcgggaggauagcgaacccuuccgccagccugcugaccuccugucuuaccccggccaucaggagcaggaaggggaguccagcgaaucuguggucccggagagacaacaggauagcucccucucugaggacuaucaggaugugaucgacaccccuguugauuuuagcacagugaaagaaacccuggaggccggaaacuacggcuccccccuugaauucuauaaggacguccggcagauuuuuaauaacucuaaggcuuacacaagcaauaaaaagucccgcaucuacagcaugaugcugagacucucugcccuguucgagucccacauuaaaaacaucauuagcgaauauaaguccgcgauccaaucucagaaacggagacgcccccgguacagaaagcgccugcggagcuccucuagcucccuuagcucuuccggggccccuagccccaagggaaaacagaagcagaugaaacugcaaccuaagaaugaucagaacaccucugugucccacgcuagaacgagcucuccguuuagcucccccgucucugacgccgcugagggccucagccuguaucuccuggaugacgagccugauggccccuucuccagcuccucuuuugggggauacagccgguccggcaauucucaugacccugggaaagccaagagcuuccgcaacagagugcuucccguuaaacaggaccacucccuggauggaccgcucaccaauggcgacgggcgggaaccucgcacaggaaucaagagaaagcugcugucugccagcgaggaagaugagaacaugggcggcgaagacaaagagaagaaagagaccaaggaaaaaucccaucuuagcacaucugaguccggggaacugggaagcucucucuccagcgagucuaccugcggcuccgauagcgacuccgagagcacaucucggaccgaucaagacuauguggauggggaccacgauuacagcaaguuuauucagacgcgccccaagagaaaacugcggaagcagcacggaaacggcaaacgcaauuggaagacaagagggaccggaggccggggcagaugggggcgcuggggacggugguccagaggcgggcgcggacggggcgggagaggacgcggcucucggggcagagggggaggcgggacccgcggacggggcagagggcgcggaggccggggcgcuagcagaggggcgacacgcgccaaaagagcucggaucgccgacgacgaauucgauaccauguucuccggacgcuuuucuagacucccucggauuaagacgagaaaccagggccggcgcacaguccuguauaaugacgauagcgacaacgauaauuucguguccaccgaggacccccuuaaccuggggacaucuagaagcggacggguucgcaagaugaccgaaaaagccagagugucccaucugaugggcuggaauuacuga

SEQ ID NO: 66538 - RNA, 1389 nt, Artificial Sequence
  derived and/or modified sequence opt5 from BSCL2__Homo_sapiens__NP_001116427
augagcaccgagaagguggaccagaaagaagaggccggcgaaaaggaggucugcggggaucaaaucaaaggacccgacaaggaagaggagccuccggcugccgcgucccacggccagggguggagacccggaggccgggcugcccgcaacgccagaccugaacccggggcucggcauccugcccugcccgcuaugguuaaugauccuccggugcccgcccuccugugggcgcaggaggugggacagguccuugccggccgcgcuagacggcugcuccugcaauucggcgugcuguuuuguacaauucuucuccugcuguggguuucuguguuccucuacgggagcuuuuauuacuccuauaugccuacggucucucaccugagccccgugcauuucuacuaucgcaccgacugcgauuccucuacaaccagccuuuguuccuuuccuguugccaacgugagccugacaaaaggaggcagagaccggguccucauguacgggcagcccuaucgcgugacccuggaacuugagcugccggagucuccugugaaucaggaucucggaauguuccuggucacaaucuccugcuacaccagaggcgggcggauuaucagcacgucuucccgcagcguuaugcugcacuacagaucugaccuccugcagaugcuugauacccugguguuuuccagccuccugcuuuucggauuugcugaacaaaagcagcugcucgagguggaacuguaugccgacuaccgggagaacuccuauguccccacaaccggcgcgauuaucgaaauccauucuaagcgcauucagcuguacggcgccuaucucagaauccacgcucacuucacagggcugcgguaccuucuguauaauuuuccuaugaccugugccuucauuggaguggcuagcaacuuuacguuccucuccguuaucgugcuguucagcuacaugcagugggucuggggcgggauuuggcccagacaucgcuuuucucuucaagugaauauccggaaaagagauaacucccgcaaggagguucagcggagaauuagcgcccaccagcccggaccugagggccaagaagagucuacaccgcagagcgacgugaccgaagauggggagucccccgaagacccuucuggaacagagggccagcugagcgaggaagagaaacccgaccagcaaccucucuccggcgaagaggaacuggagcccgaggccagcgaugggucuggauccugggaagacgcugcgcugcucaccgaggccaaucugccggcuccugcccccgccagcgcuucugccccuguccuugaaacccugggcuccagcgagcccgcugggggagcgcuccgccagcggccuacaugcuccucuagcuga

SEQ ID NO: 66539 - RNA, 1158 nt, Artificial Sequence
  derived and/or modified sequence opt5 from BSG__Homo_sapiens__NP_001719
auggccgcugcccuguucgugcuccugggcuuugcgcuucuggggacccacggagcuagcggcgccgccggguucguccaggcuccccucucccaacagagauggguuggaggcucuguggagcugcauugcgaagccguggggagcccugucccggagauccaguggugguuugaaggacagggccccaacgacacauguucccaacuuugggauggcgcucggcuggaccgcgugcacauucaugccacguaccaccagcaugcggccucuaccaucagcauugauacacucguugaggaagacaccgggacauaugagugcagagcuuccaaugauccugaccggaaccaccugacccgcgcccccagagugaaguggguccgggcucaggccgugguucuggugcucgagccuggaacagucuucaccacgguggaagaucugggcucuaaaauccuucugaccuguagccucaaugacuccgcgacagaggugaccgggcaccgcuggcugaagggaggcgucguucuuaaagaagaugcccugcccgggcagaagacagaguuuaaaguggacagcgaugaccaauggggagaguacucuugcguguuccucccugaaccgaugggcaccgcuaacauucagcugcaugggcccccuagagucaaggccgugaaguccagcgagcacaucaaugaaggcgagacggcuaugcugguuuguaaaucugaauccgugcccccugucacagauugggccugguauaagaucaccgacagcgaggacaaagcccucaugaacggaucugagucccgguuuuucgugagcuccucucagggccgcagcgaacugcauauugagaaucuuaacauggaagcugaucccgggcaguacagaugcaauggaacauccagcaagggcucugaccaagcgaucauuacccugcggguucgcucccaccucgccgcucuguggccguuucuugggaucguggccgagguccuggugcucgucaccauuaucuucauuuaugagaaaagacggaagccugaagaugugcuggacgaugacgaugccggaagcgcuccccugaagucuagcggccagcaccagaacgacaaaggcaagaauguucgccaaagaaacuccucuuga

SEQ ID NO: 66540 - RNA, 11781 nt, Artificial Sequence
  derived and/or modified sequence opt5 from BSN__Homo_sapiens__NP_003449
augggcaacgaggucagccuggaagggggagccggcgacgggccccucccuccgggaggcgcugggcccggaccuggccccggcccugggcccggagccggcaagccuccguccgcccccgcugggggaggccagcugccugccgccggggcugccagaucuaccgcugugcccccuguucccggaccgggcccuggccccgggccuggacccggccccgggagcacaucccggcgccuugacccuaaagagccgcugggaaaucaaagagccgccucucccacgccuaagcaggccagcgcuaccacacccggccacgaauccccucgggagacccgcgcccaggggcccgcuggacaggaagccgacggcccgagacggacacuccaaguggauucucgcacccagagaagcggccgguccccuagcgugucucccgaccgcggguccacaccuaccagccccuacucugucccucagaucgccccgcugcccuccagcacgcuuugcccuauuuguaaaaccucugaucugacauccacccccagccagcccaacuucaauacaugcacccaaugucauaacaaggugugcaaucaguguggauuuaacccuaauccgcaccucacgcagguuaaagaguggcugugccugaacugucagaugcaaagagcccucggcauggacaugacaaccgcuccccgguccaagucucagcagcaacugcauagcccugcccuuucccccgcucacagcccugccaagcagccccuggggaaaccugaucaggagcgcucuagaggacccggcgggccgcagccuggcucccggcaagccgaaacagcucgcgccaccagcgugcccggaccugcccaggcugccgcgcccccggaggucggcagagugucuccucagcccccucagcccaccaagcccagcacagcugaaccucggccgcccgccggggaggcgccugcuaaauccgccacggccguucccgcuggacucggcgccaccgagcaaacacaggaagggcugaccggaaaacuuuucggccugggggcuucucuccugacacaggccagcacccugauguccgugcagccugaggcggacacgcaaggccagcccgccccuagcaaaggaacaccgaagaucgucuuuaaugaugcuucuaaggaagccggccccaaaccucucggguccggacccggcccugggcccgcuccgggagccaagaccgagccuggcgcgagaauggggcccggcagcggacccggcgcccugccuaaaaccgggggaacaaccucucccaagcauggccgcgcugaacaccaggccgcuuccaaagccgccgcuaagccuaaaacaaugccgaaggagcgggcgauuugcccccuuugucaggccgagcugaacguggggagcaaguccccugcuaauuauaacacgugcaccacauguagacuccaagugugcaaucugugcggauucaaccccaccccucaccuugucgagaagacagaguggcugugucucaauugccagaccaagcgccugcuggaaggcucucucggggagcccacgccgcugccucccccuaccagccagcaacccccuguuggcgcgccccaccgggccuccggaacaucuccgcuuaaacagaagggcccucaggggcugggacagcccagcggcccccucccugcuaaagccuccccgcugagcaccaaggcgucuccccuuccuuccaaggcuagcccccaagccaaaccucugagagccucugaacccuccaagacaccuagcucugugcaggagaaaaagacccgcgugccgacgaaagcugagcccaugccuaagcccccucccgaaacaaccccgaccccugccacccccaaggucaaaagcggggugcggagagcggagcccgcuaccccuguugugaaggccguccccgaagccccuaaaggaggcgaggcugaagaccucgugggcaagccguacucccaggaugccagccgcucuccccagucccugagcgacacaggguauuccucugauggaaucagcuccucucaaagcgagauuacgggcguugugcagcaggaggucgaacagcuggacuccgcuggggugaccggaccucaucccccuucucccagcgagauccauaaagucggcuccagcaugcggccgcuccugcaagcccaggggcuugcgccuucugaaagauccaagccccugagcucuggaacaggcgaggagcagaagcaacgcccucacucccucagcaucacccccgaagccuuugacucugaugaggaacuggaggacauucuggaagaggaugaggacuccgcugaauggcggagacggcgcgagcagcaggauacagccgaaagcuccgacgauuucggcagccagcuuagacacgacuacguggaggauucuagcgaagggggacucuccccucugcccccgcaaccucccgcucgggccgccgagcugaccgacgaggauuuuaugagacgccagauccucgaaaugucugcugaggaagacaaccuggaggaagacgauacggcgacaagcggccgggggcuugccaaacauggaacccagaagggcgggcccagaccucgcccggagcccucccaggagccugcugcccugcccaaaagacggcucccucacaacgccaccacaggauaugaggaacuccugcccgaaggcggcucugcugaggccaccgacgggagcggaacacuucaaggcgggcuccgcagauucaagacgauugagcucaauagcaccggaucuuacggccaugaacuggaucucgggcagggaccugaccccagccuggaucgggagccggaacuugagauggaaucccugacaggcagcccugaggaccgcucuagaggcgagcacuccagcacccuccccgcgucuacaccuuccuauaccagcgggacgucccccaccucucugagcucccuggaagaggauagcgacucuuccccgagccggcgccagagacuugaagaggcuaaacagcaacggaaggcccgccauagaucucacggaccucuccugcccacaaucgaagauagcuccgaggaggaagaacugcgggaagaggaggagcugcugagagagcaggagaaaaugcgcgagguugaacagcagcggauuagaucuaccgcccgcaagacacggagagacaaggaggagcuucgcgcucaacggagacgcgaacggagcaaaacacccccuuccaaccugucucccaucgaggaugccagcccuacagaagaacugagacaggcggcugaaauggaggagcugcaccgguccagcuguucugaauacuccccgagccccucccuggacucugaggccgaagcccuugauggcgggccuagccgccucuacaaguccggaucugaguauaaucugcccaccuuuaugagccuguacuccccuacggaaacacccagcggaucuagcaccaccccuagcucugggagaccgcucaaauccgcugaggaggccuaugaagagaugaugcggaaggcugaacugcuucagcgccaacagggacaggccgcgggcgccagaggcccccaugggggaccuagccagcccacaggcccucgggggcugggaucuuucgaguaccaagacaccacggacagagaauauggccaggcugcccagcccgcugccgaggggacaccggccagccucggagcugcgguguacgaggaaauucugcagaccucccaaucuaucguccgcaugcggcaggccagcuccagagaucuggcuuuugccgaggacaaaaagaaggaaaaacaguuccuuaacgccgagagcgcuuauauggauccuaugaagcagaauggcggcccccugacacccgggaccuccccuacacaacucgccgcgcccgugucuuuuagcaccccuacguccucugacagcuccggaggccgcguuaucccggaugugcgggucacccagcacuucgcuaaagagacacaggacccccugaagcuccauucuagcccugccucccccagcucugccuccaaagaaauugggaugccuuucagccaaggacccggcaccccggcuacaaccgccguggcgccuugccccgccgggcugccuagaggauacaugacgcccgcuucuccggccggcuccgagcgcagcccuucucccuccagcacagcucacuccuacggccacagccccaccacagccaacuaugggucucagaccgaagaucuuccucaggcucccagcggacuggccgcggccggccgggcugccagagagaagccucucuccgcuucugacggggaaggaggcaccccgcagcccagccgcgccuacuccuauuuugccucuagcuccccuccccugucuccuagcucccccagcgagucuccuacauucuccccggggaagaugggccccagagcuacggcggaguuuagcacccaaacaccuucucccgccccugcuuccgauaugccccggagcccgggagccccuacccccucccccaugguggcccagggcacacagaccccucaucgccccucuacgccuagacugguuuggcaggaaagcucccaagaggcuccguucauggucaucacacuugccagcgacgcgucuucccagacccggauggugcacgccagcgcuucuaccagcccccuguguuccccuacagaaacccagcccacaacgcauggguacucucagaccacaccucccagcgugucccaacucccgccugagcccccuggacccccuggcuuuccccgcgucccgucugccggggcugauggaccccuggcccucuauggcuggggcgcgcugccugccgaaaauauuagccuuugcagaaucuccagcgugcccgggaccucucggguugagccuggaccgagaacacccggcaccgcuguggucgaccugcgcacggccgugaaaccuacccccauuauccucacagaucaggggauggaccugaccucccuggcuguugaggcccggaaguacggacuugcucuggacccuauccccggcagacagagcacagccgugcagccucucgucauuaaccugaaugcgcaagaacacaccuuccucgccacagcuacgaccguguccaucacaauggccucuagcguuuuuauggcucagcagaaacaacccguggucuauggggauccguaccagucccgccuggacuucggacagggcgggggcucuccugugugucuugcccaggugaagcaagucgagcaggccguucagaccgcgcccuaccggagcggaccuagaggccggccccgcgaagcuaaauuugccagauauaaccugccgaaucagguggcuccucuggcccggcgcgaugugcucauuacccaaauggggacagcccaguccaucggacugaagcccggccccgucccugagcccggggcugaaccucauagagccacgccggcggagcuucggagccacgcccugcccggagcucgcaagccucacaccgugguugugcagaugggcgagggcacagccgggaccgucacaacccuccugcccgaggaaccugcuggagcccucgaccugacgggcaugagacccgaaucucagcuugcgugcugugauaugguguacaaacugccguucggguccagcugcacaggaaccuuucauccugcccccucuguuccugagaaguccauggcugacgccgcucccccuggccaauccucuagccccuucuaugggccgcgggaucccgagccucccgaaccucccaccuaccgcgcccagggaguggucggcccuggcccgcacgaggaacagagacccuauccucaagggcugcccggacggcucuacagcucuaugagcgacacaaaccuggcugaggccggccuuaauuaucaugcgcagagaauugggcagcuguuucagggaccuggccgcgauuccgccauggaccucagcucccugaaacacucuuacagccucggguucgcugauggacgguaccugggccaaggccuucaguauggguccgugaccgaccugagacaucccacagaccugcucgcccacccgcugccuaugcgccgguacucuagcguuuccaacaucuauucugaucacagauacggaccccgcggcgacgcugugggguuccaggaagccagccuugcccaguauuccgcgaccacggcucgggagaucagcagaaugugugccgcccucaauucuauggaucaauacggaggccgccauggguccggaggcggcgggccugaccucguccaguaucagccccagcacggaccgggccugagcgcuccucaaucucucgugccccugcggcccgggcuucugggaaacccuacauuucccgagggccauccuuccccggggaaccuggcccaguacggacccgcugccggccagggcaccgcggugagacaacuccugccuagcacagccaccguccgcgcugccgaugggaugauuuacucuacgaucaauacccccauugcugccacacuuccuaucaccacacagcccgcguccguucugcggccuauggugagaggaggcauguaucgcccguacgccagcgggggaauuaccgcugugccccucacaucucugaccagagucccuaugaucgcgccccgggugccucugggccccacggggcucuaucgcuacccggcucccuccagauucccuauugccagcagcguucccccugcugaaggacccguguaucuuggcaagccugccgcggccaaagcuccgggcgccgggggacccucccggccugagaugcccgucggcgccgcuagagaagaaccucugcccacaaccaccccggccgcgaucaaggaagcugccggggccccugcucccgccccucuggcuggacagaaacccccugccgacgcggcccccggcgggggaucuggcgcucucagccggccgggcuuugagaaggaggaagccucccaggaggaacgccaaagaaagcagcaggagcagcugcuucaacuggaacgggagcgcguggagcucgaaaaacugagacagcugcggcuccaggaggaacuugagcgcgagagaguugaacugcagcggcaccgcgaggaggaacaacugcucgugcagagagaacugcaggagcuucagacaaucaagcaccauguccugcaacagcagcaagaggaacggcaggcucaguucgcccuccagcgcgagcaacuggcgcagcagagacugcagcucgaacaaauucagcagcuucagcaacagcugcagcaacagcuggaggaacagaaacagcggcaaaaggcccccuuuccugcugccugcgaggcucccgggcgcggaccuccccucgccgccgcugagcuggcgcagaacggccaguacuggccgccucuuacccacgccgcuuucaucgccauggccgggcccgaaggacugggccagccuagagagcccgugcuccaucgggggcugccuucuagcgcuuccgauaugucucugcaaacagaggaacagugggaagccagcagauccggcauuaaaaagcgccacagcaugccccggcucagagacgcgugcgagcuugagucuggaacggaaccgugugucgugcgccggaucgcugauuccagcguucagaccgacgaugaggacggcgaaucuagauaucugcugucccgccggagacgcgcccggagaagcgccgauugcuccgugcagacagacgacgaggauucugcugagugggaacaaccuguccgccggagacggagcagacucccccgccauuccgacucugggagcgauuccaagcacgacgccaccgcuuccucuagcagcgccgcggccacagugcgggcuaugucuagcguuggcauucagaccaucuccgauuguucugugcagacggagccugaccagcugcccagagucagcccggccauccacauuaccgcugccacagaucccaaaguggaaaucgugcgcuacauuuccgcgccugagaagaccggcagaggggaaagccuugccugccaaacagagcccgacggacaggcucagggcguugccgggccucaacuggucggccccaccgcuaucucuccuuaccucccgggcauucagaucgugacgcccggcccucuggggcgguuugagaaaaagaaacccgauccucuggaaaucggauaucaggcccaucugcccccggagucccuuagccagcuggugucccgccaaccucccaagucuccucagguccuguacagccccguguccccucucucuccccacagacugcuugacaccagcuucgccuccucugaacggcugaauaaggcucauguuagcccgcagaaacacuuuacagcggauuccgcccuccgccagcaaacacugcccagaccuaugaagacccugcagcggagccucucugaccccaaaccucuuucccccaccgcugaggaaagcgccaaggagcgcuucucucuguaucagcaccagggcgggcugggaucccaagugagcgcccucccuccgaacucucuggucagaaaagugaagcggacacuucccagcccucccccugaggaagcucaucugccccucgccggccaggcguccccgcagcuguacgcugccagccugcuccaacgcgggcuuacgggcccuaccacaguucccgccaccaaggcuucccugcugagagagcucgaucgggaccugcgccuuguggaacacgagucuacaaaacugagaaagaaacaggccgaacucgacgaggaggaaaaggagauugaugcuaaacugaaguaucuggaacucggaaucacccagcggaaggagagccuugccaaagacagaggcgggcgcgauuacccuccccugcggggacugggcgagcauagagacuaucucuccgauucugaacugaaucagcuucgccugcaaggguguacgacaccggcgggacaguuugucgacuuccccgccaccgcugccgcuccugccacccccagcggcccuacagcguuucagcagccccgguuccaaccuccggcgccccaguacuccgcugggucuggcggaccuacccagaacggcuuccccgcccaccaggcuccuacauaccccgggccuagcacguauccggcccccgccuuuccucccggagcuuccuacccugcggagcccggccucccgaaucaacaggccuucagacccaccgggcauuaugcuggacagacaccuaugcccaccacacaaagcacccuguuuccugugcccgccgauucucgcgccccucugcagaagccgcggcagacgucccucgcugaccuugaacagaaaguucccaccaacuacgaggugauugccagcccugucgugcccaugucuuccgcgccuagcgaaacaucuuauuccggccccgcugugagcucuggcuacgagcaagggaaggucccggagguuccuagagccggagaucgcggcuccgugagccagucccccgccccuaccuaucccagcgacucucacuacacaagccuggaacagaaugugccucggaacuacgucaugaucgaugacauuuccgagcugaccaaagacucuacaagcaccgcucccgauucccagagacucgaaccgcuggggcccggaucuagcggccggccugggaaggagcccggagaaccuggcgugcuugacggccccacgcugccgugcuguuaugcccgcggggaggaggaauccgaggaagauagcuacgacccuagaggaaaaggcgggcaccuccggucuauggaguccaauggacgccccgcuagcacacauuauuacggcgauucugacuauagacacggggcccggguugaaaaguacggaccuggccccaugggcccuaagcaucccuccaaaagccuggcgccggccgcuaucucuuccaagagaagcaaacaccgcaagcaagggauggagcagaaaaucuccaaguucucuccuauugaggaagccaaggauguggagagcgaccuggcuuccuaucccccucccgccgucuccucuucccucgugagccggggaagaaaauuucaggaugaaaucaccuacggccugaagaaaaacguuuacgagcagcaaaaguauuacgggaugucuagccgcgacgcgguggaggaugaccggauuuauggaggcuccucuagaagccgcgccccguccgcuuacagcggggaaaaacuuucuucccacgauuucagcggauggggcaagggcuaugagagagaacgggaggccgucgaacgccugcagaaggcugggcccaaaccuucuucccucagcauggcccauuccagagugcggcccccuaugcgcucucaggcgagcgaggaggaaucccccgucucuccucugggaagaccgcggcccgccggcgggccucuucccccuggaggcgauaccugcccccaguuuuguagcucccacagcaugccggacgugcaagagcauguuaaggaugggccucgcgcucacgccuacaaaagagaagagggauauauccuggacgauucucauugcgugguguccgacagcgaggcuuaccaccucggccaggaggagacagauugguucgacaagccccgggaugccagaucugaccgcuuucggcaccauggcgggcacgccgucuccuccucuucccagaaaagaggaccugcucgccauagcuaccacgauuaugacgaacccccugaggaaggccuguggccccaugaugaagggggaccgggccggcacgccagcgcgaaggaacacagacauggggaccacggacgccauuccggccggcacacgggcgaggagcccgggagacgggcugccaagccucacgcccgcgaccugggaagacaugaagcucggccccacucucaaccuagcuccgcccccgcgaugccuaaaaagggccagccgggguaccccucuagcgcugaguauucccagccuucucgcgccagcuccgccuaccaucacgcuucugauagcaaaaagggauccagacaggcccauagcggccccgcugcccuccaaucuaaagcggaaccucaggcccagccccagcugcaagggcggcaggcugccccgggaccucagcagucccaaagccccucuucccgccagauuccuagcggcgcugccucuagacagccccaaacccagcagcagcaacagggccuugggcugcagccgccccagcaagcgcucacacaggcccggcugcagcagcaaucccagccuaccacaagaggaagcgcucccgccgcuucccagccugccggcaagccccagccugggccgagcaccgccacaggaccccaaccugcuggacccccucgcgccgagcagaccaaugggucuaaaggcacggcgaaggcuccccagcaaggacgggccccucaggcccagccggcucccggcccugggcccgccggaguuaaggcgggcgcuagaccugggggaacccccggcgccccggccgggcagcccggcgcugacggagagagcguguucuccaaaauccuuccuggcggggccgcugaacaagccggaaagcugacagaggcggugucugccuuuggcaaaaaguucagcuccuucugguga

SEQ ID NO: 66541 - RNA, 399 nt, Artificial Sequence
  derived and/or modified sequence opt5 from BSPH1__Homo_sapiens__NP_001121798
augggcagccugaugcuccuguucguggagaccacaagaaacuccucugccugcaucuuucccgucauucuuaaugaacugagcuccacgguugagaccaucacacacuucccugaagugaccgacggggaguguguguuuccguuccauuacaagaacggaacauauuacgauugcauuaaaucuaaggcucggcacaaaugguguagccucaauaagaccuaugaaggcuacuggaaauuuugcuccgccgaggacuucgcgaacugugucuuucccuucugguaucgcagacugaucuacugggagugcacagaugacggggaggcuuuuggaaagaagugguguucucuuaccaaaaauuucaacaaggaucggauuuggaaauauugcgaauga

SEQ ID NO: 66542 - RNA, 1209 nt, Artificial Sequence
  derived and/or modified sequence opt5 from BSPRY__Homo_sapiens__NP_060158
augagcgccgagggcgcugaacccgggccuggauccggcucugggccgggacccggcccucugugccccgagcacgggcaggcccucagcugguucuguggauccgaaagacggccugugugcgcggcuugugccggccugggcgggcgcugcagaggacaucggauccgcagagccgaggaacgggcugaggagcuucgcaacaagauugucgaccaaugugaaagacugcagcuccagucugccgcuaucaccaaauacguugccgaugugcugcccggcaagaaucagcgggcggugagcauggccuccgcugcccgcgagcuugucauucaaagacugucucucgugcggagccugugcgaauccgaggagcagcgccugcucgaacagguucacggggaggaagagagagcucaucagagcauccugacacaacgggugcacugggccgaagcgcuucagaaacuggacacgauucgcaccggacucgucggcaugcugacacaucuugaugaccugcagcucauccagaaggagcaagagaucuuugaaagaaccgaggaagccgaggggauucuggauccucaggaaucugagaugcugaacuucaaugagaaauguacacgguccccgcuccugacccagcuuugggcuacagccgugcugggaagccucucuggcaccgaagacaucagaauugaugagcgcacgguuucccccuuucugcaacuuagcgacgaucggaagacccugacauucucuaccaagaaauccaaggcuugcgccgacggcccugaaagauuugaucacuggcccaacgcccucgcugcgacauccuuccagaaugggcugcacgccuggauggugaacguccagaauagcugugcuuauaaagugggaguggccucuggccaucugccucgcaaggggagcggauccgacugccggcucggccacaacgccuuuagcugggucuucucuagauacgaucaggaguuucgcuucucccauaaugggcaacacgaaccccugggacuucugcggggcccggcucagcucggcguugugcuggaccuucaggugcaggagcugcucuuuuaugagccugccagcgggaccguccugugugcgcaccaugugucuuuccccggaccucuguuucccguuuucgcuguggccgaccaaacgaucagcauugucagauga

SEQ ID NO: 66543 - RNA, 957 nt, Artificial Sequence
  derived and/or modified sequence opt5 from BST1__Homo_sapiens__NP_004325
auggccgcucagggcugcgccgcgagcagacugcuccaacugcuucugcagcuccugcuucugcuccugcugcucgcugccgggggagcccgggcucgcuggagaggcgaggggaccuccgcccaucugcgggacaucuuccuuggacgcugugcugaauacagagcccugcucucucccgagcagcggaacaagaauugcacagcgauuugggaagccuuuaaaguggcucuggauaaggacccuuguagcguccuuccguccgauuaugaccuguucaucaaccucucucgccacagcauucccagagauaaaucccuguuuugggaaaauucucaucugcucguuaacagcuucgccgacaauacgcggcgcuuuaugccucuguccgaugugcuuuacggcagaguggcugacuuccugagcuggugccggcagaagaacgauucugggcucgacuaucaauccugucccaccagcgaggauugcgagaauaacccugucgacucuuuuuggaaacgcgccuccauccaguacagcaaggauucuuccggagugauucacguuaugcugaauggcagcgagcccacaggcgcguauccuaucaagggguucuuugccgacuacgaaaucccgaaccuucagaaagagaagauuaccagaaucgaaauuugggugaugcacgagaucggaggccccaaugucgaguccuguggggaaggaucuaugaaagugcuggagaagcggcucaaagacaugggcuuccaguauagcugcauuaacgauuaccgcccuguuaagcugcugcaauguguggaccauuccacacaccccgauugcgcucucaagagcgccgcugccgccacccagagaaaagcuccuucucuguacacagaacagcgggcggggcuuaucauuccccuguuucucguccuggccuccagaacccagcuuuga

SEQ ID NO: 66544 - RNA, 543 nt, Artificial Sequence
  derived and/or modified sequence opt5 from BST2__Homo_sapiens__NP_004326
auggccagcaccuccuacgacuauugcagagugcccauggaggauggcgacaagcgguguaaacugcuccuggggaucggcauucuuguccugcucaucauuguuauccugggagugccucuuauuaucuucacaaucaaggcuaacucugaagccugccgcgaugggcugagagcggugauggagugucggaaugucacgcaccuccugcagcaagaacugaccgaggcucagaaaggauuucaggacguggaagcccaggccgcuacaugcaaccauaccguuauggcccucauggcuagccuggaugccgagaaggcgcaaggccagaaaaagguggaggaacuugagggggaaauuacaacccugaaucacaagcuccaggacgccuccgcugaggucgagcgccugagacgggaaaaccaggugcuuucuguucgcaucgccgauaaaaaguacuauccgagcucccaagacucuagcuccgcugccgcgccccagcugcucauugugcugcugggacucagcgcccugcuucaguga

SEQ ID NO: 66545 - RNA, 702 nt, Artificial Sequence
  derived and/or modified sequence opt5 from BSX__Homo_sapiens__NP_001091639
augaaccugaauuucaccagcccccuccacccugccuccucucagagaccgacauccuuuuucaucgaggacauucugcuucauaagcccaaaccucugcgggaaguggcucccgaucacuuugccuccucucucgcgagccgcgucccucugcuugacuacggcuauccccugaugccuacgccgacccuccuggcuccccaugcccaccauccucugcacaagggggaucaccaucaccccuacuuccucacaaccuccggaaugccuguucccgcccuguuuccgcauccucaacacgcugagcuucccggcaaacacugcagacggcgcaaggccagaacaguguucucugacagccagcuguccgggcucgaaaaacgguuugagauccagcgcuaucugagcaccccugaaagaguggagcuugcuacagcccugucucucuccgagacccaggucaagacgugguuccaaaaccggcgcaugaagcauaaaaagcagcugagaaaaagccaggaugaacccaaggcgcccgacggaccugagucuccggaaggcagcccccgggggagcgaggccgcuaccgccgcugaggcccgccugucucucccugcgggacccuuugugcugacagaaccugaggaugaaguugacauuggcgaugagggcgaacuuggguccggaccccacgugcuguga

SEQ ID NO: 66546 - RNA, 1428 nt, Artificial Sequence
  derived and/or modified sequence opt5 from BTBD10__Homo_sapiens__XP_011518706
auggccggcagaccccacccuuacgacgggaacagcuccgauccggagaauugggaccggaagcugcauucucgccccagaaaacucuauaagcacagcuccaccucuagccggaucgcuaaaggaggcguggaucauacaaagaugucccugcacggggccucuggaggccaugaacgcagcagagaccggcgcagauccagcgaucggucucgcgacuccagccacgagagaacggaaucucagcuuaccccuugcauucggaacgucacaucccccacccgccaacaccauguugagagagaaaaagaucacuccucuucccggccuagcagcccccgcccucagaaggcgucuccgaaugggagcaucuccagcgcuggaaacucuuccagaaauagcucucagagcuccucugacggcagcuguaagacagccggcgagaugguguucguguacgagaacgccaaagaaggggcucggaauauuagaaccuccgagcgcgucacacugaucguggauaacacccgguuuguuguggaccccagcauuuucacggcccagccuaauaccaugcucggaagaauguuuggcucugggcgcgaacauaacuucacacggcccaaugagaagggagaguaugaagucgcugagggcaucggguccaccguguuuagagccauccuggauuacuauaaaacaggaauuauccgcugcccugacggcauuagcauccccgaacuucgggaggcgugugauuaccugugcauuucuuucgaauauuccaccaucaaguguagagaccucagcgcccugaugcacgagcuguccaacgacggcgcucgccggcaauuugaguucuaccucgaagagaugauucugccgcuuaugguugccucugcucagagcggggaaagagagugccacaucgugguccugacggaugacgaugugguggacugggaugaagaguacccuccccagaugggagaggaauauucccagaucauuuacucuacaaaacucuaucgcuuuuucaaguacaucgagaaucgggacgucgccaagagcguucugaaagaaagaggccuuaagaaaauucggcuggggaucgagggauauccuaccuacaaggaaaaagugaagaaacgccccggcgggagacccgaggugauuuauaacuacguccaacggccuuuuaucagaauguccugggagaaggaagagggaaagagccgccauguggauuuccaguguguuaaaucuaaguccaucacaaaucucgcggccgcugccgcugacauuccgcaggaucagcugguggucaugcaccccaccccucaaguggacgaacuggauauccuccccauucauccucccagcggcaacucugaccuggacccggaugcccagaacccuaugcuuuga

SEQ ID NO: 66547 - RNA, 1926 nt, Artificial Sequence
  derived and/or modified sequence opt5 from BTBD11__Homo_sapiens__NP_001017523
augagaaagcugcggcccaaagacagccgcgagccugccccgggcucccccgugagaucugggugccuccagcggcugagccacuacuccggaauccaacgcccuuuccuuguccugcccccucucauggaauggauuagaguugcuguggcccaugcgggccaccggcgcucuuuuagcauggauuccgacgaugugagacaggcugcccggcugcuucugcccggggucgacugugagccucgccagcucagagccgaugacugcuucugugcuucucggaagcuggaugccguggcuaucgaagccaaauuuaagcaggaccugggauuccgcaugcucaacugcggcagaaccgaucugguuaaacaagcggugagccuucuggggccggacggaauuaauacaauguccgagcagggcaugacgccccucauguaugccuguguccggggcgaugaagcuauggugcagaugcugcuugacgccggggcugaucugaacguugagguggucagcaccccucauaaguaccccucugugcacccugagacacgccauuggaccgcccucacauuugcggugcugcacggacacauccccgucguucagcugcuccuggacgccggcgcuaagguggaaggguccguggagcauggagaagagaauuauagcgagaccccgcuucaacuggccgcugccgucggcaacuucgaacucgugucucugcuucuggagagaggggccgacccucucauuggaacaauguaccggaauggcaucuccaccacgccccagggcgauaugaacagcuuuucucaggcugcggcccacgggcauagaaauguuuuccgcaaacugcuggcucagccugaaaaggagaaauccgacauccucagccuggaagagauucuugccgagggaaccgaucuggccgaaacagcucccccuccccucugcgccucccggaacucuaaggcgaaacugagagcucuuagagaggccauguaucacagcgccgaacacggcuacguggacgucaccaucgauauucgguccaucggggugccguggacacugcauaccuggcucgagagccugagaauugcuuuucaacagcaccgccggccccugauccagugucuccugaaggaguucaagacgauucaagaagaggaauauacagaggaacuuguuacccagggacugccucucauguuugagauccugaaagccucuaagaaugaagugaucucccagcagcugugcgucauuuucacacauuguuacggccccuacccuauccccaaacuuaccgagauuaagagaaaacaaaccagccgccucgacccgcacuuucugaacaauaaggagaugucugaugugacauuccuggucgaagggcggccuuucuaugcucauaaagugcuccuguuuacggccagccccagauucaaggcgcuucuguccucuaagccuaccaacgacggaacaugcaucgagauuggcuacguuaaauauagcaucuuucagcucgugaugcaguaccuguauuacggcgggcccgaaucccugcuuaucaagaauaacgagauuauggagcuccugagcgccgcuaaauucuuucagcuggaagcccuccaacgccacugugagaucauuugcgcuaagucuaucaauaccgauaacugcgucgacauuuauaaccacgccaaauuccugggagugacagaacuuuccgcguacugugagggcuacuuucugaagaauaugaugguucucaucgaaaacgaggccuucaagcagcugcuguaugauaaaaauggggagggaaccggccaggacgugcuucaggaccuccaacggacgcuggcuauccgcauucagagcauccaucugucuuccagcaagggguccgucguguga

SEQ ID NO: 66548 - RNA, 1521 nt, Artificial Sequence
  derived and/or modified sequence opt5 from BTBD16__Homo_sapiens__NP_653188
augaucaugagcaacacccacaaggccagacuggaacggcgcgugacaggcuccacgaauagauggcggcuccccaaacagccuuucucuggggaccugcuuagccugucccaaaugugcaaggcucucucuauugauuuugaagaggcccugcgcaacccggacagacuuuguaucagccagauucagaaauucuuuuucgaaaauuuuaagaacaaagauauccaguccggagaggcggacgucauucuggaaugccucggcuucaagugggagcugcaucaaccccagcuguuucagucugagacccucgcuaagcuguaccuuaaagcccuggcccaggggacaacccacccucuccgggaacuggaggaacuucugcgcgcucaaagccccaagaaaacaaaggagaaauccccugccaagagaaucaucauuagccucaagaucaaugauccccugguuaccaaaguggcuuucgccacagcgcugaagaaccucuauaugucugagguggaaauuaaucuggaggaccuucugggaguccucgccuccgcucauauccugcaguuuagcggccuuuuccagcgguguguggauguuaugauugcccgccugaaaccuucuaccaucaagaaauuuuacgaagcugggugcaaguauaaagaggaacagcucacgaccggaugugagaaguggcuggagaugaaccuggugccgcucggcggcacacaaauucaucugcacaagaucccccaggaccuucugcacaaaguccucaaguccccuagacuguucaccuuuagcgaguuccaccuucugaaaacaaugcuccuguggguguuccugcagcucaauuacaagauccaagccauucccaccuaugaaacgguuaugacauuuuucaaaucuuuuccugaaaacugcuguuuccuggaucgggacaucgggcgcucccuuagaccccuguuucucugccugcggcugcauggaauuaccaagggcaaggaucuugaggugcuccgccaccugaauuucuuuccggaaagcuggcuggaccaggucacagugaaccauuaccacgcgcucgagaaugggggagauauggugcaccugaaagaccuuaacacccaggccgucagauucggccugcucuuuaaucaggagaacaccacauauuccaagacgaucgcucuguacggguucuuuuucaaaauuaagggacugaaacaugacaccacaucuuacagcuuuuauaugcaacggaucaagcacaccgaucuugaauccccuagcgccguuuacgagcauaaccacgugucucucagagcugcccgccuggugaaguaugaaauccgggccgaggcucuggucgacggcaaauggcaggaguucagaacaaaucagauuaagcagaaauucggccucaccacguccagcuguaagucucauacacugaaaauccaaaccguggggauucccaucuacguuagcuuugcguucauuuuuccugccuccuga

SEQ ID NO: 66549 - RNA, 1158 nt, Artificial Sequence
  derived and/or modified sequence opt5 from BTBD1__Homo_sapiens__NP_001011885
auggccagccugggccccgcugccgcgggggagcaggcuuccggagccgaagccgagccuggcccggcugggcccccucccccucccucuccuagcucccucggaccgcugcuuccccugcaaagagaaccucucuacaacuggcaggccaccaaggcuucucugaaagagcgguucgccuuucuuuucaauagcgaacugcucuccgacgugcgcuuuguccugggcaaggggagaggagcggccgcugccggcggcccccagcggaucccugcucaccgcuucguucuggccgcggggucugccguguuugaugcuauguucaacggaggcauggccacaacgagcgcugagauugagcuccccgacguggaaccggccgccuuucuggcgcuucugagauuccucuauuccgaugagguccagaucgggccugaaaccgugaugacaacccuguacacagcuaaaaaguaugccguucccgcucuugaggcccauugcguggaguuucugaccaaacaccuccgggccgacaaugcuuucaugcugcugacacaagcccgccucuuugaugaaccucagcuggcgagccuuugucuggacaccauugauaagucuacgauggacgcuaucuccgccgagggauucaccgauauugacaucgauacacucugcgccguccuggaaagagacacccuuagcauccgggagucucgccuguuuggcgcugugguuagaugggccgaagcugagugucagcggcagcaacuccccgugacauucgggaacaagcagaaaguccugggaaaggcccugucccucauucgcuucccccugaugaccaucgaggaauuugcggccggcccugcucagagcggcauucuuucugauagagagguggugaaucuguuccuccauuuuacggucaacccgaaaccccggguugaauacaucgaccgcccuagaugcugucugcgggggaaggagugcuguauuaauagauuccagcaaguggaaucccgcuggggauauagcggcacauccgaccggaucagaucucuuaacaugcgcaaaagcaagcccugggaucggaugauuccugcccugguggucauggggcagcucacccacuccggaagcugcucuagaaaucccuga

SEQ ID NO: 66550 - RNA, 1578 nt, Artificial Sequence
  derived and/or modified sequence opt5 from BTBD2__Homo_sapiens__NP_060267
auggccgcuggcgggagcggaggcagagccuccugucccccuggggugggagucggcccggggaccggaggcucucccggcccuagcgcgaacgcugccgccacacccgcuccugggaaugccgcugccgcggccgcugccgcugccgcggccgcugccgcucccggaccuacgccgcccgccccucccggcccugggaccgacgcccaggcugcgggagccgagcgggcugaagaggccgccggccccggggcugccgcgcugcaacgcgaagcugccuacaacuggcaggccuccaagccgacaguucaggagagauucgcuuuucucuucaauaacgaagugcugugcgaugugcacuuucuugucggaaaaggccugucuagccagcggaucccugcccaucgcuucgugcucgcuguuggcuccgccguguuugacgcgauguucaaugggggaauggccaccacaucuaccgagauugagcugcccgaugucgaaccugcugccuuucuugcucugcucaaguuccuguauagcgacgaggugcaaaucggccccgaaacaguuaugaccacgcuguacaccgccaaaaaguaugcggugcccgcccucgaggcucacugcgucgaguuucugaaaaagaaccuuagagccgauaaugcuuucaugcugcucacacaggcccggcuguuugacgaaccucagcuugccucccugugucucgagaacauugauaagaauaccgcugacgcgaucacagccgaaggguucaccgauauugaccuggauacgcugguggcugugcucgagcgcgacacacugggaaucagagaaguccggcuuuuuaacgccguugugcgcuggagcgaggccgagugccagagacaacagcuccaggugaccccggaaaaucggcgcaaaguccugggcaaggcucuggggcuuaucagauucccccugaugacaauugaggaauuugccgcgggaccugcucagucuggcauccucguggaucgggagguugugucccuguuucugcauuucaccgucaaccccaaaccucgcguggaauuuauugacagaccccgguguugccucagaggcaaggaguguagcaucaaucgcuuccaacagguugagucucgguggggguacuccggaaccagcgaccgcauuagauuuucugugaacaaacggaucuucgucgugggcuuugggcuguauggauccauucacggcccgacagauuaccaggucaauauccaaaucauucauacggacagcaacaccgugcuugggcagaacgauacaggcuucuccugcgacggaucugccagcaccuuuagaguuauguucaaggaaccuguggagguccugcccaaugugaacuauacagccugugcuacccucaagggcccugauucccacuacgggacgaaaggacugcgcaagguuacacacgaaagccccaccaccggcgccaaaacaugcuuuaccuucuguuacgcggcugggaauaacaauggaacaucuguggaggacggccagaucccugaagucauuuucuauacguga

SEQ ID NO: 66551 - RNA, 1386 nt, Artificial Sequence
  derived and/or modified sequence opt5 from BTBD3__Homo_sapiens__NP_001269480
auggccgcugacaucuuccccagaaagaaaccugccaacagcuccucuaccagcgugcagcaauaccaccagcagaaucuguccaacaauaaccucauuccggcgcccaauuggcagggccuguauccuacaauccgggagcgcaacgcuaugauguuuaauaacgaucuuauggccgacguccauuucguuguggggcccccuggaggcacgcaaagacugcccgggcacaaguacgugcucgccgucggaucuagcguguuucaugcuauguucuauggcgaacuggccgaggauaaagacgaaauucggaucccugauguugagccggcugccuuucuugcgaugcugaaguacauuuauugcgacgaaaucgaucucgccgcugacaccgugcuggccacacuguacgcugccaaaaaguauaucgucccccaccucgcgcgcgccugugugaauuuccuggagaccucccuuucugcuaagaacgccugcguucugcucagccaguccugucuguuugaggaaccugaucuuacacagagaugcugggaggugauugacgcucaggccgaacuggcccucaaaagcgagggguucugugauaucgacuuucaaacccuggagucuauucugcggcgcgaaacacucaaugcuaaggagaucgucguguucgaagcggcccugaacugggcugagguggaaugccagagacaggaucuugcccuguccauugagaauaaacggaagguccucggaaaagcccuguaccuuauccgcauucccaccauggcucuggacgacuuugccaacggcgcggcucagagcggcguucucacgcugaaugagaccaacgauaucuuccugugguacacagccgccaagaagccugaacuccaauuugugucuaaagcuagaaaggggcuggugccccagcggugucaucgcuuccaguccugcgccuauagaagcaaccaauggcgguaccgcggaagaugugacucuauccaguucgcugucgauaaacggguguuuauugccggcuucgggcuuuauggauccagcugcggcuccgcggaguacucugccaagaucgaacugaaaagacaggggguugugcucggacagaaucugagcaaguauuuuuccgacggcagcucuaacaccuucccggucugguuugaguacccugugcaaauugaacccgauacauucuauaccgcuuccguuauccuugacggcaaugagcugagcuacuuugggcaggagggaaugacggaagugcaguguggcaaagucacagugcaguuccaaugcucuagcgauuccaccaacgggacaggaguccagggcgggcagauuccugagcucaucuuuuacgccuga

SEQ ID NO: 66552 - RNA, 1749 nt, Artificial Sequence
  derived and/or modified sequence opt5 from BTBD9__Homo_sapiens__NP_001165889
augugcagagcccugcucuacggcgggaugcgggagagccagcccgaagcugagaucccucugcaagacaccacagccgaagcguucacgaugcuucugaaguauauuuacaccggacgcgcuacacucaccgaugagaaagaagaggugcugcuugacuuucugucccucgcccacaaguauggcuucccggagcuggaagauucuacaagcgaguaccuguguaccauccucaacauucagaaugucugcaugacauuugacguugccucccuguauucucuucccaaacugaccuguaugugcuguauguucauggauagaaacgcucaggaagugcucagcuccgagggguuucugucucuuagcaagacggcccugcucaauaucgugcugcgggacuccuucgcugccccugagaaagauauuuuucuggcgcuccugaacuggugcaagcauaauagcaaggaaaaccacgccgagaucaugcaggcuguccgccuuccccugaugucucucaccgaacugcuuaaugugguuagaccuuccggacugcucagccccgacgccauccuggaugcuauuaaagugcggucugagucccgcgacauggaucugaacuacagaggcaugcucaucccugaagagaauauugccacaaugaaguauggggcgcaagucgugaaaggagagcuuaagagcgcccugcuggacggcgauacccagaacuacgaccucgaccauggcuucucucggcacccgaucgaugacgauugucgcuccgggauugaaaucaaacugggacagcccagcauuaucaaucauauccggauucuucugugggacagagauucccgcucuuacagcuauuuuaucgagguuuccauggacgaacucgauugggugagagucauugaccacagccaguaccugugccggucuuggcaaaagcuguauuucccugcucgcguguguuccggcgauggggugagccucuggugcccccuguggucuagaacaccugagcuuaagcagagcucccugcucggacugcccaaaugucgguacaucagaauugucggcacccacaacacgguuaauaagaucuuucauaucguggccuucgaaugcauguuuacaaacaaaaccuucacacuggagaaggggcuuauugugccgauggagaaugucgcuaccaucgccgacugcgccucugugauugaaggaguuagccgcucccggaacgcucuccugaacggcgauaccaaaaauuaugacugggacagcggcuacacaugucaccagcuggggucuggagcgaucgugguccagcucgcccaaccuuauaugauuggcuccaucagacugcuucugugggauugcgacgaucgcagcuacucuuacuauguggagguuuccacgaaccagcagcaauggaccaugguggcugaccggacaaaggucagcuguaaauccuggcagucugugaccuucgaaagacagcccgccagcuuuauccgcauugucgggacacauaauaccgccaacgagguguuccacugcguucacuuugaauguccugagcagcaauccucucagaaggaggaaaauagcgaggaauccggaacgggcgauacaagccucgcugggcagcagcuggacucucaugcccugcgggcgcccuccggaagcucucuucccuccagcccuggcucuaacagcagauccccgaaucgccaacaccaguga

SEQ ID NO: 66553 - RNA, 537 nt, Artificial Sequence
  derived and/or modified sequence opt5 from BTC__Homo_sapiens__NP_001720
auggacagagccgcucggugcagcggcgccuccucucugccccuccugcuugcgcuggcucucgggcuggugauccuucacugugucguugccgauggaaacagcacccgcuccccugagacaaauggccugcucugcggggacccggaagagaacugugccgcuacgaccacacagucuaagagaaaaggacauuucagccggugccccaagcaauacaaacacuauuguauuaagggccgcugcagauuugugguggccgaacagaccccuuccugugucugcgaugagggguacaucggagcucggugugaacgcguggaccuguucuaucugagaggcgaucggggccagauucucguuaucugccugauugccgugauggucguguuuaucauccuuguuauugggguguguacaugcugccauccccugcgcaaaagacggaagcgcaagaaaaaggaggaggaaauggagacccucggaaaagacaucacaccuauuaaugaagauaucgaggagaccaacauugcguga

SEQ ID NO: 66554 - RNA, 1632 nt, Artificial Sequence
  derived and/or modified sequence opt5 from BTD__Homo_sapiens__NP_000051
auggcccacgcucauauccagggcgggagacgggccaagagccgcuucguggucugcauuauguccggagcgagaucuaaacuggcucucuuucuguguggcugcuacguuguggcccuuggggcccacaccggagaggaaagcguggcugaccaucacgaggccgaauauuacgucgcugccguguaugagcaucccuccauccugucucucaacccucuggcgcuuauuagccggcaagaagcccuggagcucaugaaucagaaccuggauaucuacgagcagcagguuaugacagcugcccaaaaggacgugcagauuaucgucuucccggaagauggcauccacggguuuaauuucacgcgcaccuccauuuaucccuuucuggacuucaugccuucuccccaggugguuagauggaacccuugucucgagccccaccgguuuaaugauacagaagugcugcagcgccuuagcugcauggcuaucagaggagacauguuccuggucgccaaccucggcaccaaagagccuugucauuccagcgauccgcggugccccaaggacggccgcuaccaauuuaauacaaacgugguguucucuaauaacgggacccuggucgauagauaucggaaacacaaucuuuacuuugaggcggccuucgacguuccucugaagguggaucucauuacauuugacacccccuucgcuggacgcuucggcaucuuuacguguuucgauauucuguuuuucgacccugccaucagagugcugcgggacuacaaggucaaacaugugguuuaucccaccgcuuggaugaaccagcucccgcugcuugccgccauugaaauccagaaggcuuuugcgguggccuucgggaucaauguccuggcugccaacgugcaccacccuguucucggaaugacaggcuccgggauucauacaccccuggagagcuuuugguaccacgauauggaaaauccuaaaucucaucuuaucauugcccagguggcuaagaaccccgucggacugaucggcgccgagaacgcgaccggcgaaaccgaccccucccacagcaaauuccucaagauucugucuggggauccuuauugcgagaaggacgcucaagaggugcauugugaugaagccacgaaauggaaugucaacgccccgcccacauuucacuccgagaugauguacgacaauuucacccuggugccuguuuggggaaaggaaggcuaucuccacgugugcagcaacgggcuguguugcuaccuucuguaugagcgccccacacucuccaaagaacuguacgcucuuggagucuuugauggccugcauaccgugcacgggaccuacuauauccagguuugcgcccucgugagauguggaggccugggcuucgacacaugcgggcaggagaucacggaggcuaccggaauuuuugaguuccaucuguggggcaauuucucuacaagcuacaucuuuccucucuuccugaccuccgggaugacacuugaaguccccgaucaacugggaugggaaaacgaccacuauuuucucagaaagagccggcugucuuccggccuggugaccgccgcgcuuuacgggcgccucuaugagcgggauuga

SEQ ID NO: 66555 - RNA, 621 nt, Artificial Sequence
  derived and/or modified sequence opt5 from BTF3__Homo_sapiens__NP_001032726
augagacggaccggcgcccccgcucaggccgacagccgcgggagaggacgggcgcgcggcgggugcccuggaggcgaggcuacacugucccaaccgcccccuagagggggaacgcggggccaggaaccccagaugaaggagaccaucaugaaccaggaaaaacucgccaagcugcaagcccaggugcgcauuggcgggaaaggaacagcuagacggaagaaaaaggucguucaccgcaccgccacagcugaugacaagaaacuucaguucucucugaagaaacucggcgugaauaacaucagcgggauugaggaagugaauauguuuaccaaccagggaacagucauccauuucaauaacccuaaggugcaagccucccuggcggccaauaccuuuacgauuaccggccacgcugagacaaaacagcuuaccgagaugcugcccucuauccucaaccagcugggggccgauagccugacaucccucagacggcuggcugaagcccuuccuaagcagucuguugacggaaaggcgccgcuggccaccggcgaggaugacgaugacgaagugcccgaucucgucgagaauuucgacgaggcuagcaaaaacgaagccaauuga

SEQ ID NO: 66556 - RNA, 516 nt, Artificial Sequence
  derived and/or modified sequence opt5 from BTG1__Homo_sapiens__NP_001722
augcaccccuucuacaccagagccgcuacaaugaucggcgagauugccgcggcugugagcuuuaucuccaaguuccugcggacgaaagggcucaccucugaacgccagcugcagacauuuagccagucccuucaggagcugcucgccgaacauuauaagcaccauugguucccugagaaaccgugcaagggaucuggcuacagauguauucggaucaaccacaaaauggacccccugauugggcaggccgcucaacgcaucggacuuagcucccaggaacuguuuagacuccugccuucugagcugacccucugggucgaucccuaugagguuagcuaccggaucggcgaagacggguccauuugcgugcuguaugaggccagcccugcuggaggcucuacacaaaauuccaccaacgugcagauggucgauagccgcaucucuuguaaggaggaacuucugcucggcagaacaucccccagcaagaauuacaacaugaugaccgugucuggguga

SEQ ID NO: 66557 - RNA, 477 nt, Artificial Sequence
  derived and/or modified sequence opt5 from BTG2__Homo_sapiens__NP_006754
augagccacggcaaggggaccgacaugcugcccgagaucgccgcugccgugggauuccucuccucucugcuuagaacacggggcugcgucagcgaacagcgccugaaaguguuuuccggggcgcuccaagaggcucugacggaacauuacaagcaccauugguucccugagaaaccgucuaagggaagcggcuauagauguauucggaucaaccacaaaauggaucccauuaucucccgcguugccucucagauugggcuuagccagccucagcugcaucaacuccugcccuccgaacugacccucuggguggacccuuacgaggucagcuauagaaucggagaggauggcucuaucugcgugcuguacgaagaggcuccccuugccgccuccuguggccugcucacaugcaagaaucagguucugcuugggcggagcucuccuuccaagaacuaugugauggcugucagcucuuga

SEQ ID NO: 66558 - RNA, 891 nt, Artificial Sequence
  derived and/or modified sequence opt5 from BTG3__Homo_sapiens__NP_001124386
augaagaacgagaucgccgcuguggucuucuuuuucaccagacugguucggaaacacgacaagcucaaaaaggaagccguggagcgcuuugcggaaaaacugacacuuauucugcaggagaaguacaagaaucauugguaucccgaaaaaccuagcaagggccaagccuacagaugcauccgggugaacaaauuccagcgcgucgauccggacgugcucaaggccugugagaauagcugcauucuguauucugaucuugggcugcccaaagagcucacgcuguggguugacccuugugaagugugcuguagacgggauggagucagccccugcuggccugacuguucccagacccccgaucuggugauccgcccuccguggcccccuaaggcccucgacuacagacgggagccccugcgcccugcuucuagcuuucuuauuauguauggcgaaaagaacaaugccuucaucguugcuuccuuugagaacaaagaugagaauaaggacgaaaucucuagaaaagugacacgggcccuggauaaggucaccagcgacuaccacuccggguccucuuccagcgaugaggaaacaucuaaagagauggaagugaagcccuccagcgugaccgcggccgcuucuccggucuaucagauuuccgagcucaucuucccuccccugccuauguggcauccccuuccccgcaaaaagccuggaauguacagaggcaacgggcaccaaaaucauuacccgcccccuguucccuuuggauauccuaaccagggccggaagaauaaacccuaccgcccgauuccugugacaugggugcccccucccggcaugcacugcgacagaaaccacuggaucaauccucauaugcuggcuccccacuga

SEQ ID NO: 66559 - RNA, 672 nt, Artificial Sequence
  derived and/or modified sequence opt5 from BTG4__Homo_sapiens__NP_060059
augagagacgagaucgccaccacaguguucuuugucacgcggcugguuaagaaacacgauaagcucagcaaacagcaaauugaagacuucgcugagaagcugaugaccauccuuuuugaaacauaccgcucccauuggcacucugauugccccagcaaaggccaggccuucagauguauucggaucaacaauaaccagaauaaggacccuauucuggagcgcgcgugcguggaauccaacguggauuuuucucaucucgggcugccgaaggagaugaccaucugggucgaccccuucgagguguguugcagauauggagagaaaaaucacccuuuuacaguugcuagcuucaagggccggugggaagaaugggagcuuuaccagcaaaucuccuaugccgugucucgcgccagcuccgaugucagcucugggaccuccugugacgaggaaagcugcucuaaagagcccagagugauuccuaagguuuccaaccccaaaagcaucuaccagguggaaaaucugaagcagccuuuucagucuuggcuccaaauuccgcggaagaaaaacgucguggauggacgcgugggccugcuggggaauacauaucauggaucccagaagcaccccaaauguuacagaccugcuaugcaccggcucgaccgcauccuguga

SEQ ID NO: 66560 - RNA, 1980 nt, Artificial Sequence
  derived and/or modified sequence opt5 from BTK__Homo_sapiens__NP_000052
auggccgcugugauccuggagagcauuuuccucaagagaucccagcagaaaaagaaaaccucuccccugaacuuuaagaaacggcuuuuccugcucacaguccacaagcugagcuacuaugaauacgacuuugagcgcggcagacggggguccaagaaaggaucuaucgauguugaaaagauuacgugcguggagaccguggucccugagaaaaauccgcccccugagcgccaaauccccagacggggcgaggaaagcuccgagauggaacagauuucuaucaucgagcgcuucccuuaucccuuucaggugguuuacgacgaggggccucuuuauguguucagcccgacagaagaacugagaaagcgguggauucaucaacucaaaaacgucauccgcuacaauuccgaucuggugcagaaguaucaccccuguuuuuggauugacggacaguaccugugcuguagccagaccgccaagaacgcgaugggcugccaaauccucgaaaauagaaacgggucucugaaaccuggauccagccaucggaagaccaaaaagccccuuccucccaccccggaggaagaucagauucugaaaaagccucugcccccugagcccgcugccgcccccguuucuacauccgagcucaaaaagguggucgcucuuuacgacuauaugccuaugaaugccaacgaucugcagcuccgcaagggcgacgaauacuucauccuggaggaaagcaaucugccgugguggagagcucgggauaaaaacggccaggagggguauauucccucuaauuacgugaccgaagccgaggacuccaucgagauguaugaaugguacagcaagcacaugacgcgcucccaagcggagcagcuccugaaacaggaaggaaaggagggcggguuuaucgugagagauucuagcaaagccggaaaguauaccgucuccguuuucgcuaagagcacaggcgacccucaaggggugauucggcauuacguggucuguucuacaccccagucccaguacuaucuugccgaaaaacaccuguuuagcacaaucccugagcucauuaacuaccaccagcauaauucugcuggacugaucagcagacuuaaguaucccgugucccaacagaacaaaaaugccccgucuaccgcgggccugggcuacgggagcugggagauugauccuaaggaccucacguuccugaaagaacugggaacaggccaguuugggguugugaaguauggaaaguggcgcggccaguacgacgucgccaucaaaaugaucaaggagggguccaugagcgaagaugaguucauugaggaagcuaaagugaugaugaaccucucucacgagaagcugguucaacuuuauggagugugcaccaaacagcggcccaucuucauuaucacagaauacauggccaacggcugucugcucaauuaccugagagagaugcgccaucgguuucagacccagcaacuucuggaaaugugcaaggacgucugugaggcuauggaguaucucgaauccaagcaguuccugcacagagaucuggccgcccgcaacugccucgugaaugaccagggcgucgugaaaguuagcgauuuugggcugucucgguacgugcuugacgaugaguauaccuccagcgucggauccaaguucccugugagauggucucccccugaaguucugauguacagcaaauuuuccucuaagagcgacauuugggcuuucggcgugcucaugugggagaucuauucccuggggaaaaugcccuacgaacgcuuuacaaacagcgagacggcggagcacaucgcccagggacugcggcuuuauagaccgcaucucgcuucugaaaaggucuacaccauuauguacuccuguuggcacgagaaagccgaugaacgcccuacauucaagauccugcugagcaauauucucgacgugauggaugaggaaucuuga

SEQ ID NO: 66561 - RNA, 726 nt, Artificial Sequence
  derived and/or modified sequence opt5 from BTLA__Homo_sapiens__NP_001078826
augaagacccugcccgccaugcucggcacagggaaacuguucuggguguuuuuccuuaucccuuaccuggacauuuggaacauccacggaaaggagagcugcgauguccagcucuauauuaaaagacaauccgaacauucuauccuggcuggcgacccguuugagcuugaaugucccguuaaguacugcgccaaucggccucacgugacgugguguaaacugaacgggaccacaugcgugaagcucgaggaucgccagaccagcuggaaggaagagaaaaauauuuccuucuuuauccugcauuucgagcccguccugccuaacgacaauggaucuuauagauguagcgcgaacuuucaguccaaucucaucgaaucucacagcacaacccuguacgugacaggcaagcagaacgagcuuuccgauaccgcugggcgggaaauuaaucugguugacgcccaucucaaaagcgagcaaacggaggccucuacccgccagaacucccaggugcugcuuagcgaaacaggaaucuaugauaaugaccccgaucugugcuucagaaugcaggagggcucugaagucuacuccaacccuugucucgaggaaaauaagccgggcauuguguaugcuagccugaaccacucuguuaucgggcccaauucccggcuggcccgcaacgugaaagaggcuccuaccgaguacgccagcauuugcgucagauccuga

SEQ ID NO: 66562 - RNA, 1581 nt, Artificial Sequence
  derived and/or modified sequence opt5 from BTN1A1__Homo_sapiens__NP_001723
auggccguguuccccagcuccggccugccuagaugccuccugacccuuauccugcuccagcugccgaagcucgacucugcucccuuugaugucauugggccucccgagccuauccuggccguugugggagaagacgcggagcuccccugucggcugagcccuaacgcuuccgccgaacaccuggagcuccgcugguuccggaaaaaggugucuccggccguccuggugcaucgggauggccgcgaacaagaggcugagcagaugcccgaauacagagggcgggccacacuuguucaggacggaauugcuaaaggccgcguggcccugagaaucagagggguccgcgugagcgaugacggagaguauacgugcuuuuucagagaagauggcuccuacgaggaggcgcucguucaccugaagguggccgcucuuggcucugacccucauauuagcaugcagguccaagaaaauggggagaucugucuggaaugcaccuccgugggaugguaucccgagccucaggugcaguggcggacaagcaaaggcgaaaaguuucccucuaccuccgagagccgcaacccggaugaggaagggcuuuucacagucgccgcuucuguuaucauuagagacaccuccgccaagaaugugagcuguuacauccagaaccugcugcucggacaagagaaaaagguggaaauuucuaucccugcguccagccugccccggcuuacaccuuggauugucgccguggcuguuauccugauggugcucggccugcuuaccauuggguccaucuuuuucacguggcgccuguauaaugagagaccccgggaaagacgcaacgaguuuucuagcaaagagcggcuccuggaggaacugaaguggaaaaaggccacccuccacgcugucgaugugacacuggaccccgauaccgcccauccucaccuuuuccuguacgaagacuccaagagcguuagacucgaggacucucgccagaaacugccggaaaagacagagcgguuugauuccuggcccugcgugcuuggaagagagaccuucacgagcggccgccacuauugggaagucgaggugggcgaccggacagauugggccaucggggucuguagagaaaaugugaugaaaaagggauuugacccuaugacccccgagaacggcuucugggcuguugagcuguacgggaauggauacugggcgcucacaccucugcgcacaccccugccgcucgccggcccuccccggagaguggggauuuuccuggauuaugaaucuggagacaucagcuuuuacaacaugaaugauggcuccgacauuuauaccuucucuaacgucaccuuuagcggcccucuucgccccuucuuuugccugugguccagcgggaaaaagccucucacgaucugucccauugcugauggaccggagcgggugaccguuaucgccaaugcccaggaccugucuaaagaaaucccucugucccccaugggcgaggauagcgcucccagagacgccgacacacuucauucuaagcucauuccuacccagccgucccaaggggcgcccuga

SEQ ID NO: 66563 - RNA, 1401 nt, Artificial Sequence
  derived and/or modified sequence opt5 from BTN2A1__Homo_sapiens__NP_001184162
auggaggugagaugguuccggagccaguuuucccccgccgucuucguuuacaagggcgggcgcgaaagaaccgaggaacaaauggaggaauaucggggacgcacaacguuugugucuaaagacaucagcagaggcuccguggcucuggucauucacaacaucaccgcccaggagaaugggacauaccggugcuauuuccaggagggacgcucuuacgaugaagcgauucuccaucuggugguugcuggccuugggagcaagccucugaucuccaugagaggacacgaggacggcggcauucggcucgaauguaucucucgcgggugguauccgaaaccccugaccguguggagagauccuuacggaggcgucgcccccgcccuuaaggaggugagcaugccugacgcugaugggcuguuuaugguuacaaccgccgugaucauucgggacaaauccguccgcaacaugagcugcucuaucaauaacacacuccugggacagaagaaggaguccgugauuuucauccccgagagcuuuaugccuucuguguccccgugugcugucgcccugcccauuaucguugugauucucaugaucccuaucgcggugugcauuuauuggaucaauaaacugcaaaaggagaaaaagauucuuagcggcgaaaaagaguucgaaagagagacccgggagaucgcccugaaggaacucgagaaggaacgcguccagaaagaggaagaacuucaggugaaggagaaacugcaggaggaacugagauggcggagaacguuucuccaugcuguugaugugguccuggaccccgauaccgcccacccugaccuguuccucucugaagaucgccgguccgugagacgcugucccuuucggcaucugggggagagcguuccggacaacccugaaagauucgauucccaacccugcgugcuuggacgcgagucuuuugcuagcggcaagcacuacugggaggucgaaguggagaaugucauugaauggacagugggcguuugucgggacuccguggagagaaaaggggagguccugcucaucccucagaacggauucuggacccuggaaaugcacaagggccaguaccgcgccgugagcucucccgaccggauccuuccccugaaagagucccucugcagaguugggguguuccuggauuaugaagcgggagacgucagcuuuuacaauaugcgcgaucggucucauauuuauacauguccuagaagcgccuucuccgugccggugcggcccuuuuuccgccugggcugcgaggacucuccuaucuuuauuugucccgcucucaccggggccaacggaguuacggucccugaagagggccugacacuucacagagugggcacccaucagagccuguga

SEQ ID NO: 66564 - RNA, 1572 nt, Artificial Sequence
  derived and/or modified sequence opt5 from BTN2A2__Homo_sapiens__NP_001184166
auggagcccgccgcugcccugcacuucagccucccugcgucccugcuucugcuccugcuucugcuccugcugucucucugcgcucuggugagcgcccaguuuaccgucguuggcccggccaaccccauccuugcuauggugggggaaaauacaacgcugagaugucaucucuccccugagaagaacgccgaagacauggaggugcggugguuccgcucucaauuuagccccgcugucuucguguacaaaggaggcagagaacggaccgaggagcagauggaagaguaucgcgggagaauuacauuuguuuccaaggauaucaaucggggaucuguggcccuggucauucacaacgugaccgcgcaggaaaauggcaucuaccgcugcuauuuccaggaggggagaagcuacgacgaggccauucuucggcugguuguggcuggacucggcuccaaaccucugaucgaaaucaaggcccaagaggauggcagcauuuggcuggaauguaucucugggggaugguaucccgagccucucacagucuggcgcgacccguacggcgaaguggugcccgcucugaaagaggucuccauugccgaugcggacgggcuuuuuaugguuaccacagccgugaucauuagagauaaguaugugcggaacgucagcugcucugugaauaacacccugcucggacaggagaaggaaacgguuaucuucauuccugaguccuuuaugcccagcgcuucuccuuggaugguggcccuggcugucauccuuaccgccucccccuggauggugagcaugacaguuauccuggccguguucauuaucuuuauggcugucuccauuuguugcaucaaaaagcuccagcgcgaaaagaaaauucugucuggcgagaaaaagguggaacaggaggagaaggaaaucgcgcaacagcugcaggaggaacucagauggcggcgcaccuuccugcaugccgcugacgucgugcuugauccggacacagcccacccugagcuguuucucagcgaagauagacgguccguuagacgcgggcccuaccggcagagagugccugacaaucccgagcgcuucgauagccaacccuguguccugggaugggagucuuucgccuccggcaaacauuacugggaaguggagguugaaaacgugauggucuggaccgugggcgugugccggcacagcguugagagaaagggggagguccuucugaucccucagaauggauuuuggacgcucgaaauguucggcaaccaguaucgcgcucugucuagcccggagcggauucugccccucaaagaaucccuguguagaguggggguguuucuugacuacgaggccggagacgucucuuucuauaauaugcgcgaucggagccacaucuacacaugcccuagauccgcguuuaccgugcccguucgcccuuucuuucggcugggcagcgacgauucucccauuuucaucuguccggcucucacaggggccuccggagugauggucccugaagagggccugaagcugcauagagugggcacccaccaaagccuuuga

SEQ ID NO: 66565 - RNA, 1386 nt, Artificial Sequence
  derived and/or modified sequence opt5 from BTN3A1__Homo_sapiens__NP_001138480
augaagauggccagcuuccuggcuuuucuccugcuuaacuucagagugugccugcuccugcuucagcugcucaugccccacuccgcccaauuuucuguccugggcccuagcgggccgauccuggcgaugguuggagaggacgcugaucuccccugucaucuguucccuaccauguccgccgaaacaauggagcuuaaaugggugucuagcucccugagacagguggucaauguguacgccgacggcaaggaaguugaggaucgccagucugcucccuauagagggcggacgagcauucuccgcgacggaaucaccgccggcaaagcugcccugcggauucacaacgugacagcguccgauagcgggaaguaccuuugcuauuuucaggacggagauuucuacgaaaaagcccuggucgagcucaagguggcugacggcguuggccuguaugccguggcugccucugucaucaugcggggguccagcggagagggcgugucuuguaccauucgcuccagccugcucgggcuggaaaagacagcgucuaucuccaucgccgaucccuuuuucagaagcgcucaacgguggauugccgcucuugccggaacccugccugugcuccugcuucugcucggcggggccggauacuuucuguggcagcagcaggaggagaaaaagacacaauuccgcaaaaagaaaagagagcaggagcugcgggaaauggcuugguccaccaugaagcaggagcagucuacgcgcgucaagcuccuggaagaacuuagauggcggagcauccaauaugcgucccgcggcgaaagacauagcgccuacaaugaguggaaaaaggcucuguuuaaaccugccgacguuauucucgauccgaagaccgccaaccccauccugcuugugucugaggaccagcgguccgugcagagagcuaaagaaccucaagaucugcccgacaauccugagcgcuucaacuggcacuacugcguccucggcugugagagcuuuauuucugggcggcauuauugggaaguggaaguuggagacagaaaggaguggcacaucggcgugugcagcaaaaauguccagcgcaaggggugggugaagaugacacccgagaacggauucuggaccaugggccugacagaugggaauaaauaccggacccugacggaaccgagaacaaaccucaagcugccuaaacccccuaagaaaguuggaguguuccuugacuaugagaccggcgauauuuccuuuuacaaugccgucgacggcucucacauccauacauuccuggaugugagcuuuuccgaagcgcucuaucccgucuuccgcauccugacccuggagcccaccgcucuuacaauuuguccugccuga

SEQ ID NO: 66566 - RNA, 1005 nt, Artificial Sequence
  derived and/or modified sequence opt5 from BTN3A2__Homo_sapiens__NP_001184175
augaagauggccagcucccuggcuuuccuccugcuuaacuuucacgugucucugcuccugguccagcuucugacccccugcagcgcccaauucuccguucucggcccuucugggccgauccuggcgauggugggagaggacgcugaucugcccugucaucucuuuccuacaaugagcgccgaaacgauggagcugaaauggguguccucuagccuuagacaggucgugaauguuuacgccgacggcaaggaaguggaggaucggcaguccgcucccuaucgcgggagaaccagcauucugcgggacggaaucacagccggcaaagcugcccuccgcauucacaacgucaccgcgucugauuccgggaaguaccugugcuauuuccaggacggagauuuuuacgaaaaagcccuuguggagcugaagguugcugcccucggcagcaaucugcauguggaggucaagggcuaugaagacgggggaauccaccuggaguguagaucuacaggcugguacccucaaccccagauucagugguccaacgcuaaaggggaaaauaucccugccguggaggcgccgguggucgccgauggaguuggccucuaugagguggcugccagcgugaucaugcgcgggggaucuggcgaaggcgucuccugcauuauccggaacagccugcuugggcuggagaagaccgcuuccauuucuaucgccgaccccuucuuuagaagcgcccagccuuggauugcugcgcucgccggaacacugcccauccuucugcuccugcuggcuggcgccuccuacuuccucuggcggcaacagaaagaaauuaccgcccugagcucugagaucgaauccgagcaggagaugaaggaaaugggguacgcugccacggagcgcgaaaucagccuuagagagucucugcaggaggaacucaaacggaagaagauucaauaucugacccgcggagaggaaagcuccucugauacaaauaaaagcgcguga

SEQ ID NO: 66567 - RNA, 1755 nt, Artificial Sequence
  derived and/or modified sequence opt5 from BTN3A3__Homo_sapiens__NP_008925
augaagauggccagcucccuggcuuuccuccugcuuaacuuucacgugucucuguuccucguccagcugcuuacccccugcagcgcccaauuuuccguucugggcccuucugggccgauccucgcgauggugggagaggacgcugaucugcccugucaucuguucccuacaaugagcgccgaaacgauggagcucagauggguguccucuagccugcggcaggucgugaauguuuacgccgacggcaaagaaguggaggaucgccaguccgcucccuauagagggcggaccagcauucuucgcgacggaaucacagccggcaaggcugcccugcggauucacaacgucaccgcgucugauuccgggaaauaccucugcuauuuucaggacggagauuucuacgaaaaggcccugguggagcuuaaaguugcugcccugggcagcgaccuccauaucgaggugaagggcuaugaagaugggggcauucaccuggaguguagaucuacaggaugguacccucaaccccagaucaagugguccgacaccaaaggggaaaauaucccugcugucgaggccccggugguggcggauggagucggccuguaugccguugcugccagcgugauuaugcgcgggucuuccggaggcggcgugagcugcaucauuagaaacucccuccuggggcuugagaagacagcuucuaucagcauugccgaccccuuuuuccgguccgcccagccuuggaucgcugcgcuggccggaacccuccccauuagccugcuucugcucgcuggcgccucuuacuuucuguggcgccagcaaaaagaaaagaucgcccuguccagagagacggaacgggagcgcgaaaugaaagagaugggguacgcugccaccgagcaggaaaucagccucagagagaagcugcaggaagaacuuaaguggcggaaaauucaguauauggcgcgcggagaaaagucucuggcuuaccaugaguggaaaauggcccucuucaagccugccgaugucauccuggaccccgacacagcuaaugccauucuucuggugagcgaggaucaaagauccguucagcgggcugaggagccgagagaccucccugauaaccccgaacgcuuugaguggcgguauugugugcugggcugcgaaaauuucaccucugggagacacuacugggaggucgaggugggagaccgcaaagaauggcacaucggcguuuguagcaagaacguggagcggaaaaagggcugggucaagaugacaccugaaaauggguauuggaccaugggacugacggauggcaacaaauacagagcccucacagagccccgcaccaaucugaaacuucccgagccuccgcggaagguggggauuuuucuggacuaugaaacaggagagaucuccuucuacaacgcgaccgauggcagccauaucuacaccuucccccacgccucuuuuuccgaaccucucuaucccgucuuccgcauucugacacuggagccuacggcucuuaccaucugccccauuccgaaggaaguggagagcucuccugaccccgaucucguuccugaccauucccuggagacaccccugaccccugggcucgccaaugaaagcggcgagccccaggcugaagugacaucccugcuucugccggcccacccuggagcggaggucucucccagcgccaccacgaaccaaaaucacaaacuccaggcuagaacagaagcccuguacuga

SEQ ID NO: 66568 - RNA, 1449 nt, Artificial Sequence
  derived and/or modified sequence opt5 from BTNL2__Homo_sapiens__NP_001291490
augguggacuuccccggcuacaaccugagcggggccgucgcuuccuuucucuucauccugcuuaccaugaagcagucugaggauuuuagaguuauuggaccugcccacccgauccuggcgggcgugggggaagacgcucuccugacaugccaacuucugcccaaacggacgaccaugcauguggagguccgcugguauagaagcgaaccuuccacacccguguucguucaccgggauggaguggaggucaccgaaaugcagauggaggaguaccgcggcuggguggaauggauugagaaugggaucgccaagggaaacguugcccucaaaauucauaauauccagccuucugacaacggccaguauuggugucacuuucaagauggcaauuacugcggggaaacaagccugcugcucaagguggcuggacugggcuccgcccccucuauccauauggaggggccuggagagagcggcguccagcuuguguguaccgcuagagggugguucccggaaccccagguguauugggaggacauucggggagaaaaacugcucgccgucuccgagcaccgcauccaggauaaggacggccuguuuuacgcggaagccacacuuguugugagaaacgcuagcgccgagucuguguccugccugguccacaauccugugcucaccgaggaaaagggcagcguuauuucucugcccgagaaacugcaaacggaacucgcuucccugaaggugaacgggccuagccagcccauccuuguccgggugggagaggauauucagcugaccuguuaucucucuccgaaagccaaugcgcaguccauggaaguucgcugggacagaagccaucgguacccugccgugcacgucuacauggauggcgaccauguggcuggggagcaaauggccgaguaucgcggaagaacaguccugguguccgaugcuaucgacgaaggccggcuuacccugcagauucucucugcccgccccagcgacgaugggcaguacagaugccuguucgagaaggacgauguuuaucaagaagccucccuggaccucaaaguggucagccugggaucuuccccucuuaucacaguggagggccaggaagauggcgagaugcagcccauguguagcucugacgggugguuuccccagccucacguuccguggcgggauauggagggaaagaccauccccagcuccucucaagcucugacgcagggcagccacggacucuuccaugugcagacacugcuuagagucaccaacauuuccgcgguggacgugacaugcagcaucucuauuccuuuucugggggaagagaagaucgccaccuucucccucagcgaaucucgcaugaccuuucuguggaaaacacugcucguuuggggccugcuucuggcugucgccguggggcucccccggaagagauccuga

SEQ ID NO: 66569 - RNA, 1740 nt, Artificial Sequence
  derived and/or modified sequence opt5 from BTRC__Homo_sapiens__NP_001243785
auggaccccgccgaggcugugcugcaggaaaaggcccucaaauucaugugcagcaugccuagaucccuguggcuuggcuguucuagccuggcggauuccaugccgucucuccggugccuguacaaccccgggaccggagcucuuacagccuuucaaacguauaauagcugugcccgccugugccucaaccaggagaccgucugucuggcuuccacagccaugaagaccgaaaauugcguugcuaaaacaaagcuggccaacggcaccucuagcaugaucgugccuaaacagagaaagcucuccgcgagcuacgagaaggaaaaagagcugugugugaaguauuucgagcaguggucugaauccgaccaagucgaguuuguggaacaccuuauuagccagaugugccauuaccagcacgggcauaucaauucuuaucugaaacccaugcuccagcgggauuucauuacagcccugccugcucgcggacuugaccacaucgccgagaacauucuguccuaccucgaugcuaagagccugugugccgcggagcugguuugcaaagaaugguauagagugaccucugacggcaugcucuggaagaagcugaucgagcggaugguccgcacggauucccuuuggagagggcuggccgaacggcgcggauggggccaauaccucuuuaaaaauaagcccccugacggcaacgcuccgcccaauagcuucuacagagcccuguauccuaaaaucauucaggauaucgagaccauugaauccaacuggcggugugggcgccauucucuucagagaauccacugccggagcgagacauccaagggaguguacugccugcaguaugacgaucagaaaauuguuagcggccuccgcgacaauaccaucaagauuugggauaaaaacacacuggaguguaagagaauccugaccgggcacacgggaucugugcucugccugcaauacgacgaacgggucaucauuacaggcuccagcgacucuaccgugagagugugggaugucaauacaggggagaugcuuaacacccugauccaucacugugaagcuguucuccaucugcgcuuuaauaacggaaugauggugaccugcagcaaggaccgguccauugccgugugggauauggccucucccacagacaucacgcuuagacgcguccuggugggccaccgggcugcgguuaacguggucgauuucgacgauaaauauauugugagcgccuccggcgacagaaccaucaagguuuggaauacaagcaccugugaguuugugcgcacacucaacgggcacaaacggggaaucgcuugccugcaguacagagaucgccuggucgugucuggcuccagcgacaauaccauucggcucugggauaucgaauguggggccugccugagaguccuugagggacaugaggaacuggugcgcuguauucgguucgacaacaagagaaucguuucuggcgccuaugacgggaaaauuaaggugugggaucucgucgcugcccuggacccucgggcgcccgcuggaacgcugugccuucgcacacucguggagcacuccggcagaguuuuucggcugcaauucgaugaauuucagaucgugagcuccucucaugacgauaccauccugauuugggacuuccucaaugauccggccgcccaggcugagccucccagaagcccuucccgcaccuacacauacaucucucgguga

SEQ ID NO: 66570 - RNA, 3153 nt, Artificial Sequence
  derived and/or modified sequence opt5 from BUB1B__Homo_sapiens__NP_001202
auggccgcugugaagaaagagggcggggcccugagcgaagcgaugucccucgagggagacgaaugggagcugucuaaggaaaacguccagccccuuagacaaggccggaucaugagcacccugcagggggcucucgcccaggaguccgccugcaauaacacacugcagcaacagaaacgcgcuuucgaguacgaaauuagauuuuauacgggaaaugauccucuugacguuugggaucgguacaucucuuggaccgagcagaacuauccgcagggcgggaaggaaagcaauauguccacacugcucgagcgcgccguggaggcucugcaaggagaaaagagauacuauucugacccccgguuccugaaccucuggcugaaacuuggccgccuguguaaugagccucucgauauguacagcuaucugcacaaccagggcauuggggugucccuugcccaguuuuacaucagcugggcggaagaguacgaagccagagagaauuuccggaaggcugacgccauuuuucaggagggaauccaacagaaagcugaaccccuggagcgccuccagucucaacauagacaguuccaggcccgggucucccgccagacccugcuggcgcucgaaaaggaggaagaggaggaaguguuugagagcucuguuccucaaagauccacacuggccgaacuuaaaagcaagggcaaaaagaccgcucgggcccccaucauucgcgucgggggagcucugaaggccccuucucagaacagaggccuccagaauccguucccccagcaaaugcagaacaauucccggaucacaguguuugaugagaacgccgacgaagcuagcaccgcggagcuguccaaaccuacggugcagcccuggauugccccucccaugccgagagcuaaggagaaugaacuucaggccgggccuuggaacaccggacgcucucuggagcaccggcccagaggcaacacagccagccucaucgcuguuccugccgugcugcccuccuucacccccuaugucgaagagacagcgcaacagccugugaugaccccgugcaaaauugagcccagcaucaaucauauucugucuacgcgcaagccuggcaaagaagagggggauccccuccagcgggugcagucccaccaacaggcuagcgaagagaagaaagaaaagaugauguacuguaaggagaaaaucuaugccggagucggcgaguuuucuuucgaagagaucagagccgaaguuuuucgcaagaaacugaaggagcagcgggaagcugagcuucugacaagcgccgagaaaagagcugaaaugcaaaagcagauugaggaaauggagaagaaacucaaggaaauccagaccacacagcaagagcgcaccggggaccagcaggaggaaaccaugccuacaaaagagacgaccaagcugcagauugccuccgaaucucaaaagauccccggaaugacacuuagcuccagcgugugccaggugaacuguugcgcgcgggagaccucucuggccgagaauauuuggcaggaacagccgcauuccaagggcccuagcguccccuucucuaucuucgaugaguuucuccuguccgaaaagaaaaacaagagcccucccgcugacccucccagagugcuggcccaacgccggccgcucgcuguucugaaaacauccgagucuaucaccagcaaugaagauguguccccugacgucugugacgaguucacggggauugagccccuuucugaagaugccaucauuacaggauuuagaaacgugaccaucugccccaauccugaggacaccugugauuucgcgcgggccgcucgcuuuguuagcacaccguuccacgaaauuaugucccugaaggaccuccccagcgauccugagagacugcugcccgaagaggaccuugaugugaaaaccucugaggaccagcagacagccugcggcacgaucuacucccaaacccucagcaucaagaagcugucuccuauuaucgaagauucccgggaggcuacacacagcucuggcuuuagcggguccagcgccucugucgccuccaccagcuccauuaaaugucugcagauccccgaaaagcucgagcugacaaacgaaaccucugagaauccuacgcagagccccuggugcucccaguauagacgccaacuucugaaaucucucccggagcugagcgcuuccgcggaacugugcauugaggaccggccuaugcccaaacuugaaaucgagaaagagauugaacucggaaacgaggauuacuguaucaagagagaauaucugaucugcgaggacuacaaacuguucuggguggccccucgcaauucugcugaacucaccgucauuaaggugagcucccagcccguuccgugggacuuuuacaucaaccugaaacuuaaggagagacugaaugaggauuucgaccauuuuuguagcugcuaucaguaccaggauggcuguauuguguggcaccaauauaucaacugcuucacacuccaggaccugcugcagcauucugaauacauuacccacgagaucacaguccuuaucauuuauaaucuccugaccaucguggaaaugcugcacaaggccgagauuguucauggggaucucuccccucggugucugauccuucgcaaccggauucacgaccccuacgauugcaacaaaaauaaccaggcccugaagaucguggacuuuagcuauucugucgaucucagagugcaacuggacguguucacgcuguccggauuccgcacaguucagauccuugaaggccagaaaauucucgcuaauuguagcucuccuuaccaggucgaucuguuugggaucgccgaccuggcgcaucuccugcuuuucaaggagcaucugcaaguguuuugggauggcuccuucuggaagcucagccagaacauuuccgagcugaaagacggagaacuguggaauaaguuuuucgugagaauccuuaacgcuaaugacgaggccaccgucagcgugcugggcgaacucgccgcugagaugaacgggguuuuugauacaaccuuccagucucaccugaauaaagcccucuggaaggugggaaaacugaccagccccggcgcgcuucuguuucaauga

SEQ ID NO: 66571 - RNA, 3198 nt, Artificial Sequence
  derived and/or modified sequence opt5 from BUB1__Homo_sapiens__NP_001265545
auggacacccccgagaacgugcugcaguacauccaaugggucgaagagaauuucccugaaaacaaggaguaucucauuacacugcuugaacaccugaugaaagaguuucucgauaagaaaaaguaccauaaugacccgagauucaucagcuauugccugaaauuugccgaguacaacuccgaucuucaccaguucuuugaguuccuguauaaucauggcauugggacgcucucuagcccccuguacaucgcuugggccggacaccuggaagcgcagggcgaacuccagcaugcuuccgccguucugcaacgggggauucagaaccaggccgagccucgcgaguuucuucagcaacaguauagacuguuccagacccggcucacagaaacccaucugcccgcucaggcccgcacaucugagccucuucacaaugugcaagugcugaaccagaugaucaccagcaaguccaaucccggaaacaauauggcuuguaucucuaagaaccagggcagcgaacucuccggggucauuagcucugccugcgacaaagaguccaauauggaaagacgggugaucacaauuagcaagucugaguacuccguucacagcucucuggcguccaaaguggaugucgagcaagugguuauguacuguaaggaaaaacugauccgcggagagagcgaauuuuccuucgaggaacucagagcccagaaguauaaccagcggcgcaagcacgagcagugggugaaugaggacagacauuacaugaaacggaaggaagcuaacgccuuugaggaacaacugcuuaaacagaagauggaugagcugcacaaaaagcuccaccaggucguggaaaccucucaugaggaccugccugcuagccaggagcgcuccgaagugaacccggccagaaugggccccagcgucggcucucaacaggagcuucgggcgccuugccugcccguuacguaucagcagaccccugugaauauggagaaaaacccccgcgaagccccgccuguggugcccccucucgcuaaugccauuuccgcugcccuggucagccccgccacaucucaaagcaucgcucccccuguuccgcugaaggcgcagaccgugacagauuccauguucgccgucgcuucuaaggacgccgggugugugaacaaaagcacccacgaguuuaagccccaguccggagccgaaauuaaagagggcugcgaaacgcauaagguugcuaauacaagcucuuuccacaccacaccuaacaccucccucgggauggugcaggccacccccagcaaaguccaaccuucucccacagugcauacgaaggaggcgcugggauucaucaugaauauguuucaggcuccgacccuuccugauaucuccgacgauaaggacgaauggcagagccuggaccaaaacgaggaugccuucgaggcccaguuucagaaaaaugucagauccucuggcgcuuggggagugaacaagauuaucagcucccucucuagcgccuuccacguuuuugaagacggaaauaaagagaacuacggccugccccagccuaagaauaaacccacaggcgcucggaccuucggggaaagauccgugagccgccuuccuucuaagcccaaggaggaagucccgcacgccgaggaguuucuggaugacuccacagugugggggauucgguguaacaaaacccucgcgccuagccccaagucucccggcgauuucacguccgccgcucaacuggccagcacaccuuuucauaaacugccgguugaaucugugcacauccucgaggacaaggaaaaugucguggcuaaacagugcacccaggccacccuggauagcugugaggaaaacauggugguucccuccagagacgggaaguucagcccuauucaggagaagucucccaaacaagcgcuuuccagccauauguauuccgccucucugcuccgccugagccagccugcugccggaggcguccugacaugcgaggcugaacuugggguggaggccugucggcucaccgauacagacgccgcuaucgcggaagaucccccugacgccaucgcuggacugcaggccgaguggaugcagauguccucucugggcacgguggacgcccccaacuuuauugucggcaauccgugggaugacaagcucaucuucaaacugcuuagcgggcuguccaagccugugucuagcuaccccaacaccuuugaguggcaaugcaaacucccugcuauuaagcccaaaacagaguuccagcugggauccaagcugguuuaugugcaccaccuucucggcgaaggggccuucgcgcaggucuacgaagcuacccaaggagaucugaaugacgccaagaacaaacagaaguuugugcugaaaguucagaagccggccaauccuugggaguucuacaucggcacacagcucauggaaagacugaaacccagcaugcaacauauguuuaugaaguucuauucugcucaccuuuuucagaacggguccgugcuggucggcgagcucuacagcuauggaacccugcugaaugccauuaaccuuuacaagaauacgccugagaaagugaugccccagggccucguuaucucuuucgcgaugcgcaugcuguauaugaucgaacaggugcaugauugcgagauuauccacggggacauuaagcccgauaacuuuauccugggaaauggcuuccucgaacaagacgaugaggacgaucuguccgcugggcuugcccugauugaccucggacagagcaucgauaugaaacuguuuccuaagggcaccauuuucacagccaaaugugaaaccucuggguuucagugcgucgagaugcuguccaacaagccguggaauuaccagaucgacuauuucggcguggcugccacaguguacuguaugcuuuuuggaaccuacaugaaggucaaaaacgagggcggggaaugcaagcccgagggacucuuccggagacugccucaucuggacauguggaaugaguucuuucacguuaugcucaacauccccgauugucaccaucugccuagccuugaccugcuccgccaaaaacugaagaaaguguuccagcagcacuauacgaacaagauucgggcucugagaaaucgccuuaucgugcugcuccuggaaugcaagcgguccagaaaauga

SEQ ID NO: 66572 - RNA, 981 nt, Artificial Sequence
  derived and/or modified sequence opt5 from BUB3__Homo_sapiens__NP_001007794
augaccggcagcaacgaguucaagcugaaucagcccccugaagacgggaucuccucugugaaauuuagcccgaacacaucccaauuccuccuggucucuagcugggauacguccguucggcuuuacgacgugcccgccaauucuaugcggcugaaguaucagcacaccggagcugugcucgauugcgccuuuuacgacccuacacaugcguggagcggcgggcuggaucaccagcuuaaaaugcaugaccugaacaccgaucaggagaaucucgucggaacacacgacgcucccauucgcuguguggaauauugcccugagguuaacgugauggucaccggcuccugggaucaaacagugaagcugugggaccccagaaccccuuguaaugccgggacguucagccagccggaaaaaguuuacacccugucuguguccggagaucggcucaucgucggcacagccggccgcagagugcuggugugggaccuucggaacaugggguauguccagcagcgcagagagagcucucugaaguaccaaacccggugcauucgcgcuuuucccaauaagcagggauauguucucuccagcaucgagggcagaguggccguggaauaccuggauccuucucccgagguccagaaaaagaaauacgcuuucaagugucaucggcuuaaagaaaacaauauugagcagaucuauccugugaacgccaucuccuuucacaauauucacaacacauucgcgaccgggggaagcgacggcuuuguuaauaucugggaccccuucaacaagaagcgccugugccaauuucauagauacccgacguccauugccucucucgcuuucagcaacgaugggacaacccuggccaucgcuuccagcuauauguacgagauggacgauacagaacacccugaggacggaauuuuuaucagacaggugaccgaugccgaaaccaaacccaagucuacauga

SEQ ID NO: 66573 - RNA, 1458 nt, Artificial Sequence
  derived and/or modified sequence opt5 from BUD13__Homo_sapiens__NP_001153208
auggccgcugcgcccccucugagcaaggccgaguaccucaaaagauaucuguccggcgcugacgccgggguggaucggggaucugaaagcggccgcaagagacggaaaaagcgcccgaaacccgggggagccggcgggaagggaaugagaaucgucgacgaugacguuuccuggaccgcuauuucuacaacgaaacuugagaaggaagaggaagaggaugacggcgaucugccugugguggccgaguucgucgacgaacggcccgaggaagugaagcagauggaggcuuuucgcagcuccgccaaauggaagcuccugggcgggcacaacgaggaucuuccuucuaauagacauuuccggcacgacacccccgauagcuccccucgcagaguucggcauggaacaccggaccccagcccucgcaaagauagacacgacacccccgacccuucuccccggcgcgcgagacaugauacaccggacccuagcccccugcggggcgccagacacgauuccgacaccucuccuccccgccggaucagacacgauuccagcgacacaucucccccucgccgggcuagacaugauuccccggaccccagcccuccccgccggccucaacacaacuccucuggggauugccagaaggccaccgacagcgaucucuccagccccagacauaagcagucuccgggacaccaggacuccgacagcgaucugucuccuccccgcaaucggccuagacaccgcagcuccgacucugaucugagcccuccccggagacggcaacgcacgaaauccagcgacucugaucucuccccgcccagacggagccagccucccggcaagaaagcugcccauauguacucuggggcgaagaccggacuggugcuuacagacauucagagagaacagcaagagcugaaagaacaggaucaggagaccauggccuuugaagcugaguuccaguaugccgagacagucuuucgcgacaaguccggccggaaaagaaaccucaagcuggaacgccuugagcaaagacggaaggcugaaaaagauagcgagcgcgacgaacuguacgcccaguggggcaaggggcucgcccaguccagacaacagcagcagaauguggaggaugcuaugaaagagaugcaaaagccccuggcgcgguauaucgacgaugaagaccuggaccgcaugcucagagagcaggaacgggagggagauccuauggccaacuucauuaaaaagaauaaggcuaaagaaaacaagaauaaaaagguucgcccgagauacucuggccccgccccucccccuaaccgguuuaauaucuggcccggguaucgcugggacggaguggauagaagcaacggcuucgagcagaaacgguuugccagacuggcuuccaagaaggccgucgaggaacuugcguacaaauggucuguggaggacauguga

SEQ ID NO: 66574 - RNA, 435 nt, Artificial Sequence
  derived and/or modified sequence opt5 from BUD31__Homo_sapiens__NP_003901
augcccaaggugaaaagaagccggaaggccccuccggacggcugggagcugaucgaacccacccucgaugagcuggaccagaaaaugcgcgaagcugagacagaaccucacgaggggaagagaaaagucgagucccuuuggcccauuuuccggauccaucaccaaaagacgcgcuacauuuuugaucuguucuauaagagaaaagccaucucucgggaacucuacgaguauugcauuaaggaaggauacgcggacaaaaaccugaucgcuaaguggaaaaagcagggcuaugagaaucuuuguugccugcgcuguauccagaccagagauacaaacuuugggaccaauugcauuugucggguuccuaagagcaaacucgaggugggacgcaucauugaaugcacacauuguggcugcagaggguguuccggauga

SEQ ID NO: 66575 - RNA, 1083 nt, Artificial Sequence
  derived and/or modified sequence opt5 from BVES__Homo_sapiens__XP_011533700
augaacuacaccgagagcucuccccugagagaauccacagccaucggcuucacgccugagcucgaaagcauuaucccggugcccuccaauaagaccacaugcgagaacuggcgggaaauucaccaucuggucuuucacguugcuaauaucuguuucgccguggggcuugugauuccuaccacacugcaucuccacaugaucuuucugcgcggaaugcuuacccugggcugcacacucuauaucgucugggcgacccuguacagaugugcucuggacauuaugaucuggaacucuguguuccucgggguuaauauucugcaucuuagcuaucugcucuacaaaaagcggcccgugaaaaucgagaaggagcuguccggaauguaucgcagacuuuuugaaccucugcgggugcccccugaucucuuccgcagacugacgggccaguuuugcaugauucaaacccugaaaaaggggcagacauacgccgccgaggacaagaccucugucgaugaccggcucagcauccugcuuaaaggaaagaugaaaguuuccuaucgcggccacuuccugcacaacauuuacccgugugcuuuuaucgauagccccgaguucagaucuacacagaugcauaagggcgaaaaauuucaggugaccaucauugccgacgauaauugccgguuccucuguuggucccgcgagagacugacguacuuucuugaaagcgagccuuuccuguaugaaaucuuccgguaccucauugggaaggacaucacaaacaagcuguauucucugaaugaucccacccucaacgacaaaaaggcuaaaaagcuggagcaccaacuuucccugugcacacagauuagcaugcucgaaaugcgcaauucuaucgccuccagcuccgauucugacgauggacugcaucaguuucuuagaggcaccagcuccaugagcucucugcacgucuccagcccucaccagcgggcgucugccaaaaugaagcccaucgaggagggggcugaagacgacgaugacguguucgagccggccagcccuaacacccucaaagugcaucaacugcccuga

SEQ ID NO: 66576 - RNA, 1314 nt, Artificial Sequence
  derived and/or modified sequence opt5 from BYSL__Homo_sapiens__NP_004044
augcccaaguucaaagccgcuagaggcgucgggggacaggagaagcacgccccucuggcggaccaaauccucgcuggcaacgccgugcgggccgggguucgcgagaaaagacggggacgcggcaccggggaagcugaagaggaauacgugggaccgagacugagccggcgcauucuucagcaggccagacagcaacaggaggagcuggaagcugagcauggcacaggcgauaagcccgccgcgccucgggaacgcacgaccagacucgggccccggaugccucaggacggauccgaugacgaggaugaggaauggcccacacuggagaaagccgcuaccaugacagccgcuggccaccaugccgaaguggucguggacccugaggaugaacgcgcgaucgagauguuuaugaauaagaacccgcccgccagacggacccuugcugacauuaucauggagaagcugacagaaaaacagaccgagguugaaacggugaugucugaggucagcggguucccuaugccccaacucgauccucgcgugcuggaaguuuauagaggagugcgggagguccuguccaaguacagaucuggcaaacuccccaaggccuuuaaaauuaucccggcucugagcaauugggagcagauccuuuaugugaccgaaccugaggccuggacagccgcugcgauguaccaggccacccgcauuuucgcuuccaaccugaaggaacggauggcccagagauuuuauaaucucgugcugcuuccccgcguccgggacgauguugccgaguacaagagacugaacuuccaccucuauauggcucugaaaaaggcccuguuuaaaccuggggcgugguucaagggaauccucauuccccugugcgaaucuggcacauguacccuucgcgaggcuaucauugugggcagcaucauuacgaaaugcuccauccccgugcugcauagcucugccgccaugcucaagaucgcugagauggaauacuccggggccaauagcauuuuucugcggcuucugcucgacaaaaaguacgcucugccuuauagaguccuggaugcccucguguuccacuuucugggauuccgcacagagaagcgggaacuuccgguucuguggcaccaaugucuccugacccuugugcagagauacaaagcggaccuggccacagaccagaaggaggcucuccuggagcugcuccgccugcaaccccauccucagcuuucucccgaaauccggagagagcugcaguccgccgucccucgggauguggaagacguucccauuaccguggaguga

SEQ ID NO: 66577 - RNA, 5547 nt, Artificial Sequence
  derived and/or modified sequence opt5 from BZRAP1__Homo_sapiens__NP_001248764
auggagcagcugaccacacuccccagaccuggcgaccccggggcuauggaacccugggcucugccuacguggcacagcuggacccccggacggggcggggagccuuccucugccgcccccagcaucgcugacacaccucccgccgcccuucaacugcaggaacuccgcuccgaggaaucuagcaagcccaaaggagacggcuccucuagaccugucggcgggaccgaucccgagggggcugaggccugccugccuagccuuggccagcaggcuuccagcucugggcccgccugccaacggccggaagacgaggaaguggaggccuuccugaaggccaaacucaacauguccuuuggagaucgcccuaaucuggagcugcucagagcucugggcgaacuucggcagcgcugcgccauucugaaggaggaaaaccagaugcucagaaaaagcucuuuccccgagacagaagagaagguucggcgccugaagcgcaaaaaugcugagcuugccgugaucgcgaagcggcuggaggaaagagccagaaaacuccaggaaaccaaccugcggguggucuccgcuccucugccccgccccgggacaagccucgagcuguguagaaaggcccuugcucggcaaagagcccgcgaccugucugaaaccgccuccgcucuccuggcgaaagauaagcagauugccgcccuucagcgggagugcagagagcugcaggcccgccucacgcuggugggaaaggaaggcccucaauggcugcauguucgggacuuugauagacuccugcgcgagagccagcgggaagugcuuagacugcagcgccaaaucgcccuccggaaucagagagagacccugccgcuucccccuuccuggcccccugggcccgcucugcaggcccgcgcgggagcuccggccccuggcgcccccggcgaagcuacaccucaggaggacgccgauaaccuccccgucauucugggggagccugaaaaagagcaacgggugcagcagcuggaaucugagcucagcaagaaaagaaagaaaugugagucccuggaacaggaggcucggaagaaacaacgcagaugcgaggaacuugaacugcagcuccggcaggcccagaaugagaacgcgagacugguugaggaaaauagccgccugucuggacgggccaccgagaaggaacaaguggagugggaaaacgcugagcuuagaggccagcuccugggggucacacaggagcgcgacuccgcccugagaaagagccagggacuccaaucuaaacuggaaagccuugaacaggugcugaagcacaugcgggaaguggcucagcgcagacaacagcucgaggucgaacaugagcaggcccggcugucccugcgcgagaaacaggaagagguuagacggcuucaacaggcgcaggccgaagcucagcgcgagcacgagggcgccgugcaacuccuggaaucuacccuggauagcaugcaggcuagagugcgggagcucgaggagcagugucgcucccagacggaacaauucagccugcuugcccaggagcugcaggccuuuagacuccaucccgggccgcuggaccugcuuacaucugcucucgacugcggaucccugggcgauuguccuccgcccccuugcuguugcagcaucccgcaacccugccggggcucugggccuaaggaccuggaucugcccccuggaucccccggcagauguaccccuaaaagcuccgagcccgcgccggccacacugaccggggucccucgccggaccgcuaagaaggccgaaucucuuagcaauuccucucacagcgaguccauccacaacagccccaaaucuugcccuacacccgaaguggacacggccuccgagguugaagaacucgaggcugauagcgugucucuccugccggccgcgccugaaggauccagaggcggggcucgcauucaggucuuccuggcccgguacagcuauaaucccuuugagggcccuaacgaaaaucccgaggccgaacuuccccucaccgcuggagaguacaucuauauuuacggcaacauggacgaggauggguucuuugaaggagagcugauggacggcagacgcgggcuggugccuucuaacuucguugaacgggugagcgaugacgaucuccugacaucccuuccgcccgagcuggccgaccucagccauucuuccggaccugagcugagcuuucuguccgucggcgggggcggaucuagcuccggcgggcagucuagcgugggaagaucccagccccgcccugaagaggaagacgcgggcgaugagcuuucucugagccccuccccugaagggcucggagagccgcccgcugucccuuauccccggagacuggugguucucaagcaacuggcccacagcgugguccuugccugggagccucccccggaacagguggagcugcauggcuuccacaucuguguuaauggggaacuccggcaggcucugggcccuggagcgccgcccaaagcugugcuggagaaccuugaccugugggccggcccucuccacauuucuguccaggcgcugaccucccgcgggagcucugauccccucagaugcugucuggccgugggagcucgggccggcgugguuccuucccaacuucgcguccauagacugacagcuaccagcgccgaaaucacgugggugccgggaaauucuaaccucgcccacgcuauuuaccugaauggagaggagugucccccugcgucccccagcacauauugggccaccuuuugucaucugcggccuggcacccccuaccaggcucagguggaagcccagcuuccgccucaagggcccugggagccuggcugggaaagacuggagcagcgcgccgcuacacuccaguucaccacacugcccgccggaccucccgacgcgccgcucgauguccagaucgaaccuggccccucccccgggauccugauuaucagcuggcuuccugugacgauugacgcugccggaaccucuaacggcguucgggugacaggguacgccaucuaugcugauggacaaaagauuauggaggucgccagcccgaccgcgggcuccgugcugguugagcugucucagcuccagcugcuucaagugugcagagaagucgugguucgcacaaugagcccccacggcgaguccgcugacucuaucccugcccccaucaccccugcccuggcucccgccagccucccugcucggguguccuguccgucuccccauccuagccccgaagccagagcgccucuggccuccgcuagccccgggccgggagauccuucuagcccccuccagcaccccgccccucugggcacgcaggagcccccuggggcuccgcccgccagcccuucucgcgagauggccaaaggaucccacgaagaucccccugcucccugcagccaggaggaagcgggcgccgcuguccuugggaccuccgaggaacggacagccucuaccagcacacugggagagaaggauccgggcccugccgcucccucccuggccaagcaagaggcggaauggaccgcuggcgaggccuguccugccuccucuuccacgcagggggcuagagcccagcaggcgcccaauacagaaaugugccaaggaggcgacccugggagcggacuccgccccagagccgagaaagaagauaccgcugagcugggcgugcaucuugugaacucucuggucgaccacgggcggaauagcgaccucuccgauauucaggaggaagaggaagaggaagaggaggaagaggaagaggagcugggaucucgcacaugcagcuuccagaagcagguugccggcaacuccaucagagaaaauggcgcuaaaucucaaccggacccuuuuugugagaccgauagcgacgaagagauucucgaacagauccuggagcuuccccugcagcaauucugcuccaagaaacuguuuagcauucccgaggaagaggaagaggaagaggaggaugaagaggaagagaagucuggggccggauguuccagccgggacccuggcccgcccgaaccugcucuccuggggcuuggaugcgauuccggccagccccgcagaccugggcaguguccccugucuccugagagcucccgggccggagacugccucgaggauaugcccggccuggugggcgggucuagcagacgccggggaggcggguccccggaaaagccucccagcagacgccggccucccgacccgagagagcauuguucucggcuccuguccaacaauggaccucaggcgagcggccgccuugggcccaccagagaacggggaggccugcccgugaucgagggcccucgcacagggcuggaggccucuggaagaggccggcucgggcccucccgcagaugcagccggggacgcgcucuggaaccuggccuugccucuugucugagcccgaaaugccucgagaucuccauugaauacgauucugaggacgaacaagaggcugggagcggaggcaucuccauuacgagcuccuguuaucccggcgauggggaggccuggggaaccgccacagucggcagaccucgggggcccccuaaggcuaacucuggacccaaaccuuacccgagacugcccgcgugggaaaagggcgagccugaacgccgggggagaagcgccaccggacgcgcuaaagagccccugucccgggccacagaaaccggcgaggccagaggccaggacgggucuggacgccggggcccucagaagagaggggugcgcguucuccggcccagcacggcugagcuugugccggccagauccccuucugaaacacuggcguaucagcaucugcccguccgcaucuucguggcccucuuugacuacgaucccguuagcauguccccuaaucccgacgcuggagaggaggagcugccuuuccgggaaggccaaauucuuaaaguguuuggggauaaggacgccgauggcuucuaucagggagagggcgggggaagaaccggcuacaucccgugcaacauggucgcugagguggccguugacagccccgcggggcgccagcagcugcuccaaagaggauaccugucuccugauauucugcucgaaggcuccgcccacaccacagggcccccucccaagccgcggcgcagcaaaaaggcugagucugaaggcccugcccagcccugcccuggacccccgaaacuugugccuuccgcugaccugaaggcgccccacagcauggucgcugccuuugauuauaacccccaggagucuuccccuaauauggacguggaggcggaacugcccuucagagccggcgaugugaucaccgucuuugggggaauggacgacgauggcuucuacuauggggagcucaacggacagcggggccugguuccuagcaauuuucuugaagggccgggccccgaggcuggaggccuggacagagaaccucggacaccccaagccgagucccagcgcacgagacggcgcagagugcaguguuga

SEQ ID NO: 66578 - RNA, 1260 nt, Artificial Sequence
  derived and/or modified sequence opt5 from BZW1__Homo_sapiens__NP_001193996
augaacaaucagaagcaacagaaacccacccugagcggccagagauucaagacacggaaacgcgacgagaaggaaagauuugauccuacgcaguuccaagacugcaucauucaggggcucaccgagacaggaaccgaucuggaagccguggcuaaauuucuugacgccuccggcgcgaagcuggauuaccggcgcuaugcugagacacucuucgacauccuggucgccgggggaaugcuugccccgggcgggacccuggcugaugacaugaugagaacagauguuuguguguuugccgcucaggaagaccucgagaccaugcaggccuucgcgcaaguguuuaacaagcugauucggcgcuacaaauaucuggagaagggauucgaagaugaggucaaaaagcuccugcuuuuucugaaaggcuucucugaaagcgagagaaauaagcucgccaugcugacgggcgugcuucuggcuaacgggacccucaaugccuccauccugaacucucuguacaaugagaaccucguuaaggaaggagugagcgcugccuuugcggucaaacuguucaaguccuggauuaaugagaaagacaucaacgccguggcugccucucuucggaagguuagcauggauaaucgccugauggaacucuuucccgcuaacaaacaguccguggagcacuucacaaaguauuucaccgaagccggccugaaagagcuuagcgaguacgucagaaaucagcagacaaucggggcccggaaggaacugcaaaaggagcuccaggaacagaugucucgcggagacccuuuuaaagacauuauccuguaugugaaggaggaaaugaaaaagaacaauauucccgagccuguggucaucggcauuguuugguccagcgugaugucuaccguggaguggaacaaaaaggaggaacuggucgcugaacaagcgaucaagcaucucaaacaguacagcccccugcuugccgcuuucacgacacaggggcaguccgagcugacccuccugcuuaagauucaagaauacugcuaugauaacauccacuuuaugaaagccuuccagaagaucgugguucuguuuuacaaagccgaggugcucucugaggaaccuauucugaagugguauaaggacgcucaugucgccaaaggaaaguccguguuccuggagcagaugaaaaaguuuguugaauggcucaaaaaugcggaggaggaaagcgaguccgaagcugaggaaggcgauuga

SEQ ID NO: 66579 - RNA, 627 nt, Artificial Sequence
  derived and/or modified sequence opt5 from C10orf107__Homo_sapiens__XP_005269657
auggacuucagcaucauucaguacuccaaguuuaugacccugcucgccaugucucugcaaaaccuuaaaacacugcacaugagccucgaggaauccaucaaguggcugggcgaggugauggcugaaauugggcccacgcauucucagaaaagcgaggauuggaauaucuucgacgucaagcaggccaacgcgauuaucgauuaucuuaaaaucucccuguuucagcacuacaagcucuaugaguucauguuuuacucugcuagagaagagauuguuaucggaaccgaacaagugauugagguggucaagagcgccugcggcccuuucccgaauccccuggaagaggggaucuccuuugacauuuauagcacauucaucgagccucccaccauucuggauacagaaaugaaacggcucgaccaggagcagggaccugaagagucucagcccgaaaccgauacauccgacauggauccucuggugggcuuuaccaucgaggacguuaagagcgugcuugaucaagucacggacgauauccugauugggauccagaccgagauuaacgaaaaacuccagauccaggaggaagccuucaaugcucgcauugagaagcugaaaaaggccuga

SEQ ID NO: 66580 - RNA, 639 nt, Artificial Sequence
  derived and/or modified sequence opt5 from C10orf10__Homo_sapiens__NP_008952
augagaagccggcugcuccuguccguggcccaccuucccaccauccgcgagacaacggaagagaugcugcucggcgggccuggacaggaaccgcccccuucucccagccuggacgauuacgucagauccauuucucggcuugcucaaccuaccagcguucuggacaaggccacagcgcagggccagccccgcccuccgcauagacccgcucaggccugccggaaagggcgcccugccgugucccucagagauaucaccgcucgguucucuggacaacagcccacacugccuauggccgacaccguggauccccuggacuggcucuuuggcgagagccaggaaaagcagccgucccaacgcgaucugccuagacggacagggcccagcgcuggacuuuggggcccucaccgccagauggacucuuccaaacccaugggcgcccccagagggcggcugugugaggcgcgcaugccuggacauagccucgccagaccgccccaggauggccagcaaucuuccgaccugcggagcuggaccuucgggcagucugcucaggccauggcuuccagacaccgcccucggcccagcuccguccuuagaacgcuguauucucaucucccugugauucacgagcuguga

SEQ ID NO: 66581 - RNA, 468 nt, Artificial Sequence
  derived and/or modified sequence opt5 from C10orf113__Homo_sapiens__NP_001010896
auggccaagagcgagagacggaucuacuccauggaaucuauggcucccgagauuagcgaagacaucggcugcccucuggccuauaugcgcgaguccgugugugcgcuccugauuaaccagucuuucuuuagcugcgucgcugaaauguacaucccggauaugaauagacccgggaaagccgagcggcgcgccgagaagggacuuagaccuccccggaaacugguuggcgaaacccgcagacuccaauccuggccuacacuggcucgguggcuucgcagagugucuuucagccuguauaagcccccuauucaggccgcuccggagcccgacccugggaacugggccaaaagcccccggcucucccugggaccugaaggcaucacgaaggggaagcacggauuuaaauuccagggcaucaaggagaaauuuaaugugucuaagaaaguccugaagaugaccuuccucuga

SEQ ID NO: 66582 - RNA, 597 nt, Artificial Sequence
  derived and/or modified sequence opt5 from C10orf11__Homo_sapiens__NP_114413
auggagaaguaccugagccucuccggcaaccacucuagcaauaaaagaucccuggaagggcuuucugccuuccggagccuggaggaacucauccuggacaacaaucagcuuggagaugaccuggugcuccccggccugccucgccugcauacccucacacugaacaagaauagaauuacggaucuugagaaccugcucgaccaccuggcugaagucaccccggcccuugaguaucugucccuccuggggaauguugcgugccccaacgagcuggugucucucgaaaaagaugaggaagacuacaagcgguaucgcuguuuugugcuguacaaacuuccuaaucugaaguuccucgaugcucaaaaggucacaagacaggagcgggaggaagcccuggugcgcggaguuuuuaugaaaguggucaagcccaaagccagcuccgaggacguggcuagcucuccugaaagacauuauacaccccuuccuuccgccagccgggagcugaccucucaccagggcguucucgggaagugccgcuacguguauuacggcaaaaacuccgaaggaaauagauucauccgggaugaccagcuguga

SEQ ID NO: 66583 - RNA, 1749 nt, Artificial Sequence
  derived and/or modified sequence opt5 from C10orf2__Homo_sapiens__NP_001157284
augugggugcugcucagaagcggcuacccccugcggauccuucugccucuccgcggggaguggaugggaagacggggccugccgcgcaaccuugcccccgggccucccagacggcgcuauagaaaggaaacccugcaggcucucgacaugccuguccugcccguuacagccacggagauucggcaauaccugcgcggacacggcaucccuuuccaggaugggcauuccugccucagagcgcugucuccguuugcugaaagcucccagcuuaaaggacagaccggcgugacaaccucuuucagccuguuuauugacaagacaaccggccacuuccucuguaugacaucccuggccgaggggucuugggaagauuuucaagccagcguggagggacggggcgacggggcucgcgagggauuccuucuguccaaagcccccgaauuugaggauagcgaagaggucagacggaucuggaaucgcgcuauuccucucugggagcugcccgaccaggaagaggugcagcuggccgauaccauguucggccucacgaagguuaccgacgauacacugaaaagauuuucugugcgguaucuuagaccugcgcgcucccuggucuuccccugguuuagcccugggggaucuggccuccggggccugaagcugcuugaagccaagugccagggggacggaguguccuacgaggaaaccacaaucccgagacccagcgcuuaucauaaccucuucggccugccucugaucucucgccgggaugccgagguugugcucaccuccagagagcuggacagccuugcucugaaucaauccacggggcuccccacacugacccuuccccgcggaacaaccugucugccuccggcccuccugcccuaccuggaacaguuucggagaauugucuucuggcucggcgaugaccugcgcucuugggaggcggccaaacuuuucgcucggaagcugaacccuaaaagaugcuuucucgugcgccccggggaccagcagccucggccccuggaagcccugaauggaggcuucaaccuuagcagaauccuccggaccgcucugccggccuggcacaaguccauugugagcuuucgccaacugagagaggaaguccucggcgagcugucuaauguugagcaggccgcugggcuucggugguccagauucccugaucugaaccgcauccucaaaggacaucggaagggcgaacugacaguguuuacggggcccaccggaagcggcaagacaaccuucauuucugaguaugcgcuggaccuuuguagccagggggugaauacacucuggggcuccuuugaaaucucuaacgucagacuggcccgcgugaugcugacccaauucgcugagggaagacucgaagaucagcuggacaaauacgaucacugggccgaccgguuugaggaucuuccucuguacuucaugacguuucacggccagcagagcauucgcacaguuaucgacaccaugcaacaugccguguaugucuacgauaucugccacgugauuaucgacaaucuccaguucaugauggggcaugagcagcuguccaccgauagaauugcugcccaggacuauaucauuggaguuuuucggaaguucgcgacagacaacaauugucacgugacccuggucauccacccccgcaaagaagaugacgauaaggagcuucaaacagcuagcaucuucggcucugccaaaguguccgggcucuga

SEQ ID NO: 66584 - RNA, 321 nt, Artificial Sequence
  derived and/or modified sequence opt5 from C10orf32__Homo_sapiens__NP_001129672
augauggccaccggcacacccgagagccaggcuagauucgggcaauccgugaagggacugcucacggaaaaagucaccacaugcggcaccgacguuaucgcccugacaaaacaggugcuuaaggggucucggagcuccgagcugcucggacaggcggcucgcaacauggugcugcaggaagaugccauucuucacucugaggacagccugagaaagauggccaucauuaccacacaucuccaauaccagcaggaagcuauccagaaaaaugucgagcaauccucugaucugcaggaccagcugaaccaccuccugaaguga

SEQ ID NO: 66585 - RNA, 366 nt, Artificial Sequence
  derived and/or modified sequence opt5 from C10orf35__Homo_sapiens__NP_660349
auggugagaauccuggccaacggcgagauuguccaggacgaugacccccggguucgcaccacaacgcaaccuccgagagggagcaucccccggcaguccuucuuuaaucgcggacacggcgcuccucccgggggaccuggccccagacagcagcaagccggggcgcggcucggagcugcccagucuccuuucaacgaucugaaucgccagcuugugaacaugggcuuuccgcaguggcaucugggcaaucacgccguggaacccgucaccagcauucuccugcuuuuccugcucaugaugcugggggugagaggacugcuccugguuggccuuguguaccuggucucccaucucucucaacgguga

SEQ ID NO: 66586 - RNA, 936 nt, Artificial Sequence
  derived and/or modified sequence opt5 from C10orf54__Homo_sapiens__NP_071436
augggcgugcccaccgcccuggaggcugggagcuggagauggggaucccuccuguucgcccuuuuucuggcggcuucucucggcccugucgccgccuucaagguugcuacaccguacagccuguaugugugccccgaagggcagaacgugacgcuuaccugucggcugcucggaccugucgacaaaggccacgaugugacauuuuacaagaccugguaucgcuccucuagaggggagguucaaacaugcagcgaacggcgccccaucagaaaucugaccuuccaggaccugcaucuccaccauggaggccaccaggccgcuaacacaucccaugaucuggcccagcggcacggccuugagucugcgagcgaccaccaugggaauuuuuccauuaccaugcgcaaccugacgcuccuggauagcggacuuuacuguugccugguggucgaaaucagacaccaucacucugagcaccgggugcauggcgccauggagcuccaaguucagaccgggaaagacgcuccuuccaauuguguggucuaucccagcagcucccaggauagcgaaaacauuacagccgcugcccuggcgaccggagccugcaucgugggcauucugugucucccucugauccuucugcucguguacaagcagcgccaagcugccucuaauagacgggcucaggagcugguccgcauggacuccaacauccaggggauugaaaauccgggauucgaggccucucccccugcccagggcauccccgaggcuaaaguuagacacccucuuuccuauguggcgcaacggcagcccucugaaagcggccgccaucugcucuccgagccgagcacaccucugucucccccugggcccggagauguguuuuuccccucccuggacccugucccggauagccccaacuuugaagugauuuga

SEQ ID NO: 66587 - RNA, 558 nt, Artificial Sequence
  derived and/or modified sequence opt5 from C10orf67__Homo_sapiens__NP_714925
augauggcccuggugagagaccggcgcgcucacuacgucaugagcaucguuauuagaugggugcauugcuucuccucuagccuccggggcaccuuugggacacgcugggaggccaugaaggcgaaagcuacggaacugagaguguguugcgcccggcgcaagagagaggcccgggaguucaaacccccucagaugcgcggauccaccagacuuaacaucucugaugaccugaagauuggcuuuuucagcacagaucacgcuacccaaacagacuccucugaaauccucagcgucaaagaacuguccagcucuacccagaagcuggcccagaugaugaagucccuucagguggauuuuggguuccucaaacaacugcugcagcucaaguuugaggaccggcugaaagaggaaagccuuucucuguucacaauucuccaugaucgcauccuggagaucgaaaagcacuaucagcagaaugaggacaaaaugagaaaguccuuuaaccaacagcuugcugaugccauugcgguuaucaagggaauguaccagccgcuguga

SEQ ID NO: 66588 - RNA, 465 nt, Artificial Sequence
  derived and/or modified sequence opt5 from C10orf82__Homo_sapiens__NP_653262
auggagcccagcaagaccuucaugagaaaccugccuaucacaccgggcuacuccggguuugugcccuuccucucuugccagggaaugagcaaagaagacgauaugaaucacugugucaagacguuucaagagaaaacccagcgguauaaggaacagcugcgcgagcuuugcugugccguugcuacagccccuaaacugaagcccgugaacuccgaagagaccgugcuccaggcgcugcaucaauacaaucuucaguaucacccucugauucucgagugcaaguacgucaaaaagccccugcaggaaccuccgauccccggcugggcuggguaucugccuagagccaaagugacagaguucggauguggcacccgguacacaguuauggccaagaacugcuauaaagacuuucucgaaauuaccgagcgcgcuaagaaggcccaucugaaacccuacgaggaauga

SEQ ID NO: 66589 - RNA, 1338 nt, Artificial Sequence
  derived and/or modified sequence opt5 from C10orf88__Homo_sapiens__NP_079218
auggagaccagaacagaagacggcgggcugacgcggcgccccacccucgccagcuccugggauguggcuggaggcgcccugacacacucucuucugcucaccagagcggggcugggaccuggcgacuucgauugggaggaacuucuggcuccgcccgccccugggcaggaccucgucauccugaagcggaaccauaauaacaaagaugagaaucccugcuuucuguaccuccgcuguggaccugacggcggcgaagagauugccagcaucgggauucuguccucugcuagaaacauggagguuuaucuuggagaagaguacugcggcacaagccgggggaagaauguguguaccgugcuggaugacuccgaacacgagaaaaucauucucuauaagaaaaaccugaagcuggagucuagcacacaugccugcaagaucaaacugcucuccuucggagaacgccaaugugucuuuaucagcaaggugguugugcacaugagaucugucuucgcuaauuccagcaccucuucccccgcccugggcagccggauugaucuggacaaagugcagacgaucauggagucuaugggguccaagcucagcccuggagcgcagcagcugauggauaugguucgcugccaacagagaaacuguauuccgaucggcgaacagcuucaguccgugcugggcaauucuggguacaaacauaugauuggacuccaaagcuccagcacccugggcacacuuaacaagucuuccagcacccccuuuccuuuccggacagggcugaccucuggaaaugucacggagaaccuccagacauauaucgacaagagcacccagcugcccggcggggaaaauuccacaaaacuggaugagugcaaggugaugccucagaaccacucuuuucucgagaaugaccugaaaaacgccauggcuagcuuccuucccaagaaaguguccgacaacagcaauauuccgaacucugaacugcucccuuuucugcaaaaucuuuguucccaggucaaccaccuucauguuggaaauaagaccgagugccaggaaaacaucaccaaacacggcgagcgcauccucggcguggggauggaggaacaaagcauuuguucuuaccuggagaagauccuguccaagaauauggaacucauggagaaaaagcugauggauuauauugaccagagaauccaugaacuucaggagcacauugaugacaaaaucgcccugcuccuggaucugcuucagaaccccaauagcccucccacaggaaucccccuccggcacuacgacuccggcgaacgccugucuaacggggagagauga

SEQ ID NO: 66590 - RNA, 2100 nt, Artificial Sequence
  derived and/or modified sequence opt5 from C10orf90__Homo_sapiens__NP_001004298
augcugaagcucagcggcgaggggcugagagacuccuaccacucucggcgcgaucagaucgcccuuaaaaaccugcaaagcgacgugaccgaagcuaaguccgauuucacaaaagagacgcucgccucucagaauaccaagaugauuagcuccaucgucauuucucagaugaucgacgaaaacaaaagcagagagaaucgggcgucccugccccuuccuugcgcuauugcccagagccgcgcccaucacgcuaagcaaucucuggccaacagauccggaguuaauauccaucgggcuuuugcccuccugccgggccgccuggggauccccgcgccuagcgaugaaagaggacccgaggccgagcucccucccaaggaggaacggccuuguggcgggccgcgcagaggauucgcuucuauuacaaucaccgcccggcgcgugggcccuccugcuagagcccugguguggggcacagcgggggacucccuuugccccaaaugucgggccgaagauacccuguuucaggcuccucccgcccucgcuaacggagcccacccgggccgccaucagcggagcuucgccugcacagaguuuucuagaaauuccagcgucgugagacugaagguuccugaggcucacaccgggcuuugugaacgccggaaauauugggugacgcacgcggacgauaaggagaccuccuucucucccgacacaccucugagcggaaaaagcccccucgucuuuuccucuugcgugcaucugagaguuucccagcaaugucccgauagcauuuacuauguggacaagucucugagcgucccuaucgaaccgccccagauugccuccccuaagaugcaccgcucugugcucagccugaaccuuaauugcuccagccaucggcugaccgcugauggcguggacgggcucgucaacagagagcccaucucugaagcccugaaacaggagcuucuggagggagaccaggaucucguuggccaacgcuggaauccuggccugcaggaaucccaccugaaggagacacccagccuccggagagugcaccuggggaccggagccuguccguggucuggcuccuucccucuugaaaacacggagcuggcuaaugugggggccaaccaggucacagugcgcaaaggagaaaaggaccauaccacacacugccaugcgagcgaucacgcuaaucaacucuccauucauauccccggcuggucuuaccgggccguucacaccaaaguguuuagcggguccucuaagagacagcagggagaggucuguaugaccgugagcgccccucccguugagcagaaaccuacacgccacuuccugcccaucggcgacuccagcccgucugaugacugccuuucccgggaucugagcgaaccuacggagagacggcaucaaucuuuucucaagccccgcauucuguuccccggcuuucugugcccucuccaggacgugugugcuucccugcaggaagauaacgggguccagaucgagagcaaguucccgaaaggagacuauaccugcugugaucuuguggucaagauuaaagaaugcaagaaaucugaggaccccacaaccccugagcccagcccugccgcucccuccccugcccccagagacggcgcggggagcccgggacugucugaagauuguuccgagagccaacagacacccgcccggucccucacccugcaggaagcucuggaggugagaaagccccaguucaucucucgcagccaagagcggcuuaagaaacucgaacacaugguucagcagagaaaggcccagcgcaaagaggaccugagacaaaagcagucccugcucccuauucggacgucuaaaaagcaguuuacaaucccccauccgcugagcgauaaccuuuucaagccuaaagaacgcugcaucuccgagaaggaaaugcacaugagaucuaaacggauuuacgacaaucugcccgaggugaagaaaaagaaggaggaacaacgcaaaagagucauccuccagagcaaccggcugcgcgcugagguguuuaagaaacagcugcuugaucagcuccugcaaagaaaugccguuuga

SEQ ID NO: 66591 - RNA, 537 nt, Artificial Sequence
  derived and/or modified sequence opt5 from C11orf21__Homo_sapiens__NP_001136418
auggccagcuuccugguguggccccucagaaccgcucugcggggcgggaaguccugggccggaccuggcgucgggugcggaggcgacggggcgcgcggaggcggcgagcuuucucugagcaaccucgaucugccgggggcuggagaagccggccuugagcaccauccccugcucgggcaccuguuuaucuccgccguuccuagauggccccaucugucuagccaguccggaguggaaccucccgaccgguggacaggcacgccuggguggccgucucgcgaucaagaggcucccggaagcaugaugccucccgccgcugcccagccuuccgcgcacggcgcccucgugcccccggcuaccgcccaugaaccugucgaccaccccgcucugcacuggcuugccuguugcuguugccugagccucccuggccagcugccccuugcgauuagacuggggugggaucucgaccuggaggccggacccucuuccggcaaacuguguccucgggcucgcagauggcagccgcuccccagcuga

SEQ ID NO: 66592 - RNA, 3969 nt, Artificial Sequence
  derived and/or modified sequence opt5 from C11orf30__Homo_sapiens__NP_064578
augcccguggucuggccuacccugcucgaccugagcagagaugagugcaagcggauccuucgcaaacuggaacucgaggccuacgcuggcguuauuuccgcccugagagcgcagggggaccuuacaaaggaaaagaaggaucugcucggagagcugucuaaagugcugagcaucuccacggaacggcaccgcgcugaggugagacgggccgucaacgacgagcgccucaccacaauugcccauaauaugucuggcccgaacagcuccucugaauggagcaucgaggggagacggcuggugccccuuaugccucgccugguuccccaaaccgcuuucacagugaccgccaaugcugucgccaacgcggccauucagcacaaugcuucccucccugugcccgccgaaacaggaagcaaggagguuguguguuauucuuacaccuccacgaccagcacaccuaccucuacaccgguccccuccggcagcaucgcuaccgugaagucuccuagacccgccuccccugcgagcaacguggucguucugcccuccgggucuacgguguaugugaaaagcgucuccugcagcgaugaggacgaaaagccgcggaaacgcagacggacaaauucuuccagcucuagcccugugguucuuaaggaggugcccaaagccgucgugccuguuuccaagaccaucacagugcccgucucuggaagccccaagauguccaacauuaugcagagcaucgcuaauucucugccuccgcauaugucccccgugaaaauuaccuuuaccaagccuagcacacagacgaccaacacaaccacacaaaaagucaucauugugaccacgucucccuccagcacauucguuccuaauauccucuccaagucucacaacuacgccgcugugaccaaacugguccccaccagcgugauugccuccacaacccagaagccgccuguugugaucacagccucucagagcucccuggucagcaauucuuccagcgggucuuccagcucuacgcccagcccuauccccaacaccguggcugugacagcgguugucuccagcaccccuucuguggugauguccacagucgcccagggcgugagcaccuccgcuauuaaaauggccucuacgcgccuccccagcccgaagucccugguuucugccccuacccaaauccuugcucaguuucccaagcagcaucagcaaagccccaaacagcagcuguaucaagugcagcagcagacacaacagcaggucgcccagccuuccccggugucucaccaacagcagccccagcaaagcccucuucccccugggauuaagcccaccauccagauuaaacaggaauccggaguuaagaucaucacacagcaagugcagccuagcaaaauucugcccaagccggucaccgcgacgcuuccuacaucuuccaauagccccaucauggugguuucuuccaacggcgcuauuaugaccacaaagcuggugaccaccccuacagggacgcaggccaccuacacaagacccaccgucagcccgucuaucggacggauggccgcuacaccuggcgccgcuaccuaugugaaaacgacauccgggagcauuaucaccgugguccccaagucccucgccacccugggaggcaaaaucauuagcucuaacaucguuagcggcacaaccacaaagauuacgaccaucccuaugacauccaaacccaaugugauugugguccaaaagaccacagggaagggaaccacgauccagggccugcccgggaaaaacgugguuaccacacuccugaaugcgggaggcgagaagaccauucagacagugccuaccggggccaaaccggcuauccuuacagccaccagacccaucacgaagaugauugucacacagccuaaaggaaucggcucuaccgugcaacccgcugccaagauuaucccuaccaagauuguuuacggccagcaggggaaaacacaggugcugaucaagcccaaaccugucaccuuccaagcgacggugguuagcgaacagacacgccagcucgugaccgagacacugcagcaagccucccgggucgcugaggccggaaacucuagcauccaggaaggcaaggaggaaccgcagaauuacaccgauuccucuagcuccagcacagagucuucccaaagcucucaggacucccagcccguggugcacgucauugcuagcagacgccaggauugguccgaacaugagaucgccauggagaccucuccuacgauuaucuaucaagacguuagcuccgaaagccagucugccaccuccacaauuaaagcgcuucuggagcuccagcagaccacagugaaggaaaaacuggagagcaagccccggcaaccuaccaucgaucugucucagauggcugugcccauccagaugacgcaggaaaagagacacagcccggaguccccuucuauugccgucguggagagcgaacucguugcugaguacaucacaaccgaacgcacagacgaggggaccgagguggccuuuccccugcuugucucccaucggucucaaccccagcagccuagccagccccaaagaacccugcuccagcacguggcccagucccaaacagcuacgcagaccagcguuguggucaaaucuauuccugccuccagcccgggagcgaucacacacauuaugcagcaggcucuguccucucauaccgccuucacaaagcacagcgaggaacugggcaccgaagagggggaaguggaggagauggauacgcuugacccccaaacaggccucuuuuaucgcuccgcccugacccagucucagagcgcuaaacagcaaaagcugucccagccuccccucgaacagacccagcugcaagucaaaacacuucaguguuuccagaccaagcaaaagcagacaauccaucugcaggccgaccagcuccaacacaaacugccucagaugccccagcugagcauccggcaucagaagcucacgccgcuccaacaggagcaggcgcagccuaaacccgaugugcaacacacccagcacccuaugguugcuaaggacagacagcugcccacacugauggcccagccuccccaaaccgugguccaggugcucgccguuaaaacaacccagcaacugccgaaacuucagcaggcuccuaaccagcccaagauuuacgugcaaccccagacgccucagucucagaugucccugccggccagcucugaaaaacaaaccgcuucccaggucgagcagcccaucauuacacagggaagcucugugaccaagaucacauuugaaggccgccaaccucccaccgugacaaaaauuacgggcggaagcuccguuccuaagcucaccucucccgucacaagcaucuccccuauucaggccagcgagaaaaccgcgguguccgauauccugaagaugucucugauggaggcccagaucgacaccaauguggaacauaugauugucgauccgcccaagaaagcucuugccacaagcaugcucacgggcgaggcugggucccugccuucuacccacauggugguugccggaauggccaacagcacaccccaacagcagaagugccgggaauccuguucuagcccuuccaccgugggcagcucucugacaaccagaaaaaucgaucccccggcugucccugcgacggggcaguucaugcggauucaaaaugugggccagaagaaagccgaggaaucccccgcugagaucauuauccaggccaucccccaguaugccauuccuugccauucuagcuccaacguuguggucgagcccagcggacuccuggaacuuaauaacuuuacaucucaacagcuggacgacgaggaaaccgcuauggagcaggauaucgacuccagcaccgaggauggcacagaaccuuccccgagccagucuagcgccgagcgcuccuga

SEQ ID NO: 66593 - RNA, 711 nt, Artificial Sequence
  derived and/or modified sequence opt5 from C11orf53__Homo_sapiens__NP_940900
augcccggcagcccugugaccuccggguacuauggagucagacggucuuuccugagcgacuccgauuuucacaacucuaagcaguucagcaaugacguuuacacauccucugugggcaaaccguuucccugcgagagcuccgccgggcaaagccaugcugcccuccuggaaccuuauuucccccaggagccuuacggagauuauagacccccugcgcuuacgccgaacgcuggcucucuguuuuccgccagcccccucccuccccugcuuccucccccguucccuggggaccccgcccacuuucuguuccgcgauucuugggaacagacccucccugacggacugucccagcccgaucccgugagcgcugacgcccugcucacacugccuccgucuaccuccugucuuagccaacuggaguccggcucuaucgcucagcaucggggcagcuccugggggagcucucucgccggagcgcaguccuacagccugcacgcccuugaagaucugcaucacacacccggcuauccuacacccccucccuacccguuuaccccuuucaugaccgucucuaaugaccugcccccuaagguggggccccucagcccugaugaggaggcugacacgggaucccugcacgaucccucuccguggguuaaagaagacggcagcauugccuggggguccuacgagugccgcagagcuuauuga

SEQ ID NO: 66594 - RNA, 942 nt, Artificial Sequence
  derived and/or modified sequence opt5 from C11orf65__Homo_sapiens__NP_689800
augcccuggaaggaggaaagcgaguucaccaaacaggacaaggccgcuagagugauccaacaggccuggaaauccuuucugaacgucgcgauuuuccagcacuuuaagucucucaucgaucugcggcgccagggcgaaccuagacaaauuguuaaauacaucaauccgaaggaggcugaacuucuggacgccgccgcugggauucaugugcgguuccgccucggaggcgugaaguuucccccugauaucuauuacaaaaucuucacacacagacccauugaggaccugugcgccaacagcccucggaauuaugcuaaacuucccgccaagcauacgucccacaacaagaaugaucaucugcaggaggaagaccacucugggugguaccaccgcaucgagaacaauggauggagaccugucagcgauaccuuuuggcucuccacagacggcauggugguugaagauaaaaaggagucugaguuccauuuuagcaagcugaaacggcgccaggaccuggaaaagaaaagaaagcuccggaaaauugaguggaugcgccagauguauuacuccgggagccuggaagcgaagucuacccaccaugagacacuuggacugauccacaccgccacaaaaggccucauuagagcuuucgaagauggcgggaucgacuccgugauggagugggaggucgaugaagugcugaacuggaccaauacgcuuaacuuugacgaguauauugccagcuggaaggaaaucgcuaccucuaauuccagcgccaacuucaagggauuucgguucaaucaagcgcagaaaaacaucuacaauuacggcggggacauuucuaagaugcagaugggaaucccggaugacacauauuacgagaacguuuaucaggaacccaacgugacccgccugacaccugauuccaccuacggccucuga

SEQ ID NO: 66595 - RNA, 882 nt, Artificial Sequence
  derived and/or modified sequence opt5 from C11orf68__Homo_sapiens__NP_001129107
auggccgcugccgcggcugccgccguggcuggcgucgggagaggaggcgggggagccgagccccggcaggaacgcagcagagcucggggcugggccgggguugagcgcuccgaaggaagaucucggauggagccuggcgaggaacuggaggaagagggcagccccgggggacgcgaagacggcuucaccgcggagcaccucgccgcugaggccauggcugccgauauggaccccuggcugguguuugaugcgagaacaacgccugccaccgaacuugacgcuuggcuggccaaguacccgccuucccaagugacacgguauggggaucccggaucuccuaacagcgagccggucggcuggaucgcuguguacgggcagggauauucccccaauucuggcgacguucagggccuccaggccgccugggaagcucugcaaaccagcgggcgcccuauuacacccggaacccuuagacagcuggcgaucacacaucacgugcucuccggcaaauggcugaugcaucuggccccuggguucaagcucgaucacgcuugggccggaauugcccgggcugucguggagggccagcugcagguugccaaagugagcccccgcgcgaaggaagggggaagacaagucaucugcguguacaccgacgauuuuacggaccggcuuggcgugcuggaggcugauucugccauucgcgccgcuggcaucaaaugucuccugaccuauaagccggacgucuacacauaucuugggaucuacagagccaaccgguggcaucugugcccuacccucuacgaguccagauuccagcugggaggcagcgcucgcgggucucggguucuggauagagccaauaacguggaacucacauga

SEQ ID NO: 66596 - RNA, 594 nt, Artificial Sequence
  derived and/or modified sequence opt5 from C11orf73__Homo_sapiens__NP_057485
auguucggcugccugguggccgggagacucguccagaccgcugcccaacagguugcggaggacaaguuuguguucgaucugcccgacuacgaaagcaucaaccacguggucguguuuaugcuuggaacaauuccuuucccggagggcaugggaggguccguuuauuuuucuuaccccgauagcaauggcaugccuguguggcagcugcucggguucgucacgaacggaaaacccuccgcuaucuuuaagauuucuggccugaaaagcggcgaagggucccagcauccuuucggagccaugaauaucgugcggacccccucuguugcccaaauuggcaucagcguggagcuucuggacuccauggcucagcagacaccugucgggaacgccgcugugagcucuguggauuccuuuacccaguucacacaaaagaugcucgacaauuuuuauaacuucgccagcucuuuugcggucucccaggcccagaugaccccgagccccucugaaauguucaucccugcuaauguugugcugaaaugguacgagaacuuccagcgcagacuggcccaaaauccccucuuuuggaagacauga

SEQ ID NO: 66597 - RNA, 444 nt, Artificial Sequence
  derived and/or modified sequence opt5 from C11orf74__Homo_sapiens__NP_001263656
augagcgcccacauguccggccuggagaucauggacgaggaucagcucauuaaggacgugcuggauaaauuccuuaacugccaugagcaaaccuacgacgaagaguuucugaauacauucacgcaccucucucaggaucugcuucugcuccccggggaagucgagcaggacguuagcaccuccaucccuucuuguauuccguuuguggcucagcccccuacaugcgaggugaagcccaaaccuagcgucaagagaauggauaaacaaaccgaagagauccugggagacgaagugcagcuguucucccucgaugaggaguuugacuaugauaacguuaugcugacaucuaaguucagccccgccgaaauugagaauaucaaggaacuuuguaaacagcagaagcggaaagacaccuccccugaucuggaaaagagcugcgacuga

SEQ ID NO: 66598 - RNA, 1536 nt, Artificial Sequence
  derived and/or modified sequence opt5 from C11orf80__Homo_sapiens__NP_001289013
auggugcugaagaaauuccucaaggagauccagagcauucugcccggcaucuccgccaaacuuaccuggacaucugaagaggggagcuacucccaagacaugacgggagucaccccuuuucagaugauuuucgaaguugaugagaagccgagaacacugaugaccgacugccucgugaucaaacacuuucugcggaagauuaucauggugcaucccaagguccgcuuccacuuuucugugaaaguuaacggcauccuuagcacagaaauuuucgggguggagaaugagccuacccugaaccucggaaauggcaucgcucugcuggucgauucccagcauuaugugucuagacccaacuuugggacaauugaaagccacuguucccggauccauccuguucucggacaccccgugaugcuguucauuccugaggacgucgccggcauggaucuucugggcgaacucauccugaccccggcggcugcccuuugccccagcccuaaggugucuuccaaucagcugaaccgcauuagcucuguguccaucuuucucuacgggccccugggacugccucucauccugagcacgugggagcaacccaugaccacauucuuuaaagacaccucuucccuugucgauuggaagaaauaucaccuguguaugauuccgaaucucgaccugaaccuugauagagaccugguucucccugaugugagcuaccagguggaguccucugaagaggaccagagccagacaauggauccccaaggccagacccugcuccuguuccuguuugucgacuuccauuccgccuucccugugcagcagauggaaaucuggggaguuuauacgcuucugacaacccaccucaaugcuauucugguggagagccauucugucgugcaaggauccauccaguuuacaguugacaaggugcuugaacagcaccaccaagccgcuaaggcccagcagaaacugcaggcgagccucucugucgccgugaacagcauuauguccauccugaccggcucuacccggagcuccuuccgcaagaugugccugcaaacacuccaggcugccgauacgcaggaguuuagaaccaaacugcauaaggucuuccgggagaucacacagcaccaauuucuucaucacuguagcugcgaagugaaacagcugacccucgagaagaaagacucugcucaggggacagaagaugcccccgacaauuccagccuggagcugcuugcggauaccucuggacaggccgaaaacaagcgccucaagagaggcagcccccggauugaggagaugcgcgcucugagauccgcccgggcuccuuccccgucugaagccgcuccccgcagaccugaggccacggcggcuccccugacaccucggggcagagaacaucgcgaggcccacgggcgggcccucgcccccgggagagcuagccugggcucccgccuugaagacguucuguggcuccaagaggugucuaaucugagcgaguggcuguccccgagcccugggcccuga

SEQ ID NO: 66599 - RNA, 1035 nt, Artificial Sequence
  derived and/or modified sequence opt5 from C11orf87__Homo_sapiens__XP_011541119
augggccccaaggggagcgacgccgugcagggaggcagagucuggaccgggcgggagcgcaaaggaggccugagaacacgguccccucgcgggggaccggaauggguucucggcagagugggcucucggcgcagacaccaaccccgggggcgcagaaaggaggaaagccggcgcuccggaaaccuggugccucuucagagaaaaggcgagcggggcgaugucuucgaagugguuucugcucgcaucagcagagcgccccugacgccuuggucccccugccucccugccguggcuccgcugguccuuggaucucuggcccauccccucccucugcagggcgccgugcucgggggaguuggcagcgugcuguuucuggcuggccggaaugggguccccaagagaggaucccuugugggccuggccccucccagcccggcuccuaugucugcccgcgcgcccaaagagcuccggcuggcccuuccucccugucugcucaacagaaccuucgcuucccccaaugccagcgggucuggaaacacaggcgcucgcgggccuggagccgugggcuccgggaccugcauuacacaggucgggcaacagcuguuucagagcuucucuuccacccugguucucaucgugcuggugacacuuaucuuuugucugauuguccucagccuguccaccuuccacauucauaagcggagaaugaagaaacgcaagaugcagcgggcgcaagaggaauacgagagagaccacugcucuggaagccgcggcgggggaggccuuccgcggcccgggagacaggccccuacgcaugcuaaagaaacccgccuggagcggcagcccagagauuccccuuuuugugcccccagcaaugcuucuucccucagcucuagcuccccgggccugccuugccagggacccugugccccucccccucccccgccugccucuagcccccaaggcgcucacgcggccuccagcugccuggacacagcuggggagggacuccugcagaccgugguucuuucuuga

SEQ ID NO: 66600 - RNA, 2037 nt, Artificial Sequence
  derived and/or modified sequence opt5 from C11orf95__Homo_sapiens__NP_001138408
auggagcccggcggggaccacagaagccgguccucuggaggccgcgggggaccuggcccggccguggcuagcgccagagggcggcgccugcccccugcgggauccucuggcagcgcugaacccgaggaagaugagggcgggcaggaccuccaacuggaaggaggcgcccuuggguccuggggaucugccccucugcccagcuccagagcucggggcccugccagcucugggcgcaaguacuccgaucauugcgaggcuagagccagccggccgggaaaaucucgcauccccggcagagaccaccggcgcuauuaccaugaucacuggagacucgaguaucugauggacuucaacccugcgcggcauggcauggucuguaugguuugcggguccagccuugccacccugaagcucucuacaauuaaacgccacaucagacagaagcaccccuacucccugcauuggagcccucgggaaaaagaggugauuuccaauucuugggaugcucaccugggacucggcgccuguggggaagcugagggacugggcgugcagggggccgaggaagaggaagaggaagaggaggaagaggaagaggaaggagcgggcguccccgccugcccgccuaagggccccgggaaggcuccugccggaggcggguguagacgccagcggagaggaggccccguggcuccccgcgcccggagacuucgccugagcgccucccggagagcugggggcagccgcggacucggcgcgcggagacuggagcgccggcuuaaagagucucugcaaaacugguuuagagccgaaugccucauggacuaugauccucgggggaaucgccugguuuguauggcuugcggcagagcccugccgucccuccaucuggacgauauccgggcccacgugcuugagguccaccccggaagccuggggcucucuggaccucagagaagcgcucugcuucaggccuggggcgggcagcccgaagcgcuguccgagcucacgcaaucuccucccggcgacgaucuggcuccgcaggaccugaccggaaagagccgcgacuccgccagcgccgcuggcgccccuucuucccaggaucucucucccccugacgugaaagaagaggcuggguggguucccgagcggccuggacccgccgaagaggaagaggagcuggaagagggcgaaggggagagagcgggagugccgggccgcagcccuagagggcgggcccaucgcagacacccccaggaacgguggcgccuugaguaccugauggagcucgauggcggaagacggggccuggucuguggggugugcggaggcgcucuugccucccugaagaugagcacaauugaacgccauaucagacggcgccaccccggguccaccagacucggaggcccugugcaagcucugaucgcccgggaguggucugaaaaagcggcccaucugcucgcucuggggccgcccagaccugagagcccccagggcccuauucccccuggaacagccgcugccuccgacgaaggcgggggagaugaggaggaggaacccgaagaggaagaggaggaauggggcgacgucccgcuuucuccuggggcuccccuggagcgcccugccgaagaggaggaagaugaggaagacggacaggagcccggcggccucgcgcugccgccucccccucccccucccccgcccccucccccucggagcagagaacaacgccggaacuaucagcccagauggcgcggggaguaccugauggauuacgacggaucccggagaggccuuguuuguauggugugcgggggagcccucgcuacccugaaggugagcacaaucaagcgccacauucugcagguccacccuuucucuauggauuuuaccccggaggaacggcagacgauccucgaggccuaugaagaggccgcucugagaugcuacggccaugaaggguucggacccccugcccccgcgccucgggacggcggcgcugaccuuaaauccggggccgugugucgcgccuga

SEQ ID NO: 66601 - RNA, 1131 nt, Artificial Sequence
  derived and/or modified sequence opt5 from C12orf10__Homo_sapiens__NP_067653
augggccaccaguuccugagagggcuccugacccuucugcuucccccuccgccccuguacacacggcaucgcaugcuuggaccugagagcgugcccccucccaagagaucccggucuaaacugauggccccuccgcgcaucggcacgcacaacgggaccuuucauugcgacgaagcucucgccugugcgcugcugagacuccugcccgaguaucgggaugcugaaauuguccgcacaagagacccugagaagcucgccagcugcgauaucguuguggacgugggaggcgaauacgauccccggcgccacagauaugaccaucaccaacgguccuucaccgagacaaugucuagccuguccccugggaaacccuggcagaccaagcucucuagcgccggacugauuuaccuucacuuuggccauaaacugcucgcucagcugcugggcacauccgaggaagauagcauggucgggacccucuaugacaagauguacgagaauuucguggaagagguugaugccguggacaacggaaucucucagugggcugagggcgaaccgcgcuaugcccugacgaccacacuuuccgcgagagucgcccggcugaauccuaccuggaaccaccccgaucaagacacagaggcuggguuuaagcgcgccauggaucucgugcaggaagaguuccugcagagacuugacuuuuaccagcauagcuggcugccugcucgggcccucguugaagaggcgcuggcccaaagauuccagguggaccccucuggagagauugucgaacuggcuaaaggcgccugucccuggaaggagcaccucuaccaccuggaauccgggcuuagcccuccgguggcuaucuuuuucgugaucuauaccgaucaggccggacaguggcgcauucaaugcguccccaaagagccucauucuuuucagucccggcugccccucccugaacccuggagaggccugcgcgacgaggcccuugaucagguuagcggcaucccgggguguauuuucgugcacgcuuccggauuuaucggcgggcaucacacgcgggagggagcgcugucuauggccagagcuacacucgcccaacgcagcuaccugccucagauuuccuga

SEQ ID NO: 66602 - RNA, 1083 nt, Artificial Sequence
  derived and/or modified sequence opt5 from C12orf42__Homo_sapiens__NP_940923
augagcaccgugaucugcaugaagcagagagaggaagaguuccugcucacaauucggcccuuugccaaccgcaugcaaaaauccccuuguuacaucccgauugucucuagcgcuacgcugugggacagauccacccccucugccaagcacaucccuugcuaugaacggacaagcguucccuguucccgcuucauuaaucauaugaaaaacuuuucugagagcccuaaguucagaucccuucacuuucugaauuuccccguguuuccugaacggacccagaacagcauggcgugcaaacgccuccugcauacaugucaguacaucgugccgagaugcucugucuccaccgugagcuucgaugaggagucuuaugaagaguuucgguccagccccgcuccuucuuccgaaacagacgaggcuccccuuaucuucaccgcccgcggcgagacggaagagagagcccggggagccccuaagcaggcuuggaauagcuccuuucuggaacaacucguuaagaaacccaacugggcccacucugugaauccgguccaucuggaggcgcaggggauucacaucagccgccacaccagaccuaagggccagccccuguccagcccuaaaaagaacucuggguccgccgcucggcccagcacagccauuggacucugucgcagaucucagacccccggcgcucugcaaagcacagggccuuccaauaccgaacuugagccggaggaacggauggccgugcccgcgggagcccaggcucauccugaugacauccagucuagacugcucggcgccagcggcaaccccguugggaaaggagcuguggccauggccccugagaugcugcccaagcacccgcauacgccucgcgaucggagaccccaggcugacacaucccuucacggcaaucuggcgggggccccucucccccugcuggcuggagccagcacccacuucccuucuaagcgccucauuaaagucugcuccagcgcucccccgcggccuacaagacgcuuucauaccguguguucucaagcccugucccggcccguggucaacgcccaccuucauuga

SEQ ID NO: 66603 - RNA, 666 nt, Artificial Sequence
  derived and/or modified sequence opt5 from C12orf43__Homo_sapiens__NP_001273127
auguucugccagaaccccggcgccgcuaauagccaacuguccaccucucagccuagccucagacacaaggugaacgagcaugaacaggacgggaaugagcugcagacaacgccggaauuucgggcccacgucgcgaagaaacuuggagcucugcucgauuccuucaucaccauuucugaggccgccaaagaacccgcuaaggccaaaguucaaaagguggcucuggaggacgauggcuuucgccuuuucuuuacaagcgugccugggggaagagagaaggaagagucuccccagccucggcgcaaaagacagcccuccagcuccagcucugaagacuccgaugaggaguggcggcgcuguagagaagccgcggucagcgccucugacauccugcaggaguccgcuauucauagcccuggcaccguggaaaaggaggccaaaaagaaacggaagcucaagaaaaaggcuaaaaagguugccucuguggauuccgcggucgccgcuacaaccccgacaagcauggccaccgugcaaaaacagaaguccggggaacugaacggagaccagguuucucugggcacgaaaaagaagaaaaaggcuaaaaaggccagcgagaccucccccuucccucccgccaaaagcgcuacagcgaucccugccaauuga

SEQ ID NO: 66604 - RNA, 1245 nt, Artificial Sequence
  derived and/or modified sequence opt5 from C12orf50__Homo_sapiens__NP_689802
auggagaugcagcaaaacugcagcaucuccuguuucugggaaacccagccccugggcugcgugaagauuucuuguaucuuuuaccacagcaaaccuagaaauauuaacggacucuuccugccgcccuccucuaauaucacacuucagaaggagauucaggaagggaucccucugcaaagccagucccaggagccccucaaaccucaggaaaacaucucucggcccauucaucacccucugguccuuaagacgaauuuugaggaggaagaggaaguugacgagcaaaacgaugccagcucccuguggaccaaaacaccggaggaaaucgaggaaaagcgcgcuauuaaggagaugugcuauaaaagcggcgaauacuauagauuccauacacccccugacauccucucuuccaagagcaugacccccaccgccgagaaacagcuggagaagccucuggaaaaugggucugagcuccaggaaggagauucccugacagugcccaccaaacuuagccaguacgagcggcaaggcgaaauuaagacgucucugcacgggaagccgaaaaccgacaucgcggcuuuugagaacggaggcggcgauuguuaugugccucagcgcgucauuuuccucgggguggacgaguccgaagcccugacagaggaaaaggagaucaccaucagcaaaugcuccaauacaaaggauaacaaagacucuccccauccuaagcacagccuuaccacgagacugguucccacaacccacgugcucaaugccacagaaaacauuuccaugaaaugucgggaggaucccagcucuaugaaugacguccagccugugaagaagccgcauuuuaaaggaguuaagaaacgcaaguggaucuacgaugagccccaaaacuucccuaauuccggcaugcagagagcugugcaggcuccccggccucagaacaaaaugagcuaucaccgcaacaauaagaacagaaaugccgaaaacgccucuuacauucauguccaacgggacgcggugcgcaccguggcccugaaugcucccagcagaucccggccgacccacgggucuuacaacaagguccacgccaaucgcgagccuaaacccaaccugagcccugauaaguauacauccacgagcuacaaugacucugcuuggagaaaacggauccccuuuuccaagaccuauagcaaaucugaaaagauuuacccugagcccagacgcaacggauccaaguga

SEQ ID NO: 66605 - RNA, 381 nt, Artificial Sequence
  derived and/or modified sequence opt5 from C12orf57__Homo_sapiens__NP_001288763
auggccagcgcuuccacccagcccgccgcgcugucugcugagcaagccaaggugguccucgccgaaguuauccaggcuuucagcgccccugagaacgcugugagaauggacgaagcccgggauaaugcgugcaacgacaugggcaaaaugcugcaguuugugcuuccggucgccacacagauucaacaggaggugaucaaggcuuacggguucuccugugauggagaaggcguucugaaauuugcccgccucgugaagucuuaugaggcucaggaccccgagauugccagccuguccgggaaacuuaaggcgcuguuccucccucccaugacgcugccuccccacggaccugccgcuggcgggucugucgccgcuagcuga

SEQ ID NO: 66606 - RNA, 813 nt, Artificial Sequence
  derived and/or modified sequence opt5 from C12orf5__Homo_sapiens__NP_065108
auggccagauucgcucugaccgugguccggcacggcgagacacgcuuuaacaaggagaaaaucauucaggggcaaggaguugacgaaccccucagcgaaacgggcuucaagcaggccgcggcugccgggaucuuucugaauaacgugaaauucacccaugccuuuuccucugaucuuaugagaacaaagcagaccaugcacggcauucuggagcggagcaaauucugcaaggacaugacagugaaguacgauucccgccucagagaacggaaauauggagucguggaggggaaggcucugucugagcuucgcgccauggcuaaagccgcgagagaagaguguccuguuuuuaccccgcccggaggcgaaacacuggaccaggugaagaugcggggcaucgauuucuuugaguuccucugccaacugauucugaaagaggccgaccagaaggaacaguuuagccagggguccccuucuaauugucucgagaccagccuggcugaaaucuucccccuuggaaagaaccauuccagcaaagucaauucugauuccggcaucccugggcuggccgcuagcgugcucguugugucucacggagccuacaugcgcucccuguuugacuauuuccuuacggaucugaagugcagccuccccgcgacccugucuagauccgagcugaugagcgucacaccuaacaccggcaugucccucuucauuaucaauuuugaagaggggcgggaggugaaaccgacagugcaauguauuugcaugaaccugcaggaccaucuuaauggacugaccgaaacgcgcuga

SEQ ID NO: 66607 - RNA, 501 nt, Artificial Sequence
  derived and/or modified sequence opt5 from C12orf65__Homo_sapiens__NP_001181924
augagcaccgugggccuguuccacuuucccacaccucucacgagaaucugcccggcccccugggggcugcggcuuugggagaagcugacccuccuguccccuggaauugcugucacacccguucagauggccggcaaaaaggacuacccugcgcuucugucucucgaugaaaacgagcuggaggaacaauucgugaaagggcauggacccggcgggcaggcuaccaauaagacaagcaacugugugguccugaaacacaucccuuccggaauugugguuaagugccaucagacccgcucuguggaccagaauagaaagcucgcccggaaaauccugcaagaaaaggucgauguguuuuauaacggcgagaauagcccgguucacaaagagaagcgcgaagccgcuaaaaagaagcaggagcggaaaaagagagccaaagaaacacuugagaagaaaaagcugcucaaagagcugugggaauccucuaagaaggugcauuga

SEQ ID NO: 66608 - RNA, 1407 nt, Artificial Sequence
  derived and/or modified sequence opt5 from C12orf66__Homo_sapiens__NP_001287869
augggcgagagcaucccccuggccgcuccugugccggucgaacaggccguucucgagaccuucuuuucccaccuggggauuuucucuuacgacaaggcgaaagauaacguggaaaaggagagagaagcuaauaaaagcgccggaggcuccuggcuuucucugcucgccgcucuggcccaucuugcugccgcggagaagguguaucacagccugacauaccucgggcaaaaacugggaggccaguccuuuuucucucggaaggacagcauccgcacgauuuauaccucccugcauaacgagcucaagaaagucgugacagggagaggagcccugggcggcaccgcuccccacguugaagaacuucugagccaucucucugaacagcugugcuuuuucgugcaggcccggauggagaucgcugauuuuuacgagaagauguauacacuuuccacccaaaaauucauuaaugccgaggagcuggucgggcuccuggacgcgaucaugaagaaauacagcucucgcuuucaccacccuauccugagcccccucgaaagcucuuuccagcuggagguggauguucuuugucaucugcucaaggcccaggcucagguguccgaauggaaguuucugccuagccuugucaaccugcacuccgcccauacaaaacuccaaaccuggggacagauuuucgagaagcagagagagacgaaaaagcaccuguuuggcgggcagucucaaaaagcugugcagcccccucaccuguuccucuggcugaugaaacuuaagaauaugcugcucgccaaguucagcuuuuauuuccaugaagcccugucccggcagaccacagcuagcgagaugaagacccuuacagcgaaagccaacccggacuuuuucggaaagaucucuuccuuuauucgcaaauacgaugcugccaaugugagccugaucuucgacaacagaggcucugaauccuuucaagggcacggauaccaucacccccauuccuaucgggaggccccuaagggcgucgaucaguaccccgcuguugugucucucccuagcgaccgccccgugaugcacuggccgaaugucauuaugaucaugaccgauagaacguccgaccugaacagccuggaaaaagugguucacuucuaugaugacaaggugcagucuacauacuuucucacccggccugagccccauuucacaauugucaucaucuuugaguccaagaaaagcgaacgcgacucucacuucauuuccuuucugaaugaggugagccuugcccugaagaacccuaaaguuuucgcgucccucaagcccggcucuaaagggagcugcuaucaguguaauuacuucguggcuuuuugccugaacuauuccaagcugcuucuccaaagaaaguga

SEQ ID NO: 66609 - RNA, 192 nt, Artificial Sequence
  derived and/or modified sequence opt5 from C12orf75__Homo_sapiens__NP_001138671
augggcugcgggaacagcaccgccacauccgcuggagccggccaggggcccgcgggagcugccaaggacgugacggaggaaucugucaccgaggaugacaaaagacggaauuacggcgggguuuaugugggacugccuagcgaagccgugaacauggucuccucucaaacaaagaccgugcgcaaaaauuga

SEQ ID NO: 66610 - RNA, 438 nt, Artificial Sequence
  derived and/or modified sequence opt5 from C12orf77__Homo_sapiens__NP_001094809
augauccccaagcuggccaccccuagagacauuagccuccuggugaucaaagaggcuuccucucgggcccgcaacaauauucagauccuugauccgcuggaccacauugcgagacucacaaacuacacgcugaccagcugcuucuccucuaauaagguccccacaaugccuggcagccuucccaccggguccaaacaaggaaacguucagacacuggauucuauccgguggaugccugcuacccccgugccugccccggaaugucaucagaaguaugccaucagcacagagaccgcuuuucccacgcucuccaccuucaugaauacagaaaagagcgugaaaggcucuaacgccgacuuuaccaagcgcaauccuagauggcgguuccuguuugggauuuacugcucccugcaccaugcuaugacaaucuucauuuga

SEQ ID NO: 66611 - RNA, 735 nt, Artificial Sequence
  derived and/or modified sequence opt5 from C14orf166__Homo_sapiens__NP_057123
auguucagacggaagcugaccgcccucgacuaccacaaccccgcuggcuuuaauugcaaagaugagacagaguuccgcaacuuuaucguguggcuggaagaccagaagauuagacauuauaaaaucgaagaucgggggaaucuucgcaacauucacagcuccgacuggccuaaguucuuugagaaauaccugagagaugucaauuguccguucaagauccaagaccggcaggaagccauugauuggcuccugggacuugcgguucgccuggaguauggcgacaacgcugagaaguacaaagaucucgugcccgacaauucuaagacggccgauaacgccaccaaaaaugcugaaccucugaucaaccuggacgugaauaaccccgauuuuaaggccggggucauggcucucgccaaucugcuucagauccagagacaugacgacuaucuggugaugcucaaagcgauucggauccugguucaagagcgccuuacacaggaugccguggcuaaggccaaccagaccaaggaaggacugccugucgcucucgacaaacacauucugggcuucgauacaggggacgccgugcugaaugaggcggcccagauccucagacugcuucauauugaggaacugcgggagcuccaaaccaagaucaacgaagcuauuguugccgugcaggcuaucaucgccgaucccaaaacagaccaccgccugggaaaggucggcagauga

SEQ ID NO: 66612 - RNA, 378 nt, Artificial Sequence
  derived and/or modified sequence opt5 from C14orf177__Homo_sapiens__NP_872366
augcacagaaaggagcccggcgcccggcuggaagcuacccgcggggccgcgagaccucauaaacagggaacaaagccgaugaucacgcggcccagcgugucccaacucggcgaggggaaaugcccuucuagccagcaucugcagucccuucgccacaacaagcagcacgcucugacccucacaaaagccagauguugcggagaauguucuaccugcuucuguacagaggaaaagagcgagugccaacggcaugaggaaaccucccccggcucuuguaaucaccagauuaugagcgccuccacaaucagcgcuuuuugcgccaccccucgcuucaagcagcuguuuaaagggacggucgagcagaugucucaaauguga

SEQ ID NO: 66613 - RNA, 423 nt, Artificial Sequence
  derived and/or modified sequence opt5 from C14orf1__Homo_sapiens__NP_009107
augagcagauuccugaacgugcuccgguccuggcuggucaugguuucuaucauugccaugggcaauacccuucagagcuuucgcgaccacacauuccuguacgagaagcucuauacggggaaacccaaccuggugaauggacuucaagcuagaaccuuuggcaucuggacacugcucuccucugugauucggugccugugugccaucgauauucauaacaagacccuguaccacaucacacucuggaccuuccugcuugcgcuggggcauuuucucagcgaacuguucgucuauggaacagcugccccuaccaucggcgugcuugccccgcugaugguugcuuccuuuucuauucucgggaugcuggugggacugcgcuaccucgaggucgaacccgugagcagacagaaaaagcggaauuga

SEQ ID NO: 66614 - RNA, 537 nt, Artificial Sequence
  derived and/or modified sequence opt5 from C15orf32__Homo_sapiens__NP_694585
augaacaagagaaccagcguggacgccuccaaagaggaucugcaccccgcugacccucagucuggcgaaggggucccgcccaaucggaagaacacaaaaacgagcccucgcggagagggcaccgcgcccccuuucuccgccagacccugcguuuggacacucugugaaaugcugucuauccuugcucuggugggggugcuccauccuuuuuaccggagcaauaaccaagucuaucagaagcugaaaacccaccuucgcugccaguccucuagaguggauggacugaugcucaagccgacacugcugacccccagccagcucaaguccccugagggccaucugauucuucccacauucaaucaccugguuauccggcauauucucgacccuaaacaaaucuuuuguguggccgaugucugcaccgacuguaaguucaacugcgggagcauugaacgccaccagaaaagacaccugaugcgggugucucaggauugggagcaucuuauccgcuacagaaaucagaucugucuguccuga

SEQ ID NO: 66615 - RNA, 846 nt, Artificial Sequence
  derived and/or modified sequence opt5 from C15orf41__Homo_sapiens__XP_011520412
augauccugaccaaggcccaguacgacgagauugcucaaugccucgugagcguucccccuacaagacagucccugcggaaacuuaagcagcgcuucccgucucagagccaagccacgcugcucuccaucuuuucucaggaauaucagaaacacauuaagagaacccaugcgaaacaccauacaagcgaggcuaucgaauccuacuaucagcgguaccugaacggcgucgugaagaauggggccgcccccgugcuucuggaucucgcuaacgaggucgacuaugccccuucucugauggcucgccugauucucgaaagauuccugcaagagcacgaggaaacacccccuagcaaguccaucaucaauagcaugcuucgggaucccucucagauuccugacggagugcuggccaaccagguuuaccaguguaucgugaaugauugcuguuauggcccgcucgucgacugcauuaaacaugcgaucgggcacgagcacgaagugcugcuucgcgaucugcuccuggagaagaaccuguccuuucucgacgaggaucaacugagagccaaaggauacgacaagacccccgauuucauucuucagguuccuguggcugucgaaggccauaucauucacuggaucgagagcaaagccucuuuuggggacgaauguucccaucacgcuuaccugcacgaucaguucuggagcuauuggaaucgguuuggacccggccucgugaucuacugguauggcuucauucaagagcuggacugcaaccgcgaaagagggauccuucugaaggccuguuuuccuaccaauauugugacacucugccauucuaucgcguga

SEQ ID NO: 66616 - RNA, 252 nt, Artificial Sequence
  derived and/or modified sequence opt5 from C15orf48__Homo_sapiens__NP_922946
augagcuucuuucagcugcucaugaagagaaaagagcugaucccccuuguggucuucaugaccguugccgcuggcggggccuccucuuuugcgguguacagccuguggaagacagacgugauucucgaucggaaaaagaacccugaaccgugggagacggucgaccccaccgugccucaaaaacugaucacaauuaaucagcaguggaagcccaucgaggaacuucagaacguucaacgcgugaccaaguga

SEQ ID NO: 66617 - RNA, 540 nt, Artificial Sequence
  derived and/or modified sequence opt5 from C15orf53__Homo_sapiens__NP_997327
auggagcugcagggcgcccaagaagaccucgggaucagccuguccucucccagacggaaccacgagacccgcccuggaagcaaggcuaaaggcagauccucuauuugccuucaggccagcguguggauggcugggggaaagcugcggcuccgcgcguccgaacaucugacacagggccaccagcaagagcuuagagauuggaaucugggggaagacgccucucuccuguucagcaaauccccguuuggagccggcaagcugauccaggcucccgcccaugucuuccggcaguguuggguucagggcaacgcuuggauuagcugcaucacgaaauuugauucuaagcgcuccccugagguggccagcucucccuccuaccucaccgugccuagacggagcccccugccugucuuccuucgcccgucugacagaugugugugcgggggauguuaucugggcaaguccacacggcgcagagcgugccaaagccuccuguccgauccccuugggguuaccuuuccuacacagacccggcccuga

SEQ ID NO: 66618 - RNA, 882 nt, Artificial Sequence
  derived and/or modified sequence opt5 from C15orf59__Homo_sapiens__XP_005254426
augaacaucagaggcgcccccgaccuggggcagccuagcgaugacccguccucuggaggcgagcgggaacgcauuagacaacggaugaagauggugaucgggcagcucgaggggauucugcgcgaacuuaaagaggucgcuaaggaacugagagagguugugagccagaucgauaaacucaccuccgacuucgauuuugagcuggaacccgacgauuggacaacggccaccgugucuagcacauccucuagcgacaaggcgggcaugggaggaccuuucgaucuuggccaccuggacuuuaugaccgcugauauucucuccgacagcugggaguucugcucuuuucuggaugucuccacacccagcgacucuguggacggcccugaauccacccggcccggggccggaccugauuaccgccugaugaauggcgggacaccgauccccaacggaccuagaguugagacccccgacuccucuuccgaggaagccuucggcgcugggccuacggugaaaagccagcucccccaacggaccccgggaacacgcgagagaguccgguuuuccgauaaggugcuguaucaugcccuuuguugcgacgaugaagagggcgacggcgaacaggagguugaggaagaggaaguggggcugccucccgagccugcucacaccgaagcccaugcgggaccccacaagcccucuccugccccguacaaaagccgcagaagcccccucacaagccggcauucuggcuccacccuggcuccugagcagacgcgcagagucacacggaauagcucuacccagacagugagcgauaaguccacccaaaccgugcuucccuauacagccacgagacagaaagcucgcgggaagaacuga

SEQ ID NO: 66619 - RNA, 828 nt, Artificial Sequence
  derived and/or modified sequence opt5 from C16orf72__Homo_sapiens__NP_054836
auggaggaaagaaaggaggaaggcgaggccgaaauccaggagcacgggcccgagcauugguucagcaaaugggaacggcaaugccuggcugaggccgaacaggacgagcagcucccuccggagcugcaggaagaggcggcugccgccgcucaacccgaacacaagcagcagaaacuuuggcaucuguuucagaacuccgccaccgcuguggcccaacucuacaaggaucgcgucugucagcagccuggacugucucuuuggguucccuuccagaaugcggccacagcugugacgaaccuguauaaagagagcguggacacccaccaaagauccuuugauauuggcauccagauuggguaccagcggcgcaauaaggacguccucgccugggugaagaaaagacggcgcacaaucagacgggaagaucugauuucuuuccugugcggaaagguuccucccccucgcaacagcagagcuccgccccggcucaccguggucuccccuaaucgcgccacaucuaccgagacaagcuccagcguggagaccgaccugcaacccuuuagagaagcgaucgcccuucauggccugucuggggcuauggccuccaucagcguucggucuuccacgccuggaagccccacccacgugucuuccggcagcaacgcuucccgcagacggaauggccuccacgaugucgaccugaacacauucauuucugaggaaauggcccuucaucuggauaaugggggaaccagaaaacgcacaagcgcccaguguggcgacgugaucaccgauuccccgacgcacaagcggaacagaaugauuuga

SEQ ID NO: 66620 - RNA, 231 nt, Artificial Sequence
  derived and/or modified sequence opt5 from C16orf74__Homo_sapiens__NP_996850
augggccugaagaugagcugccucaaaggguuccagauguguguguccucuagcuccucuagccacgacgaagcccccguccugaacgauaagcaucuugacguuccugauaucauuaucaccccgcccacaccuacgggaaugaugcugcccagagaccucggcuccaccguguggcuggaugaaacagggucuugcccugacgauggagagauugaccccgaggcuuga

SEQ ID NO: 66621 - RNA, 798 nt, Artificial Sequence
  derived and/or modified sequence opt5 from C16orf78__Homo_sapiens__NP_653203
augagcgagcagcaaauggaccugaaggaucucaugcccaccaaaagaaaguacauguggaaaacagccgaagaccggcgcauguccgaucugacgugcgugcuugaguggcuggaaagacggcagggcaagaaaaagcaggcuccugagaagcagaaaccgaaggucguuaccgugcucaaacgcaacaagaaaaaggaagagaagaaagggaagggacugaugacagccagaggcgggaaucggcgcgacaccgagacaucucaacaggcgcuuggaaaaagauuccggaaggaugcugccagcuaucgcucccuguacggcguggaacagaaagggaagcaccucucuaugguccccggaagcuauaucaaagacggcccuaagaaguccgauaccgacauuaaagaugccguggaccccgagucuacacagagaccuaaccccuuucggcgccaaagcaucguucuggauccuaugcugcaggaaggcaccuucaauucccagagagcuacguuuauucgggacuggagcaacaagaugccggauauggccuacgagcgcaaacucaagucucugauggagaaauccaccgaacccaagauggagacaaugagaaugcuuaagccugaagaggugcugagcugucgguaucucagacugucuaaagaaaauauccgcacccuucugaagcucugcaaagacgcugggaugaacgucgacauucauccccacaugguggaggaggauaucgacgccaagaaaguuuucacaggaaucccuuccauggcgcuguga

SEQ ID NO: 66622 - RNA, 720 nt, Artificial Sequence
  derived and/or modified sequence opt5 from C16orf95__Homo_sapiens__NP_001182053
augagagccagccggucucccccuuccccgcgcagaugccaccaucaccaugaggcuaccggcgccgcgagcggggcugccgccggaggccccggggcuggaugugugggccugugccggcucgcccugacaccuuccgcucaggacgggcgcaacucuacguuccaaaccuacaagaaagaagucugucuucccagacacagcaugcauccuggacccugggccaucugcugugagugccagacacgguuuggcggccgccugccuguuuccagaguggaagcggcccucccguauugggugccccugucucuucggccucgcaagcagagccagaaaaccguccaauuccccauuccucagacagcuaagaugugucccugccugugucacagauuugggggacggcucccgaugccucgcgaucaggccgugaugcccuacuggguuccucaggugcugagaucccaacagcagaucguccggcgccagcaaagccugaaaggcauucaggcuccccuccuggacgccugcuguuggcacaauugcuggagaaucugcggggaugagugucuucugucuaaguuccagcaacuccaggcgcccuaucaggaccagcugccugccccggcugcccggcuucugccccucggacugcugacccuccugcaagcuauuccuagagugaucauggccauccgccagugcuuuggcguuuga

SEQ ID NO: 66623 - RNA, 666 nt, Artificial Sequence
  derived and/or modified sequence opt5 from C17orf51__Homo_sapiens__NP_001106905
augggcgaaaagagcagacggaaagggcccgccccucgccacgcugacggaaagcugggcagaaccugcgaucauccguacgcccccugguccuucacaccuucuagccgggcgcccacggcuugggugcgcccucccuguccugucugggccuccagacuccaggagcacucuccggagccccggcgcgccagagcuccucccacccggcgcgcccaagcugcccuguaugcgccugcccuuagacugcgggaccaucucgaucgcuuuagcauccugaugacauccugcaccucuuggcuucaggcuccccaggccccggggcuguguagagacgaacagagcucccggauuagcguuccucaacucucuggagcucccauccugcugccugaucucgagggcacaaaacuguccaacuuccaggaaagcucuccccuuccccacaagcaugagcgcaaagacaagagauccaccccugaggaagaggggcggagcgccccggaaaagauuauccagucucugaaacucugccccggaggccacagaccugcgucccugagcuccggcugucccgccgggugccgccuuucuuuuaaucugccucccagcaugcuccuguccgugcagaaguguugcaugccgagcucucugaaaacauguuga

SEQ ID NO: 66624 - RNA, 1944 nt, Artificial Sequence
  derived and/or modified sequence opt5 from C17orf53__Homo_sapiens__NP_076937
auggccugcagccugcagaagcucuuugcuguggaggaagaguuugaagacgaggauuuccuguccgccgucgaagacgcggagaacagauuuaccggcucucuucccguuaaugcugggcggcugcgcccugugagcuccagaccgcaagagacagugcaggcccagucuagccggcuccugcuucugcaccccacggccccuuccgaagcucucggacugcccgaucuggaccucugucugccugccucuagcacccccuccgcugauagccgcccuucuugcaucggcgccgcgccgcuuagacccgucuccacaucuagcuccuggauugggaaccagcggcgcgugaccguuacagaggugcugagagaaaccgcccggccucaaagcucugcucuccauccccugcuuacauucgagucccagcagcagcaagucggaggcuuugaggggccugaacaggacgaguucgauaaagugcuggccagcauggaacucgaggaacccggaauggagcuggaguguggcguuuccucugaagcuaucccgauucugccugcccagcagcgcgagggcagcgugcucgcgaagaaagccagagucguggaccuguccgggagcugccaaaagggacccgugccugcuauccacaaagccggcauuaugucugcucaggaugaaucccuugaccccgucauccagugucggacgccccgcccuccgcugagacccggggccguuggacaucucccugugcccaccgcccugaccgugccuacacaacagcuucacugggaggucugcccccagcggagcccggugcaggcucugcaaccucuccaggcggcccgcggcaccauccagucuagcccccagaauagauuuccuugucaacccuuccaguccccuucuagcuggcuguccgggaaggcucaucugccccggccgagaacaccuaacagcucuugcuccacccccagccgcacgucuuccggacucuuuccccggauuccucugcagccgcaggcccccguuagcuccaucggcucuccugugggcacacccaaggggccucaaggagcccuucagacccccauugucacaaaucaccuggugcagcucguuaccgcugccagcagaaccccucagcaacccacacacccguccacgcgcgcgaaaacccggagauucccuggccccgcugggauccugccucaucagcagucuggacgcagccuugaagauauuaugguguccgcuccccaaacaccgacccacggcgcccuggccaaguuucagacagagaucgucgccagcucucaggcuuccguggaggaagacuucgggcggggaccuuggcucaccaugaaaagcacgcugggccuggaugagagagaccccucuuguuuucucugcacauacuccauugucauggugcugcgcaagcaggccgcgcuuaaacaacugccucggaacaagguucccaauauggccgugaugaucaagagccucaccagaucuaccauggacgcuagcgucguguucaaagaucccacaggcgaaaugcaggggaccguucaucgccugcugcuugagacaugucagaacgaacucaagccuggauccgugcugcugcucaaacagaucggcgucuucagcccgucucugcggaaucacuaucuuaacgugacgcccaauaaccuggugcacauuuacuccccugacagcggggauggauccuuucucaagcccucucaaccuuuccccaaagacagcggcuccuuucagcaugauguugccgcuaagccugaggagggguucagaaccgcccagaaucuggaagcggaggccucuccggaagaggagcugcccgaagcugacgaucuugacggccuccugagcgagcugccugaagauuucuucugcggaacauccucuuga

SEQ ID NO: 66625 - RNA, 711 nt, Artificial Sequence
  derived and/or modified sequence opt5 from C17orf64__Homo_sapiens__NP_859058
auggaggccagcgacggccagggaggggaaggcgauaagccccuggagcaagugaccaacgucuccugccucgaaacaucuagcuccgcuucuccugccagagacagccugaugcggcacgcgaaagggcuugaucaggacacguucaagaccuguaaagaguaccugcgcccgcucaagaaauuucugagaaaacuucaucugccccgggaucucccucagaagaagaagcugaaauauaugaagcagucccugguugugcucggagaccacaucaauacauuccugcaacauuacugccaggcuugggaaauuaaacacuggcgcaagaugcuuuggagauuuaucucucuguucagcgagcucgaggccaagcagcugcggcgccuuuauaaauacaccaaguccagccagcccgccaaauuucuggugacauucugugcuucugaugccccugaaagaucccuccuggcugaccgggaggauagccugcccaagcucugccaugccuggggccugcacucuaacauuuccgggaugaaagaacgccuuagcaauaugcaaaccccuggacagggcucuccgcugcccggccagccuagaucccaggaccacgucaagaaagauagccuccgggagcugucccaaaagcccaaacuuaagcgcaagagaaucaaagaggcgccugaaacacccgagaccgaaccguga

SEQ ID NO: 66626 - RNA, 1140 nt, Artificial Sequence
  derived and/or modified sequence opt5 from C17orf96__Homo_sapiens__NP_001124149
auggagacccugugccccgccccuagacucgcugugccggccagcccccggggcuccccuugcucucccacaccucgcaagcccugcagagggacgcaggaguucagcccucugugucuucgggcgcuggcuuuuugcgcccucgccaaaccgcgcgcuuccucucugggacccggcccuggggaacuugccgcuagaagccccguccugcggggaccucaagcgccccuccgcccgggcgggugggccccugacggacugaagcaccugugggcccccaccggcagaccuggcguucccaacacagcugccggggaagaugcugacguggccgcguguccccggcgcggagaggaagaggagggcgggggaggcuucccucauuuuggggugagauccugcgccccgcccggacgguguccugcucccccucacccccgcgaaucuaccaccagcuucgccuccgcuccgccuagacccgccccuggccucgagccccagcggggcccugccgcuucucccccgcaggaaccuagcucccgcccucccucucccccggcggggcugagcacagagcccgccggaccuggcacagcucccagaccuuuucuucccgggcagccugccgaggucgauggaaaucccccgccugccgcucccgaagccccugcggcuucccccagcaccgccucuccggccccugcugcccccggcgaccugcggcaagagcauuucgauagacucauccgccgguccaaacuguggugcuacgcuaagggguuugcccuugacacgccuagccugagacgcggacccgaacggcccccugcgaaaggcccggccagaggcgcugccaagaagcgccggcuccccgcuccucccccuagaaccgcccagccccgccggccugcgccgacacugcccaccacauccaccuucucucugcucaacuguuuuccuugucccccugcccuggugguuggggaggauggagaccuuaaacccgcuagcucccugagacuccagggcgauagcaagccgccucccgcccacccccuguggcgcuggcagaugggagggccugcugugcccgaaccuccgggccuuaaauucugggggauuaauauggacgagucuuga

SEQ ID NO: 66627 - RNA, 1602 nt, Artificial Sequence
  derived and/or modified sequence opt5 from C18orf54__Homo_sapiens__NP_001275909
auggccaagagcaaaaccaagcacagacugugcucccaggagucuagcguguccgcucuccuggccucuuguacacuuagcggcuccaacucuagcaauuccgacgggagcuuccauuacaaagauaagcuguaucggucugcgucccaagcucuccaggccuacaucgacgauuuugaccugggacagauuuaucccggcgccagcacggggaaaaucaacauugaugaagacuucaccaauaugucucaguuuugcaacuacaucuauaagccuaauaacgcuuucgagaaucuugaucacaagaaacauuccaacuuuauuagcugucgcagacacacagucaaugacaucgauucuaugucccugaccacagacgaucuccugcggcugccggccgacggcagcuucuccuacaccuauguuggacccucucaucgcacaagcaagaaaaacaagaaaugcagagggcggcucggaucccuggauaucgaaaagaauccucacuuucaaggccccuacaccagcaugggcaaggacaacuucgugacgccugugauucgcucuaauaucaacgggaaacaguguggaagacuuaagaaucccaaacugaugaaccggaccaacaauugcauuuccgagagcucucucagcuuuccuaagaaauccucuuucaaggacagcuccgaacacagccuggagaaaaacuacccgcgcuggcuuacaucucagaaguccgaucugaaugucagcggcaucaccucuauucccgacuuuaaguauccuguguggcuccauaaccaggaucugcugcccgacgcuaauucccaaagaguuuaccagaucuucaaagaugaccaguguagcccucggcacucccaucaggcccaagggacaucucgccucauuaacaagcuggauugcuuugaguaugcguucgaacccagcaauuucuccaacucucuuagcgacgauaaagagcuggugaaugaauacaagugugacuuugagcacucccagugccagugugagaacccgcuccugccuggacaaagcaccaaacccuucucuggcgauaagaucgaacuucugauccucaaggccaaaagaaaucuggagcagugcacggaggaacugccuaaguccaugaaaaaggacgacagccccugcucucucgauaaacuggaagcugaccgguccugggagaacauucccgucacauuuaagagcccugugccgguuaauucugaugacagcccccagcagaccucccgcgccaagagcgcuaaaggggugcuugaggauuuccugaacaaugacaaccaaucuuguacacucuccggaggcaagcaccauggcccugucgaagcccugaaacagaugcuuuuuaaccugcaggcggugcaggagagauucaaucaaaacaagaccaccgaucccaaagaagagaucaaacaggugagcgaagacgauuuuuccaagcuccagcugaaggagucuaugauuccuaucacacggagccugcagaaggcccuccaccaucuguccagacuucgcgaccuggucgaugacacgaauggggagcggucucccaaaauguga

SEQ ID NO: 66628 - RNA, 1686 nt, Artificial Sequence
  derived and/or modified sequence opt5 from C18orf8__Homo_sapiens__NP_001263271
augggcgaggaagacuacuaucuggagcucugcgaaagacccgugcaguucgagaaggccaacccugucaauuguguuuucuucgaugaagcuaacaaacaaguguuugccgugcggagcgggggagcgaccggcgucgugguuaaggggccggacgaucgcaaucccaucuccuucagaauggacgauaaaggagaggugaagugcauuaaauuuucucuggagaacaagauccuugcuguccagcggacaagcaagacggugguucugccugaaaaacgcucccucaagcugcuuaaaucucacaaucugaacgugaauugguacauguauugucccgagagcgccgucauucuccuguccaccacagugcuggaaaacgugcuccagccuuuccauuuuagagccggcaccaugucuaagcugcccaaauucgagaucgagcuuccugcugcccccaagagcacaaagcccucccugagcgaacgggacauugcuauggccaccaucuacgggcagcucuauguccuguuucuucgccaccauucuagaacauccaauagcaccggagcggagguugugcuguaccaccucccucgggaaggcgccugcaaaaagaugcauauccugaaacugaaccgcacgggcaaguucgcucucaauguggucgauaaccuggugguugugcaccaccaagacaccgagacaucugucauuuuugauaucaaacuuagaggggaauuugacggauccgugaccuuucaucaccccguucugccugcccggagcauucagcccuaucagaucccgauuacaggcccugcugccgugaccucucagucccccgucccuuguaagcucuacagcuccucuuggaucguguuccaacccgauauuaucaucagcgcgucccagggguaccuguggaaucuucaggucaaacuggagcccauugugaaccuccugccugacaagggacgccugauggauuuccuccugcagagaaaggagugcaaaaugguuauccuuagcguguguucucaaaugcuguccgaaagcgaccgggccucucucccggucauugcuacgguguuugacaagcugaaucaugaguauaaaaaguaccuugaugccgaacagagcuaugcuauggccguugaggccggccagucccgcucuagcccccugcucaaaagaccugugcggacacaagcuguccuggaccaguccgauguguacacccacgugcugagcgcguucguugaaaagaaggagaugccccacaaauuugucaucgccgugcucauggaguauauuagaucucugaaccaguuccagaucgcugugcaacauuaccuucacgaacuggucaucaagacacucgugcagcauaaccuguuuuauaugcugcaccaguuccuucaguaccauguucucuccgacagcaaaccucuggccugccugcuccugucucuugaguccuuuuacccgccggcccaccaacugagccucgauaugcugaagaugcugcagucccgccuuaaaaccaccuguuucucuauucaguauagcgcuuuucucaauuccgaaacaucugugugcgagggggccccuaucagccaccagggaaacacggucaagaauaugcugcuguucuccaaccgguuucucgaaaccaagcuguga

SEQ ID NO: 66629 - RNA, 459 nt, Artificial Sequence
  derived and/or modified sequence opt5 from C19orf12__Homo_sapiens__NP_001026896
auggagagacucaagagccacaaacccgccaccaugacaaucaugguggaagacauuaugaagcugcugugcucccuuucuggcgagcggaaaaugaaggcugccgucaaacauagcgggaagggagcgcugguuacgggcgcuauggccuucgucgggggacucgugggcgggccuccgggacuggccgugggcggcgcuguugggggacuucugggcgccuggaugaccuccgggcaguuuaagcccgugccucaaauccucauggaacugcccccugcugagcagcagcgccuguucaacgaagccgcggccauuaucagacaccucgaguggacagaugcugugcagcugaccgcccuugucaugggaucugaggcucugcaacagcagcuccuggccaugcuugugaauuacguuacaaaagaacugcgggcggagauucaguaugacgauuga

SEQ ID NO: 66630 - RNA, 648 nt, Artificial Sequence
  derived and/or modified sequence opt5 from C19orf18__Homo_sapiens__NP_689687
auggacaaggugcagagcggcuuccugauccucuuucuguuccuuauggagugccaacugcaccucugucugcccuacgccgaugggcuucauccuacaggaaacauuacaggccugccgggguccaaaagaucucagcccccucggaauaucacgaaggaacccaaagucuuuuuccacaagacccagcucccuggcauucagggagcugccagccgcuccacagcggcuucucccaccaacccuaugaaauuucugagaaauaaggccaucauucggcaucgcccggcccugguuaaggugauccucaucagcuccguggcuuucucuauugcccugaucugcgggauggcuauuagcuauaugaucuacagacuugcccaagcggaggaacggcagcagcuggagucccucuauaaaaaccugcgcauuccccuucugggagacgaagaggagggcagcgaagaugagggcgaaucuacacaccuccugccugagaaugagaacgaacuggagaaguuuauccauuccgucauuaucagcaaaagaucuaagaauaucaaaaagaagcucaaagaggaacagaacuccgugaccgaaaauaagaccaaaaacgccagccacaaugggaagauggaggaccuguga

SEQ ID NO: 66631 - RNA, 399 nt, Artificial Sequence
  derived and/or modified sequence opt5 from C19orf24__Homo_sapiens__NP_060384
augggccccagagugcugcagccuccgcuccugcuucugcuccuggcccuucugcucgcugcccugcccugcggggcggaggaagcuagcccucugcggcccgcccaagucacccucuccccucccccugccguuacaaacggaucucagccgggcgcuccccacaauagcacgcauacccgcccucccggggccuccggaucugcucugacacggagcuucuacgugauccuuggcuuuugugggcugaccgcccucuauuuccugauuagagcguuucgccuuaagaaaccucagagacggcgcuacggacugcucgccaacacagaggaccccaccgaaauggcuucccuggauucugacgaggaaacaguguucgagagcagaaaucugcgguga

SEQ ID NO: 66632 - RNA, 1362 nt, Artificial Sequence
  derived and/or modified sequence opt5 from C19orf26__Homo_sapiens__NP_689982
augcagcccaccgccacaauggcuacggccgcgaccacaaccacaaccacaaccgcuacgguggcccugaccacaagcugggacaacgccaccggcagaccuacagcugagccggaucccauccucgacaauuacguccugcuuguuguggugaugucccuguucgucgggggaacccucgugguucugucuggcgugcuucugcucugcaagcgguguugggauguccaccaacgccugaacagagccauggaagaggcugagaaaacgacaaccacauaucuggacaaugggacccauccugcccaggaucccgacuuucggggagaagauccugaaugccaggacgcggagaccgagcgcuuccucagcacauccucuacgggcagacgggugagcuuuaacgaagccgcucuguucgagcagucccgcaagacccaagauaaagggagacgguacacacuuaccgaaggagacuuucaccaucugaagaaugcccgccucacacaucugcaccuucccccucugaaaauuguuaccauccacgagugugauucuggcgaggcuagcuccgccacgacaccgcaccccgcgaccagcccuaaggccacccucgcuauuuuccagcccccuggcaaggcccugacagggagaucugugggacccuccagcgcucugccgggcgacccuuauaacucugccgccggggcuaccgauuuugcggaaaucucccccagcgccucuuccgacagcggagagggcacaucccucgacgcugggacgcggucuaccaaagccggaggcccuggcgccgcugccgggcccggagaagcgggccccgggagcggagcuggcacaguccugcaguuccuuacccgccugagacggcaugccucccucgauggggccagcccuuacuuuaaggugaaaaaguggaaacuggagccgucucagcgcgcugccucccuugacacaagaggaagccccaagcggcaccauuuccaaagacagcgcgcugccucugaaagcaccgagcaggaggaaggcgaugcgccucaggaggacuuuauucaauauaucgcccgggcuggcgaugccguggcuuucccccacccuagacccuuucuggccuccccgccucccgcgcucgggcgcuacuucucugucgacggaggcgccagagggggaccuguuggccccugcccucccagcccgccuccccggcgcccccgggaaagauccccugggccgguggauacgcgcagccccgcuucuuccggcaaggccccuccccggggaggccugaccggggcuacaagcccugccuggaccagaggaggcaaacagggggagacaggauga

SEQ ID NO: 66633 - RNA, 321 nt, Artificial Sequence
  derived and/or modified sequence opt5 from C19orf33__Homo_sapiens__NP_277055
auggaguucgaccugggcgccgcucucgaacccaccagccagaagccuggggugggagccggccacgggggagauccgaaacugucuccccauaagguccaaggcagauccgaggcgggggcuggaccuggccccaaacagggccaccauagcuccucugacagcuccucuagcuccagcgauucugacacagauguuaagucccacgccgccgggagcaaacagcaugaaucuaucccuggaaaggcuaagaaacccaaggugaaaaagaaagagaagggcaagaaagaaaaggggaaaaagaaagaggccccucacuga

SEQ ID NO: 66634 - RNA, 648 nt, Artificial Sequence
  derived and/or modified sequence opt5 from C19orf40__Homo_sapiens__NP_689479
auggagaagaaucccccugacgauaccggcccggugcacgucccccuggggcauaucguugccaacgagaaauggagaggaagccagcucgcucaagagaugcagggcaagauuaaacugaucuucgaagacgggcuuacaccugauuuuuaccuguccaaccggugcuguauucucuaugugacggaggccgaccugguggcgggaaauggcuaccgcaagagacuuguccgggugcgcaacucuaauaaccugaaagggaucguuguggucgaaaagaccagaaugagcgagcaguauuuccccgcucuccagaaguuuacagugcuggaucugggaaugguucuccugccuguggccucccaaauggaggccucuugccuugucauucagcuggugcaggaacagaccaaagagcccagcaagaauccucuccugggcaaaaagcgggcccuucugcucuccgaaccgucucugcugcgcacagugcaacagauccccggcgucgggaaaguuaaggcuccucuccugcuucagaaguuccccagcauccagcaacuguccaacgcuagcauuggagagcucgaacagguggugggccaggccgucgcgcaacagauccacgccuuuuucacccagccuagauga

SEQ ID NO: 66635 - RNA, 1518 nt, Artificial Sequence
  derived and/or modified sequence opt5 from C19orf45__Homo_sapiens__XP_011526294
auggccaccggcgcucugcuccccugcagcagaccuuguccgaugucccggcuggacuuccuuaaggccucucacuuuagccuggggcccgaucuccgccugcaugagggaaccaugagaacgaccucccaccgggacuucgcguacccugcugccacacgcgaacccccuucucuucagcccccuccggcccugcucuuucccauggauccuagaugggaccgggaggaacgcgugagcgaggcucauagagccuuucccccucccuccaccccgccuugggaacugcugcaagcucaggcccgggagcgcacacucgcgaugcaggccggcaaccugcaccuucaugaggaugcucacgccgggaucggacugucuaaugcucacgccgcguauggcuggcccgaacucccugccagaacccgggagcgcauuagaggggcucggcugaucuucgaccgcgauagccuuccucccggagacagagauaaacugcggauucccccgacaacccaucaggcccucuuucccccucacgacgcuagaccccaaccucgcgcccccuccugccaucugggcggcccgaacacgcugaagugggauuacacccggcaggacgggacaagcuaucagagacaguuccaagcccucccuggacccccugcucugcgcuguaaacgggcgucuuccggcgucgaacuuggggauugcaagaucagcuacggaucuaccuguuccgagcagaaacaggccuauagaccccaggaccugccugaggaccgcuacgauaaggcucaagccacagcccacauucacugcguuaauauccggcccggcgacggacucuucagagaucgcaccacgaaggcugaacauuuuuaugcccgggagccggaaccuuucgugcugcaccaugaccagacacccgagagccacauccuuaaagggaacuggugucccggcccuggcucucuggauaccuuuaugcaguacuucuacgggcaaccgcccccucccacacagccucccuccagacaugugccucacgaaaagcuccagagccacgucacccugggagagcccaaacugcucaagcgcuuuuucaaaaccacaaugggcuccgacuauugcccgucugaguggagacaggugcaaaaggcgccuaaucugcaucuucagcagagcuaccugccccgggggacgggagaguucgauuuucucaccaugaaccagaagaugcugaaaccucaccggacacccccggcuccuguuaccgaagaaaugcuucaacgcuguaaguauucccauauggagcccccucugggcgggcucagauucuuuagcacacaguacaaagacgaguuccccuuuaaguaucagggacccgccgcccugcggcugaaaaauccucaggaaggcuucgugccgcucggcacaccccaccaaagagggugccgcgagaagauugauccucuggucccccagccucccauguaccuuuguccuucucagcaguga

SEQ ID NO: 66636 - RNA, 354 nt, Artificial Sequence
  derived and/or modified sequence opt5 from C19orf48__Homo_sapiens__NP_001277083
augaccgugcuggaggccguccucgaaauccaggcuauuacaggcagcagacugcuuuccaugguucccgggccugcccggccgcccggaucuugcugggacccuacgcaauguacccgcacauggcugcucagccacacccccagacggcgcuggaucuccggccugccuagagcgucuugccggcuuggggaggaacccccuccgcugcccuacugugaucaggcuuauggagaggaacucagcauucgccauagagagacaugggccuggcugucccggaccgacacagccuggccuggcgcucccggggugaagcaggcccgcauccugggagagcuccugcuuguguga

SEQ ID NO: 66637 - RNA, 1914 nt, Artificial Sequence
  derived and/or modified sequence opt5 from C19orf57__Homo_sapiens__NP_077299
augaccaagcggaaaaagcugagaacaagcggcgaggggcucugucccccuaaaccgcugaagaacccccgccuuggagacuucuacggcgacccucaguccucuaugcuggggugccuccaccaucccgaagaaccugaaggaaaacugggccccgugccuagcacgcaacagcacggggaggaaccgggaaaggccgucuccucuagccccgacgaggagaccggcuccccuugcagacuucugcggcagcccgaaaaggagccugcuccccucccgccuucucagaauagcuuuggccgcuucguuccccaauuugccaaauccagaaagacagugacccggaaagaagagaugaaggaugaggaccgcgggagcggagcguucucucuggaaacaaucgcugaguccagcgcccagucuccuggcugucagcugcucguggaaacccugggggucccccuucaggaggccacagaacugggagaucccacccaagcugacuccgccagaccugagcagagcucucaguccccggugcaggcuguucccggcagcggggauucccaaccugacgaucccccugaccggggaacgggccucucugccagccagcgcgcgucccaggaucaucugagcgagcaaggcgccgacgauucuaaacccgaaaccgacagagugccgggggacggaggccagaaggagcaccuuccuuccauugauagcgaaggggagaagcccgaccggggagcuccucaggaaggcggggcccagcgcacagcuggagccggccugcccggcgggccucaagaggagggagauggcguccccugcaccccggcgucugccccuacaagcgggcccgcucccggacucggcccugccuccuggugucuggaaccggggucuguggcucagggcagccccgacccucagcagacccccuccagaaugggacgggagggcgaagggacgcauagcucucugggaugcuccagccucggcaugguugugaucgccgaucugucuacagacccuaccgagcuugaggagcgcgcccuggaggucgcugggcccgauggacaagcguccgccauuagcccugcuucccccagacggaaagccgccgacggcgggcacagacgcgcucucccgggcuguacaucucugaccggagaaaccacaggcgagagcggggaagccggacaggauggcaagccucccggggacgugcuugugggaccuacggcgucccuggcucucgcccccggcucuggggagagcaugaugggcgccggagauuccggccacgcuagcccggacaccgggccuugcgucaaccagaaacaggagcccggaccugcccaagaagaggcugaacugggcgggcagaaucuggagcgggaccucgaaggauuuagaguuucuccccaggccuccguggugcuggagcaucgcgagaucgcggaugacccccuucaggaaccuggcgcccaacaggggauuccggauacaaccagcgagcuggcuggccagcgggaccaccucccccauucugccgaucaaggaacaugggcugacucccuggccgucgaacuugauuuccugcucgacagccagauccaggaugcgcuggacgccucugauuuugaggcuccucccgaacagcuguucccuagcggcaacaagcccgggccuuguuggccgggacccuccagccacgccaauggcgacccuguggcuguugccaaagcccaacccucuagacucaucauggggacccaccgcgaucuggaggcuuuuaagcggcuuaacuauagaaaaacgaagcugggaggcaaggcgccucuccccuacccguccaaaggcccugggaauauuccccgcggagaucccccuuggcgggagcuguga

SEQ ID NO: 66638 - RNA, 2763 nt, Artificial Sequence
  derived and/or modified sequence opt5 from C19orf68__Homo_sapiens__NP_955373
auggagagacccgaaccuccgcccggcaccgccgcugggcaggaggaacaagagcugcgggaacgcgccuucuuuagcugggcggaguucuccagauuuuucgacgcuuggugccagcagcggcucgcccuguuuuucgugaagucuagcaugcaccuugcccgcuguagaugggcuuccgccccuccccuguacacacucaucgauguccugaaauauucuuacguucggcuugugugcaaggacgugcgcgcuccuagcagacccgccgucggaccuccgcagcccggcuguccugcguuuauuaucgugaaacugucuccccuccgggaucgccugguugugacggagugccaacugacccauucccacccugccuguccccucgaauuugcuuauuacuuuagaccggggcaucugcuugccaacgcuugccugccuguccggacaaccaauaagauuagcaaacaguucguggcccccgcggacguucgcagacuccuguccuauuguaagggacgggaucacggcgugcuugacgcccugcauguccucgaggggcuguuucgcacagauccugaagcuaaggugaaacugguguucgucgaggaccaggccguuguggagaccguguuuuuccucacaagcagaacccgggcucugcuuagacgcuucccccggaugcugcucgucgauagacugcccggacuucagggcgcccuggaccuccuggccgugcugugcguugauggcucugggcgcgcucggcaagcggccuguugcguggcuagaccuggaacgccgucccuccugcgcuuugcccuugccagccugcuccagucugcucccgacgucaagggccgggugagaugucugaccgccgggccugaaguugcggcucagcuucccgccgugcgccagcugcucccuugcgcccggguccaaaucugcagagcucagggacuggagacacuguucuccaaagcccaggaacucggcggggcuggacgcgaggaucccggccuguggagccggcuuuguagacuggccggcgcgucuuccccggccgcuuacgacgaagcccucgcugagcugcacgcccacgggccugcggccuuuguggacuauuucgagcggaacugggaaccccgcagagauauguggguccgguuuagagcuuucgaggccgcucgcgaccuggaugccugcgcccuugugcggggacauagacgcagacuccugcggcgccugagcccuuccagaggcguugcucaaugucuccgggaccugguggcgaugcagugggccgaugcugccggggaagccguccccgagggaccugacggcgggggacccuggcuugaagaugagccgggccgcggcgcucagggggagaaugaaagagugcggggacuggagaccggcgacuggggaggagccccuaaggaaggcucuauuuggcgcggggcgcagauggagaaagaaugggcuagagcccucgagacacgggauuggggcggagcccaauuugagggcgaaaaggggcgcgcucugcagaucagagacuggcggggaggcagacuggagaaccagaagccccgcgggcuugaaggaggcguucuccgggggagcaaacuggagaagggccaccugagaggacccgagauccgcgauuggcggggcccucagcucgaaggggagaaagacuggggacuggaaggcuacguguggagagggucccaacuugaggaccaggcccugcgcggacucgaaggcuacaccuggcgggucgcgcagcuggaggauagacgcagcacgacagaccugcgggggacccaguucgauuaugagagagugcggucucuugaaggcuccccguggcgcggagcucaacuccaugacgagagagccggcgggcugcggacagccgaauggaagggaccccagagcgagguggaaaaaggccgcgggcuggagguuagaaaucuccgggggauuccucuggagaagucucuugaacuggcucccgagaacggcgaucagagagggccucagugggaagacgagcgccggagaggccccgaaaucgccgaggagcgcggagcucgggucggcgugaaaagacgccgggggcucgaagauauugugcugguccaacugggagacaccagagugaccggcauggagaauggggauggaggcggcgcccgcagcguugggccuaaguccagagcgggacggggcauggaauggggagacgccgggggccgcugccuugggcucggaaacggcguggucucuggcacacccguggggacgguucuggagggaagcccggagugggcugccgcuagauccgaacaccuggccgccggcgaugggcuccaggagggaggcgaagacgggccucgggagcccaagcgccuguguagaccucccggagaagaggagguggauugggaaccgcuugcuaaauuucgggcggccugcggcccugagcuggcugaccucgucgccgaggaacuggccuucgcuagacagcacggcacccgcggguuucauuggacaggagccggcuucgcgcugaaggacgggaccagcgauuucuuccuugacggagcucugacacgguguucuugcuccauccacgccgccagacgccuccccugucggcaucuguucgcugccagacuccugaccggcgcggcucuuuuucacauggaucugcuccgggacugcugggggcgcgccccugaacccuga

SEQ ID NO: 66639 - RNA, 426 nt, Artificial Sequence
  derived and/or modified sequence opt5 from C1D__Homo_sapiens__NP_775269
auggccggcgaggaaaucaacgaggacuaccccguggaaauucacgaguaucugagcgcuuucgaaaauuccaucggggccgucgaugagaugcucaagaccaugaugucuguuagcagaaacgagcugcuucagaaacuggacccucucgaacaagcgaagguggaucugguguccgcuuacacacuuaauucuauguuuugggucuaucuggccacgcagggagugaacccgaaagagcaucccguuaagcaggaacucgagcggauucgcguguacaugaauagagucaaagagaucaccgacaagaagaaagccggcaagcuggaucgcggggcugccagccgguucgugaaaaacgcucugugggaaccuaaguccaaaaaugccucuaagguugcgaacaagggaaaaagcaaguccuga

SEQ ID NO: 66640 - RNA, 957 nt, Artificial Sequence
  derived and/or modified sequence opt5 from C1GALT1C1__Homo_sapiens__NP_689905
augcugagcgaguccucuagcuuccucaagggcgugaugcugggguccaucuuuugcgcccuuauuaccaugcugggacacaucagaauuggccaugggaaccggaugcaccaucacgaacaucaccaccuccaggcucccaauaaagaggacauccugaagauuucugaagaugagcgcauggaacuuagcaaauccuucagagucuacuguaucauccugguuaagccuaaagacgugucucucugggccgcggugaaggagacauggacgaagcauugcgauaaagcugaguuuuucagcuccgaaaacgucaagguguuugagagcauuaauauggacaccaacgauauguggcugaugaugcggaaagccuauaaguacgccuucgacaaauaucgcgaucaauacaauugguuuuuccuggcuagaccgacaaccuuugccaucauugaaaaccucaaguauuuccugcuuaagaaagaccccucucagccuuuuuaccugggacacacaaucaaguccggcgaucucgaguauguugggauggagggaggcauugugcugagcgucgaaucuaugaaacggcuuaauucccugcucaacauccccgagaaguguccugaacagggcgggaugauuuggaaaaucagcgaggacaagcagcuggcugugugccugaaauacgccggaguuuucgcggaaaaugccgaggaugcugacggcaaggauguguuuaacaccaagucugucgggcucuccaucaaagaggccaugacauaccaucccaaucaagugguggaaggauguugcagcgacauggcugucaccuucaacggccugacgccuaaucagaugcacguuaugauguaugggguguaccgccuuagagccuucggacacauuuuuaacgacgcgcugguguuccucccgcccaauggcuccgauaacgacuga

SEQ ID NO: 66641 - RNA, 1116 nt, Artificial Sequence
  derived and/or modified sequence opt5 from C1GALT1__Homo_sapiens__XP_005249869
augagcgagauccacuucagagaaauggccuccaagucuuggcugaacuuucucaccuuccugugcggcagcgcuauuggguuucuucuguguucccaacucuucucuauccugcuuggagagaaaguggacacacagcccaauguccugcauaacgauccucacgcccggcauagcgacgauaauggccagaaccaccucgaagggcagaugaauuuuaacgcggacuccucucagcauaaggaugagaauacggacauugcugaaaaccuguaccaaaaaguucgcauccugugcugggugaugaccggaccgcagaaucucgagaagaaagccaagcacgugaaggccacaugggcucagagauguaacaaaguccuguucaugagcuccgaggaaaauaaggauuuucccgccgugggccuuaaaaccaaggaggggcgggaccagcuguauuggaaaacaauuaaggcuuuccaauacguucacgaacauuaucucgaggaugccgacugguuucugaaggcggaugacgauaccuacgugauccuugacaaccugcgcuggcuccugagcaaauaugacccugaggaacccaucuacuucggaagacgguuuaagccuuaugucaaacagggcuacaugucuggcggggccggauacgugcuguccaaggaggcucucaaacgcuucguugaugccuuuaagacagacaaaugcacccacucuagcuccauugaagaucuggcucuuggcagauguauggagaucaugaauguggaagccggggacagccgggauacgauuggaaaggagaccuuccaucccuucgucccugagcaccaccugaucaagggcuaucucccgcgcacauuuugguacuggaacuauaauuacuaucccccuguggaagggcccggaugcuguucugaccuggcgguguccuuccauuacgucgauagcaccacaauguaugagcuugaauaccugguuuaccaccucagaccuuauggcuaccuguaucgguaccagcccacccugccggagcgcauucucaaagaaaucucccaggccaacaagaacgaggacacgaaagugaagcugggcaauccuuga

SEQ ID NO: 66642 - RNA, 1737 nt, Artificial Sequence
  derived and/or modified sequence opt5 from C1orf106__Homo_sapiens__NP_001136041
auggagagcaaggacgaaguguccgauaccgacucuggcaucauucugcagagcgggcccgauuccccugucucuccgaugaaagagcucacacacgccguucauaagcaacagagagcucuggaagcccggcuugaggcgugccuggaggaacuccgcagacugugucuucgggaggcugaacugacgggaacccuccccgccgaguacccucugaaacccggcgaaaaggccccuaaagugcgcagacggaucggggcugccuauaagcuggacgauugggcucuccaccgcgaggacccccugagcucccuugagagacagcuggcccuccagcugcaaauuacagaagcggcccggcgccuuugccuggaggaaaaccucucuagacaggcucggcgccagagaaagcauagcaugcugcaggaggagaaaaagcugcaagaacuccagcggugucugguggagcgcagacggaauagcgaaccuccgcccgccgcugcccuuccucugggaagagagcucagcgcgucugaugacuccagccugucugauggccuucugcucgaagaggaagagucccagguccccaaaccucccccggagagcccugcucccccuucucgcccccugcccccucagacccuggaagggcuccaaccgacaggacccgaggccggcuccccugaacgggcccccgugcagaacagcccuuggaaggagaccucccuggaccaccccuacgaaaaaccgagaaagucuagcgagccuugguccgaguccucuucccccgcuacaaccccucaggauggccccagcgccucuagccuuuggcugcucgaaccugccuccuaucauguugugcccauccgcggggucccgggacaauggcagggccggacgucugcuccugcgacccccgagauucaggggagacgcggacagagccaaucccugcggguggacagcuucagagccggccccgaagggcgcggacggucugcuuuuccuagacgccggccgacacacuacaccguuacagugcccgauuccugcuucccugccaccaagcccccucuuccccacgccgcuugucauagcugcucugaggacuccggcagcgacgucuccucuaucagccacccuacgucccccggcucuagcuccccggauaucagcuuucugcagccucucucucccccuaaaacacauagacaccgcggggccugggugcccgcgggaucccgggagcugguggcucaccauccgaagcugcuccugccucccggcuauuucccugccgggagauacgucguuguggccgaaagcccccuucccccuggagagugggaacugcggagagcugccccgggccccgcuuaugaggaagaggggaccccucuccgcuaccagcggcuggugcccucuagaucccgcauugucagaacaccuagccugaaagacucucccgccggacggggccuuagcaaggcggccguguccgaggaacucaaaugguggcacgagcgcgcuagacugcggagcacccgcccucauucucuggauagacagggcgccuuucggguucgcucccucccgcuggggagagaaggauucggccgggcucuugggccccgcgcccaagugccuaccgucugugugcugagacggagccccgacggagcgccuguucagguguuuguccccgagaagggcgaaaucauuucccagguguga

SEQ ID NO: 66643 - RNA, 798 nt, Artificial Sequence
  derived and/or modified sequence opt5 from C1orf109__Homo_sapiens__NP_001289959
augagcgagaagagacggcgccuggacgccagaaacccccucaaacaggaaaccgcucugucccggcuuccuuucccgcgcggcaaucaagggcugcuccagaaggccgaggcgggcagagcucgguggcugacacccgugaucccugcccuuuggaaaacggaagccggagggucucccgagaagaugacccaggaucgcccucugcucgcuguccaggaagcccugaaaaagugcuuucccguuguggaggagcaacagggacuguggcagagcgcucucagagacugucagccucugcuuuccucucugagcaaccucgccgaacaacugcaggcggcccagaaucuucgguucgaggaugugccggcucugcgcgccuuucccgaccucaaggaaagacugcggcgcaaacagcuggucgcuggcgauauugugcucgacaagcugggggagagacuugccauccugcucaaaguucgggauaugguguccucucacgucgagcgcguguuccaaauuuacgaacagcaugcggacacaguuggaaucgaugccgugcugcagccuagcgcugucucccccagcguggccgacaugcuugaguggcugcaagauauugaaagacacuaucggaagucuuaccucaaaagaaaguaucugcuguccagcauccaguggggcgaccucgcuaacauccaggcccugccuaaggccugggaucgcauuucuaaagacgagcaucaggaccuugugcaagauauccugcucaaugucuccuuuuuccuggaagaguga

SEQ ID NO: 66644 - RNA, 909 nt, Artificial Sequence
  derived and/or modified sequence opt5 from C1orf110__Homo_sapiens__NP_848645
auggagagacacauggugcggggccagcuguacaagcauuucgaccucgaacgcaaaaacgccaagcaagcugaggccagacuggaucagcggcuucagcgccugaaagucaucugccucuaucacguuaagcugcuuaccugggaacagagacaacugcagaaagagcuccagcggcugcagcaagcggaaacaaugaagaagaaauuuagcuccuaccuggggaauggauuccagaagcgccccgaggacgugcucguguuuucuccucagggcagacagaaacaucgggcuccgcaagccaagaaaaugcgcgcccuggcuacgagaauggcccaggauaccuguaagagcaagucccaggugcccccuucucacgacgcugggcuuaaagaucccaugaaaagcaagaagcaaccucugucccagaacaaucggacagccugcuucauuaaagagcagccccaggcgcaagaaaaggacucugucaacccuagcaaagauguugacccguccaagggaaucagcgugcccugucagaaucaggaggucucuaccaacacaauugaacagggcccuuccagcucucccgccuccgauagcgggauggcuugcgccgacgagacccgcucuaaggauguggcucucaaaccugacggaaauacaggcaagcaaauucccccgaaacauauggagugugccggcuccuuugaaggggaguucaccaagccuacguuucuggaacuucugagcaaagcgagaaacgcccacuaucuccggcaccgcguucccccugaguccgaaagacugcugucuaucggagagaucuucggccauggggagagcuccagcucucgggcuggaaaggaaugcgagaauagagugcccuccaaguuucucccccuguga

SEQ ID NO: 66645 - RNA, 2736 nt, Artificial Sequence
  derived and/or modified sequence opt5 from C1orf112__Homo_sapiens__XP_005245374
augagccaggagggcgccgugcccgcuuccgccgucccucuggaagaacucucuagcuggccggaggagcugugcagacgggaacuucccuccguucugccucgccuccugucucuuagccaacacuccgacucuuggaucgagcauauucagauccugaagauuaucguggagauguuccucccccacaugaaccaucugacccuggaacagacauuuuucagccaggugcucccuaaaacggucaagcuguuugaugacaugauguacgagcuuaccucccaagcgagagggcugagcucucagaaucucgaaauucagacaacccugcggaacauccuucagacaauggugcaacugcucggagcucugaccggcuguguucagcacaucugcgccacacaggaguccauuauccuggagaauauucagagccuccccucuuccgugcugcauaucauuaaaagcaccuucguccacuguaagaacucugaauccguguauagcgggugccuucaccugguuuccgaucuccugcaagcccuuuuuaaagaggcuuacucucugcagaagcagcucauggaacugcuggacaugguguguauggauccucucgucgacgauaaugacgauauccugaacauggugauugugauccauagccuucuggacaucugcuccgucauuagcucuauggaucacgccuuccaugcuaauacguggaaguuuaucauuaaacaaucccucaagcaccagagcaucauuaaaucucagcugaagcacaaagacaucaucaccagccuuugugaggauauucuguucuccuuucauucuugccuccagcuggccgaacaaaugacacagagcgacgcgcaggacaacgccgauuaucgccuguuccagaagacccucaagcuguguagauuuuucgcuaauucccuucugcacuacgccaaagaguuucucccguuccugagcgacucuugcuguacacugcaucaacuuuaucuccagauccacuccaaguuucccccuagccuguacgcuacccggauuucuaaagcccaucaggaggaaaucgcgggagccuuucugguuacgcucgauccccugauuucccagcuucugacauuccaaccuuuuaugcaaguggugcucgacagcaagcuggaucugcccugcgagcuucaguucccgcagugccuccugcuggucgugguuauggacaaacucccuucccagcccaaggaagugcagacccugugguguacagauucucaggucagcgagaccaccacacgcaucucccuucugaaagcuguguuuuauucuuucgaacaaugcagcggcgagcucucccugccuguucaccuucaggggcuuaagagcaagggaaaagccgagguggcugucacgcucuaccagcacguguguguccaucugugcaccuuuaucacaucuuuccaccccucccuguuugccgaacucgacgccgcucugcuuaacgcggugcugagcgccaauaugauuaccucucuccuggcuauggaugccugguguuuccuggccagauacggcacagcugagcuuugcgcccaucacguuaccaucguggcgcaccucauuaaguccugucccggcgaaugcuaucagcugaucaaccugagcauucuccugaaacggcuguuuuucuuuauggcuccuccgcaucaacuggaguucauccagaaguucucucccaaagaagccgagaaucucccucuguggcagcacauuagcuuucaggcccugcccccugagcuucgcgaacaaacgguccaugaggugacaaccguugggaccgcugaauguagaaaguggcugucccggagccgcacacucggagagcuggagucucucaacaccgugcuguccgcccuucuggcugucugcaauagcgccggcgaagcgcucgacacagggaagcagacggccaucaucgagguggugucccagcugugggcuuuccugaacauuaaacagguugccgaucaacccuacguccagcagaccuuuucucuucugcucccgcugcucggauucuuuauccaaacacuggacccuaaacuuauucugcaggcugugacccuccagacaagccugcugaaacuugaacugcccgacuaugugagacucgccaugcuggauuucgucuccucucucggcaagcuguuuaucccugaggcgauucaggaccggauccuucccaaccugagcuguauguucgcccugcuccuggcugaucgcuccuggcuucuggaacaacacacccucgaggccuuuacgcaguucgcugaggggaccaaucaugaagagaucgugccucagugccugucuagcgaagagacaaagaacaagguuguguccuuucucgaaaagaccggauucgucgacgagacagaggccgccaaaguggaaagaguuaagcaggagaaaggcauuuucugggaacccuucgcuaaugugaccgucgaggaagcgaagcggagcucucugcaaccguacgccaaaagagcucgccaggaguucccuugggaggaagaguaucgguccgcccuucacacgaucgccggcgcucuggaagccacagagagccugcuccagaaggggcccgcgcccgcuuggcugucuauggagauggaagcccuucaggagagaauggauaagcugaaacgcuacauucacacccucggauga

SEQ ID NO: 66646 - RNA, 429 nt, Artificial Sequence
  derived and/or modified sequence opt5 from C1orf115__Homo_sapiens__NP_078985
augaccgugggcgccagacugcggagcaaggcugaguccucucuccugcgcagagggccccggggacgcggcagaacagaaggggacgaggaagccgcggcuauccuugagcaccuggaauacgccgaugaggccgaggcugccgcugaaagcggaacguccgccgcggacgagcggggcccugggacccgcggagccagacggguccauuucgcucuccugccggaacgcuaugagccccuugaggaaccugcccccucugagcagccuagaaaacgguaccgcagaaagcugaaaaaguauggcaaaaacguuggcaaggugauuaucaaggggugccgguacguggucauuggacuccaaggcuuugcugccgcguauagcgcccccuucgcuguggccacauccguugugucuuuuguccgcuga

SEQ ID NO: 66647 - RNA, 1929 nt, Artificial Sequence
  derived and/or modified sequence opt5 from C1orf127__Homo_sapiens__XP_011539059
augagcaccuuccccacauccucucacagcggccuguuuuccccuucuagcgggcaucucaucccgcugugccuuauucccccucugcucuccucugugcccacgcuggccaugagauuccggaacgcucgcgacaaggagaaauuugccuucgcgggaagauguugggucagcuuucagccugaauccgagguucuugugcacauccccaagcaacggcugggccucgugaaacgcgggagcuacauugaagagacccugucucugagauuccuccggguccaucaguccaauaucuuuauggugacagaaaacaaggauuucguuguggucagcauuccugcugccggagugcugcagguucagcgcugccaagaggugggcgggaccccgggaacacaggccuuuuauagagucgaccuuucucuggaguucgcugaaauggccgcucccgugcucuggaccguggaguccuuuuuccagugugucggcagcggcacagaaucuccugccuccaccgcggcccugcggacgacccccagcccucccuccccggggccugagacacccccugcuggaguuccucccgccgcuucuagccaggugugggccgcgggccccgccgcucaagaguggcuuucccgcgaucugcuccacagaccgagcgacgcccuggcuaaagcccggcuguggcuccauccccugccuauggugucuuccaaggaaagcgggccccaggaggucucuaagggacuuggcccuuuucugcagaccgccaaacccgcucgcagagggcagacaagcgcguccauccucccgcgggugguucaagcccagcgcggaccucagcccccucccggcgaagcuggcaucccugggcaccccaccccgccugccacgcugcccucugagcccguggaaggaguccaagccagcccuuggagaccgcggcccgugcuuccuacacaccccgcucugacccucccuguuuccagcgaugccucuucccccagcccucccgcgccgagaccugagcgccccgagucucugcugguguccggcccuagcgucacacucaccgaagggcugggaaccgugcggcccgagcaggacccggcuaaguccccuggcucuccccuucugcucagagggcugagcuccggagaugucgccgccccugaacccauuaugggcgagcccggccaggcuucugaagaguuccagccucuugcccgcccguggcgggcuacacuggccgcggaggaacucgugagccauagaucccccggggagccucaagaaacgugcagcggaaccgagguugaacgcccccggcagacaggcccugggcugcccagagagggagcccgcggccacauggaccugucuuccagcgagccuucucaggauaucgaagggccgggccucuccauucugcccgcucgggacgccaccuucagcacaccuucugugagacagcccgauccuagcgcuuggcuuuccagcggacccgagcugaccggcaugccgcgcguccggcucgccgcgccucuggccgugcugcccauggaaccccuuccucccgagccuguuagaccggcugcccuccugacgcccgaggcuucuuccgucgggggaccugaccaagcccgguaccuggaaagcgcccccggcuggccuguggggcaggaggaauggggaguggcucauacauccucucccccgagcacccagacccucucccugugggcgccuacaggcgugcuucugcccucucucguugagcuggaauauccuuuucaggccgggcgcggcgcuagccugcaacaggagcuuaccgagcccacacucgcccuguccgccgaaucucacagaccucccgagcugcaggauagcgucgaaggacucuccgagcggccgagcagauga

SEQ ID NO: 66648 - RNA, 1416 nt, Artificial Sequence
  derived and/or modified sequence opt5 from C1orf141__Homo_sapiens__XP_011539768
auggccgagaagauccuggaaaaacucgacgugcuggauaagcaggcugagauuauccuugccagacggaccaaaauuaaccgccugcaaagcgaaggcagaaagacaacgauggcgaucccccucaccuucgacuuucagcuggaguucgaagaggcucuugccacauccgccucuaaagcuauuagcaagaucaaggaggauaaauccugcucuaucaccaagagcaaaaugcacgucuccuuuaagugugaaccugagccgcggaaaucuaauuucgaaaagagcaaccugcgccccuuuuucauucagacaaauguuaagaacaaagaguccgagagcaccgaaccuguggaggaacaucucaagucuagauccauccggcccuaccuguaucugaaagacacaaccgagauggaaaaugccgggccucucaacgugcuguacagccagcaccgccaggcuugcagacggucucuuggauccacggauuuuagccccauguucaauauucaaucuaacgcccauaagaaagagaaggacuccacccuguuuacagcgcagaucgagaaaaagccucgcaagccgcucgauagcgucggccugcuugaaggggacagaaauaaacggaagaaaucuccccagaugaacgauuucaauauuaaggagaacaaauccgugcgcaauuaucaacugagcaaguacagauccguucggaagaaaagccuccugccucuguguuuugaagacgagcucaagaacccccacgccaaaaucgugaaugucucuccuaccaagacagugaccucccauauggaacagaaagauacgaaccccauuaucuuccacgacacagaguauguucgcaugcugcuucugaccaagaacagauuuagcucucacccgcucgagaaugaaaacaucuacccucauaagcggacaaauuucauucuggagagaaacugcgaaauccuuaaaagcauuaucggaaaucaguccauuucucuguucaagccccagaaaaccaugccuaccgugcaacgcaaggauauccagauccccaugagcuuuaaagcuggccacacaacggucgacgacaagcucaagaaaaagaccaacaaacagacacuggagaaucgguccuggaacacccuguauaauuucagccaaaacuuuucuucccucacaaagcaguucgugggguaccuggauaaagccgugauucaugaaaugagcgcucagaccggaaaguuugagagaauguucucugccggcaaacccacguccaucccuacaagcuccgcgcuuccggucaaguguuacucuaagcccuuuaaauauauuuacgagcugaauaacguuaccccucucgacaaucugcuuaaccugagcaaugaaauccucaacgccuccuga

SEQ ID NO: 66649 - RNA, 4485 nt, Artificial Sequence
  derived and/or modified sequence opt5 from C1orf167__Homo_sapiens__XP_011539574
augaagagacggcugagcggcgugcgcaccagacagaacaaaggggaccaacucggaggcgggcgggcccaccugaucaagcagacacgcccccuuacggucgaguggaccaaagauacaccuguuccggaacccauggagcugagauccgacgcuucucauaaggaaaaugugagcccuaaacccgccgcgcucccuaagcccgagcagcggcgcuucagacggucccugggaauuggccuuucugggcgccacgaucagugggugccuggaugccaagucgaaagaggcggcccggcugccacccccagcccuggggccgugcuggaccaggagcccugucggguucagacaaaccucgcuuccccuggaccccgccugggccuggcccucaaggauaccacagggcagcuggucaauucuagcuuuuggcaacaguccaaccuucagagccuggcuagacggcgccagggaaaagccagagaguucgcgauccaacagucuaaucucuccauuaacgaaaccagcucuccgcaucugugcccugagcccggcggguccagcggaccucacaagcugcccuggggcccccuucucucucaggaaccucuggcccggccguccagcugucugagacaauccggccuccccgcuccugggacgcccucuggagacuuucgcccuaccgaggccuucgcuccccuggauggccauacacagccggggcuucggagcuggggaggccugggguccuggagaagccgccucgugggagagccucugacccuugaagaccuggccgugcccucucagaaucagacacaagcgccuucccgggccgcuguucaccagcuccuggccagcgugcacugccuggcucaggaggccgccagacuccgcugucaggcuccccaagaaccucccggcgcgguccagcaggaucuguggaccggcgggggacagccguuuucugcccauccucaacccagccagcccgugcuugcuuccucugacggccggagacgccggcugagagggcaccgcgagacggccgccuuccucgaaaccccugcuagccuguccgauagcugggcccagucuaaacuuauguccccggagacaacacugggaacccggaccaaggacagccucaaccccgagcagggccugccucccgcgcauccucuggggucuggcgauuccugcagccccuggucccaagacggacgcgcucagcggggcgacccuucucucccccgcggggugggaagcagaggcacagauccguguuccucugccuuuagcaauacggccuggggagucuccccuaaacagaagggagaagagggcgcuccccgggaaagaguucaccgcgaggaggaacggaccgccuuccaccugagcgacacagugccugcuucuuccgccagcaagaacaaagcgcaaaauaucaccgcccccgagucugaagcuauuugcuggcagcuucuguccagauguuuucgcagcuggagacaucucgugaagcggcagcgcgagccggccgcugccgcggucgcccuggggagauggcagcugcuucggaaaugccuccaagcucuguggcugcgcgaagcccagcucgaggcugccuggggccaguacacaaaggugcugcuuguuagaucuuuccgggaauggcgcaaccuggcccuccagcaaaaacaggugcagccucacaugcaggcuggacccggcagcccucccuccagacgggcgcaagggaagggacugagccugggccgcucuaccgucguggaucccgcccagagaucccggcuugagcauacgagcccugggucccucagagaggaagagaucgcucagcgccugcugucucacccgcggcaaagaacagacagccgccaugaacggguucagauccuccaggcccugcagcuugccguguuuuuccuguggugucaacagaaaaagagagcucgccaggagcgggagacccucagaaaggccacccgcgcgacacagcggaccggauccuuuccccaagccuggcacucuacagccgccggcgucgcuuggguggccccucugagcccccagcaccagagagcguggcugugccggugcuucggggcuuggcagcaauucguccagcgcggcuccagauaucgggaucaucuugccgaccgcagaacgggaacccuccggaaaugucuggaacagugggugagaaugaagcagcugcgcgagucugauggcgccaaaguuacacaacucagccugugccggcagaaggcugggagagaagccguguacaccgcuggaccuggcgccugugggcuuggagcggucggccaggcccaagggcagcaggagcagggccgcggaucccugcaagacgcuugcuggacacucgcccuguguugggcucugcuucucuggaaaaugcggcuguuucagagacagugggccaauagcuucuuucagggccugcaacagcgcaugcuccagcggucucugagaugguggcaccuucgcgcccuggggcccgaugcuaccuccagcugcacgaagaccccuucugcgcucgaaccgcuguccagcucuacacugcaggacucccuugagaaggugcccagagccccuacccugcccgauacacuccaaggaagccugcucugggcugccggccagcggcagcaagggcagugucugcuucuguggcaggcccgcgcucagcaauuccagggaaccgccagaugguaucagcauacgcggcagcgcagaauuuuucucuccuggagccggugggcgacagcucaaugggccuggagagagcuggccucucaccgcgcuugggaccggaccugcagagccguucugggccuuuggcgccagcggcugcuccagagcagacugguggaauggugggcgcaggagcggggcuggcgccucgcuagagacgcccugugucacuggcauuccugcuggcaagggcagcaguuccuucacgaaaaaugucagacauggguccaagugcaucugcagggacuccagaaggugguuuuucggucuuggcaacaggccgcugcccaccagcgcugcaccgucaccagaccugagcagcugcugcuucaaagcuacuuccaggcuuggugcgaaguggugcgggauacaggcguccugcgcgcccagcaucaggcguuucaagacgggcucagacggcgcgcccugggagcuguguucgccacguggagagaggcucaggagguugccgccggcgcucaggaacagcggguggcgcaagccucccucgcuagauggcgcucuugugggcagcagggacaagaggauggccagcagaaaaaggcccgggcuccccaggcuuuuccggccuggccugucgcgcccggcaugcaccacgaagcucaacagcaggccggggagagcgccggagcucaggccgcgcaaugcuggaccugguguugggcccugugggugcaugaauccugcagaggccagguuucucgcgcucacgccagcuggaaaccccgggcuugggugcuugaggccuccguccagagcgcugugagagggggaguucagcgcgccauccugacacaacugcggccugcggagcucagacgcuuccugcggaccgugcagcuuagaguccgccugggccuccccggggccggaaagacacggucuuguuggacccaggcuacggaacuggugccuccggcccccucccuccaaugcagccugggcggcagacgcaagccuagagggacagcuugggcccagcggugucgcgagcauucucuuugccccgccuuucagcuguggccucaguggcccggacaauccagcugggugccgggccugccucucuggaccagagaccaggggccccgggcucacuccucuccugaacccagagcguguaaagcccagagcaaggcucauaaacggcgccugagagcccgguccugccgcauucuugagaagcaggcccaagcucacggaagcgcccugcuccuggcgcucaaaggccacgaugcccuggggcaucaggaggaagucccugcugcccccguuccgagaggaaccgcuucucgggccgcgggcuucccugccggccaggugcccggguccggaauggcugcccuuggcggguguccccgcgggagagcugccggcgcugacccugcccaggggguggcgccggagaugggacuggccgaugucguggcugccgaccccgcuacagccagcggcucugccguuaccgcggcuggccggugggccuucaagaaguggcaccaacgccuggcugccagaagcccucggcgcggggccgcuuccucucccagaccuuggagcaaacccggaccuaagggcccggaauccgggcaggaggccgcgcgggcccccagaggauggggccucggggcugaacauggagcccagcugcagcuuuga

SEQ ID NO: 66650 - RNA, 708 nt, Artificial Sequence
  derived and/or modified sequence opt5 from C1orf204__Homo_sapiens__NP_001127705
augggcaugcuggcucccgggccucuccagggaagacggccgcgcaagggccacaaagggcaagaggacgcuguggcccccggaugcaaggcgagcggcagagggucccgggucacccaucugcuuggauacccuacacagaacguuucucgcagccugagacggaaauaugcucccccucccuguggcggcccugaagauguggcccucgccccgugcacggcugccgcugccugugaggcggggcccuccccuguguacgucaaggugaaaucugccgaacccgcugacugcgccgagggaccuguucaguguaagaauggccugcuugugagcucuccccacugcgaggaaccgugugcucauuccugcgcccacccugggcugcccccucaucucguccacaagcugccccugagcuaucuccagacccaagauacagacgcggccucccgcagaaucaacgcuccccuggccgcuggauggagcuggcuucggcuguggcucgugacccuggccucuggcguugauuucccucagguguccgccuggaugcgcgcccuuccgagccccgacuguccugggcugagaacaaccggagagcagaugcagaaacuccugcugaaggaaaauaaagucaagacacggaaaucuaagcgcagauccggcgagggcagccaccucaccacgucuauucuggaacaauga

SEQ ID NO: 66651 - RNA, 819 nt, Artificial Sequence
  derived and/or modified sequence opt5 from C1orf226__Homo_sapiens__NP_001078844
auguucgagaaccugaauaccgcccucacacccaagcugcaggcuagcagauccuuuccucaccuuucuaaaccgguggcccccggcagcgcgccucugggguccggagaacccggcgggccuggacucugggucggcucuagccaacaucugaagaaccuugggaaagcuaugggagccaagguuaaugacuuccugcggcgcaaagagcccuccucucucggcagcgugggcgugacggaaaucaacaagaccgccggggcucagcuggccuccggaacagaugcugccccugaggcguggcuggaagacgagagaagcguccuccaggagaccuuuccgcggcuggaucccccucccccuauuacacgcaagagaacaccccgggcccuuaaaaccacccaggacaugcugaucucuucccaaccggugcucagcucucuggaauacggcacggagccuucccccgggcaggcucaggauagcgccccuaccgcucagcccgacguucccgccgaugcgucucaaccugaagccacaauggagcgcgaggaaagaggaaaggugcuuccgaauggcgaggucucccugagcgugcccgaccucauucacaaagauucccaggacgaaucuaagcugaaaaugaccgagugccggcgcgcuagcuccccuagccugaucgaaagaaacggguucaagcucucucugucccccauuagccuugccgagucuugggaggauggaagcccucccccgcaggcucggacauccucucuggacaaugaaggcccucaucccgaucuccugagcuuugaguga

SEQ ID NO: 66652 - RNA, 1323 nt, Artificial Sequence
  derived and/or modified sequence opt5 from C1orf228__Homo_sapiens__XP_011539646
augaccagcaucaaggagcaggccgcuauuuccagacugcucucuuuccugcaagaaugggacaacgccggcaaaguggcgcggagccacauccuugauaaguuuauugagacaaaucaggggaaaacggcucccgaacuggagcaggaguucucccagggagccucucucuuucugguccgccuuaccacaagccugagaaucaccuacaugacagacuccugccucgaaaagcugcugcggucuauuggcaucuuccucagcgccguuuccagcaaccgcuaucugaucgaguuucuugaagucgggggagugcugacccuccuggagauucuuggccuggagaaaaucaaggaagaggcuaagaaagaaucugugaagcuccugcaagugauugccaauuccgggagaacauacaaagagcugaucugugaaagcuauggaguucggucuauugcugaguuccucgccaaguccaaaagcgaagagacccaggaggaagugcagguccugcuugauucucuggugcauggcaacccuaaguaccagaaucaaguuuauaagggccucaucgcgcugcuuccgugcgagucccccaaagcccagcagcugagccuccagacgcugcgcaccgcucaaccuauuaucgggacaacccaccccuccaucguggacuguguccugaaggugcucggaacaaugcaucuggaagugcaguacgaggccauugaacuuaucaaagaucuggucggcuaugacguuagacaggcucuccugaaggggcuuguggcccugcucauuccuucugugaaagagaucagcaagcugcaagcgaaaauucuguccgaucccagcguccuccagcugaccccuucucuuccgauguuucugcagcaggccgcugccgcuaaggccaucggagugcucgcccggaacgacauguccaucgcugaggaacugcuguaccuucgcguugugagaggccucauggcggccauggggaauacggaucacagcaacucucaacggcuggcuagccugacacucgagugcuucguccagauguuuccccugguggccgaacauguucgcaaguguaugggagaggaacuuuaccagcuguuccucuccaaugccgaggaccuguauaugaaaauugauucuauccaggcugacauucuggccgcgaacaccgugaaugucacaaaggcucuuugccuccacggcagcuccuacagcaugaacacccuguauggcucuagagauuccgcccaaauggccuaccugacccacuuugaggaagacguggagagcaaagaauga

SEQ ID NO: 66653 - RNA, 1296 nt, Artificial Sequence
  derived and/or modified sequence opt5 from C1orf27__Homo_sapiens__NP_001157717
augggcagaaccuacaucguggaggaaacagucgggcaguaucugagcaacauuaaucuccaaggaaaggccuucguuuccggccugcuuaucgggcagugcucuagccagaaagacuacgugauucuggcuacgcggacacccccuaaggaggaacaguccgagaaccucaaacacccgaaggccaaacuggauaaucuugacgaagagugggcgaccgagcaugcuugucaagugucucgcaugcugcccggaggccuccugguccuggggguguuuaucauuaccacacucgaacuggccaacgauuuccagaaugcccuuagacggcugauguuugcuguugaaaagagcaucaaccgcaagagacucuggaauuucaccgaagaggagguguccgaacgggucacacugcacaucugcgccucuaccaaaaagaucuuuugucgcacguaugacauucaugauccuaaaagcuccgcuagacccgccgacuggaaguaccagagcggacuuucuuccagcuggcugucucucgagugcaccgugcacauuaacauccauauuccucuguccgcgacaagcguuucuuauacccuggagaaaaauacaaagaacggccucacccggugggccaaggagaucgaaaauggcguguaccugauuaacgggcaggucaaagaugaggacugugaucuucuggagggacaacuccucaauuccgaccaccgcagcacggcuacagugcagaucugcuccggcucugugaaccuuaagggggccgucaaauguagagcuuauauccacagcuccaagcccaaaguuaaggaugccgugcaggcggugaaacgggacauucugaauaccgucgccgaucgcugcgaaaugcuguucgaggaccugcugcucaacgaaaucccugagaagaaggacagcgaaaaagaguuucaugugcugccguacagaguuuucgugccccuuccuggaucuacagucaugcugugugauuacaaguuugacgaugaguccgcugaagagauucgggaccacuucauggaaaugcucgaucauaccauccagauugaggaccuggaaaucgccgaggagaccaacacagcuugcaugagcucuagcaugaacucccaagccucucuugauaauacggacgaugaacagcccaaacagccuaucaagaccacaaugcugcucaaaauucaacagaauaucggcgugauugccgcuuuuaccguugcggugcuggccgcugggaucagcuuccacuauuuuuccgacuga

SEQ ID NO: 66654 - RNA, 330 nt, Artificial Sequence
  derived and/or modified sequence opt5 from C1orf61__Homo_sapiens__NP_001307383
augggcacccuggggagcaucuucucccccggagccggcggguuuugcacaacgcucccuccgucuuuccugagaguggacgaucgggcuaccagcuccacaaccgacucuagccgcgcccccuccucuccuagacccccuggaagcacaucccacuguggcauuagcacccggugcacagagcgcugucuuugcguccugccccucagaaccucucagguuccugaugugauggcgccgcaacaugaccaggaacccaagcggcgcauguacuuuaucuggcugggguggauuccuuccgauaaacccagccagcuuacggagagauga

SEQ ID NO: 66655 - RNA, 588 nt, Artificial Sequence
  derived and/or modified sequence opt5 from C1orf86__Homo_sapiens__XP_011539224
auggaggccgcuagacggccccgccugggccucagcagacggcgcccuagaccggccgggggacccuccggcgggcggccuugguuccugcuuggaggcgacgaacgcgagagacugugggcggaacuccugcggaccgugucucccgagcuuauccuggaucacgaagucccuagccuccccgcuuuuccugggcaggagccgcgcugcggacccgagccuacagaaguuuucacggugggccccaagaccuuuuccuggacaccuuuucccccggaccuguggggcccugggagaucuuaccggcugcuccauggagccggcgggcaccuggagagccccgcccgcucccuuccucaaagacccgcucccgauccuugucgggccccgcgcguggaacagcagcccucugucgagggagcugccgcgcugagaagcugcccuaugugucagaaagaguucgcuccccgguccaagaacagcucuggcaugagacgccaucgguccccuaaacucgccgccaauaacaauaacaauaagagaaaagggcgcgcucgguggcugacccccgugauuccggcccuuuga

SEQ ID NO: 66656 - RNA, 762 nt, Artificial Sequence
  derived and/or modified sequence opt5 from C1QB__Homo_sapiens__XP_011540361
augaugaugaagauccccuggggcagcauuccugugcugaugcuccugcuucugcucgggcugaucgacauuucccaggcccaacuuucuugcaccggaccgcccgcuaucccuggcauucccgggaucccuggaacacccggcccugaugggcagccgggaacgcccggcaucaaaggcgagaaggggcugccuggacucgccggcgaccacggggaguucggagaaaaaggcgaucccgggauuccuggaaaccccggcaaggucggcccgaaagggccuaugggacccaagggcgggccuggagcgcccggcgcucccgggccuaagggagaaagcggcgacuacaaagccacccagaagaucgccuuuuccgcuacaagaaccauuaauguuccgcugcggcgcgaucagacaaucagauucgaccaugugauuaccaacaugaauaacaauuaugagccccggucuggcaaauuuacauguaaggugccugggcuguacuauuucaccuaccacgccagcucccgcggaaaccucugcgucaaucugaugagaggccgggaacgcgcucaaaaagugguuacguuuugugauuaugccuacaacaccuuccaggugacaaccgggggaaugguccuuaagcuggagcagggcgagaauguguuucuccaggcgacagacaagaacucucugcuugggauggaaggcgccaauagcaucuucuccggauuucuccuguuccccgauauggaggcuuga

SEQ ID NO: 66657 - RNA, 849 nt, Artificial Sequence
  derived and/or modified sequence opt5 from C1QBP__Homo_sapiens__NP_001203
augcugccccuccugagaugcgugccucggguccuuggcagcuccguugccgggcugcgcgcugccgcgccggcuucucccuucagacagcuccugcaaccugcuccccggcuuuguacccgcccuuuuggacugcucagcgugagagccggcuccgagcggcgccccgggcugcugagaccucggggaccgugcgccuguggcugcggguguggaucucuccacacagacggcgauaaggccuucguggacuuucugagcgaugaaaucaaagaggaacgcaagauucagaaacauaagacgcuucccaaaauguccggcgggugggagcuggaacucaacggaaccgaggcuaagcuggucagaaagguggccggcgagaaaaucacaguuaccuucaauauuaacaauucuaucccucccacauuugacggggaagaggaaccuagccagggacagaagguggaggagcaagaacccgagcuuaccuccacaccgaacuucgucguggaaguuauuaaaaaugaugacggcaagaaagcgcuggugcucgauugccacuacccugaggacgaagucgggcaggaggaugaggccgaaagcgacaucuuuucuauccgggagguguccuuccagagcaccggagaaucugaguggaaggauacgaacuauacccugaauacagacucccuggauugggcucucuacgaccaucugauggacuuucuugccgaucgcggcguggacaacaccuucgcugaugaacuggucgagcucagcacagcccuggagcaccaggaauauauuaccuuucuugaggaccugaagucuuucguuaaaucccaauga

SEQ ID NO: 66658 - RNA, 777 nt, Artificial Sequence
  derived and/or modified sequence opt5 from C1QL1__Homo_sapiens__NP_006679
augcugcucgugcuggucguucuuauccccgugcuggugagcuccggcgggccugagggacacuacgaaaugcucgggaccugcagaauggucugugacccguaucccgcccgggggccuggagcuggcgcccgcacagaugggggagacgcgcugucugagcagagcggcgcucccccucccuccacgcuugugcaaggcccucaggggaagccgggaagaaccggcaaacccgggccucccggaccucccggcgauccggggccucccggaccuguuggcccucccggcgaaaagggggagcccggaaaaccggggcccccuggccugcccggagccggcgggucuggagccauuagcacagcuaccuacacaaccgugccucgggucgccuucuaugcuggccucaagaacccccaugaaggcuacgaggugcugaaauuugacgauguugugacaaaucuggggaacaauuaugacgccgcguccggaaaguuuaccugcaacaucccgggcacguacuucuucaccuaucacguccucaugcgcgggggagauggcacaucuaugugggccgaccuguguaagaauggccaggugagagcuagcgccauugcucaggaugccgaccaaaacuacgauuacgcguccaauagcgugauccuucaucuggacgccggcgaugaggucuuuauuaaacucgacggaggcaaggcucacgggggaaacucuaauaaauauuccaccuucagcggcuuuaucaucuacucugacuga

SEQ ID NO: 66659 - RNA, 768 nt, Artificial Sequence
  derived and/or modified sequence opt5 from C1QL3__Homo_sapiens__NP_001010908
auggugcugcuccuggucauccuuauucccguucuggugagcuccgccggcaccucugcucacuacgagaugcucgggacaugcagaauggugugugacccuuauggaggcacgaaggccccgagcaccgcggcuacacccgaucgggggcugaugcagucccuuccuaccuucauccaaggacccaaaggcgaagccgggcgcccuggaaaggccggccccagaggcccuccgggggagcccggaccucccggcccuauggggcccccgggagaaaaaggcgagccugggcggcagggacugcccggcccucccggcgcucccgggcucaacgccgcuggagccauuucugcggccacauacagcaccgucccuaagaucgcuuuuuaugccggccugaaacgccagcaugaaggguacgaggugcugaaguucgacgauguugugacaaaucucggaaaccacuaugacccgaccacgggcaaguuuaccugcuccauucccgggaucuacuucuuuacauaucauguccugaugagaggaggcgauggcaccucuaugugggcugaccuuuguaaaaauaaccaggugcgggccagcgcgaucgcccaagaugcugaccagaauuacgauuacgccuccaacagcguugugcugcaccucgagccuggggacgaagucuauauuaagcuggauggaggcaaagcucaugggggaaauaacaauaaguacucuacauucuccggcuuuaucauuuaugccgacuga

SEQ ID NO: 66660 - RNA, 846 nt, Artificial Sequence
  derived and/or modified sequence opt5 from C1QTNF1__Homo_sapiens__NP_112230
augggcagcagagggcagggacugcuccuggccuacugccuucugcucgcuuucgccuccggccuggugcuuucucgggucccccacguucaaggggagcagcaggaaugggagggaaccgaagaacugccuagcccgcccgaccaugcggaacgcgcugaggagcagcacgaaaaguauagaccuucccaagaucagggccuccccgccucucggugucugcgcugcugugacccugggacaagcauguaccccgccacggcugugccucagaucaacauuaccauccugaaaggagagaagggcgauagaggcgaccgggggcuccagggaaaauauggcaagacaggguccgccggagcucgcggccauaccgggccgaaaggacaaaagggcucuaugggcgcccccggggaaagaugcaagagccacuacgcggccuuuuccgugggacggaaaaagccuaugcauagcaaucacuauuaccagacagucauuuucgauaccgaguuugugaaccuguaugaccacuucaauauguuuacaggcaaauucuacuguuacguucccgggcuuuacuuuuucucucugaacgugcauaccuggaaucagaaggagacguaucuccacaucaugaaaaacgaagaggaagucgugauucuguuugcucagguuggagaucgcuccaucaugcaaagccagucucuuaugcuggagcucagagaacaggaccaaguguggguccggcuguauaagggcgagcgcgagaaugccaucuucuccgaggagcuggauaccuacauuacauuuagcggguaucucgugaagcaugcuaccgaaccuuga

SEQ ID NO: 66661 - RNA, 741 nt, Artificial Sequence
  derived and/or modified sequence opt5 from C1QTNF3__Homo_sapiens__NP_112207
augcuguggagacagcucaucuacuggcaacugcuugcccuguucuuucuccccuucugccugugucaggacgaguauauggaaagcccucagaccggcgggcuuccgcccgauugcuccaaguguugccacggagacuacucuuuucggggcuaucaggggccucccggaccucccggcccuccggggauucccggaaaccauggcaauaacggcaauaacggggcuacaggacacgagggcgccaaaggggaaaagggagauaaaggcgaccuggggccucgcggagagagaggccaacauggccccaagggggaaaaaggauacccuggcauucccccggagcuccagaucgcguucauggcuagccuggccacgcacuuuuccaaucagaacucugggaucauuuucagcuccguggagaccaauaucggaaacuuuuucgaugucaugacaggccgguuuggggccccuguuucuggaguguauuucuuuaccuucagcaugaugaagcaugaagacguggaggaagucuacguguaucugaugcacaauggcaacacaguguuuuccauguacagcuacgagaugaagggcaaaucugauaccuccagcaaucacgcuguucucaagcuggccaaaggggacgaggucuggcuucgcaugggaaacggcgcucugcauggggaucaccagagauucucuacauucgccggauuucuccuguucgaaaccaaguga

SEQ ID NO: 66662 - RNA, 732 nt, Artificial Sequence
  derived and/or modified sequence opt5 from C1QTNF5__Homo_sapiens__NP_001265360
augagaccccugcucgugcugcuucugcucggccuggccgcugggagcccuccgcuugacgauaacaagauccccucccugugcccuggacaccccggccucccugggacccccggacaucacggcucucaggggcugccuggacgggacggccgcgauggcagagacggggccccgggagcgcccggcgagaaaggggaaggaggccggccugggcugcccggaccucgcggcgaucccggcccgagaggggaggcuggaccugccggccccacagggccugccggagaauguagcgucccuccccgguccgcuuucucugccaagcgcagcgaguccagaguucccccgcccucugacgcuccucuccccuuugaucgggugcuggugaaugaacaaggccauuacgacgccgucacggggaaauuuaccugccaggugccuggaguuuauuacuucgcggugcacgccacagucuaucgcgcuagccuucaguucgaucuggugaagaacggcgaguccauugccagcuuuuuccaguuuuucggcggguggcccaaaccggcuucucucuccggaggcgccaugguuagacuggagccugaagaccaaguguggguccaggugggggugggagauuacaucggcauuuaugcgagcaucaagaccgacucuacauuuuccggguuccuugucuacagcgauuggcauucuucccccguuuuugccuga

SEQ ID NO: 66663 - RNA, 837 nt, Artificial Sequence
  derived and/or modified sequence opt5 from C1QTNF6__Homo_sapiens__NP_872292
augcaguggcugagagugcgggagagccccggcgaagccaccgggcaccgcgucacaaugggaacggcugcccucggcccuguuugggcggcucugcuucuguuccuccugaugugcgagaucccgaugguggaacuuaccuuugacagagccguggccuccgggugucaacggugcugugauucugaggacccccuggauccugcucaugucagcuccgccucuagcuccggacgcccccacgcucucccugaaauuagacccuacaucaacauuacaauccugaagggcgacaaaggggauccuggaccgaugggccugcccggcuauauggggcgggagggaccucagggcgagcccgggccucagggaucuaagggcgacaaaggggaaaugggaagccccggcgccccgugccagaagcgcuucuuugcguucuccgugggcagaaaaaccgcccuccauagcggggaggauuuucaaacacugcuuuucgaacggguuuuugugaaucuggacggauguuucgauauggcuaccggccaguuugccgcuccucuccgcgggauuuacuucuuuucucugaacguccacuccuggaauuauaaggagacauacgugcauaucaugcacaaccagaaggaggccguuauccuuuaugcgcagcccagcgaaagaucuauuaugcaaucccagagcgugaugcuggaccucgccuacggagaucgggucugggugcgccuguucaaaagacagcgggagaaugcuaucuauucuaacgacuuugauaccuacauuacguucuccggccaccugaucaaggccgaagacgacuga

SEQ ID NO: 66664 - RNA, 891 nt, Artificial Sequence
  derived and/or modified sequence opt5 from C1QTNF7__Homo_sapiens__NP_001128642
augagcagacaggagcccaagauguucgugcugcucuacgucaccuccuuugccaucugcgcuucuggccaaccucgggggaaccagcugaaaggagaaaauuauagcccgcgcuacauuuguuccauccccggccuuccugggcccccuggacccccuggcgccaacgggucuccgggaccccacggcagaauuggccugccugggcgggacggacgcgauggcagaaagggggagaaaggagaaaagggcacagcggggcuccggggaaaaacgggcccccugggccuugcuggggagaagggagaccagggcgaaaccgggaagaaaggaccuaucggccccgagggggagaagggagaaguuggcccgauuggcccucccgggccuaaaggagaucgcggcgagcagggggaccccggacugcccggcgugugcagaugugggagcaucgugcucaaguccgccuucucugucggcaucacaaccagcuauccugaggaacggcugccgauuaucuuuaauaaagugcuguucaacgagggagaacauuacaaucccgccacaggcaaguuuauuugcgcuuucccugggaucuauuacuuuuccuaugauauuacccucgccaacaagcaccuggcuaucggacuuguucauaauggccaauaccgcauuaaaacauucgacgccaacaccgggaaucacgauguggcgagcggaucuacggucaucuaccugcagcccgaggacgaaguguggcucgagaucuuuuucaccgaucagaacggccuguuuuccgacccugggugggccgauagccuuuucucuggcuuucugcucuauguugacacagauuaccuggacuccauuagcgaagacgaugagcuguga

SEQ ID NO: 66665 - RNA, 324 nt, Artificial Sequence
  derived and/or modified sequence opt5 from C1QTNF9B-AS1__Homo_sapiens__NP_001014442
auguggauccuguccaaccucaugggcaccuccgaggaagggaaucugcuuucuacagugagccccacggucaaggcccuguucggaaaaaccagaguuuccccuauuuuuccguucucuccccggagcccuuuucagccccucaucccucgcacacccggcuccccuugggggccggugggacccgcuucuccucugggccccggguucccuauuggacccaugggcccgggcaagccuguggggcccaaaggaccuaugcuuccccugggccccagcgggccugucggaccgaccagcccccucuuuccuuucugccccuga

SEQ ID NO: 66666 - RNA, 2118 nt, Artificial Sequence
  derived and/or modified sequence opt5 from C1R__Homo_sapiens__NP_001724
auguggcugcucuaccugcuugugcccgcccuguucugcagagcuggcgggagcaucccuauuccgcagaagcucuuuggagaggucaccucuccccuguucccuaaacccuauccuaacaauuuugaaacaacgaccguuaucacagugcccaccggcuaccgggugaaacuugucuuccaacaguuugaccuggagccuuccgaaggguguuucuaugauuacgugaaaauuagcgccgacaagaaaucccucggacgcuuuugcggccagcuggggucuccgcugggaaaucccccuggcaagaaggaguucaugagccagggcaacaaaaugcuccugacauuucacaccgauuucuccaacgaagagaaugggacaaucauguuuuauaagggauuccuugcguacuaucaagcuguugaccuggaugagugugccucuagaagcaaacucggcgaagaggacccccagccucagugccagcaucugugucacaacuacgucgggggauacuuuugcuccugucggcccggcuaugaacuucaagaggaucgccauagcugccaggccgaguguucuuccgaacuguacaccgaggcuagcggguauauuucuucccucgaauacccgagaagcuauccucccgaccugcggugcaauuacucuauccgcguggagagaggacugacgcuccaccugaaguuccuugaaccuuucgauaucgacgaucaucaacaggugcacugucccuaugaccagcugcagauuuacgccaacggcaaaaauaucggcgaguuuugcgggaagcagcggcccccugaucucgacaccuccagcaacgcuguugaccugcuuuucuuuacagaugaguccggagacucucgcggcuggaagcugagauacaccacagaaauuaucaaaugcccgcaacccaagacccucgaugaguucacgauuauccagaaucugcagccucaguaucaauuucgggacuacuucauugccacauguaaacagggguaucagcugaucgaaggaaaccaggugcuccacagcuuuaccgcggucugccaagaugacggcacauggcaucgcgccaugcccagauguaagaucaaagauugcgggcagccucggaaucugcccaacggagacuuccgcuacaccaccacaaugggcgugaauacguauaaggcucggauucaguacuauugucacgagccguacuacaaaaugcagaccagagccggcuccagagaaagcgagcaagggguguauacaugcaccgcucagggaaucuggaagaacgagcagaagggcgaaaagauuccucgcugucuucccgucugcgggaagccuguuaaccccguggagcagcggcaaagaaucauuggaggccagaaagccaagauggggaauuuuccuuggcaaguguucacaaacauccauggccgcggaggcggggcgcugcucggagaucgguggauccugaccgccgcucacacgcuuuaccccaaagaacacgaggcccagucuaaugcuucccuggacgucuuucucggccauacaaacguggaggaacugaugaagcuggggaaucacccgauuagacgcguuagcgugcauccugauuaucggcaggacgagucuuacaacuucgaaggagacaucgcccuccuggagcuugaaaauagcgucacccugggccccaaccuccugcccauuugucugccugauaaugacaccuuuuaugaucuugggcucaugggcuacguguccggauucggcguuauggaggagaagaucgcccacgaccugagauucgugcgccugccggucgcuaacccccaggcgugcgaaaauuggcuccgggggaaaaacagaauggauguguuuucucagaauauguucugugccggacauccuagccugaagcaagacgcuugccagggcgauuccgggggagucuuugccgugcgcgaccccaacacagaucgguggguugccaccggcauugugagcugggggaucggcugcucuagaggauauggcuucuacacaaaaguccuuaauuacguggacuggaucaagaaagagauggaagaggaagauuga

SEQ ID NO: 66667 - RNA, 564 nt, Artificial Sequence
  derived and/or modified sequence opt5 from C1RL__Homo_sapiens__NP_001284572
augcccggcccuagagugugggggaaguaccuguggcggagcccgcacuccaaaggaugccccggcgccaugugguggcuccugcuuuggggaguccugcaggcuuguccuacccgcgggucuguucuccuggcccaagagcuuccccagcagcugacaagcccuggcuaucccgaaccuuacgggaagggacaggaguccucuacggacaucaaagcgccggaaggcuucgcugugagacucguguuucaagauuucgaccuggagcccagccaggauugcgccggcgacuccgucaccauuucuuuuguggggagcgauccuucccaguucuguggacagcaaggcagcccccuggggcggccucccggacagcgcgaauuuguuucuuccggcagaagccuccggcugacauuccgcacccagccgucuuccgagaacaagacagcccaucuucacaaaggguuucuggcucucuaucagaccgugggagagugcccuagcuggggcuguagagaaggcgccucuguccccucccaugacccugggaucuucaagcccuga

SEQ ID NO: 66668 - RNA, 2067 nt, Artificial Sequence
  derived and/or modified sequence opt5 from C1S__Homo_sapiens__XP_005253817
auguggugcaucgugcuguucagccuccuggccugggucuacgcugagcccaccauguauggcgaaauucuuuccccuaacuacccgcaggccuaucccucugagguugaaaagagcugggacaucgaggugccugaaggguacggcauucaccuguauuuuacacaucucgauaucgagcuguccgagaauugugcguacgacucugugcaaauuaucagcggagauacggaagaggggagacuuugcggacagcgguccucuaacaauccccacagcccuaucgucgaagaguuccaggugcccuauaacaaacugcagguuauuuuuaaguccgacuucagcaaugaggaacgcuuuaccggcuucgcugccuacuacguggccacagauaucaacgaguguaccgacuuugucgaugugccuugcucucauuucuguaauaacuuuauugggggauauuucugcuccuguccgcccgaauacuuucuccacgacgauaugaaaaauugcggcguuaacuguagcggcgacguguucacagcucugaucggggagauugccucuccuaauuaucccaagccuuaccccgaaaacuccagaugcgaguaucaaauccggcuggagaaaggauuucaggucguggugacccuccgcagagaagauuucgacgucgaggcugccgauagcgcgggcaauugucuggacucucuuguuuucguggccggggaccggcaguuuggaccguacugcggccauggguucccuggaccccugaacauugaaacaaaguccaaugcucucgauaucaucuuucagaccgaccugacgggccaaaagaaaggcuggaaacuucgcuaucacggggauccuaugcccugccccaaggaggacaccccuaacagcgugugggaaccggccaaggcuaaauacgucuucagagaugugguucagauuacaugucuggacggauuugagguggucgagggccgggugggggccaccuccuucuacucuacaugccagagcaacggaaagugguccaauagcaagcucaaaugucagcccguugauugcggcaucccugaaucuauugagaacgggaagguggaagaccccgaguccacccuguuuggaagcgucauccgcuauacgugugaggaaccuuacuauuacauggagaauggcggcgggggagaauaucacugcgcgggcaacgggucuugggugaaugagguccugggacccgaacucccgaaaugugugccuguuugcggcgugcccagagagccuuucgaggaaaagcaacggauuaucgggggcagcgaugccgacaucaaaaacuuucccuggcaggucuucuuugauaauccuugggcuggaggcgcccugauuaacgaguacugggugcuuacagcugcccauguuguggaagggaaucgcgagcccaccauguaugucggauccacaucugugcagaccagcagacuggccaaguccaaaaugcucaccccggaacacguguucauccauccuggcuggaagcugcuugagguucccgaggggcggacaaacuuugacaaugacauugcucugguccgccucaaggaucccgugaaaaugggaccuacggugagcccgaucugucugcccggcaccucuuccgacuacaaccugauggauggggaccucggccugauuagcggauggggcagaacagaaaagcgggauagagcgguccgccuuaaagccgcucggcugccuguggcgccccucagaaagugcaaagagguuaagguggaaaagccuaccgccgacgcugaggccuacgucuucacacccaauaugaucugugccgggggagaaaaaggcauggauucuugcaagggggacuccggaggcgcuuucgccgugcaagauccuaacgacaaaaccaaguuuuaugccgcugggcugguuagcuggggcccccagugcggaacguacggccuuuauacacgcgugaaaaauuacgucgauuggaucaugaagaccaugcaggagaacuccaccccgcgggaggacuga

SEQ ID NO: 66669 - RNA, 3534 nt, Artificial Sequence
  derived and/or modified sequence opt5 from C20orf194__Homo_sapiens__NP_001009984
auggacguguaucccccuagacggcagggccugccgcgcgccagaagccccgggggauccucucggggcagcccuuccgucucuugcagccgccucagacaaguucaguccauccugacccagucuagcaagucccggcccgaugggauucuuuguauccugggaauugacagccgcuauaacgagggcugcagagaacucgcuaauuaccugcuuuucgggcuguauaaccagaauacaucugauuuugagaaaacgggauucuccgaagaggugcucgacgaugugaucauucugaucaagagcgacucuguccaccuguacuguaacccugugaauuuucgguaucuccugcccuacguugcccauuggcgcaaccuucacuuccauugcaugaccgaaaaugaguaugaggaugaagaggcggcugaagaguuuaaaaucacauccuucguggacauggucagagauuguagccggauuggcaucccuuacucuucccaaggccaucugcagauuuuugacauguucgugguugagaaguggccgaucgugcaggccuuugcccucgaagggauuggaggcgauggguucuuuaccaugaaauacgagcugcaggacgucagccuuaaccuguggaauguguauuccaagauggaucccaugucucucgaaagccugcuguccgacgaccucguggcuuucgagcaccaauggaccagcuuuuucgccaacuucgauaccgaaaucccuuuucugcuugagcugucugagucccaggcuggagaacccuuccgcagcuacuuuucucacggcaugauuagcucccacaucacagaaaauucuccuaacagacagcccuucguccucuuugggaaucauagcacccgggaaaaccugaaugccggaaacuucaacuuuccguccgagggccaccuuguucgcagcacgggcccugggggaucuuucgcgaagcauaugguggcccagugcgugucccccaaaggcccucuggcuuguagcagaaccuacuuuuucggggccacacacguccccuaccucggaggcgacucuaagcugcccaaaaagaccgaacaaauccggcugcucucccagauuuaugcugccgugaucgaggcgguucuggccgggauugcuugcuacgccaaaacaagcucccuuaccaaggcuaaggagguggccgaacagacgcugggaucuggccucgauagcuuugagcugaucccuuucaaagccgcucuuagauccaagaugacauuucacauucaugcggucaauaaccaaggccgcaucgugccgcuggacucugaagauagccucuccuucguuaaaaccgccuguauggcuguguaugacauccccgaucugcucgggggaaauggcugccuggggagcgucguguucucugaguccuuucugacaagccagauucuugucaaggaaaaagacggaaccgugaccacagagacgucuuccguugugcugaccgccgccgucccucgguucuguagcuggcucguggaggauaacgaaguuaagcugucugagaaaacacagcaggcugugagaggcgacgagagcuuucuggggaccuaccuuacaggcggagagggcgccuaccucuauuccagcaaucugcaaucuuggcccgaggaagggaacguccacuucuuuuccagcggacuccuguucucccauugccgccaccggucuaucauuaucagcaaggaucauaugaacuccauuucuuuuuacgacggcgacagcaccuccacgguggcggcucugcuuaucgauuucaagucuagccugcucccucaucugcccgugcacuuucacggguccagcaauuuccugaugaucgcccuuuuuccgaaaucuaagauuuaucaggccuucuacuccgagguuuuuagccucuggaaacagcaggacaauucuggaaucucccugaaggucauucaagaagauggccugagcguggagcagaaaagacuccacucuuccgcucagaagcuguucagcgcccuuucccagccugcuggggaaaagcgcagcucucugaaacuccugagcgccaagcugcccgagcuugacugguuccuccaacauuuugcgaucuccucuauuagccaggagccugugaugcggacacaucugcccguccugcuccagcaggccgaaaucaacaccacccacagaauugaguccgauaaagugaucaucucuauuguuacaggccugccuggaugccacgcuagcgaacuuugugccuuccuggugacccuccacaaggagugcggccgcuggauggucuaucggcaaaucauggacuccucugaauguuuucaugcugcccacuuccagagauaccugagcuccgcgcuggaggcccagcaaaaucgcagcgcucggcagucugccuauauucggaaaaagacaagacuucucgugguucugcagggguacacggaugugaucgacgucgugcaggcucugcaaacccaucccgauuccaacguuaaggccagcuuuacaauuggagccaucaccgcuugcguggagccgaugucuuguuacauggaacaccgcuuccucuuuccuaaaugccuggaccaguguucccagggccuugucagcaaugugguguucacaucccacaccacggagcagagacauccccugcucguccaacugcagucucugauccgggcggccaaccccgcugccgccuuuauucuugcugaaaaugggaucguuaccagaaacgaggauauugaacugauccucagcgagaacuccuucagcucuccugagaugcugcgcucccgguaucucauguacccgggaugguaugaaggcaagcugaaugccgggagcguguacccccuuauggugcagauuugcgucugguuuggcagaccucuggagaaaacacgcuucguggcgaaguguaaagcuauccagucuagcaucaagcccuccccuuucucuggaaacauuuaucacauccucggcaagguuaaauuuagcgacuccgaaagaaccauggaggugugcuacaauacacuggccaacucucugagcauuaugcccguccuugaggggccuacacccccgccugauuccaagagcgugucucaagacuccagcggacagcaggaauguuaucugguuuucaucggcugcucccucaaagaggacucuauuaaggauuggcugcggcaaagcgccaaacagaagccccagcgcaaagcucucaagacgagagggaugcugacacagcaagaaauccgguccauccaugugaagcgccaccuugagccucugcccgccggauacuuuuacaauggcacccaguucgucaacuuuuucggggacaaaacagauuuucauccgcucauggaccaguucaugaaugauuauguggaagaggcgaacagagagauugaaaaguacaaucaggagcuggaacaacaggaguaucacgaccuguuugaacuuaaaccuuga

SEQ ID NO: 66670 - RNA, 618 nt, Artificial Sequence
  derived and/or modified sequence opt5 from C20orf196__Homo_sapiens__NP_001290406
auggccgcuagagacgccaccagcggcucccugucugaggaaagcuccgcgcucgaucugcccucugcuugcgacauccgggauuacgugcuucaggggccuagccaagaggccaacuccgaagccuucucuagccuggaguuucacuccuucccguauagcucugacgucgaucccgacacauccaaucucaacauugaacagaauaacagcuggacggcugagaauuuuuggcuggauccugccguuaagggacagucugagaaagaagaggacgauggccuucgcaagucccuggacagauucuacgaaauguuugggcauccccagccuggaagcgcuaacucucucuccgccagcguguguaaaugccugucccaaaagaucacccagcugcggggccaggagucucagaaauaugcgcuccgcagcuuccaaauggccagagugauuuuuaaucgggauggguguuccguccugcagcgccacagcagagacacacauuucuacccccuugaggaaggaucuaccucccuggaugacgagaagccuaacccgggccucagcaaggacaucacacacuuucugcuucagcagaaugugaugaaagaucuguga

SEQ ID NO: 66671 - RNA, 600 nt, Artificial Sequence
  derived and/or modified sequence opt5 from C20orf27__Homo_sapiens__NP_001034229
auggccgcugccaacaagggcaaaugccugcccgggguggucggacucgcgcaggcucugccuguuggcccggggagacgggccaucgccgcuggaaauaagccccgcgugagaagcauucgguucgccgcuggccacgacgccgaggggucccauucucacgugcauuuugaugaaaaacuucacgacagcgucgugaugguuacccaagaguccgauucuagcuuccuggugaaggucggauuucucaaaauccugcaucgcuacgaaauuacauucacgcuuccucccgugcacagacuguccaaggacguucgggaggcgccugugcccucucuccaccugaagcugcucagcgucgugccugugccggaaggcuauuccgucaaaugugaguacagcgcccauaaggagggcguucugaaagaagagauccuucuggcuugcgaagggggaaccggcacaugugugcgcgugaccguccaggccagagugauggaucggcaccaugggacacccaugcuccuggacggaguuaagugcgugggcgcugagcuugaguaugauucugaacacuccgacuggcacggguuugauuga

SEQ ID NO: 66672 - RNA, 414 nt, Artificial Sequence
  derived and/or modified sequence opt5 from C20orf85__Homo_sapiens__NP_848551
auggcccagaagccccugagcaccgcugccgcggagagaaugaaccucgugggccaagacgaaaucuggaaauaccggcugaaggcugaguccgaagcccgccagaauuggccucagaacuggggguuccuuacaacgccguuugaggaacugauuaaaugcgaggaggaucuccccaccccuaagcccaaaaucgaacugccugagagauuccggauucgccccgucacaccuguugaaaaguauaucaagguguuuccgucucccccugugccccagaccacacaaggauucauuggcuggagaagcgccgucccugggcuuaauaaaugucuggagcucgacgaugcuauccgguccugcaagggagccuuugcucgcgagcuguguuggcccaaacagggcgugcacuga

SEQ ID NO: 66673 - RNA, 768 nt, Artificial Sequence
  derived and/or modified sequence opt5 from C21orf2__Homo_sapiens__NP_001258369
augaagcugaccagaaaaauggugcucacacgggccaaggcuagcgagcugcacuccguccgcaaacuuaacugcuggggcucuagacugacggacaucagcauuugucaggaaaugcccucccucgagguuaucacccugucugugaauagcauuuccacacuugaaccugugucucggugccaacgccugagcgagcucuaccugagacggaaccgcaucccgucccuggccgaacucuucuaucugaaggggcuucccagacugcggguccucuggcuggcggagaauccuuguugcggaaccagcccccaucgcuacagaaugacagugcuucggacccugccucgccuccagaaacuggauaaccaggcuguuacagaggaggaacugucuagagcccucuccgaaggcgaggagauuaccgccgcucccgaacgggaggggacgggacacggcgggccuaagcuguguugcacccuuagcucucuguccagcgccgcugaaacaggacgcgacccgcucgauucugaggaagaggccaccggcgcgcaggacgagagaggccugaagcccccuucccgggggcaauuucccagccuuuccgccagagaugcuucuagcucccaucgcggacggaaugugcugacagccauccuccugcugcucagagaacuggacgcugagggccuugaagccguccagcagaccguggggagccgccugcaggcgcuccggggagaggaaguucaagagcacgccgaguga

SEQ ID NO: 66674 - RNA, 807 nt, Artificial Sequence
  derived and/or modified sequence opt5 from C21orf33__Homo_sapiens__NP_004640
auggccgcugugagaguccugguugccagccggcucgcggcugccuccgccuucaccucucugagccccggcgggcgcacaccuucccagagagcugcccuucaccugucugugccgcggcccgcugcccgcguggcgcucguccugagcggaugcggcguguacgacgggacggagauccaugaagccuccgcuauucuuguucaccugucuagaggaggcgccgaggugcaaaucuuugcuccugaugucccccagaugcaugugauugaccacaccaaggggcagccuagcgaaggagagucccggaacguucucacagaaagcgcccgcaucgcgagaggcaaaauuaccgaucuggccaaucugucugcugccaaccaugacgcugccaucuuccccggcggguuuggagccgcuaagaaucucuccacauucgcgguggauggcaaagacuguaaggucaacaaagagguggagcgggugcugaaggaauuucaccaggccgggaagccuaucggacuuugcuguauugcuccgguccuggccgccaaaguucuccgcggcguggaggugaccgucgggcacgaacaagaggagggaggcaaguggcccuaugcuggcacagccgaagcgaucaaagcucugggggccaagcauugcgugaaagagguuguggaagcccacgucgaucagaagaauaaggugguuaccacgccugcuuucaugugugagaccgcccuucauuacauucacgacggaaucggcgcuauggugagaaaaguccuggaacucacagggaaguga

SEQ ID NO: 66675 - RNA, 873 nt, Artificial Sequence
  derived and/or modified sequence opt5 from C21orf59__Homo_sapiens__NP_067077
auggugcugcuccacgucaagagaggcgacgagagccaguuccugcuucaagcccccggguccaccgaacuggaggaacucacaguucagguggcucggguguacaacggacgccugaaaguccagagacuuugcucugagauggaagaacuggccgagcauggcaucuuucucccuccgaauaugcaggggcugacggaugaccaaauugaggagcugaagcucaaagaugaauggggagagaagugugugcccagcggcggggcgguuuucaaaaaggacgauaucggacggcgcaacggccaggcuccuaaugagaagaugaaacaggugcugaagaaaaccauugaagaggccaaggccaucauuuccaaaaagcaggucgaagcuggcgugugcguuacaauggagauggugaaggacgcccuugaucaacugagaggggcugucaugaucguguaucccaugggacucccucccuacgacccuauccggauggaauuugagaacaaagaggaucugucuggcacccaggccgggcuuaaugugauuaaggaagcggaggcccagcuguggugggcugccaaagaacuccgcagaacaaagaaacugagcgacuaugucggaaagaacgagaaaaccaagaucauugcuaagauccagcaacggggccagggggccccggcgcgcgaacccauuaucuccucugaggagcagaaacaacugaugcucuacuaucacagacggcaggaggaacugaagcgccuugaagagaaugaugacgaugccuaccugaacagcccuugggcugacaauacagcccucaaaagacauuuccacggaguuaaggacauuaaauggcggccccgcuga

SEQ ID NO: 66676 - RNA, 660 nt, Artificial Sequence
  derived and/or modified sequence opt5 from C21orf62__Homo_sapiens__XP_011545334
auggcucccccuagcagacacugccugcuccugaucuccacccuuggcguguucgcccugaacuguuuuacaaaggggcagaaaaauucuacgcucauuuucacccgggagaacacaauccgcaauugcagcuguuccgccgacauuagagauugcgacuacucucuggcgaaccuuauguguaauugcaagaccguccugccgcucgcuguugaacggacaagcuauaacggacaucugaccaucugguuuacagauaccuccgcccugggccaccuccugaauuucacgcuugugcaagaccugaaacucucucuguguagcaccaacacacuucccaccgaguaccuggccauuugcgggcucaagcgccugagaaucaauauggaagcuaaacauccuuuucccgagcagucccugcucauccacagcggaggcgauucugacucccgggaaaagccuauguggcugcauaagggguggcagcccuguauguauauuagcuuccuugauauggcccuguuuaaccgcgacucugcucucaaauccuacagcaucgagaaugugacaucuauugccaacaauuucccugauuuuuccuauuucagaaccuuuccgaugcccagcaacaaguccuacgucgugacguucaucuauuga

SEQ ID NO: 66677 - RNA, 894 nt, Artificial Sequence
  derived and/or modified sequence opt5 from C21orf91__Homo_sapiens__NP_001093890
augaacgaggaagaacaguucgugaauaucgaccugaacgaugacaauauuugcagcgucuguaagcucggcaccgauaaagaaacacuguccuuuugccacaucuguuucgagcuuaacauugaagggguucccaagucugaccugcuccauacgaaaagccugagaggacacaaggauugcuuugagaaauaccaucuuaucgccaaucaaggcuguccucgguccaagcugucuaagagcaccuaugaggaagugaaaacaauucucuccaagaaaaucaacuggaucgugcaguacgcucagaauaaggaccuggauucugacagcgagugcuccaaaaacccgcagcaccaucuguucaauuuucgccacaagcccgaagagaagcuccugccucaauucgauagccagguccccaaauauucugccaaguggauugacggguccgcgggaggcaucagcaacuguacccagcggauucuugagcagagagaaaauacagauuuugggcugucuaugcuccaagacuccggagcuacccugugccgcaacagcgugcuuuggccucacucucauaaucaggcccagaaaaaggaggaaacaaucuccagccccgaggccaacguucagacccaacacccucauuacuccagagaggagcuuaauucuaugacgcucggcgagguggaacagcugaacgcuaaacugcuccagcaaauucaggaggucuucgaggaacugacccaccaggugcaggaaaaggauagccuugccucccaacugcacguucggcauguggcuaucgagcagcuccugaaaaacuguagcaagcugccgugccugcaggucggccgcacagggaugaagucucaccuccccauuaauaacuga

SEQ ID NO: 66678 - RNA, 1095 nt, Artificial Sequence
  derived and/or modified sequence opt5 from C22orf29__Homo_sapiens__NP_078903
augcccagaggccggugccgccagcaagggccuagaaucccgauuugggccgcugccaacuacgcgaaugcucaccccuggcagcagauggacaaggccagcccuggaguggccuauacaccccuggucgauccuuggaucgagcggcccuguugcggcgacaccguuugugugcgcacgaccauggaacagaaauccacagcuucugggaccugcggaggcaagccugccgagagagggccgcucgcuggacauaugcccagcucccggccucaccgcguggauuucuguuggguccccggcucugacccuggcacauuugaugggagccccuggcugcuugacagauuccuggcccaacucggagauuacauguccuuucauuucgaacacuaucaggacaacauuucucgggugugcgagauccugcgcagacuuaccggccgggcgcaggccugggcugccccguaccuggauggggaccucccucugcccgaugacuaugaacuguuuugucaggaucucaaagagguugugcaagacccuaauagcuucgcugaguaccaugccgucgugacaugcccccugccccuugcguccagccagcugccuguugccccgcagcuccccgugguccgccaguaucuggcuagauuucuugaaggacuggcccucgacaugggcaccgcuccucggucucugcccgccgccauggcuacgccugcgguguccgggagcaacucugugucccgcagcgcccuguucgagcaacagcucaccaaggaaucuacacccggaccgaaagagccucccguccugccuuccagcaccuguuccucuaagcccggcccuguugagcccgcuagcucccagccggaagaggccgccccuacacccgugcccagacuuagcgaaucugcuaauccuccggcccaacggcccgauccugcgcaccccggcgggccuaagccccagaaaaccgaggaagaggugcuggagacggaaggagaccaggaggucucccucggcacaccucaggaagugguugaggcucccgaaaccccgggggagccuccccugagcccuggauuuuga

SEQ ID NO: 66679 - RNA, 7062 nt, Artificial Sequence
  derived and/or modified sequence opt5 from C2CD3__Homo_sapiens__NP_001273506
augaagcagcggaaaggccaagggagcgggggcucccgggggcgcaagaaaagaggacugucugacaucagccccuccaccucucuuccuccccugguggagggccagcuucggugcuuccugaagcugaccgucaaccgcguuauuuggaaaaucgccaagcccccuacgugugugcuggugagaguccggugguggggagaaaccagcgauggaacacucuucugcccccgcgacgcucugcagaccgagccuaaggccgugagaacaaccacacgguacgcgauucgcuguggccccaaacaguucaccuccuaucucacggauauggcuguucuggugcuggaagucaucaccaagcucgacggccugccuauugggagagugcaaaucaauggacuugcccagcugucucccacacaccagaucaacggcuuuuucaccauuguuagcuccacaagcaaaaagcucggggagcuccaggugucucuugcccuggaaccccucuccgagaccuacgauagcuaucacccucugcccacgacagacaugaccgagaauguccugcucucuaaacaaggauuucgggaaaacacagagccuuccagcacccaguuccaggugcccucucgcccgagagauauccacaccauuaagaucgacggcaaggaacuggcugccaauuccagccgguccacaacgccucgcgggaaagaucaugugugcuuugcugagaaccccgacaccauuaaggauucuagcuucggacuucagcacucccugaauagcggccaaucucucgaguccgucacacugaaaggcagagccccucggaagcagaugagccuucugaacucuagcgaauuucagccccaaaucagaaccguugcgaaaucccauucugacagcuguauucucuccagcaauaaccugcccacaaaggaucugcucucugcccugcuugagcaggggaauaaacugcgcaacgcuauggugaucuccgccaugaaguccucuccugaaaccuccaugcuccuggaccaggugcacccgcccaucaaugaggacagccuucgggcuuccacgcagauuagagccuucucucgcaaccgguuuaaggaucacaucgaagaccaucugcucccuagcacagagaauaccuucuggagacacgauaccaaagcggacacacgcgccauucaacugcugcucggauccgcugagcugucucagggcaacuuuugggaugggcuuggauccccucccgacucccccagcccgggcucugaugucuacugcaucuccgaacugaacgacccucaguaugaucagagccuccuggagaaucuguucuacaccgcccccaagucugacacauccauuagcgauuuccuuucugaagaggacgacaucgugccuagcaaaaagaucucccaaagcacggcucucgcccggucuuccaaaguucuggaaagcuccgaucauaagcugaagaaaagaucugccgggaagcgcaaccggaaucucguggagcagcagaugcugagcgagacccccgaagacgcucagacaaugacccuuuccgucgauagacuggcgcuccugggacgcacacacucugugcggauuaucauugagaccaugggcguuccucccgacagcccgcaaaugacgccuggcaaaaaguccuaugccgggccgcccccuaaagugaccacagcuaagaagagaaccuuuuucgucgaauaccacuuuccggugggauucucugagagcggccuggggaaaacagcccuuaucaccgaagucgugcggcucgccuccagcaagauuacggauggaaaaguuaaguuucagcagcgcuucguguuucccguccaguucggcgggccuaugaucgagcauugguggaacucuaaucugacauuucaaaucuacgugaaaaagacaccccagaagaaaccugagguuauuggcuccgugagccugucucucagagcugucauccaguccgaacugcuuagcuucucugaccaacugcccgugcagcaggagaacggacaguccccuuuuggcccccucaaggugacaauggaacugauuaccgauaauaaagacuucaccgggaucaacacaaagcugagcggaaauacgcacuauaccccgcuuugugccccuacaucccccaacaaagcgcucccugagcugaaucaagauaugaccugcacaaagaacccccagaaucugaaccagauucaugaggaaaccgcuaaaaaggcccagaaucucguucugccgaacagaaagagcccuucucccgucgccccucaccccagcacguuuguggcuacacccgccucccauaaccuugugaaucaaaccaacggcaccacaaaagagucugcucugcuccugcacguccugcuuauggugccugacgggaaggauuucaucagcggagaauccgagaaacagucuccguguaauguuuaccucaacugcaagcuguucagcaccgaagaggugacaagauccgucauugccuggggcacgacccagcccguguuuaauuucucucagguuaucccugugagccuguccagcaaauaucucgagcgccugaagaacaaugucauggugaucgaaacauggaacaagguucggucucccgggcaagacaaacuucugggccucgugaagcugccucugcaccaguuuuacauguccuucaaagaugcgaagauuagcagacuucugcucgacgcccaguaucccgucguggcuguggacucuuacaugccugucaucgauguuuuuagcggacaucaaaauggcagccugcgcguguuccucgccaugggguccucuaaccagauuauggcucugcagagacuuaaaaaugaggaaggaacccugccgcccuuuagcccucggcccgcccacuuccucgaccagccuacagcggccuccguggcuauggccgaggaucgcggcaacgggcugauggaacauuguuuugagauccacauugagauggucaagggacuggcuccccuucaagccaccguguggggcgaagccgacugcuauguucaguacuacuucccggugcagcacagccagucuuccguccugaaggggccugaguuucucgaaaauggcaucacgcugaaacccuucagaaccgcuacaacccucugcgugcccgauccuaucuuuaacagcgagcaucaccauucucugcuucugcccgcggaaguuccugugcaacggcuccugcugagcgccuucuccgcucagggacuugucccgggcgggggagugcaguucgagauuuggugucgcuauuacuaucccaauguuagagaccagaagguggccaaaggcacacugccucucucucggaucugcgccauggucaccacacaacaccgcgaggauguggggauucagaccuuuaaccugccccucacgccuagaaucgaaaaccggaaggagcugcgcaaucagagcuccggacuucuggacgugggccugagauaccggagaucuccccgcacagcugaagggguccucgccgcgcggaccguuagcauuuccgugcagaucaucagagcuuguggccugcaagccgccgcuaaagcccuugcggagcgcgagccggcucugcaguucagcgccaccgugggagucaacgccucugugacaacccaucucuccuuucugccucagggcgaacaacggagaacgcaccccguugcuugcagcuucuguccugaguuuucccaccauguggaauuuacaugcaaucucgucacccagcacuguucuggggaggccugcuuucuggcugaacuucuggaguucgccgaggugauuuuugcgguuuaucaugaaaacacaaagagcgccuccgauaucauuucuaucgagagcuguaaggaauaccugcucggaguggucaaagugcccaccaaggagcugcuuauuaaacgcuccggcaucacagggugguauccuaucauucugcccgaagacggaggccucccgcacggccuggagcucaugcagaagaucgucgggggacuggagcuuagcauuucuuucacccaucggggcgauagagaacgcgugcuggaggcugccgaacaccuggggugguccuuugagaauagccucaaagacuucguucggauggaugaaggagagccugcuacggugaccaucucuacacccagacuguggcuucccauucacugcguccugcucgccggccauaaccacauccauaagaauaccuacuguuaccugcgguauaaauucuacgaccacgaggccuuuuggacaccucucaagaagccgaaagaauccgugaacaagaaacagauuaugguuaccuucaaggcuagcaaacgcgcggaggugacgagagggcccucucugcuuugguauuuucgggaggaacgccuggagauccaagucuggagagccuacggaaaugacagcguggaacggccucaccagacagauuccuggaucggcucugcuuauguggaccuggccagacucggcgagcgcagcgcccggacccugacaguuuccggggucuacccccuuuucggaagaaacgcuagcaaucuguccggcgccgcgcuccgcgugcaugugguccugucuagccuguccucucaccucgaaccuacccaugagcuugauagcauggacugcuccucucacagcgaauccgagcagcugccccggagaaacgaugaggugcagcugagcccuccggaaguuauuucuugccaucaaaagucccccgcuagcacccaggugccuuguucuuccacaacggccgagguccgccucacccaggaagggcccgccgaccuggauggaacauuugcugugagcauccuuguugagcgggccaugcaccugucucucaagggcuccccucugaccgaaagaaaagugagcauucccuccugcugugucagcuucgcgacagcugacgagucuagcccgguguauacccagguuguggagaauacggauuccccuaucuggaacuuucaacagcagucucgccugagcaaggaacuccuucuggacccccaacagacacuggucuucaaaguguggcacaagggggaugaggaaagagugauuggauuugccuccgucgaccucucuccccugcuuagcggcuuccaguuuguuugcggcugguacaauaucaccgacuucuccggggagugucagggacaaaucaaaguggccgugucuccucuggaaagccucauucauuuuaaggaggagcggcaggcucgcagaggcgucgaaaccuccaagagccugauccccauuuacucuccuuucuccuucccggccagcgauacauaugcugccuuuucuucccacauggcgcggcagacccuggaccagcucgcccaugcuagcuccaaagagcuugauuucucuagccccgggcgcuccgacacaacgagaagccaagccucucggcacgaggaacacgugcagaacaucagacgcuuucaugagucccugcaucugcagggagaagcuccucuccccugcgaugacaagcugaccacaagcccucuuucuagccagaccuccauucugacaucucuccggaaaaaccugagcgagcuggaucaaauccagagauacuuccgccagaagcucaccaaacccuuucuuccgcuguccccucagacgcaaaccgccaucucucagcaucaggaaagcugucgggaccaccugggccccggggccuccagccucgauccuggaucucaaugcauucuggagaaguccagcaaucuuguucuccagguguccucucugaucacagaccugcagaccauuacaagagauagccaggcugcgcuguccucucaucgggcccgcagcagauccaacaaggcuaccacacuccccgacgcccaagauacggaagcccuucaggagcgguguaccaugccugacgagccccugguccgcgcuccggacaaaggcacagauagcccuucuccgcccccucuggaagagaccuccaauggcgggagaaugcuccacgaaagccugcggcacgccgugccgaucacccgcaugcagucuuccgaggacacagaagcgggacccgcuuauagcgaugaggacuacgaggaagauauuaucgagccuagaacgcuuaacgaaauuaccacaguuaccgacaagacaucucccugguccagcgugaucucugauaccagcgaggucaucuccccucagcccgacgaagugcaacgggagggcccuagcugccccuccccggggccuuucugucgcgaggaacugauggucaaaucuagcuuucucuccucucccgagagagccgugaauccucaucugccccggcagggaagcccgucccagucucugguugccugcgaaugcgaggcuagcaaggccagagugggcggggaguccgcgagcgccaacccucagcccauucccuguccuacgcucucuggagcucaacaguccagcacauucgugggcuggucuagcccccagaccgaucaaaauaaagaaccuaagagcgaggccccggcugaaaacgaggccgcuaccucugaacuuggcgacuccgccgauagcuuuaagaaacugccccugaaucucgcgucucagucccgccgggagaaccacaaggggccucccaucgacagcagcgauauuagacagcgccaggucacaaccggauccgagacaucuaccaaacaaagccugcuucugccuggccccaucguugugccuaauuucuuucucccgccccagcagcuggaagccucccugcggaugcucucucuuagcgcuacgcugccucccgccgcuacaaccgaccaggacaaguccgaggccacaagaggggcccugucucaacgcccuugccggcccagaccgaacagccucccucugaaucuucccgaagaggaaacccugcgcauugcucggaucuucuccagccaguauucucagaaagauuga

SEQ ID NO: 66680 - RNA, 1110 nt, Artificial Sequence
  derived and/or modified sequence opt5 from C2CD4A__Homo_sapiens__NP_997205
auguggugccuggagagacuccggcugggccccgaaugucuucgcagaagcggggacuggcugcucccuggacgggcucgcggcgcuaaguccagaaccacagccgcgugcgcuaacgugcugacgccggaucggauccccgaguucuguauuccuccccgccuuaugccuagacuggcccucgccgcucugcgcaauucuugggucgaagaggccgggauggacgaaggagcuggccggaccgauugggaccccagaagccaggccgcgcugucccucccucaccuuccgcggguucgcacagccuacggguuuugcgcucugcuggagucuccccauaccagacggaaagagagccuccugcuuggaggcccucccgccccucgccccagagcucacacauauggcgggggaggcgggccggaugcccugcucggaacccugcgggugccuagagcgcccggcccugccacacccgcugcccccggguguccucgcccgccccaagacgcucuggcccggagaccucgcggaugccggcuccugagagugcccgauggccuucugucccgcgcccuccgggcuggcagaucucgccggcugaccagaguccgcagcguguccagcgggaacgaagacaaggagcggagagcgggaucucaguccccugcccgggcucccagcacgucuccgccuuccagccgcguucccuucccugaaagacuugaggccgagggcaccguggcccuggggcgggcuggagaugcccucagacuggcggcugaauacugucccggcacagggcgccugcggcucagacugcuucgcgccgagucuccugccggaggcgcucccggcccgagagccgucuccugccggcugagccucgugcugcgcccucccgggaccgcucuuagacaguguuccacaguugugggacggucucgcaaagccagcuuugaccaggauuucugcuuugacggccuguccgaagaugaggucagacggcucgcggugcgcgugaaggccagagacgaagggcggggacgcgagagaggccggcugcuggggcaaggcgagcucagccugggagcccuucugcuccuguga

SEQ ID NO: 66681 - RNA, 1095 nt, Artificial Sequence
  derived and/or modified sequence opt5 from C2CD4B__Homo_sapiens__NP_001007596
augagacugcucgagaagcugugcagcuccgccgcuggcucuagcgcccccaaaccugcguucgcuaaggugcuuaccccgaaccggauccccgaauuuuguauuccuccccgccugccugcccccugcacacucgaguccccuaucagagccgcugccgucccgcggcgcugugcugccgaaucugaccuguggcccagagcggccgaugaggacgcugggcggacggauugggacccucgcagccaggccgcucuuucccugccccaccucccuagaguucggaccacauacggauucugcgcccugcuggaaucuccccauacccgcagaaaagagagccuccugcuuggcgggccgccugcgccccggccucgcgcccacuccuguggaggcgggggaggccccgaugcuccccugggcacacucugcgggccuagaggaccgggccccgccaccccugcugcccccgggggaccucggcugccccaagacgcccuugcugcgggcccgcgcagaugucggcugcucagagugccugaugggcugcugagccgcgcccuccgggcuggaagaucucgccggcuggccagagugcgcuccgucagcucuggcaaugaggacgaggaacggagagccggcuccgaaagccccgcucgcgccccuucuuccagcccccuuuccucucgggcgccucugcccgagagacucgaggcuaaggggacaguggcccugggacgcgccggcgaugcccuucggcuggcugcugaauauugcccggggaccagacggcuccgccugagacugcuccgggccgagagccuguuuggaggcgcgccugggcccagagccguucgcugucggcuuucccuggugcucagacccccuggaacggcucgcuggcagugcagcgccgucgugggcagaucucggaaggcuuccuucgaccaggauuuuuguuucgacggccugagcgaagaugagguucgcagacuugccgugcgggucaaagcgcgcgacgaagggagaggacgggaccgcggcagacugcucgggcagggagagcugucucugggcgcccuccugcuucuguga

SEQ ID NO: 66682 - RNA, 3165 nt, Artificial Sequence
  derived and/or modified sequence opt5 from C2CD5__Homo_sapiens__NP_001273104
augcccggcaagcugaaagugaagaucgucgccgggagacaccucccuguuauggaccgggcuagcgaucugaccgacgccuucguggaggugaaauuuggaaacacaacguucaagaccgaugucuaccuuaaaucccugaauccgcaguggaacucugaaugguuuaaguucgagguggacgaugaagaccuccaagaugagccccugcagauuacaguucuugaccaugauaccuauagcgcgaaugacgcuaucggcaagguguacauugauaucgacccucugcucuauuccgaagccgccacagucauuucugggugguuucccaucuacgauaccauccacggaauuagaggcgagaucaacgugguugugaaagucgaccuguucaaugaccugaacagauuucggcagagcuccugcggggugaaguucuuuuguacaaccucuauuccuaaaugcuaucgcgcugugaucauucauggauucgucgaggaacucguugugaaugaggaucccgaauaccaguggaucgaccgcauucggacgccucgcgccagcaacgaggcuagacaacggcugaucucccuuaugagcggcgagcugcagcgcaagaucggccucaaagugcuggaaaugagagggaaugccgucgugggauaucuucaguguuuugaucuggagggcgaaucugggcucguugugcgggcgauuggaaccgccugcacacuggacaagcuguccagcccggcugccuuccuccccgcuuguaacucuccuuccaaggagaugaaagaaagcccccugguccacccucccucucauggcugccgcuccacccacaauagcccgauccacacagccaccggguccagacuuacgcagaacuuuucugugagcguuccuacacugauuuacaccggaaugggcuccggcagcgcggggaaggagggaggccccuucaaagcccuccugcggcaacagacacagucugcucuugagcagcgcgaguuccccuuuuucacccugaccgccuuuccucccggguuccucgugcaugucggaggcguggucuccgcuagaagcgugaagcugcuggaucggauccacaauccugccuuuguugggauuaugggaaacacaagaucuuacaaacuccuggacuggaauagcuucaacuccgaugagccggaaacgcgcgacgccuggugggcugagauccggcaagaaaucaagucucaugcgaaagcccuuggcugucacgcuguggucggcuauagcgaguccaccagcauuugcgaggaaguguguauccugucugccuccgggacagccgcuguucucaaccccagauuucugcaggauggaaccguggagggcugccuugaacagcgccuggaggaaaaucucccuacacgguguggguucugccacauucccuacgacgagcugaacaugccuuuucccgcccaucugaccuauugcuacaauuguagaaagcaaaaggucccggauguucucuucacgacaaucgaccugccuaccgacgcgaccgugauuggaaaaggcugccuuauccaggcucgccugugucggcucaagaaaaaggcccaggccgaggcuaacgccacagcuaucagcaaucugcugcccuuuauggaauaugaggugcacacccagcuuaugaacaaacucaagcugaaggggaugaaugcccuguucggccuccgcauucaaaucacagucggagaaaacaugcugaugggccuugcgucugccacggggguguaccuggcugcccucccuacccccggaggcauucagaucgcugggaaaacaccuaaugauggauccuaugagcagcauauuagccacaugcagaagaaaaucaacgacaccauugccaagaauaaagagcuguacgaaaucaaucccccggagaucuccgaagagauuaucggcucuccuauucccgaacccagacaacggagcagacugcuucgcucccagucugagagcuccgaugaggugacagaacucgaccugagccaugggaagaaggaugcguuuguccuggagaucgacgauaccgacgccauggaagaugugcacucucuccugacggacguuccuccgcccuccggcuucuacagcugcaacaccgagauuaugccuggaaucaacaauuggacaucugaaauccagauguucaccuccgugcgggucauuagacuuagcucucugaaccucacaaaccaggcucugaauaaaaacuuuaaugaucugugugagaaccuucucaagagccuguauuucaaacugcgguccaugauccccugcugucucugccacgugaauuuuaccguuagccugccugaggacgaacuuauucaagugacggucacagccguggcuaucaccuucgauaagaaccaggcccugcagacaaccaaaacccccguugagaagucucuccagcgcgccuccacagacaaugaggaacugcugcaauuuccucuugaacucuguagcgacucccugcccucucauccguucccucccgcuaaggagcaccuggagagcgcguccucuaacagcggcauuccugccgcucagagagaucggugcuccucuuggaucgaacucaucaaacugaaggcccagacgauuagacgcgggagcaucaaaaccacaaugaccguggagaaggccucccccgucggagacggcaauuuucggaacagaagcgcuccgccuugugccaauucuacaguggggguggucaaaaugacgccccuuuccuucauuccuggagcgaagaucaccaaauaccugggcauuaucaacauguuuuucauccgcgaaacaaccagccucagagaggaagggggcguuucuggauuucugcaugcuuucauugccgaaguguuugccauggugcgggcucacgucgccgcgcugggcgggaaugcugugguuuccuauaucaugaagcaaugcguguucauggagaaccccaauaagaaccaggcccagugccuuauuaacgucagcggagaugccgugguuuucgugcgcgaaucugaccuggaggucguguccagccagcaacccaccacaaauugucaguccagcugcaccgaaggcgagguuacaacguga

SEQ ID NO: 66683 - RNA, 2259 nt, Artificial Sequence
  derived and/or modified sequence opt5 from C2__Homo_sapiens__NP_000054
augggcccccugaugguccucuucugccugcuuuuucuguacccugggcucgccgacagcgcuccguccuguccccagaacgugaauaucucuggaggcaccuucacacugagccacgggugggccccuggaucccuucugacguauucuugcccccaaggccucuacccuagccccgcguccagacuguguaagucuagcgggcaguggcagaccccuggagcuacacggucccugagcaaagccguuugcaagccggugcgcugucccgccccugugucuuuugagaacggcauuuauacccccagacucggcuccuacccugucgggggaaaugugagcuucgaaugcgaggauggcuuuauccugcgggggucucccguucgccaguguagaccgaacggaaugugggacggcgaaacagcugugugcgauaauggggccggacauuguccuaaccccggcauuucccuuggcgcuguccggaccggguuccgcuuuggacacggcgacaaagugagauaucggugcagcucuaaucugguucucacaggguccagcgagcgcgaaugucaaggaaacggcgugugguccgggaccgagccuaucugcagacagcccuacucuuaugauuuccccgaggacgucgccccugcgcugggaacgagcuuuucccauaugcuuggcgccaccaauccgacacagaagaccaaagaaagccugggccggaagauucagauccaacgcucugggcaccucaaccuguaccugcuccuggauugcucccagagcgugucugagaaugacuuccuuaucuuuaaggaaagcgcuucccugaugguggauagaauuuucucuuuugagaucaacgucagcguugccauuaucacauucgcuuccgagcccaaagugcucaugagcgugcugaaugacaacucucgggauaugaccgaagucauuuccagccuugagaaugccaacuacaaggaccaugaaaacggaacgggcacaaauaccuaugcggcccugaacucuguguaccucaugaugaauaaccagaugcgccugcuggggauggagacaauggcuuggcaggaaaucagacacgccauuauccuccugaccgauggaaaauccaauaugggcgggagcccuaagaccgcuguugaccacauccgggagauucuuaacaucaaucaaaagagaaacgacuaucuggauauuuacgccaucggcgugggaaagcucgacgucgauuggcgcgagcugaaugaacuuggcuccaagaaagacggggagcggcaugccuucauucugcaggauacaaaggcucuccaccagguguuugaacauaugcuggacguuucuaaacugacggauaccaucuguggagugggcaacaugagcgcgaaugccuccgaccaagagagaacacccuggcacgucaccaucaagccuaaaucucaggaaacaugccgcggggcucucauuagcgaucagugggugcugaccgccgcccacuguuuccgggacggaaacgaucauucccuuuggagagucaaugugggcgaccccaagagccagugggggaaagaguuucugaucgagaaggcuguuauuucuccgggcuucgacguguuugccaagaaaaaccaaggaauccucgaguucuauggcgaugacauugcgcugcugaaacuugcucagaaagucaagauguccacgcacgcccgcccuaucugccuccccuguacaauggaagccaaucuggcucugcggagaccucaggggucuaccugccgcgaucaugaaaacgagcuccugaacaaacagagcgugcccgcccacuuuguugcucuuaauggauccaagcugaacaucaaucucaagaugggcguggaauggaccagcugugccgaggucgugucucaagagaaaacaauguucccuaaccugaccgacgugcgggaaguugucacagaucaguuucugugcagcgggacgcaggaggacgaaucccccuguaagggagagagcggcggggcgguguuccuugagagacgcuuucgguucuuucaggugggccucgucucuuggggacuguacaauccgugccugggcuccgccgauaaaaacagcagaaagcgggcuccucgcuccaaagugcccccucccagagacuuccauauuaaucucuuccggaugcaaccguggcugagacagcaccuuggggauguucugaacuuucucccccuguga

SEQ ID NO: 66684 - RNA, 5955 nt, Artificial Sequence
  derived and/or modified sequence opt5 from C2orf16__Homo_sapiens__NP_115642
auggagcugacccccggcgcccagcaacaggggauuaacuaccaggaacucacgagcggauggcaggacgugaaguccaugaugcuggugccugagccgacgagaaaauuccccucuggcccucuucugaccagcguucgguuuuccaaucucucucccgaaagccaacagcaggaugugaagucccuggaguucacaguggaaccuaaacuucagucugucaagcacgugaaacugagcuccguuagccuccaacagaccauuaagucuguggagcuggcucccgggucccugccucagagagucaaguauggagagcagacaccgagaaccaacuaccaaaucauggaaagcucugagcucauuccccggccuggccaucaguuugccaaauaugcggaaaugaucccccagccuaaguaccaaauucccaaauccgcuaaucugaucagcaucccgauuuaucacgccacagagucuuccgagauggcccaggggcuugcuuacaagggaaucgacaccguggagaaaagcguuggccugacgccuaagcucaccggcagagccaaggagucccuggggaugcuucugcagcccgaucuccaggugccuaaauucgucgaccugacacccauggugagagaucaaggaucuaaguuucugggccucacccccgagaaauccuaucagauucuggagacaauggaacuucugucccagagccggccucgcgugaaggacgucggggagcucuacaugaaaccgcugcagcaaaccguugaguacgaaggaaucacgcccgagcuuaagcauuauuucacagaagcuaugggccugaccgccgaggcgcgcauucaggccaacgaauuuuucgggaugacaccuaaacccaccucucaggcuaccggauuugccgagcgguccccucgccucugcccccagaaucuggaguguguggaagugaucagcgagaagagacugcaaggcgaagagucugucgugcucauucccaaaagccugcaccauguuccugauuccgcuucuggcaugacacccgggcuuggacaccgggugccugaaagcgucgagcugacguccaaaagcggcgugcagguugagaagacccuccagcugacacccaaaccucagcaccauguggggucucccggaaucaucuccggccuugggcaccaagucccggaaagcgugaaccugaccugcaagcaguggcuccagauggaggaaucucuggaggucccucugaaacaaacaucccaggugauuggacaugaggaaagcguugagcucaccuccgaagcccgccagcacagagaggugucuaugggccugacaaagagcaagaaucaguccaugaaaucucccggcacaacccccgggccucuuggacggaucgucgaguucaugcgcauuagcccggagccccuggaccaagugaccgaguccgcgagaacacagcuccagguugcccagagcgaagaggugauccugauugaugucccuaagguggugcaaucuguuaaagucacccccggcccucccuuucagaucgugaaguccgugacaaucccucggcccacgccgcagauggucgaauacauugagcugaccccuaaacuucaguaugugagacccagcgaacaccauacagggccuugucuccaagacguuaagucuaccaagcugaucacaaaacccaagcaccagauucuggagaccguggagcucacgggauuccagaucgucaaaaccaugcugauuccgggcccuucccuucaaaucgucaagagcgaagaacuggcucccgggccuaucccccagguuguggaacccauuggcgucgcccucgagucuggaaucgaagcuauuaacugcguggaucugcugccucgcccgcaucuucaggagcucaucguucccgccgagcugacaccuagccccuguacccaggugaaauccgccgaacugacaagcccucaaaccucucccuuugaggaacacacgauucucacacauaagcagggccugcaggcugucaaguccaccgugaucaaaacagagccuccgaaggugauggagaccgaagaccuuaaucuggggcacgucugccagaaccgggauugucaaaaacucaccagcgaggaacugcagguuggaacagacuucuccagauuccugcagucuagcuccacgacccuuauuucuagcuccgugcgcacagcgucugagcucggcgggcugugggacagcggaauccaggaagugucccgggcccuggauaucaagaaucccggcaccgacauucuccaaccugaggagacauacaucgaucccaccaugauucagagccugacguuuccucuugcucugcacaaccagucuuccgacaaaacagccaauaucgucgaaaaccccugcccggagauucucgggguggauguuaucagcaaggaaaccaccaaaagaaagcagauggaggaacuggaaaauucucugcaacgccaucuuccucaguccuggcggagcagaucucgcacauuccaggccgaguccggcgugcaaaagggacucaucaagagcuuucccggccggcagcacaacgucugggaaucccaugcuuggagacagcgccugccccggaaguaucugagcaccaugcucaugcuggggaacauucuuggaacaacgauggagagaaaacuguguucucagaccagccucgccgaacgggcgacagcugacacaugccaauccauccagaaucuguucggcauuccugccgagcugauggaacccucucagagccuuccugagaaggggccggugacaaucucccagcccucuguugugaaaaacuacauucaacgccacaccuuuuaucacggacauaagaagagaauggcccugcggaucuggacgagaggcagcaccuccucuaucauucagcaguacagcgggacacgcguccggaucaaaaagaccaauuccacauucaacggcauuagccaggaggugauccaacacaugccuguuucuugugcuggaggccagcuccccgugcuggucaaauccgaaagcucucucuccaucuuuuacgauagagaggaccuggugccuauggaagagagcgaggauucccagucugacagccaaacccgcaucuccgaaagccagcauucucuuaagcccaauuaucugucccaggccaaaacagauuucagcgagcaguuucaacuccuggaagaccugcagcuuaagaucgcugccaagcugcucagaucucagauuccgccugacgugcccccuccccuggcgagcgggcucguccugaaauacccuaucugccuucagugcggacgguguuccggccugaacugccaccauaagcuccaaaccacgucugggcccuaucugcugauuuacccgcagcuucaccugguucgcacaccugagggacacggcgaagugagacuccaucugggguuccggcuccgcaucggcaaaagaagccagauuuccaaguaucgggagcgcgauagacccgugauccggcgcucucccauuagcccuucccagagaaaagccaagaucuacacccaagcuagcaagucuccgaccuccacaaucgaccugcagagcggacccucccagucuccugcccccguccagguguauauucggagaggccaacgcagccggccugaucuuguugagaaaaccaagacgagagcucccgggcacuacgaauuuacacaggugcauaaucugccugaguccgacucugaaagcacccagaacgagaaacgcgccaagguccggaccaaaaagaccuccgauagcaaauacccgaugaagagaaucacaaagcgccugcggaaacacagaaaguucuauaccaauucucgcacgaccauugaaucccccagccgggagcucgcggcccaucugagacggaaacgcaucggagcuacacaaaccucuacagccucccuuaagagacagccuaaaaagcccagccagccuaaguuuaugcagcuucucuuccaaucucugaaacgggcuuuccagaccgcccaccgcgugauugccagcguuggcagaaagcccguggacgggacgcggccggauaaccucugggcuuccaaaaauuacuauccuaagcagaacgcgagagacuacugucugcccucuagcaucaaacgcgauaagcgguccgccgacaagcugacacccgcuggaagcaccaucaaacaggaggauauucuguggggcggcacaguccaaugcagauccgcccagcagccucgccgggccuauucuuuucagcccagaccucugcgccucccgaagcccaccgacagccaauccgggaucgcuuuccagaccgccucugugggacagccucugcggacaguccaaaaagauagcuccucuagaagcaagaaaaauuuuuaccgcaacgaaacguccagccaggagucuaagaaucuuuccacccccggcacaagagugcaggcgcgggggcgcauucugccuggaagccccguuaagagaaccuggcaccggcaucucaaagacaagcugacacacaaagaacauaaccacccgucuuucuaucgcgagagaaccccucggggccccuccgaaagaacgcgccacaacccuagcuggcggaaucauagaucucccuccgagcgcagccagcgguccagccucgagagacggcaccauucuccuagccaacgcucccacuguucucccagcagaaagaaccauuccucuccgagcgaacgguccuggcgcucuccuagccagagaaaucacugcagcccgcccgagcggagcugucacucucuguccgaacgcgggcuucauagcccuucucagagaucccaccggggaccgagccagcgcagacaucacucccccucugagcggagccacagauccccuagcgagcgcucucaucgguccagcucugaaagacgccaccggagccccucccaaagaucucaucgcggcccuagcgagcggucccacugcucucccagcgaaagacgccaucgguccccuagccagagaucucaccgcggccccuccgagcggagacaccauagcccguccaaacgcucucacagaagcccugcucggcgcucccauagaucucccagcgaacggucccaccacagcccuucugagagaucccaucacagccccucugagcggcgccaucacuccccgagcgaaagaucucauuguuccccuagcgagcggucucacugcagccccuccgaacgcagacaccggagccccuccgagcgcagacaucacucuccuagcgaaaagucccaucacucucccagcgagcggucccaucacucuccuagcgagcgcagacggcacuccccgcuggaacgcagcagacauucucugcucgagcggucccaccgcagccccucugaaagacggucccaucgcagcuuugagcgcucucaccggagaaucuccgaacgcagccacucuccuuccgaaaagagccaucugagcccccuugagcgguccagauguucuccuagcgaacgccgggggcacuccucuagcggaaaaacaugccauucccccucugagagaagccaccgcuccccuagcggcaugcggcaggggagaaccucugaacgcucccaucggagcucuugcgagagaacccggcacuccccgagcgagaugagacccggacgcccuuccggccggaaccacuguucucccagcgaaagaucccgcagaucuccucugaaggaggggcucaaauacagcuuccccggagaacggccgucccauagccugucucgcgacuuuaagaaucagacaacccuccugggcacaacgcacaaaaacccuaaggccggccaaguguggagacccgaggccacccgguga

SEQ ID NO: 66685 - RNA, 447 nt, Artificial Sequence
  derived and/or modified sequence opt5 from C2orf40__Homo_sapiens__NP_115787
auggccgcuagccccgccagaccugcggugcuggcucucaccggccuggcccuucugcuccugcuuugcugggggccgggaggcaucuccgggaacaagcugaaacucaugcugcagaagcgggaggcccccgucccuacaaaaacgaagguugcuguggacgaaaauaaagccaaggaguuccugggaucucucaagcgccagaaaagacaacugugggaucggacccgccccgaagugcagcagugguaccaacaguuucuuuauaugggcuucgacgaggcuaaguuugaagaugacauuacauacuggcugaacagagaucggaaugggcacgaguauuacggagacuauuaccagcgccauuaugaugaggacagcgccaucggcccuagaucccccuacggcuuccggcacggggcgucugucaacuacgaugacuauuga

SEQ ID NO: 66686 - RNA, 834 nt, Artificial Sequence
  derived and/or modified sequence opt5 from C2orf43__Homo_sapiens__NP_001269649
auggacagcgagcugaaggaagagauccccgugcacgaagaguucauucucugcggcggggccgaaacccagguccugaaauguggaccuuggacagaucuuuuucaugaccaauccguuaagagaccgaaacugcucaucuucauuauccccgauucuaacgcucaggagauuaaggacaucuacggccugaaugggcagaucgagcacaaacuugccuuucugcggacgcaugugccuaaggauaugaagcucgugcugauuggacacagcaucggcuccuauuucacccugcagaugcucaaacgcguccccgaacugccugugauuagagcguuucuucuguuccccacaaucgagcggaugucugaaagcccuaacgggcgcauugcuaccccgcuccugugcugguuuagauacguucuuuaugugacaggauaccugcuccugaagcccuguccugagaccaucaaaucccugcucauucggcgcggccugcaagucaugaaucuugagaacgaguucucuccccugaauauccucgaaccuuuuugccuggccaacgccgcuuaucuuggcgggcaggaaaugauggaggugguuaagagagacgaugaaacaaucaaagagcaucuguguaagcucaccuucuacuauggaacgauugaccccuggugcccgaaggaguacuacgaagauaucaaaaaggacuuuccugagggcgauauucggcugugugagaaaaauaucccccacgccuucauuacccacuuuaaccaggaaauggcugacaugaucgccgauagccugaaggacgaccucuccaaaauguga

SEQ ID NO: 66687 - RNA, 876 nt, Artificial Sequence
  derived and/or modified sequence opt5 from C2orf47__Homo_sapiens__NP_078796
auggcccuggcugccagacuccugccccaguuccuucacagccggucccugccuugcggcgcggugcgccucagaaccccggcugucgccgagguucggcugcccucugccacacuuuguuacuuuugccgcuguagacuggggcucggagcugcccuguucccucggagcgcucgcgcccuggcggccuccgcucuccccgcccaaggcucuagauggccugugcugagcucccccgggcuuccugcugccuuugcgucuuucccggccugcccccagcggagcuauuccacggaagagaagccucagcagcaucagaaaaccaagaugaucgugcugggauuuagcaaccccauuaauuggguccgcacaagaaucaaggcuuuccucauuugggccuacuuugacaaggaguucucuaucaccgaauuuuccgaaggcgcuaaacaagccuucgcccacgugagcaagcugcuuucucaguguaaguuugaucugcucgaggagcugguugcuaaagaagugcugcaugcgcucaaggagaaagucacaucccugccugacaaccacaagaaugcccuugcugccaacauugaugaaaucguguucaccagcacaggggacaucucuauuuauuacgaugagaaaggacggaaguuuguuaauauccugaugugcuucugguaucucaccuccgccaacauucccagcgagacgcugcgcggcgcuuccguguuccaggucaaacuuggcaaucaaaacguggaaaccaaacagcugcucucugccagcuacgaguuucagagagaguucacacagggggugaagccggacuggaccaucgcgcggauugaacauuccaaacugcuggaauga

SEQ ID NO: 66688 - RNA, 1188 nt, Artificial Sequence
  derived and/or modified sequence opt5 from C2orf57__Homo_sapiens__NP_689827
auggcccugcccggcuacccucucgggaacguggacgauagcagauccaaggacucuccggcuggagagccccagggccaagucccucugaccgccgauguucuugcggugagcuccucuguggcuagcacagacuggcaggauaucgaccaggccuccuucaaaacggccacaccccgggcuauuucuaccagcggggauaaggacaaauccgccgucgugccugaacacggacagaagacaccccgcaaaaucaccccucugcucccgagccaaaaucccucuccucugcagguuuccaugagccuucagaaccccgcuugggauagacaggugcaagacgcccggaccucucagucccuggucguguuuccuagccaucuccugggcaaggauaagaugucucagauggcguccguucccgagcgcgaaccggagagcgccccuuccgcucccucugccgaacugcagagcacacaacacauggaggcucagccuguggaguccgacgccgaucaugucaccgcgggggccaauggacagcacggcccccaagcugccagcacgaccaaaucugcugaagagaaggccgaacaucccaaagccccucacccggaggcugaggcgcuccccuccgacgaaagcccuguggccaugggcgcuaacguggucgacucucugggggaucuucagacaugguucuuucccccucccccggccggaagcguuuccccuucucccggcccucacgagguggcccuggggagacggccccucgacagcucccuguauaccgcuagcgaagaaaauucuuacaugcgcuccaugacaagccuucuggauagaggagagggcucuauuuccagccucgccgacauccuggugugguccgagaccacgauggggauggcgauugcuacaggauuccuggauucuggccauagcaccgucgccgaccuccugcacuccucuggcccuagccuucgguccgugcccagccugguugggucuguguccagcgccuuuucuuccggacucgucagcggcacaucuagcgcucugcgcaccaucaccagagugcuugagacaguugaacagcggacgguggaggggauccgcuccgccaugagauaucugaccagccaucucacaccgcggcaggcucaagccgauccuaacuacgacuga

SEQ ID NO: 66689 - RNA, 747 nt, Artificial Sequence
  derived and/or modified sequence opt5 from C2orf61__Homo_sapiens__NP_001157033
auggaccagcccgccguggcuaccgccagcacauccaucagagaggaucuggucggcggggaaucuuucauuacggcgagcaagccugcucagaaaaccuccucuuuugagcgggaaggaugguggcgcaucgcccucacagacaccccgauucccggcacauaccaccugaagaccuucaucgaggaaagccuucugaacccuguuauugccacauauaauuuuaaaaacgaggggagaaagaaacccccucucgugcaacggaauaaccccgugcugaaugaucuuccucaguacaugccgcccgacuuccuggaucuccugaagaagcaggucgcuaccuauuccuuuaaagacaagccucgccccucuccuagcacgcugguggauaaagaccaaucccuccagcugagccccggacaguacaacguucuuccggccccugugcccaaguaugcuucuagauccugcgucuuccggagcaccgugcagcgcuuuccuacaaccuacuucaucccccaugagggccccgggccuggacacuauaauguuaaaaugccgcccacaucuuccgugaccagcuguuuucaaucuagagucccucgguuccugcccuccugcagcaagacgccuggccccggcgccuacacaacccuccgccaguuuccgaagcaguccccuacaaucgcgaaaauggggcaggaacauucucuguucuuuaacaauaacaauuggcuucugaaguga

SEQ ID NO: 66690 - RNA, 1449 nt, Artificial Sequence
  derived and/or modified sequence opt5 from C3AR1__Homo_sapiens__NP_004045
auggccagcuucuccgcugagaccaacucuacagaccugcucagccagcccuggaaugaaccuccggugauccuguccauggucauucuuucucugacguuucuccugggccuucccgggaacggacugguucucuggguggccggccugaagaugcaaagaaccgugaauacaaucugguuccugcaccucacccuggcggaucuucugugcugucucagccugccuuuuucccuugcucaucuggcccuccaggggcaguggcccuacggacgguuccugugcaaacugauuccuucuaucauuguccucaacauguuugccagcguguuccugcuuacagcuaucucccuggaccgcugucucguuguguuuaagcccaucuggugccagaaucacagaaacgucggcauggccuguagcauuugcggguguaucugggugguugcuuucgugaugugcauuccugucuuuguguaucgggagaucuucaccacagauaaucauaaccgcuguggauacaaauuuggccugucuuccagccuugacuauccggauuucuacggcgacccccuggaaaauagaucucucgagaacauugugcaaccucccggggaaaugaaugaucggcuggacccuuccagcuuucagaccaacgaucaccccuggacggucccgaccguuuuccagccucagacauuccaacgccccucugccgacucccugccuagaggaagcgcgcggcucaccucccagaaucuguauucuaacguguuuaagcccgccgauguggucagccccaaaaucccuuccggcuucccgauugaggaccaugagacaagcccccuugauaauucugacgcuuuucuguccacccaccucaagcuguucccuagcgccucuagcaacuccuuuuacgaaucugagcuuccccagggguuccaggacuauuacaaccugggacaauuuacggaugacgaucaggugccuacaccccucguugcuaucaccaucacacgccugguggucggcuuccugcucccgagcgugauuaugaucgccugcuacuccuuuauuguuuucagaaugcagcgggggcgcuuugcgaagucucaaucuaaaaccuucagaguggccgucguggucguggcuguuuuucugguguguuggaccccuuaucacaucuucggaguccuuucccugcucacagaccccgaaacgccucugggcaagacccugaugagcugggaucaugugugcauugcccuugcuucugccaauuccugcuucaaccccuuucucuacgcccugcugggcaaagacuuccggaagaaagcucgccagagcauccaggggauccucgaggcggccuuuuccgaggaacugacaagaucuacccacuguccuagcaauaacguuauuuccgagcggaauagcacaaccguguga

SEQ ID NO: 66691 - RNA, 4992 nt, Artificial Sequence
  derived and/or modified sequence opt5 from C3__Homo_sapiens__NP_000055
augggccccaccagcgggccuucccugcuccugcuucugcucacacaucugccgcuugcccugggaucucccauguacagcaucauuacgccuaacauccucagacuggaguccgaagagaccauggugcuggaagcucacgacgcccagggcgauguccccguuacagugaccgugcacgacuucccugggaagaaacucguccugucuagcgagaagacagugcuuacccccgcgacaaaucauaugggaaacguuaccuuuacgauuccugcuaaucgggaguucaaauccgaaaagggccgcaacaaauuugugaccguccaagccacauucgggacccaggugguugagaaggugguccuggugucucuccagagcggauaucuguuuauccagacagauaagaccauuuacacgccgggcuccacagugcuuuauagaaucuucaccgucaaucacaaacugcuccccguuggccggacagugauggugaacaucgaaaauccugaggggauucccgucaagcaagacagccugucuucccagaaccagcugggagugcucccucugagcugggauauccccgaacuuguuaauaugggccaguggaaaauucgcgccuacuaugagaacucuccgcaacagguguuuuccaccgaguucgaagucaaggaguacgugcugccuagcuuugaaguuaucguggagcccaccgaaaaauucuauuacauuuacaaugagaaggggcucgaggucacaaucacggcuagauuucuguauggaaagaaaguggaaggcaccgccuucgucauuuuugggauccaggacggagagcagcggaucucucuuccugaaucccugaagcgcauucccaucgaggauggcagcggcgaagugguucucuccagaaaagugcugcuggacgggguccaaaacccccgggcugaggaucucgugggaaagucucuguacguuagcgccacagugauucuucauuccggcagcgacaugguccaggcggagcgcucugggaucccuauugugaccuccccguaucagauccacuucacaaaaacccccaaguacuucaaaccuggaaugcccuuugaucugaugguguucguuacgaauccugacggcagccccgccuauagagucccgguggcugugcaaggggaagauacaguccagucucucacccagggagacggcguggccaagcugagcaucaacacccacccuucccagaagccccuuucuauuacaguucggaccaaaaagcaagagcugagcgaagcugagcaggccacacgcacgaugcaggcgcucccuuacuccaccgugggcaauagcaacaacuaucugcaucugucuguccucagaacagaacugcggcccggggagacccuuaaugugaacuuucugcuccgcauggacagagcccacgaggcuaaaauccgguacuacacauaucugauuaugaauaagggaagacugcuuaaagccggccgccagguucgggaaccugggcaagaucucgugguccugccccuguccaucaccacggacuucauuccgagcuuuagacucguggcuuacuauacccugaucggagccucuggccagcgcgagguuguggccgauuccgucuggguggacgugaaggauagcugcgucgggucccuuguugugaagucuggccagagcgaagaccggcagccugugcccggacaacagaugacacugaaaaucgagggcgaucauggggcuagagucgugcucguugcgguggacaagggagucuucgugcugaacaaaaagaauaaacugacccaguccaagauuugggauguuguggagaaggccgacaucggcuguacacccgggucuggaaaagauuacgcuggcgucuuuagcgacgccgggcuuaccuucacguccagcucuggccagcaaacagcccagcgcgcugaacuccagugcccucaaccggccgcgcggagacgccgguccgugcagcugaccgagaagagaauggacaaaguuggaaaguaucccaaagaacugcgcaaguguugcgaggauggcaugcgggaaaacccuaugagauuuagcugucagcggcgcacaagauucauuucucucggggaggcuugcaagaaaguguuucuggacuguugcaauuacaucaccgagcuucggagacagcacgcccgcgccucccaccugggacucgcucggagcaaccuggaugaagacauuaucgccgaggaaaauauugucucuagaagcgaguuccccgaauccuggcuguggaacguggaggaucuuaaggagccucccaaaaauggcaucagcaccaagcucaugaacaucuuucugaaagacucuauuacaacgugggaaauccuggcuguguccaugagcgauaagaaagggauuugugucgccgacccuuucgagguuaccgugaugcaagauuucuuuaucgaccuccgccugcccuauuccguggucagaaaugaacagguggagauucgggcgguucuuuacaacuaccgccagaaucaggaacugaaggugagagucgagcuccugcauaacccggccuucugcucucuggcuacaaccaagcggcgccaccaacagacagugaccaucccucccaaaagcucccuuucuguuccuuaugugaucgucccccucaagacgggacugcaggagguggaagucaaagccgcuguguaccaucacuuuauuagcgauggcguuagaaagucccugaaaguggucccggaggggauccggaugaacaagacaguggccguucgcacccucgacccugaaagacugggccgggagggagugcagaaggaggauauucccccugcggaccuuucugaccaaguccccgauaccgaaagcgagacacgcauccugcuccagggcacccccguggcccagaugacagaagacgcuguggaugccgagagacugaaacaucugauuguuacgccuuccggguguggagaacaaaauaugaucggcaugaccccgacagucaucgcugugcacuaucuugacgagaccgagcagugggaaaaguucgggcuggagaaacggcagggagcccucgaacugauuaagaaaggcuacacacagcaacucgccuuuagacagcccagcucugcuuucgcggccuuugugaagcgcgcuccuuccaccuggcugacggccuaugucgugaagguuuucagccuugccgugaaccugaucgcuauugauucucagguccucugcggggccgugaaauggcugauccuggagaagcagaaacccgacggcguuuuucaagaagaugcgccugugauucaccaggagaugaucggaggccuucggaauaacaaugagaaggacauggcucugaccgccuucguccucaucucccugcaggaagccaaagauauuugcgaggaacaggugaacagccuccccgggucuaucacaaaggcuggagacuuucuggaggccaauuacaugaaccuucaaagauccuauaccguugcgauugcuggcuacgcccuggcccagauggggcgccucaagggaccucugcugaauaaauuccuuacaaccgcuaaggauaaaaaccggugggaagacccgggcaagcagcuguacaauguggaggccacaagcuaugcucuccuggcccuccugcagcuuaaagauuuugacuucgugcccccuguggugagauggcugaacgagcaacgcuacuauggcgggggauacggcuccacccaggcgacguucauggucuuucaggcccuggcucaauaucagaaggacgcccccgaucaucaggaacucaaucuggacguuagccuucagcugccuucucggagcuccaaaaucacacaccgcauucauugggagucugcuagccuccugagauccgaagagaccaaggagaacgaaggguucaccgugacagccgagggaaagggccaagggacccucucuguggucacgauguaccacgccaaagcuaaggaucagcugacauguaauaaauuugaccuuaaggugaccaucaaacccgcgccggaaacagagaagcggccucaggaugccaagaacaccaugauucuggaaaucugcacaagauaucggggagaccaggaugcuaccaugagcauccuggacauuuccaugaugacgggcuucgcccccgauaccgacgaucucaaacaacuggccaacggcguugaccgcuacaucucuaaguacgagcuugacaaggcuuuuagcgauagaaauacacugauuaucuaucucgacaaagugucccacagcgaggaugacugucuggccuucaaaguccaucaguacuuuaacguggaacucauucagcccggggcgguuaagguguaugcuuacuauaaucuggaggaaucuugcacccgguucuaccacccugagaaggaagauggaaaacuuaacaagcugugucgcgacgagcugugcagaugugccgaggaaaauugcuuuauccagaaauccgaugacaaggucacacucgaggaacggcuggauaaagccugugagcccggcguggacuaugucuacaagaccagacuugugaagguucaacugagcaacgauuucgacgaauacaucauggcuauugagcagacgaucaaaucuggguccgaugagguccaggugggacaacagcgcacauuuauuagcccuaucaagugccgggaagcccucaaacuggaggaaaagaaacauuaucucauguggggccuguccucugacuucuggggagagaagccgaaucuuagcuacauuaucgggaaggacaccugggucgagcacuggcccgaagaggaugaaugucaggacgaggaaaaccagaaacaaugccaggaucugggcgcguucacagaguccaugguuguguuuggcugcccuaauuga

SEQ ID NO: 66692 - RNA, 1704 nt, Artificial Sequence
  derived and/or modified sequence opt5 from C3orf17__Homo_sapiens__NP_056227
augauggccgcugugcccccuggccuggagccguggaacagaguccggauccccaaggccgggaaucgcagcgcgguuaccgugcagaacccuggagcugcccucgaccugugcauugccgcugugaucaaagaaugucaccuugucauucugucccucaagucucaaacacuggaugccgagacggacgugcuuugcgcuguucuguacagcaaucauaacagaaugggccggcacaaaccccaucucgcccugaaacagguggaacagugucugaagcgccucaagaauaugaaccuggagggguccauccaggaucuuuucgaacuguuuucuagcaaugagaaccaaccucucaccacaaaggucugcgugguucccucccagccuguggucgagcuggugcuuaugaaagugcugggagcguguaagcuccugcugagacuccuggacugcuguugcaaaaccuuccuucugacagucaagcaccucggccugcaggaauuuauuauccuuaaucugguuaugguggggcucgugucucggcuguggguccuguauaaaggagugcucaagcgccugauccuucuguacgagccgcuuuucggccugcuucaggaaguugcccggauucaacccaugccuuauuuuaaggauuucaccuuucccagcgacaucacagaguuccugggccagccuuacuuugaggcuuucaaaaagaaaaugcccauugccuuugcugccaaggggaucaacaaacuccugaauaagcuguuccucauuaacgaacaguccccgagagcgagcgaggaaacccugcuuggaaucucuaaaaaggccaagcagaugaaaauuaaugugcaaaacaaugucgaucugggccagccugugaagaacaaacgcguuuuuaaggaggaauccagcgaguucgacgugagagcuuucuguaaccagcucaaacauaaggccacgcaagagaccucuuuugauuucaagugcucccagagccggcugaaaacaaccaaguauucuucccagaaagucaucgggacaccccacgcuaagagcuuugugcagcgcuucagagaagccgaguccuuuacccaacugucugaagagauccagauggccgucguguggugucggagcaaaaagcucaaggcucaggcgauuuuccucggaaauaaacugcugaaguccaaccgccucaaacaccuggaagcccagggcacgagccuuccuaagaaacuggagugcaucaagacaucuauuugcaaucaucuccugagaggguccggaaucaagaccagcaaacaccaucugcggcaaagacgcucucagaacaaguuucuucggagacagcgcaaaccccagcggaagcuccaaagcacacugcugagagagauucagcaguucucccagggcacccgcaaaucugcuaccgacacaagcgccaaguggcggcucucccacuguacgguucacagaaccgaucuguaccccaauagcaaacaacuucugaacucuggcguguccaugccugucauccagacaaaggaaaagaugauccaugagaaucuccgcgggauucacgaaaacgagaccgacagcuggacagugaugcagaucaauaaaaacucuaccuccggaacgauuaaggaaacagaugacaucgacgauauuuuugcccugaugggcguuuga

SEQ ID NO: 66693 - RNA, 489 nt, Artificial Sequence
  derived and/or modified sequence opt5 from C3orf18__Homo_sapiens__NP_001165212
augaacagcagaaccgccuccgcucggggcugguucucuagcagacccccuacauccgagucugaccuggaaccggccacggaugggcccgcgagcgagaccacaacccucuccccugaagcuacaaccuuuaaugacacacgcauccccgaugccgccggaggcaccgcuggggugggaacgaugcugcuuucuuucggcauuaucaccgucauugggcuggccguugcucucgugcuguacauccggaagaaaaagcgccuugagaaacugagacaccagcucaugccuauguauaacuuugaccccacagaggaacaagaugagcuggaacaggagcugcucgaacauggacgggacgccgcgagcgugcaggccgcuaccuccguccaggccaugcaaggcaagacaacccugccuagccagggcccgcuucagcgccccucuagacugguguucacggauguugcuaaugccauucacgcguga

SEQ ID NO: 66694 - RNA, 2349 nt, Artificial Sequence
  derived and/or modified sequence opt5 from C3orf20__Homo_sapiens__NP_001171887
auggccagacaggugcggacccaccaagagacacugaaccgcuuccagcagcagagcauccaucuccugacggaacuucugagacucaagaugaaagcuauggucgaguccaugucuguuggcgccaauccccuggacauuacccggcgcuuuguggaagcgagccaacuucugcaccucaacgcuaaggagauggccuucaauugccugaucuccacagccgggagaucuggauacagcuccggccagcuguggaaagaaucucucgcuaacaugagcgccauuggggugaauagcccuuaucagcugaucuaccauagcucuaccgcuugucuuuccuuuagccugucugccggaaaggaggcgaaaaagaagauuggcaaaucccggacaaccgaggaugucagcaugccgccccuccaccgcggggugggaacacccgccaacucucuggaguucuccgaccccugcccugaagcuagagaaaaacuucaggagcugugucggcauaucgaggccgaacgcgcuaccuggaagggcagaaauaucagcuaucccaugauucuccggaacuacaaggccaaaaugccuucccaccugaugcuggcgcgcaagggcgauucucaaacgccggggcuccacuaucccccuaccgccggagcucagacacugagccccaccucccauccuagcucugccaaucaccauuuuucccagcacugccaggagggcaaggcucccaaaaaggccuucaaauuucacuacacauucuaugacgggagcucuuuuguuuacuacccgagcggaaacguggccgucugucaaaucccuaccugcuguagaggccggacgauuacaugccuuuucaaugauauccccggguuuucccugcucgcucuguucaacaccgaaggacagggcugugugcauuauaaucuuaagacaucuugcccuuacguucugauucucgacgaggaaggcgggaccaccaacgaucagcaaggauaugugguccacaaauggagcuggacaucccgcacggagacccugcugagccucgaguacaaggugaaugaagagaugaaacugaaggugcuuggccaggacucuaucacagucaccuuuacaucccugaacgaaaccguuacgcucacagugagcgcgaacaauuguccccaugggauggccuaugauaagagacugaaccggagaauuucuaauauggacgauaaaguguacaagaugucccgcgcucuugccgagaucaaaaagcgguuccagaaaaccgucacccaguucaucaacagcauucugcucgccgcuggacuguuuacaaucgaauaucccaccaagaaggaggaggaagaguucgugagauuuaaaaugcgcucccggacacacccugaaagacugccgaagcucucucuguacagcggcgagucccuucugcgcucucaaagcgggcaucucgaauccagcauugccgagacgcugaaagacgagcccgaaucugcgccuguuucccccgugcggaagaccacaaaaauccacaccaaggcuaaggucacaagcagaggaaaagcccgcgagggccggucuccuaccagaugggccgcucugcccuccgauugcccgcuugugcuccgcaagcugaugcugaaagaagacacgcgggccggcugcaagugucucguuaaagcuccucuggugagcgacgucgagcuugagagauuccugcucgccccucgggauccuucucaggugcuggucuuugggauuaucagcucccagaauuacaccagcacaggacagcugcaauggcuucucaacacccuguauaaucaccagcagcgcggcagagggucucccugcauccagugucgguacgacuccuauagacugcuccaauacgaucuggacagcccucuucaggaagaucccccgcugauggugaagaagaacuccguugugcagggaaugauucucauguucgcgggcgggaaacugaucuuuggcggacgcguccugaauggcuaugggcuuucuaagcagaaccuccugaaacaaauuuuccggagccagcaggacuacaagaugggauauuuucugccugaugacuacaaauucuccgugcccaauucuguucucagccuggaggauuccgaaucugugaagaaagccgagagcgaagacauccaaggcuccuccucuucccuugcucuggaggauuacgucgagaaggaacucagccuggaggccgaaaagacaagagagcccgaaguggagcugcauccucuuucucgcgacuccaaaauuaccagcuggaagaaacaggcuucuaagaaauga

SEQ ID NO: 66695 - RNA, 513 nt, Artificial Sequence
  derived and/or modified sequence opt5 from C3orf35__Homo_sapiens__NP_848029
augaagaccauggccacaagaaaacggugcaagcugagccgcacgggccccgaguucgaaaacgugaucaaaagacuccugugugcucggaccuuucacacacgcauugggggagaccuuacccauggcaucauuaauagagggcggcgcgccaacgcggagcagaugggacugcaaggcuccgcucagcacuucaauaucuuuccucucgaucuguggacacaggggaagaaaaccgaaguccagaagagagagggaacagacucuauuccggccgccggccggagcggcaccgcuaaccaacccuccaucgccccucaucgcugccuuuucucuagagggaucacggcucuggauggacucaagcggggccgcggguguaauggagccgcgcaccugguuagaggcgacgccuggaaaaccaagcugggggaacccugggugagcauugcucucgcccuggcuggaccuggcgccauccuuauucuggagcucuccugguuucugggcuga

SEQ ID NO: 66696 - RNA, 729 nt, Artificial Sequence
  derived and/or modified sequence opt5 from C3orf56__Homo_sapiens__NP_001007535
augggcaccggggccagcgagaagcaggcugaacaaaaagugagacgggccuucgaggcguccgaagaggcucacggaacacuggccgccucuacgcccugggucgcuaugggcagcgccuacggguccugcaccugucucggagcucagccuguuacagaccuggcccuuuggccggugaucuauucuugcaugggcuuuagcccccaggcguacccugccuucugggcuuaucccugggugcuguacgggggauaucucuggaugggcuacccucccccugccgcucuggucccguccguguggcuuuauuggcgcggcgccucuagcuuugauccccugauuggguccccuuaccucgcggcccuggcucccaaccuguucccuuuucccaugaaguucccgccuaccuacagccucgccucucccacacugggaggcgcuaccuccagccauuguccucagguugggugcuggacacccgccucuuccgcccccagagcugcgguggaaggaccuagccggggcgccccguaucuuaaaaccuguaaggcucccccuucugagugggccucccgcuuugggaucugggcuccccugccuugcuguagcuccgagcucagaccccugccgccuucucccauugaagacagccaacuugauccuggaugcucccggucuagcucccgcagccccuguagagcccggcgcagacuguucgagugcuga

SEQ ID NO: 66697 - RNA, 666 nt, Artificial Sequence
  derived and/or modified sequence opt5 from C3orf58__Homo_sapiens__NP_001127942
augaaaagcgagaacggcaccguggucggguccuuccccucugacgaaggauggccuuuugccaaguaccugggcgcuugcgggagaaugguugccgugaauuaugugggagaggaacucuggagcuacuucaacgcgccgugggagaagcgggucgaucuggcuuggcagcuuauggaaaucgccgagcaacugacaaauaacgacuuugaguucgcccucuaucugcuugauguguccuuugacaauuucgcuguuggcccccgcgaugggaaagugauuaucgucgacgccgaaaacgugcugguugcugauaagagacucauucggcagaauaaaccugagaacugggacgugugguacgaaucuaaguuugaugacugugauaaggaggccugccugagcuucuccaaagagauccugugugcgcgcgccacggucgaccacaauuauuacgcugugugccagaaccuccugucuagacaugccaccuggcggggaacaagcggcggccuucugcacgaucccccuuccgaaauugcuaaggacgggcgccucgaggcccugcuugacgaaugugcgaaucccaaaaagagauauggacgguuucaggccgcuaaagagcugcgcgaauaccucgcccaacugagcaacaaugugagauga

SEQ ID NO: 66698 - RNA, 1692 nt, Artificial Sequence
  derived and/or modified sequence opt5 from C3orf67__Homo_sapiens__NP_940865
augaucaagagaaaaauuuggugcaaccuguguaucgaccucguggccuucaccagcgagauuuuuaagggcgcugucuuccagucccuggaugggaucguugugucugccaauugcaaacuucggaagauuuuuacacugaaaagcaagccccaagacacggcggauaaggacgcuguguacggagucccuuucuccaccgaugaaccgacagacaucaucccccgcucuugucagcucaugaccgaugugccucacguuacacagcugcuuaacaugaccaaacugagacagacagagauuaaguuuggcgggcauccccuccggagcgccgaauccgaccaauucaucaaucgcggaaccucuauuacgagaaacagcaaaaaucaggaugugugccacaucgccuuuggcuccaagguccuggggccucccccucugagcggacggcgcaacaauaugaaaauuucuuccgagaccgugagaagcguuggcucuaagaacaaucgguccugucagccgagcacaguggaaaagugcgucaacggcaccgagaugucugcucuccugauccccgaguccgaggaacaggggaauaaagaaaacauucaucaaaucaagcagacagugccuauccacgccgcuaaucuucauauuaugcacccccacccuccccaggagccgagcgccgacaaaaacaauaaccgcagacggcugcgccucaaguccaccucuagagagcggacggaaacaccuagcggauccagcucuggcaacaaucgcaucgaggauaaagcguccaccauucugacaaccgugagccagcaaggggccgaacuucugaacucuggaacccucggcccccagagcccugaccaguccgaugaguggaucuuccccgaaaaugcugaccauauuucuuaucuggccagcuccagacaaagccugcuccugggggacgauucuuguaaccccucccaccuuuggcuggaggcuagcaaggagucugaacaugaccagcaggccgaggaaucccagagcgucccuaaagauaucuuuacauucuccucucggccgagaagcgcgccccacggaaagacgcaaaccauguccccugaggaacucucuuuuauccuggaccuuaaggaggauaauagcguuacaucccgcgacacccagagcgaggaugacuucuacggcggcgauucuuccgaagaggaauaugacuggcggaacuaccagcccagccagaugucugaguccgaacugcaaaugcucgccagccugagauggcagcagaaugaggagcuggaagaugcugggacaucucacggacucagcgccucccagguggacaacugcaaugugagcauuucuaccuccagcgacgauacgacaaccuggaacuccugucugccucccccggucaaucaaggccgccauuaucagaaagagaugaacccucccucuccuagcaauccccgggacuggcuuaacaugcuguccccucccaucgugccgccuucucagcagcccgcugaacaaagacccgauagcugcgagucccucucuguucagggggaggaagaccugagcguggaggaagaugaggaaguccuuacccugcucuacgacccuugucugaauugcuauuuugauccgcagacaggaaaguacuacgagcugguguga

SEQ ID NO: 66699 - RNA, 303 nt, Artificial Sequence
  derived and/or modified sequence opt5 from C3orf79__Homo_sapiens__NP_001094807
augcacgugugcgaccugcagaagcucgucagaauccaacuggccuucaccacauuucccuggauguucagcugucaucuucugccuacgccggagcucuccucuaaacggaaccagugccugcuuuacaagaccagcggcugucugacacagaugcccauucucuaugggcacccugcuacccugcugaaagauuacauccuccaggccauucugcaacccggaaagaaaauccagggcgggacagaaauucagcgcggauccuuugcgaaucaguaucaaaccgacgcuucucaucuuuga

SEQ ID NO: 66700 - RNA, 5097 nt, Artificial Sequence
  derived and/or modified sequence opt5 from C4A__Homo_sapiens__NP_001239133
augagacugcucuggggccugaucugggccagcuccuucuuuacccuuucucugcagaagccccggcuccugcuuuucagcccuuccgugguccaccuggggguuccgcucucugugggagugcaacugcaggacgucccccgcggccaggugguuaaagggagcguguuucugagaaacccuucccggaauaacguccccugcucuccuaagguggauuucacacucagcuccgagcgcgacuuugcucugcuuagccugcagguuccccucaaagaugccaagucuuguggacugcaucaacuucugagaggcccugaagugcagcucgucgcgcacuccccguggcugaaagacagccugucucggacgaccaauauucaggggaucaaccuccuguucuccagccgcagaggacaucuuuuucugcagacagaucaacccauuuacaauccuggccagcgggugcgcuauagaguguucgcucucgaccagaagaugcggcccucuaccgauacaaucaccgucaugguugagaacucccacggccugcgcgugagaaagaaagaaguguacaugccuagcuccauuuuucaggacgauuucgucauccccgacaucucugagccggggacauggaagauuagcgcccgguuuuccgauggacuugaaagcaauucuuccacccaauucgaggugaaaaaguauguucugccuaacuuugaggugaaaaucacgcccggcaagccuuacauucucaccguccccgggcaucuggacgaaaugcagcuggauauccaggcccgcuauauuuacggaaagcccgugcaaggcguugcuuaugugagauucgggcuccuggacgaggacggaaaaaagacauucuuucggggccuugaaagccagaccaaacuggucaauggccagucucacaucagccucuccaaggccgaguuccaggaugcucuggagaaacuuaacauggggauuacagaccugcaaggacucagacuguacguggccgcggccaucaucgaaucuccuggcggggagauggaagaggcugaacugaccagcugguacuuugucuccagcccguucucucucgaucuguccaagacgaaacgccaccuugugcccggagccccuuuucugcuccaggcucugguucgggagaugagcggcucucccgccuccgggauuccugugaaggucagcgcgacaguguccucucccggaagcguuccggaggugcaggacauccagcaaaauaccgauggcuccggccaggucucuauuccuaucauuaucccccagacaaucagcgaacugcagcuuuccgugagcgccgggucuccucaucccgcuauugccagacucaccguggcugccccucccuccggaggcccgggguuccugagcaucgagcgcccugacucucggccccccagaguuggagauacccugaaccucaaucugcgcgccgucggcuccggggcuacauuuagccacuauuacuauaugauucuuucucggggccaaaucguguucaugaacagagaaccuaagcgcacgcugaccagcguguccgucuuuguggaccaucaccucgcgccgagcuucuacuuuguugccuucuauuaccacggagaucaucccguggcuaauucucugcgggucgacgugcaggccggcgccugcgaggggaaacuggaacuuuccguugauggagcuaagcaguauagaaacggcgagagcgugaaacuccaccuggagacagacucccuggcccucgucgcgcugggggcucuugacaccgcccuguacgccgcuggaucuaagagccauaaaccucucaacaugggcaagguguuugaagccaugaauuccuacgaucugggguguggccccggaggcggggacucugcucugcagguuuuccaagccgcgggacuugccuucagcgauggcgaccaguggacacucucccgcaagcggcugucuugcccuaaagagaagaccacgagaaaaaagcggaacgugaauuuucagaaagcuauuaacgaaaagcuggggcaauaugccagccccacagcuaagcgcuguugccaggauggagucaccagacucccuaugaugcgguccugugagcagagagccgcgcgcgugcagcaacccgacugccgggaaccguuccugagcuguugccaguuugccgagucucuuagaaaaaagucccgcgauaaaggccaggcugggcugcagagagcccucgagauccugcaagaagaggaccugaucgaugaagacgauauuccugugcggagcuucuuucccgagaauuggcuuuggcgcgucgagaccguugacagauuccagauccucacacuguggcugccugauucucucaccacaugggaaauucacggccugucccuuagcaagacgaaaggacuguguguggcuacccccgugcagcuccgggucuuucgcgaguuccaucugcaccugagacuuccgaugucugugcggcgcuuugaacagcuggagcucagaccuguucuguacaacuaucucgacaagaaucugacaguguccguccacgugagccccguugaaggccuuugccuggccgggggaggcgggcucgcccaacaggugcuggucccugcuggauccgcgcggcccguggccuucagcguugugcccaccgcugccgccgcugucucucugaaggugguggcccgcggcagcuuugaguucccugucggggacgcgguuuccaaagugcuucagaucgagaaggaaggcgcuauucauagagaggaacugguguacgagcucaacccgcuggaucaccggggaagaacacucgaaauccccggcaauucugacccuaacaugauucccgauggggacuuuaauagcuauguccgcgugaccgccuccgauccucuggacacgcuuggaucugagggcgcccugagccccgggggaguugcuucccuccugcggcugccuagaggcugcggcgagcaaaccaugaucuaccuugccccgacacuggcggcuucucgcuaucucgauaaaaccgaacaguggagcacacugcccccugagaccaaggaccaugccguggaucucauccagaaaggguacaugcggauucagcaauucagaaaggccgacggauccuacgcugccuggcugagccgcgauucuuccacguggcuuacagcuuucguccugaaagugcugagccucgcccaggaacagguuggcgggucucccgagaagcugcaggaaaccuccaacuggcuucugagccaacagcaggcggacggauccuuucaggauccuugucccgugcucgaccggucuaugcaaggcgggcuggucggaaaugacgagacaguggcccucaccgcuuucgucaccaucgcccugcaccacggccuugcuguguuucaggaugagggcgccgaaccgcugaagcagagaguugaggccagcauuuccaaagcuaacagcuuccugggggaaaaggcgucugccggacuccugggcgcucaugccgccgcuaucacagccuaugcgcuuacgcugaccaaagcuccuguggaccuccugggggucgcccacaauaaccucauggccauggcucaggagacaggagauaaccuguacuggggcuccgugaccgggagccaaucuaaugccguuagccccacacccgcgccucgcaaccccuccgacccuaugccgcaggcucccgcccuuuggauugagaccacggccuaugcucugcugcaucuccugcuucacgaaggaaaggccgagauggcugaucaggccucugcguggcugacacggcaaggcagcuuucagggcggguucagauccacccaggacaccgugaucgcccucgaugcucugucugccuacuggaucgcuagccauacaaccgaagagcggggacucaaugucacacuguccagcacgggccgcaacggguuuaaaucucacgcccuucagcugaauaacagacaaauucggggacuggaagaggagcuccaguucucccugggcagcaagaucaaugugaagguggggggaaacuccaaaggcacccuuaagguucugcgcacauauaauguccucgacaugaaaaacaccacaugccaggaucugcagauugaagugaccgugaagggccacgucgaguacacgauggaagccaaugaggacuaugaagauuacgaguacgacgagcugccugcuaaagacgaucccgacgcgccucuccaacccgugaccccgcuucagcuguuugaagggagacggaacagacgccggagagaggccccuaagcugacaucucucagcgaucgcuauguuucccauuucgaaaccgagggaccccacgugcugcuuuacuuugacucugucccuacaagccgggaaugugugggcuucgaggcuguucaggaggugcccgucgggcuggugcagccugccuccgccacccucuaugauuacuauaaucccgaaagacgcugcagcguuuucuacggagcuccgucuaagucccggcugcuggccacacucuguagcgcggaggugugccaaugugcugaaggcaaaugcccuagacagcgcagagcccuugagcgggggcugcaggacgaggauggauaucgcaugaaguuugccuguuacuaccccagagucgaauauggcuuccaagugaaagugcugcgggaggacucucgcgcugccuuuagacucuucgaaaccaagaucacgcagguccugcauuuuacaaaagauguuaaggcggccgcuaaccagaugcggaauuuccuugugagagccuccugccgccugcggcucgagcccggcaaggaauaccugauuauggggcuggacggagcuaccuaugaucucgagggccacccucaguaccuucuggacagcaacucuuggaucgaggaaaugccgagcgagagacugugucgcuccacccggcaaagagccgcuugcgcccagcucaacgauuuucugcaggaauaugggacacagggaugccaaguguga

SEQ ID NO: 66701 - RNA, 5235 nt, Artificial Sequence
  derived and/or modified sequence opt5 from C4B_2__Homo_sapiens__NP_001229752
augagacugcucuggggacugaucugggccagcuccuucuuuacccuuucucugcagaagccccggcuccugcuuuucagcccuuccgugguccaccuggggguuccccucucugugggagugcagcugcaggacguccccagaggccaggugguuaaagggagcguguuucugagaaacccuucccggaauaacguccccugcucuccuaagguggauuucacacucagcuccgagcgcgacuuugcucugcuuagccugcagguuccccucaaagaugccaagucuuguggacugcaccaacuucugagaggcccugaagugcagcucgucgcgcacuccccguggcugaaagacagccugucucggacgaccaauauucaggggaucaaccuccuguucuccagccgcagaggacaucuuuuucugcagacagaucaacccauuuacaauccuggccagcgggugcgcuauagaguguucgcucucgaccagaagaugcggcccucuaccgauacaaucaccgucaugguugagaacucccacggccugcgcgugagaaagaaagaaguguacaugccuagcuccauuuuucaggacgauuucgucauccccgacaucucugagccggggacauggaagauuagcgcccgguuuuccgauggacuugaaagcaauucuuccacccaauucgaggugaaaaaguauguucugccuaacuuugaggugaaaaucacgcccggcaagccuuacauucucaccguccccgggcaucuggacgaaaugcagcuggauauccaggcccgcuauauuuacggaaagcccgugcaaggcguugcuuaugugagauucgggcuccuggacgaggacggcaaaaagacauucuuucggggccuugaaagccagaccaaacuggucaauggccagucucacaucagccucuccaaggccgaguuccaggaugcucuggagaaacuuaacauggggauuacagaccugcaaggacucagacuguacguggccgcggccaucaucgaauacccuggcggggagauggaagaggcugaacugaccucuugguauuuugucagcuccccguucagccucgaucugucuaagacgaaacgccaccuugugcccggagccccuuuucugcuccaggcucugguucgggagauguccggcagccccgccucugggauuccugugaaggucuccgcgacagugagcucccccggaucuguuccggaggugcaggacauccagcaaaauaccgauggcagcggccaggucuccauuccuaucauuaucccccagacaaucucugaacugcagcuuagcguguccgccgggagcccucaucccgcuauugccagacucaccguggcugccccucccucuggaggcccgggguuccuguccaucgagcgcccugacagccggccgcccagaguuggagauacccugaaccucaaucugcgcgccgucggcucuggggcuacauuuucccacuacuauuacaugauucuuagccggggccaaaucguguucaugaacagagaaccuaagcgcacgcugaccucugugagcgucuuuguggaccaucaccucgcgccguccuucuauuuuguugccuucuacuaucacggagaucaucccguggcuaauagccugcgggucgacgugcaggccggcgccugcgaggggaaacuggaacuuucuguugauggagcuaagcaguacagaaacggcgaguccgugaaacuccaccuggagacagacagccuggcccucgucgcgcugggggcucuugacaccgcccuguacgccgcuggauccaagucucauaaaccucucaacaugggcaagguguuugaagccaugaauagcuaugaucugggguguggccccggaggcggggacuccgcucugcagguuuuccaagccgcgggacuugccuucucugauggcgaccaguggacacucagccgcaagcggcuguccugcccuaaagagaagaccacgcgcaaaaagcggaacgugaauuuucagaaagcuauuaacgaaaagcuggggcaauacgccucucccacagcuaagcgcuguugccaggauggagucaccagacucccuaugaugcggagcugugagcagagagccgcgcgcgugcagcaacccgacugccgggaaccguuccuguccuguugccaguuugccgagagccuucgcaaaaagucucgcgauaaaggccaggcugggcugcagagagcccucgagauccugcaagaagaggaccugaucgaugaagacgauauuccugugcgguccuucuuucccgagaauuggcuuuggcgcgucgagaccguugacagauuccagauccucacacuguggcugccugauagccucaccacaugggaaauucacggccugucucuuuccaagacgaaaggacuguguguggcuacccccgugcagcuccgggucuuucgcgaguuccaucugcaccugagacuuccgaugagcgugcggcgcuuugaacagcuggagcucagaccuguucuguauaacuaccucgacaagaaucugacagugucuguccacgugucccccguugaaggccuuugccuggccgggggaggcgggcucgcccaacaggugcuggucccugcuggaagcgcgcggcccguggccuucuccguugugcccaccgcugccgccgcugucagccugaaggugguggcccgcggcucuuuugaguucccugucggggacgcgguuagcaaagugcuucagaucgagaaggaaggcgcuauucauagagaggaacugguguaugagcucaacccgcuggaucaccggggaagaacacucgaaauccccggcaauuccgacccuaacaugauucccgauggggacuuuaauucuuacguccgcgugaccgccagcgauccucuggacacgcuuggauccgagggcgcccugucucccgggggaguugcuagccuccugcggcugccuagaggcugcggcgagcaaaccaugaucuaucuugccccgacacuggcggcuucccgcuaccucgauaaaaccgaacaguggucuacacugcccccugagaccaaggaccaugccguggaucucauccagaaaggguacaugcggauucagcaauucagaaaggccgacggaagcuaugcugccuggcugucccgcggcagcucuacguggcuuacagcuuucguccugaaagugcugucccucgcccaggaacagguugggggaagccccgagaagcugcaggaaaccucuaacuggcuucugucccaacagcaggcggauggcagcuuucaggaccucuccccugugauccaccggucuaugcaagggggacuggucggcaaugaugagacaguggcccucaccgcuuucgucaccauugcccugcaccauggccuugcuguguuucaggacgagggggccgaaccccugaagcagagaguugaggccagcaucuccaaagcuagcucuuuccugggagaaaaggcguccgccggccuccugggggcucacgccgccgcuauuacagccuacgcgcuuacgcugaccaaagcuccggccgaccuccgcggaguggcccauaacaaucugauggcuauggcccaggagacaggcgauaaccucuauugggggagcgucaccggaucucaaagcaacgcgguguccccuacacccgcuccccggaauccuucugaccccaugccucaggccccggcccuguggaucgagaccacggcuuacgcccuucugcaucugcuccugcaugaaggcaaggcugagauggccgaucaggcggccgcuuggcuuacaagacaaggcagcuuucaagggggauuccgguccacccaggacaccguuaucgcccuggaugcucucucugccuauuggauugccagccacacaaccgaagaaagaggccugaacgugacacucuccagcacggggagaaauggauuuaaaucucacgcucugcagcuuaacaaucggcaaauccgcggccuggaagaggagcugcaguucucccucgggagcaagauuaacgucaaggugggaggcaauuccaaaggcacccugaaggugcuuagaacauacaacguucuggacaugaaaaauaccacaugucaggaucuccagaucgaagucaccgugaaggggcauguggaguauacgauggaagcgaacgaggacuacgaagauuacgaguaugacgagcugcccgccaaagaugacccugacgcuccccugcaaccugucacaccccuccagcuuuuugaaggacggagaaaucgccggagacgcgaggccccgaaggugguugaggagcaggaaucucgggugcacuacaccgucugcauuuggagaaacggcaagguggggcugagcggaauggccaucgcugauguuacccugcucuccggcuuccaugcccugcgcgcggaccuugagaaacugacaucucucagcgaucgguaugugucccacuuugagaccgaagggccucauguccugcuguacuucgacagcgugcccacaucuagagaguguguuggauucgaagcugugcaggaggucccugugggccucgugcaacccgccuccgccacccuuuaugauuacuauaauccugagcgcagaugcagcgucuuuuacggcgcucccucuaagucccggcugcuggccacgcucuguagcgcggaaguuugccagugugccgaggggaaaugcccgcgccagagacgggcucuggaacgcggacuucaagacgaggauggcuacagaaugaaguucgccuguuauuacccucggguggaauauggguuucaggugaaaguccugagagaggacucucgcgcugccuuccggcucuuugagacaaagaucacccaggugcugcacuucaccaaggauguuaaagcugccgcgaaccagaugagaaauuuucuggugcgcgccagcugccggcucagacuugaacccggaaaggaguaccugauuaugggccuggacggggcuacauaugaucucgaaggacacccccaauaccugcuugacuccaacucuuggaucgaggaaaugccuagcgagcggcugugucgcuccaccagacagcgggccgcuugcgcccagcucaacgauuuccugcaggaguauggcacgcaaggcugccaggucuga

SEQ ID NO: 66702 - RNA, 5235 nt, Artificial Sequence
  derived and/or modified sequence opt5 from C4B__Homo_sapiens__NP_001002029
augagacugcucuggggccugaucugggccagcuccuucuuuacccuuucucugcagaagccccggcuccugcuuuucagcccuuccgugguccaccuggggguuccgcucucugugggagugcaacugcaggacgucccccgcggccaggugguuaaagggagcguguuucugagaaacccuucccggaauaacguccccugcucuccuaagguggauuucacacucagcuccgagcgcgacuuugcucugcuuagccugcagguuccccucaaagaugccaagucuuguggacugcaucaacuucugagaggcccugaagugcagcucgucgcgcacuccccguggcugaaagacagccugucucggacgaccaauauucaggggaucaaccuccuguucuccagccgcagaggacaucuuuuucugcagacagaucaacccauuuacaauccuggccagcgggugcgcuauagaguguucgcucucgaccagaagaugcggcccucuaccgauacaaucaccgucaugguugagaacucccacggccugcgcgugagaaagaaagaaguguacaugccuagcuccauuuuucaggacgauuucgucauccccgacaucucugagccggggacauggaagauuagcgcccgguuuuccgauggacuugaaagcaauucuuccacccaauucgaggugaaaaaguauguucugccuaacuuugaggugaaaaucacgcccggcaagccuuacauucucaccguccccgggcaucuggacgaaaugcagcuggauauccaggcccgcuauauuuacggaaagcccgugcaaggcguugcuuaugugagauucgggcuccuggacgaggacggaaaaaagacauucuuucggggccuugaaagccagaccaaacuggucaauggccagucucacaucagccucuccaaggccgaguuccaggaugcucuggagaaacuuaacauggggauuacagaccugcaaggacucagacuguacguggccgcggccaucaucgaaucuccuggcggggagauggaagaggcugaacugaccagcugguacuuugucuccagcccguucucucucgaucuguccaagacgaaacgccaccuugugcccggagccccuuuucugcuccaggcucugguucgggagaugagcggcucucccgccuccgggauuccugugaaggucagcgcgacaguguccucucccggaagcguuccggaggugcaggacauccagcaaaauaccgauggcuccggccaggucucuauuccuaucauuaucccccagacaaucagcgaacugcagcuuuccgugagcgccgggucuccucaucccgcuauugccagacucaccguggcugccccucccuccggaggcccgggguuccugagcaucgagcgcccugacucucggccccccagaguuggagauacccugaaccucaaucugcgcgccgucggcuccggggcuacauuuagccacuauuacuauaugauucuuucucggggccaaaucguguucaugaacagagaaccuaagcgcacgcugaccagcguguccgucuuuguggaccaucaccucgcgccgagcuucuacuuuguugccuucuauuaccacggagaucaucccguggcuaauucucugcgggucgacgugcaggccggcgccugcgaggggaaacuggaacuuuccguugauggagcuaagcaguauagaaacggcgagagcgugaaacuccaccuggagacagacucccuggcccucgucgcgcugggggcucuugacaccgcccuguacgccgcuggaucuaagagccauaaaccucucaacaugggcaagguguuugaagccaugaauuccuacgaucugggguguggccccggaggcggggacucugcucugcagguuuuccaagccgcgggacuugccuucagcgauggcgaccaguggacacucucccgcaagcggcugucuugcccuaaagagaagaccacgagaaaaaagcggaacgugaauuuucagaaagcuauuaacgaaaagcuggggcaauaugccagccccacagcuaagcgcuguugccaggauggagucaccagacucccuaugaugcgguccugugagcagagagccgcgcgcgugcagcaacccgacugccgggaaccguuccugagcuguugccaguuugccgagucucuuagaaaaaagucccgcgauaaaggccaggcugggcugcagagagcccucgagauccugcaagaagaggaccugaucgaugaagacgauauuccugugcggagcuucuuucccgagaauuggcuuuggcgcgucgagaccguugacagauuccagauccucacacuguggcugccugauucucucaccacaugggaaauucacggccugucccuuagcaagacgaaaggacuguguguggcuacccccgugcagcuccgggucuuucgcgaguuccaucugcaccugagacuuccgaugucugugcggcgcuuugaacagcuggagcucagaccuguucuguacaacuaucucgacaagaaucugacaguguccguccacgugagccccguugaaggccuuugccuggccgggggaggcgggcucgcccaacaggugcuggucccugcuggauccgcgcggcccguggccuucagcguugugcccaccgcugccacagccgucucucugaaggugguggcucgcggcagcuuugaguucccugucggggacgccguuuccaaagugcuucagaucgagaaggaaggcgcgauucauagagaggaacugguguacgagcucaacccgcuggaucaccggggaagaacccucgaaauccccggcaauucugacccuaacaugauucccgauggggacuuuaauagcuauguccgcgugacggcuuccgauccucuggacacccuuggaucugagggcgcccugagccccgggggaguugccucccuccugcggcugccuagaggcugcggcgagcaaacaaugaucuaccuugcuccgacccuggccgcgucucgcuaucucgauaaaacagaacaguggagcacccugcccccugagacgaaggaccaugcuguggaucucauccagaaaggguacaugcggauucagcaauucagaaaggccgacggauccuacgccgcuuggcugagccgcggcucuuccacauggcuuaccgccuucguccugaaagugcugagccucgcucaggaacagguugggggaucucccgagaagcugcaggaaacauccaacuggcuucugagccaacagcaggccgauggcuccuuucaggaccucucuccugugauccaccggagcaugcaagggggacuggucggcaaugaugagaccguggcgcucaccgccuucgucacaauugcucugcaccauggccuugccguguuucaggacgagggggcugaaccccugaagcagagaguugaggccuccaucagcaaagccucuuccuuccugggagaaaaggcuagcgcgggccuccugggggcccacgcugccgccauuacggcuuaugcccuuacccugacaaaagcgccggcugaccuccgcggaguggcccauaacaaucugauggccauggcucaggagaccggcgauaaccucuacugggggucugucacaggaagccaauccaacgccgugucuccuacccccgcgccccggaauccuagcgaccccaugccucaggcuccggcccuguggaucgagacgacagccuaugcucuucugcaccugcuccugcaugaaggcaaggccgagauggcugaucaggccgcggccuggcuuaccagacaaggcuccuuucaggggggauuccggucuacccaggacacaguuaucgcucuggaugcccucagcgcuuacuggauugccucccacaccacagaagagcgcggccugaacgugacgcucagcucuaccgggagaaauggauuuaaaucccacgcccugcagcuuaacaaucggcaaauccgcggccuggaagaggagcugcaguucagccucggguccaagauuaacgucaaggugggaggcaauucuaaaggcacacugaaggugcuuagaaccuauaacguucuggacaugaaaaauacaaccugucaggaucuccagaucgaagucacggugaaggggcauguggaguacaccauggaagcuaacgaggacuaugaagauuacgaguacgacgagcugcccgcgaaagaugacccugacgccccccugcaaccugucacaccccuccagcuuuuugaaggacggagaaaucgccggagacgcgaggcuccgaaggugguugaagagcaggaaagccgggugcacuauaccgucugcauuuggagaaacggcaagguggggcuguccggaauggccaucgccgauguuacacugcucucuggcuuccaugcucugcgcgccgaccuugagaaacugaccagccucuccgaucgguacgugagccacuuugagacagaagggccucauguccugcuguauuucgacucugugcccaccuccagagaguguguuggauucgaagcggugcaggaggucccugugggccucgugcaacccgcuagcgccacgcuuuacgauuauuacaauccugagcgcagaugcucugucuuuuauggcgcccccuccaagagccggcugcuggcuacacucuguucugccgaaguuugccagugugcggaggggaaaugcccgcgccagagacgggcccuggaacgcggacuucaagacgaggauggcuacagaaugaaguucgcuuguuacuauccucggguggaauacggguuucaggugaaaguccugagagaggacagccgcgccgcuuuccggcucuuugagaccaagaucacccaggugcugcacuucacaaaggauguuaaagccgcugccaaccagaugagaaauuuucuggugcgcgcguccugccggcucagacuugaacccggaaaggaguaucugauuaugggccuggacggggccaccuacgaucucgaaggacacccccaauaucugcuugacucuaacagcuggaucgaggaaaugccuuccgagcggcugugucgcagcacgagacagcgggcugccugcgcucagcucaacgauuuccugcaggaguacggcacacaaggcugccaggucuga

SEQ ID NO: 66703 - RNA, 1794 nt, Artificial Sequence
  derived and/or modified sequence opt5 from C4BPA__Homo_sapiens__XP_005273308
augcaucccccuaagaccccgagcggcgcccugcacagaaaacggaagauggcugccuggcccuucucccgccucuggaaagugucugacccuauccuguuucagaugacacuuauugcggcucugcuccccgccguccuggggaacugcggaccucccccuacgcuuagcuucgccgcuccgauggauaucacccugacagagaccagauuuaagacaggcaccacacucaaauacaccugucugcccggguauguucggucccacucuacgcaaacccugacaugcaauagcgacggagaauggguguacaacaccuucuguauuuauaagcgcugcagacauccuggcgagcuccggaauggacagguggaaaucaagacagaucuguccuuugggucucagauugaguucagcuguuccgaaggcuuuuuccuuaucggcagcaccacgucucgcugcgagguccaggacagaggggugggauggucccacccccugccucaaugugagaucguuaaaugcaagcccccgccugauauucggaacggccgccauagcggggaagagaauuuuuacgccuauggauucucugugacauacuccugugaccccagauuuagccuccugggccacgcuucuaucuccugcaccgucgaaaacgagacaauugggguguggcggccuagcccucccaccugugagaaaauuaccugccgcaagcccgauguuucccacggagaaauggugucuggcuucggcccgaucuauaauuacaaagacacaaucgucuuuaagugccagaagggguucgugcuuagaggaagcuccgugauucauugugaugccgacagcaaauggaaccccucuccucccgcgugcgagccuaauuccuguaucaaccugcccgauaucccgcacgccagcugggaaacguacccucggcccaccaaggaggacgucuauguugugggcacagugcuccgcuacagaugccauccuggguauaaacccaccacagaugaaccuaccacggucauuugucagaagaaucugcgguggacacccuaccagggaugcgaggcucuguguugcccggagccuaaacucaacaauggcgaaaucacccaacacagaaagucucgccccgccaaccacuguguguauuucuacggggacgagauuagcuuuuccugccaugaaaccucucgguucagcgcuaucugucagggagacggcacauggucccccagaaccccuagcugcggcgauauuugcaauuuuccgcccaaaaucgcccacgggcauuauaagcagucuuccagcuacucuuucuuuaaggaggaaaucauuuacgagugugacaaaggauauauccugguuggccaggcgaaacuuuccugcagcuacucccacuggucugccccugcuccccaauguaaggcccugugccgcaagccugagcucgugaacgggcggcugagcgucgauaaagaccaguauguggaacccgagaacguuacaauucagugugauuccggauacggcguggucgggccucaaucuaucacgugcagcggcaauagaaccugguaucccgaagugccgaagugugagugggaaacaccugagggaugcgagcagguccuuaccggcaagcgccugaugcagugucuccccaacccugaagacgugaaaauggcucuggagguuuacaagcugucccucgaaauugagcagcuggagcuucaacgggauagcgccagacagucuacacuggacaaagaacucuga

SEQ ID NO: 66704 - RNA, 759 nt, Artificial Sequence
  derived and/or modified sequence opt5 from C4BPB__Homo_sapiens__NP_001017365
auguucuuuuggugcgccuguugccugaugguggcuuggagagucagcgccuccgacgcggagcacugucccgaacucccuccgguugauaacucuaucuucguggcuaaggagguggaaggccagauucuggggaccuacgucugcaucaaaggauaucaucuugugggcaagaaaacacuguuuuguaaugccagcaaggagugggacaacacgaccacagaaugccggcucgggcacugucccgauccuguucuggugaauggagaguucuccucuagcggccccgucaacguguccgacaaaauuaccuuuaugugcaaugaucauuacauccuuaaggggucuaaccgcagccaaugucuggaggaccacacaugggccccucccuucccuauuugcaaguccagagauugugacccgcccggaaauccuguucauggcuauuuugaaggcaacaauuucacccucgggagcacaaucucuuacuauugcgaggaucgguacuaucuggugggaguccaggaacagcagugcguggacggcgagugguccagcgcucugcccguguguaaacucauccaagaggccccuaagcccgaaugcgagaaagcucugcuugccuuucaggaaucuaagaaccugugugaggcgauggaaaauuucaugcagcagcucaaagaguccgggaugaccauggaggaacugaaguacagccuugagcugaagaaagccgaacucaaggcuaaacugcuguga

SEQ ID NO: 66705 - RNA, 753 nt, Artificial Sequence
  derived and/or modified sequence opt5 from C4orf22__Homo_sapiens__NP_001193926
auggaccaggaggaaggccugaaggcccucgauaacaucgugacccaauucaaugcuuacgaggacuuucuggauagccagauuacaacggucgaccuuuauuaccuggaagaugagacccucgccagacagcugguugaacuuggguaucggggaacaggcgagcgcgugaaaagagaggacuucgaagcgcggaaggcugccaucgagauugcccgccuggcugaaagagcccagcagaaaacccucacauccgcugggaaggaucugcaagacaacuuucugaccgcccucgcgaugcgggaggaggauaaucgcucuggaaaacugagccuuaaccagcaggaaacagacgccgcucacauccugaagaagcaacucgccuccgugauuuucaucagagaucgcaauucucauggccaggagaucagcggguacauugacuaugcucaccggcugaaaaccgaagauuuugaggucuacuucacgggaaagaaaagacuucugccccggccuaccgacaucuccuuuuauaacugggacgccgauauugcggugucuaauagcuccccgaacuaccagguuaucgccgacaaucccgaaggccuccuguuccgcuacaagagagaucggaaaauucugaacguggacccuaaggcucagcccggcgauaauagcacacgcaucaccauucucacagagcuguauguccaagccgugaucuuugaccauaucucuagacggaagaccuga

SEQ ID NO: 66706 - RNA, 531 nt, Artificial Sequence
  derived and/or modified sequence opt5 from C4orf26__Homo_sapiens__NP_001193910
auggccagacggcacugcuucagcuacuggcugcucguguguuggcuggucguuaccguggcugaggcccuuuccacauuuuaucugcagcaacauaucaaccuccacauggacaagaaacgcuaccugagacuucuggaaauucauaagaucaugcggacgcuccccaccgcgcgcucucugcacagcccucugcaucucccgagaggcgugcggucccaggggcccucuccuagccagcgccaccccggagucccuuccauuuucuuucacgagggccccgaaucuauccugggguuccagacagaucuuagcucccugcaaggagugaccacaguuuuucauagcucucacuucauuggccauaccgugacacuccugaucgggaucuccccugaggaagacagcagagaggaggcucaccuucggaaagccgaacgcgaggaaaagccgaaacacaccgaggccaagaagucucuguccuuucggaaaaagcagcagaaagauuucugcuuuauuuucagaaauuga

SEQ ID NO: 66707 - RNA, 1041 nt, Artificial Sequence
  derived and/or modified sequence opt5 from C4orf27__Homo_sapiens__NP_060337
auggugggcgggggaggcaagagacggcccgggggagagggcccucagugcgagaaaaccacagacgucaagaaaagcaaguucugugaggccgauguuuccucugaccugcgcaaagaaguggagaaccacuacaagcucagccugccggaagauuuuuaucauuucuggaaguuuugcgaggagcuugaccccgaaaaaccuuccgauucucugagcgcuucccucgggcugcaacuugugggacccuacgacauccuggccggcaagcacaaaacgaagaaaaagucuaccggccucaauuucaaccugcauuggagauuuuauuacgauccucccgaguuccagacaauuaucauuggggacaauaagacccaguaucacaugggauacuuucgggauagcccugacgaguucccggucuaugugggcaucaacgaagcgaaaaagaauuguauuaucguucccaacggggauaauguguuugcugccgucaaacuguuccucacaaagaaacugcgcgagaucaccgacaagaaaaagauuaaccuucugaagaauaucgaugaaaaacucacagaggccgcuagagaacugggauacucccuugagcagcggaccgugaagaugaaacaacgcgacaagaaaguugugacgaagaccuuucauggcgccgggcuggucgugccuguggacaagaacgaugucggauacagagaacuccccgagacagacgcugaucugaaacggauuugcaagaccaucguugaggccgcgagcgacgaagaacgccugaaagccuucgcuccuauucaggaaaugaugacauuugugcaguucgccaaugaugagugugacuauggcaugggccucgaacuggggauggaucuuuucugcuacggaucucacuauuuucacaagguggcuggccagcugcucccccuggccuacaaccuucugaaaagaaaucucuucgcggagaucauugaggaacaucuggccaaccggucccaagagaauaucgaccagcuggcugccuga

SEQ ID NO: 66708 - RNA, 399 nt, Artificial Sequence
  derived and/or modified sequence opt5 from C4orf32__Homo_sapiens__NP_689613
augugcagcgccggcgagcugcucagagggggagacggcggggaacgggaugaggacggagaugcucuggccgaacgcgaggcggcuggcaccgaaugggaccccggggccuccccuagacggcgcggacagagaccgaaggagucugagcaagauguggaagacagccagaaccacacaggcgagcccgucggcgaugacuacaaaaagauggggacgcuuuucggagaacugaauaaaaaccucaucaauaugggcuuuacccggauguauuucggggagcgcauuguugagccugugaucgugaucuuuuucugggucaugcugugguuucuuggacugcaggcccucggccugguggcuguucugugucucgugauuauuuacguccagcaauga

SEQ ID NO: 66709 - RNA, 600 nt, Artificial Sequence
  derived and/or modified sequence opt5 from C4orf33__Homo_sapiens__NP_001093253
auggacuucaagaucgagcacaccugggauggcuuucccgugaaacaugaaccugucuucauuagacugaacccgggggaccggggaguuaugauggauaucagcgcccccuuuuuccgcgacccucccgcuccucucggcgagcccgggaagccuuuuaaugaacugugggauuacgaggugguggaagccuucuuucuuaacgacauuacagagcaguaucuggaggucgaacucugcccgcacggacaacaucuggugcuucugcucuccggcagacggaauguuuggaaacaggagcugccccugucuuuccgcaugagcagaggggaaacgaagugggagggaaaagcguaccucccuugguccuauuuucccccuaacgugaccaaguucaauucuuuugcuauccacggcagcaaggauaaacgguccuacgaggcccuguaucccgucccgcagcaugaacuucagcaaggccagaagccugacuuccacugucuggaguacuuuaaaucuuucaacuucaauacacuccugggggaagaguggaagcagcccgaaagcgaucuuuggcugauugagaaaugcgacaucuga

SEQ ID NO: 66710 - RNA, 354 nt, Artificial Sequence
  derived and/or modified sequence opt5 from C4orf36__Homo_sapiens__XP_011529917
auggccuacggcgugcccagaaagaacaccgucaaaacaauccugcgggggagcugcuauaauguucaggagccuugggacauugcucuccuggccaagacgugguccaccaaccuugcgaauaucaaacugccguuccucgaagagauuucuuuuggaggcagcgugcaacugacaaaguguaccacaaucaaagaugggcuucugcccuccgcugaaucuauuaagcucgagcgcgaauacgaggugaagagacugugcaaacugaagugucaggagaacaccagcaaagaaauccagcuccugcuucgggagcgcccugccggacugagacggccccucccuuccaaguga

SEQ ID NO: 66711 - RNA, 288 nt, Artificial Sequence
  derived and/or modified sequence opt5 from C4orf48__Homo_sapiens__NP_001135408
auggcucccccuccggccugcagaagccccauguccccucccccuccccugcuccugcuucugcuccugucucuugcccugcucggcgcgcgggcucgcgccgagccugccgggagcgcugugccggcccaguccagacccugugucgacugccacgcuuucgaauuuaugcaacgggcccugcaggaucugcgcaagaccgcguguucucucgacgccagaacagagacgcugcuucugcaggcugaacggcgcgcccucugcgcuuguuggccugccggacauuga

SEQ ID NO: 66712 - RNA, 609 nt, Artificial Sequence
  derived and/or modified sequence opt5 from C4orf51__Homo_sapiens__XP_011530499
augagccacuacuucuaucugacaccccagauccuccugccuuuuuccccgcuuaccucucaagaguucgaccugauuagacggaaggccggcgcuagcuggcaggaugaaacccgcugguccgacucuagcgugaccacauacaccggguccuauagaaagaagcagcucgauaaaucuaugugcagccaguuuuccuuccgggccggacaacaugagcccgaauguaagcagaugagccugacaaacucuuccgcgugccaccuucuguguugggcuggcacccaggagacaaccgacaucaaagggcucuuuccugauauuacgcgccccuucaaaaagagcuuugacgucaaacauggaguugcccaccagaucugggauuucggcgacugcuuuccuacgcccccuaauuacgggaaguauugugugagaccgaaaaagcccgcccaagaagcucugauuaacuacucucggcgcggaaaaggcgugcugaagcaucuccacggcagaugcgauuccgagagcaaggucuguucuuccgaggacagcgaagccgaucgguauuccgacuacggguggggaggcccuucuagccccuucaauuga

SEQ ID NO: 66713 - RNA, 1053 nt, Artificial Sequence
  derived and/or modified sequence opt5 from C5AR1__Homo_sapiens__NP_001727
augaacagcuucaauuacaccacacccgacuauggccacuacgaugacaaggauacgcuggaccucaacaccccuguggauaaaacauccaauacccugagagucccggacauccuugcccugguuauuuuugcugugguguuccucgucggggugcugggaaacgcccuuguugugugggucacagcguuugaggcuaagcggaccaucaaugccauuugguuccugaaccucgccguggcugauuuucugucuugccuggcccuccccauccuguucacaagcauuguucagcaucaccauuggccuuuuggcggggcugccuguuccauccuucccucucugauccuccugaauauguaugcgagcauucuucugcucgccaccaucuccgcugaccgcuuccugcugguguuuaaaccuauuuggugccaaaacuucagaggagccggccucgcuuggaucgccugugcggucgccugggggcuggcccuucugcucacgauucccucuuuucuguaccggguggugcgcgaagaguauuucccuccgaagguccuuugcggaguugauuacagccacgacaaaagacgggaacgcgcuguggcuaucgugagacugguccucggcuuucuguggccccugcucacccugacaauuuguuauaccuucauccuucugcggacauggucccgcagagccacccggagcacgaagacacucaaggugguuguggccgucguggcuucuuucuuuaucuucuggcugccuuaccagguuaccggcauuaugauguccuuucuugagcccagcucuccuacauuccugcuccugaauaaacuggauucccucugcgugagcuuugcguacaucaacuguugcauuaaucccaucauuuaugucguggccgggcagggauuccagggccgccugagaaagucucuuccgucccugcuccggaacguccugaccgaagagagcgugguucgcgaguccaaaucuuuuaccagaagcacaguggacacgauggcucaaaagacccaggccgucuga

SEQ ID NO: 66714 - RNA, 1014 nt, Artificial Sequence
  derived and/or modified sequence opt5 from C5AR2__Homo_sapiens__NP_001258679
augggcaacgacagcguguccuacgaguauggggauuacucugaccugagcgauagacccgucgacugccucgauggagccugucuggcuaucgacccucuucggguugccccgcugccccucuaugcggcuauuuuccuggugggcgugccugggaaugccauggucgccuggguggcuggaaagguugcccgcagacgggugggcgcuaccuggcuucugcaccucgccgucgcggaucugcugugcugucucucccugcccauccuugccgugccuauugcucgcgggggacauuggcccuacggcgccguuggcugcagagcucugccuucuaucauucuccugacaauguaugccagcgugcuucugcucgcggcccuguccgcugaccuguguuuucucgcccuggggccggcuugguggucuacgguccagcgggccugcggagugcaaguggccuguggcgcugcguggacccuugcccugcuccugacaguccccagcgcuaucuaccgcagacuucaccaggaacauuucccugcccggcugcagugcguuguggauuaugggggauccagcucuaccgagaacgccgugacagcuauccgcuuucucuucggcuuucuggggccccuggucgccguggcguccugucacagcgcucuccugugcugggccgccagacggugucgcccucuuggaaccgcuauuguugugggcuucuuugucugcugggcccccuaccaucugcucggccuggugcuuacaguugcugccccuaauucugcgcugcucgccagagcucugcgggccgaaccgcugaucguggggcucgcucuggcccacuccugccuuaaccccaugcuguuccucuacuuuggacgcgcgcagcugagacggagccugccugccgcuugucacugggcccuuagagagucucaaggccaggacgaauccgucgauagcaaaaaguccaccucucaugaccucgugagcgagauggaggucuga

SEQ ID NO: 66715 - RNA, 5031 nt, Artificial Sequence
  derived and/or modified sequence opt5 from C5__Homo_sapiens__NP_001726
augggccugcucgggauccugugcuuccuuauuuuucugggaaagaccuggggccaggagcaaacauacgugaucagcgcccccaagauuuuccgggucggggcuuccgagaacaucguuauucagguguauggauacacggaggccuuugacgcgaccaucucuaucaagagcuauccugauaaaaaguucuccuacucuagcggccacgugcaucucuccucugaaaauaaauuucagaacagcgcuauucugacaauccagcccaagcaacuucccgggggacagaauccugucuccuauguguaccuggagguugugagcaagcacuucucuaaauccaagcggaugcccauuaccuaugacaacggcuuucucuucauccauacagauaaaccugucuacacccccgaccagagcgugaagguucgcguguacucucugaaugaugaccugaaaccugccaagagagaaacaguccucaccuuuauugauccggagggcuccgagguggacaugguggaagagaucgaucacauugggaucaucagcuuccccgacuuuaagauuccuucuaacccccgguauggaauguggacgaucaaagccaaguacaaagaagauuucuccaccacaggcaccgcuuauuuugaggucaaggaguacguucugccucauuucagcguguccauugaacccgaguauaauuucaucggguacaaaaacuuuaagaauuucgaaauuacaaucaaagcccgcuauuuuuacaacaagguggucaccgaggcugacguguacaucacguucggaauuagagaagaucuuaaggacgaccagaaagagaugaugcaaacagccaugcagaauaccaugcugaucaacggcauugcgcagguuacauuugauucugagaccgccgugaaggaacucagcuauuacucccuggaggaccuuaauaacaaauaucuguacaucgcugucaccgugauugaaagcacagggggauucucugaggaagccgagaucccgggcaucaaguauguucucuccccuuacaaacugaaucugguggcuacgccccucuuucugaagccuggcauucccuaucccaucaagguccaggugaaagauagccuugaccaacuggucgggggagugccuguuacccucaacgcccagacaauugaugugaaccaggagaccucugaccuggauccgagcaaguccgucacacggguggacgauggcguugcgucuuucgugcuuaaucugcccagcggggucaccgugcucgaauuuaacgugaaaacggacgccccugaucugcccgaggaaaaucaagcucgcgagggauacagagccaucgcuuacuccagccugucucaguccuaucucuacauugacuggacagacaaccacaaggcccugcuuguuggcgaacaccugaauaucauugucaccccuaaaagccccuauaucgauaagaucacccauuacaacuaucucauucugucuaaggggaaaaucauucacuucggaacacgggagaaguuuuccgacgccagcuaccaguccaucaauauuccggugacccagaacauggugccuucuagccgccuucuggucuauuacaucgugacaggcgagcaaacggcugaacucguuuccgauucuguguggcugaauaucgaggaaaaauguggcaaccagcugcagguccaucucagccccgacgcggaugccuacuccccugggcagaccgugagccugaauauggcuacaggaauggacucuuggguugcccuugccgcuguggauuccgccgucuauggcgugcaaagaggggcgaagaaaccccuggagcggguuuuccaguuucucgaaaagagcgaccugggaugcggcgcugggggcggacugaacaaugccaacguguuccaccuugccggccucaccuuccugacaaaugcuaacgccgaugacucucaggaaaacgaugagccuuguaaggaaauucugcgccccagacggacccuccagaaaaagaucgaggaaauugcugccaaauacaagcacuccgucgugaaaaagugcuguuaugacggggcgugcgugaauaacgaugagacgugugagcaacgcgccgcuagaaucagccugggaccgcggugcauuaaagccuuuaccgaauguugcgucguugcuucucagcuuagagccaauaucagccauaaggacaugcagcugggccgccuccacaugaagacacugcugccuguguccaaacccgagauccggagcuacuuccccgaaucuuggcuuugggaggugcaucucgucccuagacgcaagcagcugcaauuugcgcugccggacucccucaccacaugggaaauucagggggugggaaucagcaacaccggcauuuguguugccgauacggugaaagcuaaggucuucaaagacguguuucuggagaugaauauccccuauuccguugugagaggggagcagauucaacuuaagggcacagucuacaacuauagaaccucuggaaugcaguucugcgugaagaugagcgccguugaaggcaucugcacauccgagucuccugugaucgaucaccaggggaccaaaagcuccaaguguguccgccagaaaguggaaggaucuagcucccaucuggugaccuuuacaguccucccccuggagauuggccugcacaauaucaacuucagccuugaaacgugguuugggaaggagauucucguuaaaacccugcggguggugccugagggagucaagagagaaucuuacuccggcgugacacuggacccccgcgggaucuacggcaccauuagccggagaaaggaguucccuuaucgcaucccccucgaucugguuccgaaaacagaaauuaagcggauccuuucugugaaaggacugcucgucggcgagauccuguccgcugugcugagccaagaggggauuaauauccuuacccaccucccuaagggaucugccgaagccgagcugauguccguugugcccgucuuuuacguguuccauuaucuggaaacgggcaaccacuggaauauuuuucauagcgacccucucaucgagaaacagaagcugaagaagaaacuuaaagaagggaugcuguccauuaugagcuacagaaacgcugauuauucuuacagcgucuggaaaggaggcuccgcgucuacauggcucaccgccuucgcucugcgggugcuggggcagguuaauaaauauguggagcagaaccaaaauagcaucugcaacucccuucuguggcucgucgagaacuaccagcuggacaauggcucuuucaaggaaaacagccaguaccagcccaucaaacuccaaggaacccugccgguggaggcccgcgaaaauucccuuuaucugacagccuuuaccguuauuggcaucagaaaggcuuucgauauuuguccucucgugaagaucgacacagcccugauuaaagcggauaacuuucugcuugagaauacgcugcccgcucagucuaccuucacacucgccaucagcgccuacgcucugucccucggggacaagacccacccucaguuucggagcaucgucucugcccugaaaagagaagcgcuugugaagggaaauccgcccauuuaucgcuucuggaaagauaaucugcaacacaaggacuccagcgugccuaacacaggcaccgcucggaugguugagacgaccgccuacgcccuccugacaucucugaaucuuaaggacaucaacuaugucaauccggugauuaaauggcuguccgaggaacagagauacgggggaggcuuuuauagcacccaggauacaaucaacgcuauugagggccucaccgaauacucccugcucgugaagcagcugcgccuuucuauggacaucgaugucagcuacaaacauaagggggcccugcacaauuauaaaaugacagacaagaacuuccugggaagacccguggagguucuccugaaugaugaccuuauuguguccaccggcuuugggagcggacuggcuacgguccaugugacaaccguugugcacaagaccucuacauccgaagaggucugcagcuucuaccucaaaaucgauacccaagacaucgaggccucucauuaucggggcuacgggaacagcgauuauaagcgcauuguggcgugugccuccuacaaaccuucuagagaagagagcuccucuggaagcucccacgcuguuauggacaucagccugcccacgggcauuucugccaacgaagaggaucucaaggcucugguggagggcgucgaccagcuuuuuacagacuaucagaucaaagaugggcacgugauucugcagcugaacuccaucccuagcuccgacuuccucugcgugcgguuccgcaucuuugaacuguucgaggucggauuucuuucucccgccaccuucacaguuuacgaauaccauagaccugauaagcaauguaccauguuuuauagcacauccaacauuaagauccagaaagugugcgagggcgccgcuuguaagugcguggaagcggacugugggcagaugcaggaggagcuggaucucaccauuucugccgaaacgcggaaacaaaccgcuugcaagccggagaucgccuacgccuauaaagucagcauuacauccaucaccguggaaaauguuuucgugaaguacaaggcuacacugcucgacaucuauaaaaccggagaggccgucgcggaaaaggauagcgagauuacguuuaucaaaaaggugacaugcaccaacgcugagcugguuaaaggccgccaguaccuuauuauggggaaggaagcccugcagaucaaauauaauuucucuuuuagauacauuuacccccuggacucccucacauggaucgaguauuggccucgggauaccaccuguagcucuugccaggccuuccuggcuaaccuugacgaauuugccgaggauauuuuccugaauggauguuga

SEQ ID NO: 66716 - RNA, 1329 nt, Artificial Sequence
  derived and/or modified sequence opt5 from C5orf22__Homo_sapiens__NP_060826
augagcgacuccgccggcgggagagcuggacugcggcgcuaccccaagcucccugugugggucguugaggaucaccaggaagugcugccguucaucuauagagccauuggcucuaaacaucuucccgcgagcaacguguccuuucugcacuucgacucucauccugaucuccugauccccgucaauaugccugcugacaccguguuugauaaggagacacuuuucggggaacugagcauugagaacuggaucaugcccgccguuuacgccggacacuuuucccaugugauuugguuccacccuacgugggcucaacagauccgggaaggccgccaccauuuucucgucgggaaagacaccucuacaaccacaaucagagugaccagcacagaucacuauuuccuguccgacggacuguacguuccggaggaucagcucgagaaucagaagccccugcaacuugacgugauuauggucaaaccuuauaagcugugcaacaaucaggaagagaacgaugccgugagcucugcuaagaaacccaagcucgcccuggaagacuccgagaauaccgcgagcacgaacugugauucuuccagcgagggccuugaaaaagacaccgccacacagcggucugaccagaccugccuggagccuuccuguagcugcuccucugaaaaucaagagugucagacagcugccagcaccggcgaaauccucgagauucugaagaaagggaaggcuuuugugcuggauaucgaccucgauuucuuuuccgucaagaaccccuucaaagagauguuuacgcaggaagaguacaagauucugcaggaacuuuaucaauucaaaaagccgggaacaaaucugaccgaggaagaccucguugauaucguggacacacgcauucaucagcuggaggaucuugaggccaccuucgcggaccugugcgauggcgacgaugaagagaccgugcagagaugggccagcaacccugggauggaaucucucgucccccuggugcaaucccugaaaaagcggauggagguuccugacuacgaaauggugcaccaggcuggacucacaugugacuacagcgagcugccccaccauaucucuacggagcaggaaaucgagugccuuauucagagcguccacuaucugcucaaaaaucugcccaacccuacccuugugacaaucgcccgcuccucucuggaugacuacuguccgagcgaucaaguugacaccauucaggaaaaggugcucaauaugcugagagcucuguauggcaaccucgaucugcaggucuacgccgccgaguccccucccagcuga

SEQ ID NO: 66717 - RNA, 621 nt, Artificial Sequence
  derived and/or modified sequence opt5 from C5orf30__Homo_sapiens__NP_149988
auggagguggacaucaacggcgaaagcagauccacccugacaacgcuccccuucccuggggccgaggcuaauucuccgggaaaggccgaagcggagaaaccccggugcagcuccaccccuuguucucccaugcgcagaacagucagcggcuaccagauucugcacauggauuccaacuaucuuguuggguuuaccacaggagaggaacugcucaagcuggcucaaaaaugcaccggcggggaggaaucuaaggccgaggccaugccuagccuucgguccaaacagcuggacgcuggacucgcccgcagcucuagacuguacaagacacggucccgcuauuaccagcccuaugaaaucccugcugugaauggcagacggcgcagacggaugccgagcucuggcgauaaguguaccaaaucccugcccuacgagccuuauaaggcccuccaugggccccugccucuuugccugcucaaaggaaagcgcgcgcacagcaaaucucuggacuaccuuaaccuggauaagaugauuaaggagcccgccgacacggaagugcuccaguaccaacugcagcaucugacccucagaggcgaucgggucuucgcucgcaauaacacauga

SEQ ID NO: 66718 - RNA, 1917 nt, Artificial Sequence
  derived and/or modified sequence opt5 from C5orf34__Homo_sapiens__NP_940968
auggccgcugagcugagaaugauccucuacgaagacgauagcgugcagguccaauauguugacggcuccacccugcagcuuucucccugcgggagcgaguuccuguuugaaaaguccccuccggugucugcccacccccucgagcagccugaacggauucgccagagaacacauuucgugaucagcacguaccgggagcaacugcagcgcgcgcuugauuuuagaaacuccucugcuaccugucccuuccugagcgagacaauuaucccuuccgaacggaaaaagcacauuuuuaucgacaucaccgagguccgcuggcccagccucgauacagacggaaccaugauuuauauggaaucuggcaucgugaaaauuacaucccuggaugggcaugccuaccugugccucccuagaagccagcacgaguucaccguucauuuucuguguaaggugucucagaaauccgacagcucugccguccuuuccgagacgaauaacaaggcuccgaaggauaaacugguggaaaagaccggaaaaaucugcauucggggcaaucuccccgggcaacgccugaagaacaaagagaaugaguuccacugucagaucaugaagucuaaggagacacuuaaaaagauguccugcguuaacggaaccgaaggcagagaggagcugccuucucccggcacaaaacacaccuguguguauacgugggucaagcagugcuggagcguggccgcuuguccugaagaguggaaauacccccucucccuggcccugcauuuucacaauaagauuagcaacaugucuaaaaucgacgcgcauaucacacagucccgguuccucaccagcgauauuucugaagaacgcgggaagguggucagcguucugccgagagcccuuucccugucuugcccugugccccaccuccaccgguggaauuuuugugacagccugcuucaacgccaguccgaugaauauagcuacccugagcuggugaagauggucugguacaaaggagugacauauagacucacccaucagaacaugaauagcaucgagauuuacuccggcgacgggagcguuuucaagucugaaggagcuuauuuuggcaacuacuucaccuauuacuccauccaagaggggagcggaaaacgggaagagaagacauauuccgugaauaaccugccucccgacagacccggcucuccguucacggucggcagccugauuaaacaggccacccgcauccuccagcacugcgugaagaugcggcugucccuuucucauaauuacagaaucugcuguuggaagaugguucccgggauuaacgauagcaacauccugccucucgugcugaaagaaucccuuauucccagcgucggacgcuuucuggcuuacucugacgauaaggugcacgccaucuuccucgacggcauuacacugacccugaauuggaacuuuuccagcccuaucgagaaacggcaggucaaucaagggcucaaccugggauggugcaaacuuacauuccccgauggccaggagcagcugauccagauugaacauccggagccuuaugaaagauacgugaccacgguuacaucuuggugucgccggcucacccaaaccucccccagagagaugccuacacacagcucuagcuccgugcugcaggagaauuggagcgucgcgucugaacuggagaagauccagaaguuuaaccuucuccuggaaaauuccgggauucugaaccagaucagcaauaagaaaaacgagcaacaguccuucgaccacuauaagcccggaucuagcgaaacccuccugggcgaggugaaugagaaccgcguuuccauugcccuuaaaaagacaucugaaauccugcaugauauugacugccuccugagcaauuccaaaaaguga

SEQ ID NO: 66719 - RNA, 213 nt, Artificial Sequence
  derived and/or modified sequence opt5 from C5orf38__Homo_sapiens__NP_001281266
augguggcccccgcugccagagucuuccugcgggcgguucgcgcugcccucaccagcacagugccugaccugcuuugccugcucgccagaggcuccccgcgggggcuggcuucuggacgccuuccccuggccgugcacagcgcucagcauggcccuggguccggagcccccuggcucagaaucgcgcggcgcgcccugucucaaagaauuuga

SEQ ID NO: 66720 - RNA, 9594 nt, Artificial Sequence
  derived and/or modified sequence opt5 from C5orf42__Homo_sapiens__NP_075561
auggaaauuagacuggaaauucucaccagcacaggcaucaagcagaaaaagcccuggccucggguguccuggcuggggaaagaaaaggaagccgucuuccuucuggacgauaaauuuauuaacgaaaucaaucuccugucuggaaagauuaagaaaaagauccccagccuucaacccuuccugaaagacguuaucgugcucacgaccuccucuaacgaugcuuggcuggccggcgugcugacaaccggggaacucuuucuguggaauaaggaccaggauugccuuaaaacaauuccuaucaccgagaagcccaaggagaugauuaaagcgacagucgcuagcucccugcgccucuaccuguaugugucuggaaacggcaagagaaucguucuuauuaccccuagcggguguaucuuccugugggaauaccucgagcugaaaaauauucuguccagcaagucucucucccuggccggacgguggagccaggugauccccgaagaggccguccuucugccuucuacggaggacaaagaagcugugguuaacgccguguuuaucaagaaugaacucuucggcgauugcugucugugcuccuuuaccuucuauagcggcgaaugucuuaaacugacauuucucgcuauucgcuggcacgagaacgucuucaccucugugagaucccugcccuaccaugugcacugggcccagcaagacugccaucuguguagccucauccccaagugcgaauccgucaagucuagaggggcgcugauuagcgccuuuucccgcgauggacuuacacuggcuguuacccucaaucagaaagacccuaaggccacgcaagugcuguucaucaacacacuuaauuuugugacccuguguggcagccucaaagggugcucuaacaagucccccgucgugccugcuacacugauuagaagcuauuggguuggagauaucucuuggacccacgacagccuguuccucgccuguaugcugaaacggggcucccuugugcugcucacaugccagggggagcugcugacacuuaucacguucggaugcucuauugaguuuggccccgcggaguucaucccgcuccauccucugauuaccuaccgcccccaacaguuuacauuccaggauagcaauaacuccgucgacagcucugccuccgacagcgauccuaugagacagcgguuuucuaucaaggcucacucccgccugcccuaucucgugauuagcgacggcuacaugguuaccacacugagauuccuugauucccugucucccagcgugcacaugcggucccuccugcuggacucuacccaacgccuugagaagaucuaccagagcgucauccucuccaaaccuaaggggaaaggacugaaucugagaagccucaacucucugcgguccagccuucuggaacaucagggcaacgagucuuccgccgauuuuacggugccgaaguuccuccaagcugaagagacaauuaaugagaacgccgccgacuuucaggauuucgaagcugaggaaaccaaugaggggagacacuuucccgacaaccuguguccuuucuggaauaaacgcgaugacguccugugcagcucuaugaaggaaggacggcuugaguuugcgagcauguucgauaccauccaugccaaggacgacuccgaggaaacagauagaaccauuacagagcuccacagcauccagaaaucucugcuggcugccuggacgauuggcaucuccaagaccgugacagagaagaaucucaugcugaauuauauuguuguguguaucacccacuucuuuuacauccuucaguucauuaagugccccuuuccuaaacuggaccucguccugagcaaguccucucgccauaacgccuggauccuguguauuuuccaacuuuuucaccagugccucagcauccauuauugggauauucgguacaagcaggacguggggcaccugaucaaacugacauccaauaccguuaagcuccugcuuacgcagcaacagaaaggacagcuguucucugagaagcuccuggcuuguuuuuaucugcuuaaaaugguggccgauaaccugaauggcgucuacauccuccagcccgaggugauuagcgcguccgcugacggcucuaagaucaccgcccaagauagccuggugguuccgauuuuccagauguuucaggacuccggguuccagaaaaacuggagcuggaacagcuuuuucaagauccauccucaagucgugaaccccgugcagcagccuggacacagacuccugauucuuuggcgcauccuguauaagaaaacacucugguaccaagcccagcugaaucggagaguccccgaagcugauucccagcugaccgagaagaugacacacgaagccagcaccgugaaaucucuucugugccaucuccaggcuaaccugcaauccacgggcgacugucucaaccagacacuggagcuuaagagcaucaauggggaagagugcuuucugcucggaucuuacgagaaauccguucagcuguggaagaaggcccugcaggaaauugaggaaaaaggcgggcgccggaccuauuuccuucaaaucagauacuaucugagccuccuguacugucaccucuauuccuacaaccugaaugaugcgcagggccuuugcgaccagcuggcccgcgagauucugcgguggagccagcucccugugaaggaaaacaaagauuucucuggagcugccaagagccauuuugagugcggcauggucgggggagugcaccccgaggcugccguuagagugguccaauccauggcgcgguucauggccgcuuauuuuacaaaucagcagcuguguauccuuccgccucaccaugugaacguucugccgccccuccacauuaaaaccgaacaaucuuuccgccugaucccucuccagcauagcaagguggccuccgucgugagagaccagaaucugucuaacguguggaccgucgaguacgcucuugaacugcuguuuaucggcgggcucguuccggaggccguguggcuggccuacaaacuuggagacuggaagacaagcguguccauuggcgucgcuuuccagcuguuuugcaagcgggauucuaauuucaugagaagcaaaaagaaaucccucaaccugccccuccgcaugacgccugcgcaaaucuuucaggaaaagcugcagugugugcuugggcagcccgccagccuggaggcuaagaaugagaugggcucuaaauauaagcaauucaccgacccuauugaagaggaagaugccaaccugcucuuuggauccguucaggaggugcugaaagccagcgucauggcugacgccgauauccuuucugagacauuccagcugcucauugacuccgcgaaggauuucagcaaacggcuguggggccucgugcccuuugggcuguaccuuccugcucccccgcuguauugcccucagcccgccauccuguccgaagaggacggagaugaccuccugcuuaaggccgagaagaauaacagacaaaagguuucuggcauucugcagcgcgugcuccugcuguucagagcugcccaguguagcuuuccugucgcgcagugguacauccuccaacuucggugggcucgcaaggugaugcagaaaaucagaaugaaggggucccugcccagccugucuccguucccucagucccuccugaauuauugcaaaggaggcauugccuuuuuccggcccggggccgcuggcgaucacaaacuugacgagguuagcauccgcgccauuggauguuuuagagaacugugcgcucucuguuggaugcugcaugugcgggauaaacugucuuacagcugccgccaauaucagaaggccagagagaacgucaagggcgagaaagaccucgaaguggaguucgacuccuguaugaucgaacacugccuuucugcgguggagugggccuaccggaugcugccuuuuagccgcuucuuuaacauggaagaacugauucaggauaucauccucucccugauuggggagcuuccgcccaucagaaaggucgcugaaauuuucguuaaagccuuuccuuacccggaggacgugcgggugccccugagagauaaguaucacucucuccaucagcgccugcggcacugcgucgugaaaggaccucaaaccgaagagaugaugagcguugugaugcauuccauccagaaggucagagugaaggcucugaaacgcguucagcggaauauuggcagcuucgaagugaacaucugggagcccaucgaggaagagaagccugacgaagcccccggggucgauagauacucucucggaacaucccuuagccgcuccacccugacggagcugggcgacucugugguccacagcgaugccgacacauucuccgaggcucucucuguggaagagaaaagccggauuaauaucuaucagagaaacgcgccuaaucauauggaacugaccuccauucacaagccgaccgauaaacgcaagauguguaaccaaaaggagaaucccaccaaaaaggaagaccacgagaaacuuagccagaacacccugccuguuaucggggugugggaguuugaacgggaugacgacgaguacauuaaguuccucgaucuguuucugucuuauauccucgaaagagaccuucccuacucccgggaugccgacauuccuuuccugaccucuuuuucuggcaaacugcgcgagcaugaacucaauucccugcuuuucgauguccacacgacccugaagagacaucagagcaagacaaaaucucagaacguguuucgggcuggaagcugcuucguuguggcccccgaguccuaugagucugaaaagagcuccagccucaaugacgaguacggcaugcaccuggaaaaccaaaaacuguccucuagcguccucgugaaucaggggaucaagccguuucuucaguacccuuccaacgaggugaauaaaaacgaaggaaugucuggccuguucgggcugaagcaacgcagcaucuauaaaauucaggaugacaccagagagaagugucucauccagcgguccucuaaccacaucuuuuggacacccaagagcaucaaaaccagacgcugcauuuucaaggccauccaguguaaugauaucaacccccaagaggaccugccucuugcucugaauacguuuggauccauuggccggcuccuggaauggaugaucagauggagcaaccgccggcugcucugcgauucuggcauuaccgaguccagcucugaauacucccccguuaucagagucaaaacaagcaccgccgcgauucuuacaucucuguggcugcucgagcagccuuauuucgcuaccuacaaggccaaaaaugccaucaucaagaugguggagaaccgcgacacagggugucagauuggaccgaauaucgaacgggaguccaagagcgaugcuggcggguccguggccgucgcgacccccggaggcacggaagagagaaacgggcagaauaaaagcugccaaaacauucugaaucgcaugccuacagaagcuaagaaccccgacaucaaagagauuaaugacgauaucauuucuaucacccauaacaccaagaaagaguucaucgacauugaugaaaaucuucuggagguggaagccuuuacagaggaagagauggacaugcacaucagcgauuaugaggaagacauugaggaauccguuggaggcuucagaucuccuagccucgccaucuguaugaugacccugccccagcagcuggaggaagaguuuacggaggaagugcagugccaacgggaggaaccgcucgagacaauuauggaggaaaaguccaccgagcagaagggcaugaucgaggcuuucucucauccugggcacacaacaccccagagcaugcaggucgauacauccucugagaucagcuccgcccaaauuagcaccuacaaagaaaagucuuccagcgugccucuucugaucucuaacggaguuaauguggcuucccagcccccugcccccacgccgcagaaaacccaacgcaacgaguuuacagcgcagcugccugacuguagcgaguccgucagacagaugcuccaggaugaaauguucaagcuggugcaacuucagcagauuaacuuuaugucucugaugcagaucguuggcagcuccuucgccaaucuccccgacacccaacagcuggugcagcagagccaaucuguccaucugggggagucccaggaaagcaaccuccggggaugcggcgauguggaggacucuaauaaaaaccuuaaggaacgcuuuuucauuaagccccagagcaugggggagaaugcuagagagccucggaaaaacuccccgcacugccacgaaggaacaauccccucuggccaaaauagcaccggcaacgugcagaaugucccucauggguccaucccccugugucagcugaacggacagccuagaaagaaaggccccauuccuucuagccaaaaucucccguccacgagcuuuuaucccgccccugcugggaacacacaccuguaccuucugucuacccccuccguugugcagaaggccccucgccucaucccccaugccaaaacauucagcccgggagauggcuuuccucugcugcaguucaaguccaaacaggaguuccaaccccucuuucuucacaccgggucuauuccccaggugccuuuccggccccugccucagccgagagaggcuuggggacugagcgacuccuuucagcccgcgcucccucaacgcgccgcucagaccacacccgccucucaccugaaugucagccaguacaacacggaggcccggaagaaggaaguggagcagaaaaccugggcugagacaguuaucaccgaaauuccuaaucaugugaaccuugaccaguaugucggccaggagaaccugacaccccagcaagauuccagcguguucaucaagccggaaaaacucuuugacguuaagccuggcacccuggagauuucuccccaccauuccuucgggcugccucuccuguaccuuccccugaaaccucccaauauguuuccgagcacgucuagagccuccaucacagugccuagcacccccauccagcccauugcggaggaacggaaguauccucgccucucucugcuucacucccaucugagcccggagaacagaugcaagaaaacccagcucaucccccuggaaaaucugauugcuuucaagcagucucaacagaaacucacacacaaccuguuugagcagggagaugccggccaccuucagcugcucaaggucaaaaucgaaccucccgaggugcggcaagggaaggacagcaagaaacgccagagacggcgcgccgagaaggaacugcaggagaaaagaugugaaaaacuucggcgcaaaccuaaugucaccuucagacccgagaacuccauuaucaauaacgaugacagcgaaaucauuaagaagccuaaagagcagcaagagcauugcggaucccacccccuggaugacuuugaugugccguucgaaaugcuccaggacgauaauacaucugcuggccugcauuuuauggccagcguuaagaaaaaggcgaucgggucccaggacgccucuacgaacaccgacccugagcacgaaccccugacagcuccucaacuccuggugcccgauguguaccuuaaucugaaacucagcuccgagaugucugaaaagccguggagcccuuccauuccccacaccgucacaaaccuggagcuucccguucgggaggaaccuagcaaugacaacgugaucaaacagcagucugaucaucuggccgugcccuccagcgcugagcuccacuauauggccgcuucugucaccaaugccgugccuccgcauaacuucaagucccagggacugcccaagccugaguucagauuuaaaggccaaagcacgaagucugacuccgcggaggauuaccugcucuggaaacgccugcagggcguuagcgccgcuugucccgccccuucuuccgcugcccaccagcuugagcaucugagcgccaagcuccagaaaauugacgaacaacugcuugcuauccagaacaucgcggagaauauugaacaggauuuccccaagccugagaugcuggaccuccacugcgauaagaucgggccgguggaccacauugaauuuagcuccggacccgaguucaaaaagacccuggccucuaaaacaaucagcauuuccgaggaaguccgguuucugacccauauggaugaggaagaccagucugauaagaaagagacaagcgaaccugaguucuccaucaccgagaacuauucuggccaaaagacauguguguuucccacggcugacagcgccgucucccucuccucuagcagcgaccagaauaccacaucuccugggaugaacuccagcgaugaacugugcgaguccgugucuguucacccccuucagaugaccggacugaccgacauugccgauaucaucgacgaucucauuaucaaggacggcgugagcuccgaagaacuggggcuuacagaacaagcuaugggaacgucucggauucagcauuacagcggccgccacucccagcggaccgauaaagagagacgcgagauccaggccuggaugaagcggaaaagaaaggaacgcauggcgaaauaccugaaugagcucgccgaaaagcggggccaagagcaugacccguucuguccuagaagcaacccccuguauaugacaucucgcgagauucggcugagacagaagaugaaacacgaaaaggaucgccuccugcuuuccgagcacuacagcagacggaucucucaggcuuaugggcugaugaaugaacuccugagcgaguccguccagcuucccacccugccucaaaaaccccucccuaacaagccgucucccacacagagcuccagcugccagcauuguccuucuccccgcggagaaaaucagcacggccauuccuuucugaucaacagaccugggaaagugaaguacaugagcaagcccuccuauauucacaaacggaagucuuucggacaaccgcagggcagcccuuggccccacgggaccgccacguuuacaauccagaaaaaggcuggaggcgccaaagcggccguuagaaaggcuacccaguccccugugaccuuccaaaaaggcucuaaugcccccugccauagccugcagcacacaaagaagcauggguccgcuggacucgccccgcagaccaaacaagucugcguggaguacgagcgggaagagacagugguuucuccuuggaccauucccagcgaaauccacaagauucugcaugagucccacaacagccuucugcaggaccucucucccacggaagaggaggaaccugagcaccccuuuggcgucgggggaguggauuccgugagcgaaucuacaggcuccauccugagcaaacuugacuggaaugcuaucgaggacauggucgccucuguugaagaucaggggcugagcgugcauugggcgcucgaccuguga

SEQ ID NO: 66721 - RNA, 348 nt, Artificial Sequence
  derived and/or modified sequence opt5 from C5orf63__Homo_sapiens__NP_001157950
augcugugguuccagggcaacagcaugcaacucgccagauccucuuuugggcuguuccuucggaauugcagcgcuuccaagaccacacugcccgugcucacgcuguuuaccaaagacccuuguccgcuuugcgaugaggccaaggaaguccugaaacccuacgagaaccgcuucauccuccaggaaguuaauauuacacugccugagaacucugugugguaugaaagauacaaguuugacauccccguguuccaccugaauggacaguuucucaugaugcaucgggucaacaccagcaaacuggagaagcagcuucugaagcucgagcaacaguccacaggcggguga

SEQ ID NO: 66722 - RNA, 2805 nt, Artificial Sequence
  derived and/or modified sequence opt5 from C6__Homo_sapiens__NP_000056
auggccagacggagcgugcuguacuucauccuccugaacgcucuuauuaauaagggccaggccugcuuuugugaccacuaugcguggacccaauggacauccugcucuaaaacguguaacagcgggacccagucccgccauagacagaucgucguugauaaguacuaucaggagaauuucugcgaacaaauuuguucuaaacaggagacacgggaaugcaacuggcagcgcugucccaucaauugccugcucggagacuuuggcccuuggagcgauugugacccgugcauugagaagcaguccaaagugagaucugugcugcggcccagccaauucgggggacagccuuguaccgcuccccuugucgccuuucagccuugcauccccuccaagcugugcaagaucgaagaggccgauuguaaaaacaaguuccgcugcgacagcggcagauguauugcucggaaacucgagugcaauggggaaaacgauuguggagacaauucugaugagcgcgacugcggcagaacaaaggccguguguacccggaaauacaacccuaucccguccguucagcugaugggcaauggguuucacuuccuggcuggagaaccccgcggcgaggugcucgauaacagcuuuacagggggaauuugcaagaccgucaagucuuccagaacgagcaauccuuaucgggugcccgccaaccuggagaauguuggcuucgaagugcaaaccgcggaggacgaucuuaaaacagacuuuuacaaggaccugaccucucucgggcauaacgaaaaccagcagggauccuucagcucccaaggcggcucuagcuuuuccgucccuaucuucuauagcucuaaacgcuccgagaauauuaaccacaauagcgccuucaagcaggcuauccaggccucucauaaaaaggauagcuccuuuauuagaauccacaaagugaugaaggugcugaacuucacaaccaaggcuaaagaccuucaccugucugaugucuuucucaaggcccugaaucaucugccccucgaauacaacagcgcgcuguacucccggaucuucgacgauuuugggacgcacuauuucacaagcggaucucuuggcgggguuuacgaccugcucuaucaguuuuccagcgaggagcugaaaaauucuggacuuaccgaagaggaagccaagcauugugugagaauugagacaaagaagcgcgugcuguucgcuaagaaaaccaaggucgaacaccggugcaccacaaacaaacucuccgagaagcacgagggcagcuuuauccaaggggccgaaaaauccauuucucugaucagaggaggccgcagcgaguacggcgcugcccuggccugggaaaagggguccucuggacucgaggaaaagacguucagcgaguggcuggaguccgugaaagaaaauccggcuguuauugauuuugagcuugcgccuaucguggaccugguccggaacauccccugugccgugaccaagagaaauaaccuccgcaaagcucugcaggaauaugccgccaaguucgauccuugccagugcgcucccugucccaauaacggccggccuacacuuagcgggaccgagugccuguguguuugccagucuggaacauacggcgagaauugugaaaaacaauccccggacuauaagagcaacgccguggaugggcaguggggcugcuggucuuccuggagcaccugugacgcgacguacaagagaucucgcacacgggagugcaacaaucccgcuccucagagaggaggcaaacgcugugaaggggagaagcggcaggaagaggacugcaccuuuagcauuauggagaacaauggacaacccuguaucaacgaugacgaagagaugaaagaagucgaucucccugagauugaagccgacuccggcugcccccagccggugccucccgagaauggguucaucagaaacgagaagcagcuguaccuggucggagaagauguggagauuagcugccucaccggcuucgaaacaguuggguaucaguacuuucggugucugccugacggcaccuggcgccaaggagauguggagugccagagaacagaauguaucaaacccgucgugcaggagguucuuacgaucaccccuuuccaacggcuguauagaauuggcgagucuaucgaacucacaugccccaagggguuuguggucgccggaccgucccgcuacaccugucagggcaauagcuggacaccucccauuuccaacucucugaccugcgagaaagacacgcugaccaaacuuaaggggcauugucagcucggacagaaacaaagcggcuccgaaugcaucuguaugucucccgaggaggauugcagccaccauuccgaagaccuguguguguucgauacagacucuaaugauuauuuuaccagcccugcuugcaaguuccuggccgagaaaugccucaacaaucagcagcugcacuuucuucauauuggguccugucaggacggccggcaacuggaauggggacucgagagaacacgccugagcucuaacuccaccaagaaagaaagcugcggcuacgacacguguuaugauugggagaagugcucugcuuccacaagcaagugugugugccugcuuccgccccaguguuucaaagggggaaaucagcucuacugcguuaagauggggucuuccaccagcgagaaaacacugaacaucugugaagucggcaccauuagaugcgccaaucggaagauggagauccugcacccuggaaaaugucucgcguga

SEQ ID NO: 66723 - RNA, 699 nt, Artificial Sequence
  derived and/or modified sequence opt5 from C6orf106__Homo_sapiens__NP_073595
auggagggcauggacguggaucuggaccccgaacucaugcagaaguucagcugccuggggaccacagauaaagacguccuuaucuccgaguuucaaagacugcucggauuccagcugaacccugccggcugugccuuuuuccuugauaugacgaauuggaaccugcaggcugcgauuggggcuuacuaugacuuugaaucuccgaauaucagcguucccuccaugucuuucguggaggaugugaccauuggagaaggcgagagcaucccucccgacacacaguuugucaagaccuggcggauucaaaacuccgaugugaucuggguuauccucucuguggaggucgggggacugcugggcgugacacagcagcucagcuccuucgaaaccgaguuuaauacacagccucaccgcaaaguugaaggcaacuucaaucccuuugccagcccucaaaagaacagacagucugacgagaauaaccugaaagaucccgggggauccgaguucgacagcauuucuaagaauaccugggccccggcuccugauacgugggcccccgcuccugaccagaccgaacaggaccaaaaccggcuuucccagaauagcgugaaccugucucccuccagccaugccaauaaccucuccgucgugacauacucuaagggccugcacgggccguauccuuuuggacagagcuga

SEQ ID NO: 66724 - RNA, 1692 nt, Artificial Sequence
  derived and/or modified sequence opt5 from C6orf10__Homo_sapiens__XP_011512542
augaccgugcuggagaucacacucgccgucauucugacgcuucugggccucgcuauccuggccauucuucugaccagaugggcgcggugcaagcagagcgaaauguacaucucccgcuauucuagcgagcaauccgcuagacuccuggacuacgaagaugggcggggaucucgccacgccuauagcacacaguccgacaccucuuacgauaacagagagcggagcaaacgcgacuauacacccuccaccaauagccugguuucuauggccuccaaguucagccucggccagacagaacugauucuucugcucauguguuuuauccuggcucuuucuagauccagcaucgggucuauuaaaugccugcagaccacggaggagccuccgucccggaccgccggagcuaugaugcaauucacagcccccaucccuggcgcgaccgggcccauuaagcucagccagaaaacaaucgugcagaccccuggacccauugugcaguacccuggcuccaacgccggcccgcccucugcuccucgcgggcccccuauggcccccaucauuaucagccaaagaacggcucggaucccgcagguccauacaauggauuccagcggaaagauuacccugacaccugugguuauccugaccggcuauauggacgaagaacucgccaagaaaucuuguuccaagauucagauccugaaaugcgggggaaccgcgcgcagccagaauagcagagaagagaacaaggaggcccuuaaaaaugauauuaucuuuacaaacagcguggaaucccugaagucugcucacaucaaggagcccgaacgggagggcaaagggacggaccucgaaaaggauaaaauuggaauggaggucaagguggacagcgaugccggcaucccuaaacgccaagagacccagcugaagauuuccgaaaugagcaucccccagggccaaggggcucagauuaaaaagucuguuuccgacgugcccagaggacaggagagccaggucaagaaaucugaauccggcgugccuaaggggcaagaggcccaggugacaaaaagcggacuugucguucugaagggccaggaagcccagguggagaaauccgagaugggggugccgcggagacaagaaucucaggucaaaaagagccaguccggagugucuaaaggccaggaggcucaaguuaagaaacgcgaaagcgugguccucaagggccaggaggcccagguggaaaaauccgagcugaagguucccaaggggcaggagggacaaguggaaaagaccgaggcggaugucccuaaggaacaggaggugcaggagaaaaagagcgaagcuggcguccugaaagggcccgagucucaagugaagaauacagaaguuuccgugccugagacccucgaaagccaggucaagaaaucugaguccggagugcugaagggccaggaggcccaggagaaaaaggagagcuucgaagacaaagggaacaaugacaaggagaaagaacgggaugccgagaaggaccccaacaagaaagagaagggcgauaaaaauacgaagggagacaaaggcaaggauaagguuaaagggaagagagaaucugagaucaacggagaaaaaucuaagggcuccaaacgcgcuaaggccaauacagggcggaaguacaacaaaaagguggaggaauga

SEQ ID NO: 66725 - RNA, 978 nt, Artificial Sequence
  derived and/or modified sequence opt5 from C6orf15__Homo_sapiens__NP_054789
augcagggcagaguggccgggagcugcgcuccccugggacuccugcuugucugucugcaccucccuggccuguucgcccgguccaucgggguuguggaggaaaaggugucucaaaaccuuggaaccaaucugccgcagcucggccagcccagcuccacagggccuucuaacagcgagcauccccagccugcgcuggacccccgcuccaaugaucuggcuagagucccucucaaacugucugugccggccagcgacggauuucccccugccggcggcuccgcuguucaacgguggcccccuagcugggggcuucccgccauggauucuuggccgccugaagaccccuggcagaugauggcugccgcggccgaggaucgccugggagaagcucucccugaggagcuguccuaccuuagcucugccgcugcccuggcgcccggcuccgggccccucccuggagaaagcucuccggacgccacgggccugucccccaaggcuagccugcuccaccaggauuccgagucuagacggcugccucgcagcaacucccuuggggccggaggcaaaauucugagccagagacccccuuggucucucauccaucgggugcugcccgaccacccguggggcacccuuaauccuuccgucagcuggggagggggcgggcccggaacaggcugggggacccgcccuaugccccauccugaaggaauuuggggcaucaacaaucaacccccgggcacaucuugggggaacauuaauagauauccuggaggcagcugggggaacaucaaucgguaccccggaggcuccugggggaacaucaaucgcuaucccggcggaucuuggggcaacauucaccuguacccugggaucaauaacccguuucccccuggagugcucagacccccuggcagcuccuggaacauucccgcuggguucccuaaucccccgagcccucggcugcaguggggauga

SEQ ID NO: 66726 - RNA, 714 nt, Artificial Sequence
  derived and/or modified sequence opt5 from C6orf25__Homo_sapiens__NP_079536
auggccguguuccugcagcuccugccccuucugcucagcagagcucaaggcaacccuggggccucccuggacggacggccgggcgaucgcgucaaucuuucuugcgggggaguuagccaccccaucagaugggugugggcgccuuccuuucccgcuuguaagggccugucuaaagggcggcgcccuauucucugggccagcuccucuggaacccccacagugccuccgcugcagcccuucgucggcagacugcggagccucgacuccggcauccgcagacuggagcuucugcucagcgccggggauucuggaacguuuuucugcaagggccggcaugaagacgagucccgcaccgugcugcacguucuuggggauagaacauacuguaaagcuccuggacccacccauggcagcguguauccucagcugcucauuccccugcugggggccggacucguccugggccuuggcgcucuggggcucgugugguggcugcaccggcgccuuccgccucagcccaucagaccucugccccgguuugcccucucucccccucauuccagcacaugcgaaaaccgcgcgccggaggccucuaagggaggcagagcucaagacucccgggggcccggaccuggcaccgaacccgcccugugugggagcggaccuuccucuccccagcaggcuccgccugccguucacagcggccccugcuga

SEQ ID NO: 66727 - RNA, 885 nt, Artificial Sequence
  derived and/or modified sequence opt5 from C6orf47__Homo_sapiens__NP_067007
auguuccugagacggcucggcggguggcugccccgcccuuggggaagacggaagccgaugcgccccgacccucccuacccugagcccagacggguggauagcuccucugaaaacagcggcuccgacugggauucugccccugagaccauggaagacgucgggcacccgaaaacaaaggauagcggagcccuucgcguuuccggcgcugcgucugagcccagcaaagaggaaccucagguggagcaacugggguccaagagaauggacagccucaaaugggaucagcccaucucuuccacgcaggaaagcggacggcuggaggcuggcggcgccucuccuaagcugcgcugggaccauguggauuccgggggaaccagacggcccggcgucagcccggaagggggacugucugugccuggccccggggccccucucgagaagcccggacgcagagagaaacugcugggcuggcuccggggcgaacccggggcuccuucccgcuaucugggaggcccggaggaaugccuucagauuagcacaaaucugacccuccaccuucuugagcugcucgccuccgcucugcuggcccucuguucuagaccccugcgggcggcccuugacacacuggggcucagaggaccucugggccuuuggcugcaugggcuccugagcuuucuggcugcccuccacggacugcaugcuguucuuucccugcucaccgcccacccccugcacuucgcgugccuuuuuggccugcuccaagcccuggugcuggcugucagccuccgcgaaccuaacggcgaugaggccgcuacagacugggagucugaagggcuggagcgggaaggagaggaacagagaggcgaucccgggaagggacuuuga

SEQ ID NO: 66728 - RNA, 228 nt, Artificial Sequence
  derived and/or modified sequence opt5 from C6orf48__Homo_sapiens__NP_001274413
auggagcggagcuucguguggcuguccugccucgacucugauagcuguaaccugaccuuuagacuuggcgaagucgagucccacgccugcucucccagccugcucuggaaucugcuuacacaguaccugccuccgggggcuggacauauccuccgcacguauaacuuccccguucuguccugugugucuagcugccaccugauuggcgggaagaugccugaaaauuga

SEQ ID NO: 66729 - RNA, 1044 nt, Artificial Sequence
  derived and/or modified sequence opt5 from C6orf89__Homo_sapiens__NP_001273564
auggaccuggccgcuaacgagaucagcauuuacgauaagcucuccgaaaccguggaccuggucagacagacaggccaccaaugcgggaugucugagaaagccaucgaaaaguucauucggcagcuucuggagaaaaaugaaccccagcgcccuccgccccaguauccucuccugaucguuguguacaaggugcuugcgacgcugggacucauucugcugaccgcuuauuuugucauccaacccuucagcccucucgcccccgagccugugcuguccggcgcccauacauggagaucucuuauccaccauauucggcugaugagccucccgaucgcuaaaaaguacauguccgagaacaaggggguuccccugcacggaggcgaugaagaccgcccuuuucccgauuucgacccuugguggaccaaugauugugagcagaacgaaucugagcccauuccggccaauugcacagggugugcucagaaacaucuuaaggugaugcugcucgaggacgccccuagaaaauuugaacggcugcacccccuggucaucaagaccggaaaaccucuccuggaggaagagauucagcacuuccuuugccaauaucccgaagcgacagagggcuuuagcgagggcuucuuugccaagugguggcgcuguuuccccgaaagaugguuuccuuucccguaccccuggcggcgcccucugaacagaucccagaugcuccgggagcuguuucccguguucacccaucuuccuuuccccaaggaugcuagccugaauaaaugcucuuuucuccacccggaaccuguugugggguccaagaugcauaaaaugcccgaccuguucaucauuggaagcggcgaggccaugcugcagcucaucccucccuuucagugucgcagacacugccaaucugucgcuaugccuaucgaacccggggauauuggauauguggacacgacccacuggaagguguacgucaucgcccggggcguucagccgcuggugauuugugaugggacagcguucuccgagcuuuga

SEQ ID NO: 66730 - RNA, 2532 nt, Artificial Sequence
  derived and/or modified sequence opt5 from C7__Homo_sapiens__NP_000578
augaaggugaucagccuguucauucucgucggcuuuaucggggaguuccaguccuuuucuagcgccuccucucccguuaacugccaaugggacuucuacgcuccuuggagcgaauguaauggaugcaccaaaacacagacgagacggcgcuccguggccguguauggccaguacgggggacagccgugugucggcaacgcguuugagacccaaucuugcgaacccacaagaggguguccuaccgaggaaggaugcggcgagcgguuccgcuguuuuagcggccagugcauuuccaagagccugguguguaauggggauucugacugcgaugaggacuccgcugaugaagacagaugugaggauagcgaacggcgccccucuugcgacaucgauaaaccucccccuaacauugagcuuacaggaaauggcuauaacgagcugaccgggcaguucagaaaucggguuaucaacacaaaguccuuuggaggccagugccgcaaaguguucagcggggacggaaaggauuuuuacagacucucuggcaauguccuguccuauaccuuccaagugaagaucaacaaugacuuuaacuacgaguucuauaauagcacgugguccuacguuaaacacaccucuacagagcauaccagcuccagccggaagcgcucuuucuuuagauccagcucuagcuccucucggagcuacacaucccacaccaacgaaauucauaaaggcaagagcuaucagcuucugguggucgagaauacgguggaaguggcccaguucaucaacaacaauccggaguuucuccagcuggccgagcccuucuggaaagaacugucucaccucccuucccuguacgauuauagcgcuuaccgcagacuuauugaccaauaugggacacauuaccugcagucuggaucccucggcggggaguaucggguccuguuuuacguugacagcgaaaaacuuaagcagaacgauuucaauuccguggaggaaaagaaguguaaaucuagcggauggcacuuuguggucaaguucuccucucacggcugcaaagagcuggagaacgcccucaaggcugccagcgggacccaaaauaacgugcugagaggagaacccuuuauccgcggcggcggggcgggauucauuuccggccugagcuaccucgagcuggacaauccugccgggaacaaacggagauauucugcuugggccgaauccguuacaaaucuuccccaggugaucaagcagaagcugaccccgcucuacgagcuggucaaagaagugccuugugcuagcguuaagaaacuuuaucugaagugggcccucgaggaguaccuggaugaauuugaccccugccauugucgcccuugccagaacggaggccuggcgaccguggaggggacacacugucucugccauuguaaacccuauacguucggcgccgcuugcgaacaaggaguccuggugggcaaucaggccgggggagucgauggcggguggucuuguugguccagcuggucucccugcgugcagggaaagaagacccggagcagagagugcaacaauccuccgcccuccggcgggggccgcagcuguguuggagagacaaccgaaucuacacagugcgaggacgaagaacuugaacaucugcggcuccuggagccucacuguuuuccccuuucccuggugccuaccgaguucugccccagcccgccugcucucaaagauggcuucguccaagacgaagggacgauguuucccgugggaaagaacguuguguacacauguaaugagggcuauucccugauugggaacccugucgccagaugcggagaagaucugcgcuggcucgugggcgagaugcacugucagaaaaucgccugcgugcugcccguucuuauggacgggauccagucucacccucagaagcccuucuacaccgucggcgaaaaagugaccgugagcuguuccggaggcaugucucuggaggggccgagcgcuuuucucugcggauccucucugaaguggagcccugagaugaagaacgcgcgguguguccaaaaagaaaauccccugacacaggccgugcccaagugccagagaugggagaaacuucagaacucccgcugcguuuguaagaugccuuacgaaugcggcccgagccucgaugugugugcucaagacgagcggucuaaacggauucugccccugaccgucugcaagaugcaugugcuccacugucaggggagaaauuauacacugacgggacgcgacuccugcacccuuccugccagcgccgaaaaggcuuguggcgccugcccccugugggggaaaugugaugcggagucuuccaagugcguuuguagagaggcuagcgaaugcgaggaagagggcuucucuaucugcguggaggucaacggaaaagaacagacaauguccgagugugaagccggcgcccuccggugcagagggcaaagcauuuccgugaccagcauccgcccuugugcugccgagacacaguga

SEQ ID NO: 66731 - RNA, 309 nt, Artificial Sequence
  derived and/or modified sequence opt5 from C7orf49__Homo_sapiens__NP_001230683
augaacgaggccgaaaucguggacgucgcucugggcauucucaucgagagcagaaagcaggaaaaagccugcgagcaacccgcgcuggcuggcgccgauaauccugaacacuccccgcccuguucuguuagcccucauaccuccucuggaagcuccucugaggaggaagacagcggcaagcaggcccuugcucccgggcuguccccuagccagcggcccggagggucuuccagcgccugcucucgcuccccugaggaagaggaggaagaggaugugcucaaauacgugagagaaauuuucuuuagcuga

SEQ ID NO: 66732 - RNA, 462 nt, Artificial Sequence
  derived and/or modified sequence opt5 from C7orf57__Homo_sapiens__NP_001254795
augcccgacuacauggugcacgaggaguucaacccugaucaggccaauggcagcuaugcuuccagacgggggccguuugacuucgauaugaagaccgucuggcaacgcgaggccgaagaacuggaaaaagagaagaaaaagcucagacugcccgcgaucgacucuaaauaccuuagcaaggcuggaacaccucugggccccaagaacccugccgggucccggcucucuuuucccccuguuaauggauauaaagaugaguggcugcagcagcagcaacgcgccgacagcgauaagagaacgccgaaaaccucccgggcuucugugcuuagccagagcccccgcgaccuggaaggcccucaggaugccgcuagacuccaggacgccgaggcguccgaagggcccgaggauacaccuggacccgaggaaucuguguccgccagcaccccggcugagcugaaguga

SEQ ID NO: 66733 - RNA, 1218 nt, Artificial Sequence
  derived and/or modified sequence opt5 from C7orf60__Homo_sapiens__NP_689769
auggagcccggcgccgggggaagaaacaccgcucgggcccagcgcgcgggcagcccuaauacaccgcccccuagagaacaagagcggaagcuggaacaggagaaacucuccgggguggucaagucuguucaccgcagacugcggaaaaaguaccgcgaagugggagacuucgauaaaaucuggagagagcauugcgaggacgaagagacgcuuugugaauaugcuguggccaugaagaaccuggccgauaaucacugggcuaagaccugcgagggcgaggggcggauugaaugguguugcagcgucugucgcgaguacuuucagaacggaggcaaaagaaaggcccucgaaaaagacgagaagcgggcugugcuggccacaaaaaccacacccgcgcuuaauaugcaugaauccucucagcuggagggccaccucaccaaccugagcuucacaaauccugaguuuaucaccgaacugcuccaagccuccgggaagauucgccugcuugauguuggaucuugcuucaaccccuuucugaaguucgaggaauuucucacggugggcaucgacauugucccugcuguggagagcguuuauaaaugugauuuccugaaucuucagcugcagcagccgcuccaacuggcccaggacgcuaucgaugccuuucugaagcagcucaaaaaccccaucgacucccugccuggggaacuuuuccauguggucguguuuagccugcuccugucuuacuuccccuccccuuaucagagauggauuugcuguaagaaagcgcacgagcuucuggugcucaauggacugcugcucaucauuacccccgauagcucucaccaaaaccggcaugccaugaugaugaaguccuggaaaaucgcuauugagagccugggcuuuaagcgcuucaaguacucuaaauucucccacaugcaucuuauggccuuuagaaagaucagccugaaaacaaccuccgaccucgucucucggaauuauccggggaugcuguacauuccucaggauuucaacagcaucgaagacgaggaauacuccaaucccagcugcuauguuagaucugacaucgaggaugaacagcuugcuuacggauuuacagagcugccugacgcccccuaugauuccgacagcggcgagucucaagccagcuccauucccuucuacgaacucgaggauccuauccugcugcucucuuga

SEQ ID NO: 66734 - RNA, 762 nt, Artificial Sequence
  derived and/or modified sequence opt5 from C7orf62__Homo_sapiens__XP_011514206
augagcuucuccgugcacaaccagaagggcucuaaaagaccccugccucucgagccgcugcuuuuucugcaagucccccggagcaauuaccuccauuuccaggaagagaagcagcgccugcaccuuaaaaaguuucugcucgacagaauguuccugguugccaaaauccaggcuaacguggaacggaaggauguggccgacuauuacgagcaaauguuucaguccguccugaagcaucaccucggggaagcggugaccggacugcuucugauuuauccuacaucuauccuccauauucuggagagcuccucugauacgcuuuacaaaguucugcucgacuauaucggccacgugaaggaugagaccgucuucuuuauucagcagaugaaaaucaucgugauuagccacaauauccccaugcgccuguucaugcaauggcauguuuccgugauuaaggucccugugauguaccuggacgaugugacacagagccagucucucaaagaagucaucaccgacuuucugacacagacccacaaacuuucccuguaucucugccaaacaaugaagguugggaccaagggacccggcgauaaccugcaucagguggcuccugaccuucugcucccggagcagauuaucaaguaccuguguaaaagcgaagaguucauggaucccgccacguuuauuaauauguacaacagaccuauccacaucacccuggacucugagguggucuggcccgccccuucccgguucuga

SEQ ID NO: 66735 - RNA, 456 nt, Artificial Sequence
  derived and/or modified sequence opt5 from C7orf65__Homo_sapiens__NP_001116537
augagaauggcccccaccgagagcacagaaggccggcgccuguggccugggccgagagagggaggcuccgggaaggaaacgaccucugagaaacucagcaaccugccccggccucacuccuacucucccaagcgcgcugacgccgagagcuucagaggagugccugcggcuuuuaaaaagugccgggaagucuuccgcgccuguuggggcuccagagagcuucuguuucucuucaaagccaucucugaagcugggcccgcccagaauagcugcggaauuacacuggagaaggcuggcggccuugaagauaccgggucccauuggcugagcugggcccgguguaagguucucuauaucaacggauuuacagacccuuggaaagaugcgcaagccuggauucugaucgugucuugcaagaaaggcaaggggaccccggagcgcgagggaagaaauuga

SEQ ID NO: 66736 - RNA, 369 nt, Artificial Sequence
  derived and/or modified sequence opt5 from C7orf69__Homo_sapiens__NP_079307
augggcuuccacuuuugcaucuggauuaucuuccugcugcccccuccguguaagaaaugccucagcccucccaccaugaaccuuagacccccuaaguccugugggaauguguuuuacuggguccugguucucaacucuggacugcuuuauaaauucugccagacaauuaagugucgggccaauuggcgccccgcuagagccccucggggcuggaacgaggcgacggaacgccaucaagagagacggacccagauggaaacagagaugggagggaucagcaccacauacuggcaccgccugugcaccuguacagacagacgggcugaaaaacucgugauggauggcaauaacugcugguuucauaaguga

SEQ ID NO: 66737 - RNA, 1317 nt, Artificial Sequence
  derived and/or modified sequence opt5 from C7orf72__Homo_sapiens__NP_001155306
auggacguggagauccaggauacccccggcaagauuagcaucuccaaaagaucuauucugagcgggacagucgaaaacaucgacuacccucacuauugcgaucuccugcggaagaugaauaugccguucguuaaaggacuugagaaccgccauaauuacggcagauuugaaaagaaauguaaccccgccuuccugaaguuucacccuuaucccccuuccgugcuccccgacuaccaucugcacgauccuuauccgcccccuuacgggccccauuauccucuuuucccccugcgggacgaugugacgcucggagacucuugcagcggcuuuaugucccccgggggagaugcugaccugaauccuggcauuggccgcaccauccccacacuggucgauuucucugacgugaagccucaacacagaguuccccggcccgauaccggguuucagacaaccaucaaacgccagaagauucucagcgaggaacugcagcaaaacagacgguggaacucccgcgaggugccugacaucagcauuagagcccggcuuggaggcuggacaucuccgcugaaagucaccccgcuccagccucaccaugaggggcgcucccugagccacaucuucacguuugacgaagaggcgaccuguacagaugaaggagagccccuugugcagaccaauaagaaaugcaaugcuaaggacucuuucuacaaguccagcacacagaaagccuacgaggauguuccuugggacaagaugcugcccccgaaacucgugccugaagagaccacgcuggaaaaggccgcugaucccauuucucaauguuuuacacugaaaagauauaagggcgucccugccaucacccagauggugggggagcucugggaccgguuccagacacgcuccuuucuggcucccgugaaaccuauuaacuucgucagcuccucuagcagauccaaguacaucccccuuuauaccggacauguucagagcaccaaugccgaugacguggauaacccgcugggcgacaucgcgucucucgccaagcaacgguacuccaaaccucuguauacaaauacgagcagagcugccaacauucccggcuacaccgggaaggugcacuucacagcuacccaccccgccaauucuaacaucccuagcacaaccccgucccccgauucugaacuucaucgcgucuuucagaaagagauggcgguggaccuguuccggcaccaggccccucucagcagacugguuacgacagugcgccccuauaacccuuuuaauaagaaagacaaggagaccauugauuacuga

SEQ ID NO: 66738 - RNA, 1122 nt, Artificial Sequence
  derived and/or modified sequence opt5 from C8orf34__Homo_sapiens__NP_001182568
augagcucuccccuggccuccgagcucagcgaacuggcugcccuuagaccuggcuuccggcuguccgcgccgcacgcucgcguggcccccagagccgcuacccaugcccgggggcgcggcagagcuucucacgccggccagccucggcuccgcagcuccugccccgggccuucucccggaaagagacgggucguuccuagcggcggggcgcaaccgcgcgugcugcccgcccuuuccagcagaucucaucuguuuccuauggcuucccacccccagacacggauccaggccuaccucgagaaaaacaagauuggaccucuguucgaggaacugaugacgaaacucaucaccgaaacacccgaccagccgauuccuuuucugaucgaucaucuucaaagcaagcagggcaaucgcggccagcugcagagaacccucucuggguccgcugcccugugggcggagagcgagaaaucugaauccaagggaacacggcgcgacuucagaagcuaugauaagcccuggcaacuuaacgccaaaaagccuaaaaaguccaaaucugaccuggcugugagcaauauuuccccucccagccccgauucuaagucccucccgcggagcgucgagcaccccaaguggaacuggagaaccaaaccucagucucgcgacuuugaugaacugaaucacauccugcaggagagcaagaaacucggcaaggcccuggagaaccuuucccggucuaucgcuauuagcgacgaacuggauaaagagacagugaccuucaauuccagccuccugagaccccgcguuaucggggaauggauuggacgggaggaaaacgacgccgauccucuugccgcugagaugcugcagcccccgaucccuagaucuaagaaugaccaaugggaguccgaagauagcggaucuucccccgcggggagccucaaaauggagccuaagaacaagggacugaaacagcagcaacagcagcauaagaaacugcucgccgcuaugcugucccaggacucuuuugaaagcauucacucccccacgccuucugugaccgaggaagacaucgauaaugaggacgaugccauggagcuucugggcaacuucaagaauuga

SEQ ID NO: 66739 - RNA, 624 nt, Artificial Sequence
  derived and/or modified sequence opt5 from C8orf37__Homo_sapiens__NP_808880
auggccgaggaccuggaugaacuccuggacgagguggaaagcaaguucugcacccccgaucuucugagacggggcauggucgagcagccuaaaggguguggaggcgggacacacuccucugaccgcaaccaagcuaaggccaaagaaacgcucagaagcaccgagacauuuaagaaagaggaugaccuggauucccuuaucaaugaaauucuggaggaaccgaaccucgacaagaagcccucuaaacugaaaagcaaguccucuggaaauaccagcguucgggcguccaucgagggccugggaaagagcugcucuccuguguaccucgggggcuccagcauucccuguggcaucgggacaaacauuucuuggcgcgcuugcgaucaucugagauguaucgccugcgacuuccuuguggucuccuaugaugacuacaugugggauaaaagcugugacuaucuguuuuuccggaauaacaugccugaguuucacaagcucaaggccaaacugaucaagaaaaagggaacccgcgcuuacgccugccaguguucuuggagaacaauugaagaggugaccgaccuucagacggaucaucagcugcgguggguuugcggcaaacacuga

SEQ ID NO: 66740 - RNA, 624 nt, Artificial Sequence
  derived and/or modified sequence opt5 from C8orf46__Homo_sapiens__NP_689978
augaugcaccagaucuacagcugcuccgacgagaacauugaaguguucaccacagucauccccucuaagguuagcuccccugccagacggcgcgcuaaaucuagccaacaucugcucacgaagaauguggugauugaguccgaucuguauacccaccagccgcuugaacugcucccccauagaggcgaccggcgcgauccuggggacagacggcgcuuuggaagacugcagacagcccggcccccuaccgcgcaccccgcuaaagccucugcccgcccugucggcaucagcgagccgaagacauccaaccuuugugggaauagagcuuacggaaaaagccugauucccccugugccccggaucucuguuaagaccuccgccagcgcuucucucgaagccacagcgaugggcaccgagaagggggccgugcugaugcgcggauccagacaucugaaaaagaugacggaggaauauccugcucucccccagggcgccgaggcuagccugccgcuuaccggcucugccuccugcggggucccuggaauccugcggaaaauguggacacgccacaagaaaaagagcgaauacgugggcgcgaccaacuccgccuucgaggcugauuga

SEQ ID NO: 66741 - RNA, 960 nt, Artificial Sequence
  derived and/or modified sequence opt5 from C8orf48__Homo_sapiens__NP_001007091
auggccaucugccccgagcuggcucagaccgacaagagcgcccucgcgaaccuguccgaugaaacagagacgcuuaaaaauuucaccgacgaagugcaaacaucuagcuccuuuucuagcuccggcgggagacagucuagcccucugaccuccggaagcaagcucgagcgggaaaaacagacaccgucucuggagcagggcgauacccaauccgagcuucuggacuacaagaacuaugagaaaaagcucagcaagaaauggauuaauuaccugaagcugaaagauucuaacuucgaacgccaccagcccgacacaaagcucccuaccgaaaucacgagagucuccgaugaggagcugaaugcucugcagagcuauuguaccaugaaaauuaaccugauccaucggcgcggggacucuaagaagaaaacauccagcagacacaagaaacuccaucugggacuugauguugaagccuccgagcgggacgccuuuucuugcaccgugcccgaugaacugcucaaucgcauuuacuucaagaacaugagaacaaccccuaaacaggaggcugccgcuaagcaacacaucagcuaucagugucccuacugcaaucggaaacgcgccgaacuggcgcuguccgccuuucucaagcagaagaaaacgcugcuugagagcuuccugcuccaggagagaaucgacgaacaucugcacacaaaggauuuucuuacccggauuggcgaggcucaccaagacuucccucgccugucugacgauccgagaaucauuuggaaacggcucacagaaaagucccauauccgcuauagcggguuugagagaucugaaaccgagcagaaaaugcagcgggacggaaacagcgccugucaccuucccuucucccugccuuuucucaagagacugacccuuauuaagcccgagcuggugaucgucaaugauaacguguga

SEQ ID NO: 66742 - RNA, 321 nt, Artificial Sequence
  derived and/or modified sequence opt5 from C8orf4__Homo_sapiens__NP_064515
augaaggccaaaagaagccaccaggcuaucauuauguccaccucucugcgggugagccccuccauccauggcuaccacuucgacacagccucucgcaagaaagcggucgggaacauuuuugagaauacggaucaagaaagccucgagagacuguuccggaacuccggagacaagaaagcugaggaacgcgccaagaucauuuuugccaucgaucaggacguugaagagaagaccagagcucuuauggcccugaaaaagcggacaaaagauaagcuguuccaguuucucaaacuucgcaaguauucuaucaaggugcauuga

SEQ ID NO: 66743 - RNA, 672 nt, Artificial Sequence
  derived and/or modified sequence opt5 from C8orf86__Homo_sapiens__NP_997295
augagaccccugggcaaggggcuccugccugccgaggaacuuauccggagcaaccugggagugggccgcucccucagagacugccugucucagagcgggaaacuugcugaggaacugggauccaagcggcucaaaccggccaaguucggcaccgaggggaaagaacgcgucgagcaaagaacagagcggcagcgcacgggaucuagcaaggaacccagaaugcagauuaucugucggcgcagauggcgggagccucccccucgccugcuguggggcugccucaugcccagagcgcagccucugcuucacguuaccgcuuacgaaaauacaggccauugggagcggcuggccuccguggugucuagcaagacccaacagccgacagucauuucccacagcucuaucuccauuaccuuuagccauuaucccccugccacacucgauucuuuccuggugcuugagcccaucaaacuguuuccuguuuccagccuccgcucuccccugugucugaacugcggguccuguagagaaagcauccggauuuccggagagcucaucggcaaugcucacucuccggccccucccagaaccccugaacuggagacgcuugggugggacaagcaggcugugcugagcggagcccaggucauucucgugugcgcggaaguuuga

SEQ ID NO: 66744 - RNA, 1680 nt, Artificial Sequence
  derived and/or modified sequence opt5 from C9__Homo_sapiens__NP_001728
augagcgccugcagauccuucgcuguggccaucuguauucuggagaucucuauucucaccgcgcaauacacaacgagcuaugaccccgaacugaccgaguccucuggcagcgcuucccacaucgauugccggaugucuccuuggagcgaauggucccaaugugacccgugccuucgccagauguuuagaagccggucuauugaggucuucgggcaguuuaacggaaagcgcuguacagaugccguuggcgacagacggcagugcgugcccaccgaaccuugugaggaugccgaggacgauugcgggaaugacuuccaauguuccacaggacgcugcaucaaaaugagacugcgguguaacggcgauaaugacugcggggauuuuagcgacgaagaugacugcgagucugaaccccgcccucccuguagagaccggguggucgaggaguccgaacucgcucgcaccgccggauacggcaucaacauucugggcauggauccucuuagcacaccguucgacaaugaguuuuauaacgggcugugcaauagagaucgggacggaaacacccucacguacuaucgcagacccuggaauguggcuucucugaucuacgaaaccaagggcgagaaaaacuuccggacagaacauuaugaggagcagauugaagccuuuaaguccaucauucaggagaaaaccagcaauuucaacgcggccaucucccugaaguuuacaccuaccgaaacgaauaaggcugagcaguguugcgaagagacagccucuagcauuucccuccacgggaaaggcagcuucagauuuucuuacuccaagaacgagaccuaccaacuguuccuuagcuauucuagcaaaaaggagaaaauguuccugcauguuaagggagaaauccaccucgggcgcuuugugaugcggaauagagaugucgugcugacaaccaccuucguugacgauaucaaggcccuucccacaacguacgaaaaaggagaguauuuugcuuuccuggaaaccuacggcacacauuauuccucuagcggcucccucgggggacuguacgagcugauuuaugugcucgacaaggcgagcaugaaacgcaagggcgucgagcugaaagauaucaagcggugucuuggguaccaccuggacgugucucucgccuuuuccgaaauuagcgugggagcugaguucaacaaagaugacugcgucaagagaggcgaagggcgcgccguuaacaucaccucugagaaucugauugacgauguggugucccuuauccggggaggcacaagaaaguacgcuuuugagcugaaagaaaagcuccugcgcggcaccgucaucgacgugacggauuucguuaacugggccagcuccauuaaugacgccccugugcugaucucucagaaacucagccccauuuauaaccuggucccggugaagaugaaaaaugcucaccuuaagaagcagaaccuggagcgggcgaucgaagauuacauuaaugaguuuuccguuagaaaaugucauacaugccagaacgggggaaccgugauccucauggacggcaagugucugugcgccuguccuuucaaauuugaagggaucgcuugcgagauuucuaagcagaaaaucagcgagggacuucccgcccuggaguucccuaaugaaaaguga

SEQ ID NO: 66745 - RNA, 699 nt, Artificial Sequence
  derived and/or modified sequence opt5 from C9orf106__Homo_sapiens__NP_001012733
auggccuacguggcucugagcgacaagccccaccucuccggcgaggucggggaagaggccugcucuagcuggaacccuccgcuguucucccccagaccucuuccccggcuguggccucuccccggaaccccuuuucugccgauccgcgcgcuucccuucucugcuagcuccucuggcaaaagcucccugguuccuagccccucuuccagcgcccauucuggguuuagaacaccuugucucggacccgauugccugcuguguacgcagggcugcgaacuccacgaggggcggaaucauauggccgugcacuccuguguggcucgcgccuggccgggagacccucaagaagucagacaucugaacccccuucugugcgauccuggcagccagguggagcccucuuggcccuggcacccuggccucgagcaggcugccgcguccuggguugggaaucacgugagcccggcccaucggcaggcucugcgcggacacucccuuggcucugcccugagagcucucaugcccgggggacauuguccucugugcguccccuguaagcggggcugcaaccugcgcgggggaagaggcaaacacggcccucggcccuguugcccgcuccugcgcaaguucccugugcuucccguucacccuuggcccuuuccuugcgccgugugggacagcgggugguccuguagauga

SEQ ID NO: 66746 - RNA, 690 nt, Artificial Sequence
  derived and/or modified sequence opt5 from C9orf135__Homo_sapiens__NP_001010940
auggacagccuggauagauccugccaggacuggugugaucggaagcaacacuggcucgagaucgggcccccugaccugguggaacgcaaaggcucucuuacccugagaagccaucacaagaaauacuccaagccgguccucguuuauucuuggcaucgggaucgcgaggccuuccccaaaggauacgacauugaaggcccugagaaggugaagaaacugugcaacagcacauauagacggcuugggacggaugaaucccccaucuggaccucugagacacacgagaagcugagccagaugugucucaauaccgaauggguggagaugaaauccaaggcucugcugaacgaagagacagucagcucuggaauuaucgagcgcgugaccggccucccugccacaggguuuggagcgguuuuccccagacauccuccggacugguccaaaaugugcgcucugaccacguacagcgaagauuaugugcccccuuacgacuaucagccccacgccuacccuugucaggaugacuacucuauuguccaccggaagugccgcucccaauuuaccgaucuuaauggcagcaagagauucggcaucaacacauggcaugacgagucugggaucuaugccaauuccgacgugaaacagaagcuguacccccucaccagcggaccgauuguuccuaucuga

SEQ ID NO: 66747 - RNA, 720 nt, Artificial Sequence
  derived and/or modified sequence opt5 from C9orf152__Homo_sapiens__NP_001013011
auggagggccugcccugcccuuguccggcccucccccacuucuggcagcugagaagccaucuuauggcugaagggucccggacccaagccccuggaaaggggcccccucugucuauccaguuucuccgcgcgcaguacgagggccugaaaagacagcaacggacacaggcucaccuucuggugcuccccaagggaggcaacacgccugccccggccgaaagcauggucaaugcuguuuggauuaacaaagagcgcagauccucucugagccuggaagaggccgacuccgagguggaagggcggcucgaggaagcugcccagggaugccugcaggcgcccaagucuccuuggcauacccaccuugagaugcauugucuggugcaaacaagcccccaggauaccucccaccagguccaccaucgcggcaaacucgugggcagcgaccagagacugccucccgagggggauacacaccuuuucgaaaccaaucaaaugacacagcagggaaccggcaucccggaggccgcucaacugccuugccagguugggaacacgcagaccaaggccguggaaucuggacucaaguuuuccacacaguguccccugagcauuaaaaauccucaucggucuggcaagcccgcuuauuaccccuucccucaacgcaaaaccccgagaaucucccaggccgcgcggaaccuggggcucuauggaagcgccuga

SEQ ID NO: 66748 - RNA, 1326 nt, Artificial Sequence
  derived and/or modified sequence opt5 from C9orf156__Homo_sapiens__NP_057565
augagaggccuggaggaaagcgggccccggccuaccgccacaccgugcggaugugugaagcccgcucucgagacgggcaaccugcuuaccgaaccugucggguaccuggaguccugcuucucugccaaaaauggaacaccccgccagccuagcaucuguuccuauucuagagcgugccuccggauucgcaagagaaucuuuaacaaucccgaacacagccugaugggccuugagcaauucucccauguuuggauucuguuuguguuccacaaaaacgggcaucucucuuguaaggcuaaagugcagccuccgcggcugaauggagccaagaccggcgucuuuagcacacgcagcccccacagaccuaacgccaucggccugacccucgcuaagcuggagaaaguggaagggggagccauuuaccuuuccggcaucgacaugauccaugggacacccguucuggauauuaagccuuauaucgcugaguacgacucuccccagaaugugauggaaccgcucgccgauuucaaccugcagaauaaccaacacaccccuaauacggucucccagagcgacucuaaaaccgauuccugcgaccagcggcagcuuagcggaugugaugagccccaaccucaccauucuacaaagcgcaaacccaagugccccgaggacagaaccuccgaagagaacuaucugacacacagcgauaccgcgcggauucagcaggccuuuccuaugcaucgcgaaaucgcuguggacuucggccucgaguccagacgggaucagucuagcuccguugccgaggagcaaauugggccguacugucccgaaaagagcuuuucugaaaaaggaacggacaagaaacuggagcgcguggaaggcgcugccguccugcagggcuccagagcggagacacagccuauggcuccccacugcccugccgggcgggccgauggagcucccagaagcguggugccggccugggucaccgaagccccuguugcuacacucgaggugcgcuucacaccccacgcggagauggaccugggccaacuuucuagccaggacguggggcaggccuccuuuaaguauuuccagucugcugaagaggccaaacgggccaucgaagcuguccugagcgccgauccuagauccguguaccgccggaagcucugucaagacagacuguuuuacuucaccguugauauugcgcaugugaccugcugguucggagacggcuuugcugagguccuucgcaucaaacccgccagcgaaccugugcacaugacggggcccguuggaucucuggugucccucggcagcuga

SEQ ID NO: 66749 - RNA, 366 nt, Artificial Sequence
  derived and/or modified sequence opt5 from C9orf170__Homo_sapiens__NP_001001709
auguggagcagacggggccugggggugucccgcgcuccccuccaucugcuucugggagucuggggcccuucugggagaaccggaggccagcggaagggggccagccucgcccgcccgggaagaggcggccuggcguccugcucuguuggggcuaacggaaaacgggacgugcuuuuccugcgcaagacacucacgaauaccguggaggauauccaaauugacaacuuuagacggaaaagcgaucugggcgucgggucccccgacuggaagaaucugcucaucgaugugacacgcgaagaccacgagaacucucagaauaacagcaaaagacgguguaagguuaauugcgaaaccgaucagcgcuga

SEQ ID NO: 66750 - RNA, 855 nt, Artificial Sequence
  derived and/or modified sequence opt5 from C9orf171__Homo_sapiens__NP_001269886
augcccgaggccagaagcuccggcccugaccugacccgguggcgcaagcagcaacagccggugagacggacagucucucagguuugucccccuccccgcagaccucucacgguggcugauauccggagcgggauggaaaacgagcgccugggaguggucagagacuccauguuccagaauccccuuauugugaaagccgaacugggcaagccucgggagcgcucuuacagccucccggggaucaacuuuaauuauggacuguacauuagaggccuugaugggggaguucccgaagcgaucggccgguggaacguguucaaacaacagccuaccugcccccacgagcugacacgcaauuauauugcuaugaacagaggcgccgucaaggccgggcucgugaccgcucgggagaaucugcuguaccgccagcucaacgacaucagaaucuccgaucaggacgaucggagaaugaaaaaggaaccucccccgcugccucccaauaugacauuuggcauucgcgcccggccuucuacccccuucuuugaccuucugcaacauagauaucuccagcuguggguucaggagcagaaggcuacacaaaaagccaucaaacuugaaaagaagcagaaagugguccugggaaagcucuacgagacccgcagcucccagcugcggaaguauaaacccccugugaagcuggauacgcucuggcacaugccgcauuuccaaaaaguggggagacaccuggacaccuuucccacagaggcggaucgccagcgggcccuuaaggcucauagagaagagugcgccguccgccagggaacccugcggaugggcaacuacacacacccuuga

SEQ ID NO: 66751 - RNA, 1701 nt, Artificial Sequence
  derived and/or modified sequence opt5 from C9orf3__Homo_sapiens__NP_001180260
auggacauccagcuggaucccgccagagacgaucucccucugauggcuaacaccagccacauucuugugaagcauuacguccuggaccucgauguugacuucgagucccaagugaucgaaggcacaauugugcuguuucuugaggaugggaaucgguucaaaaagcagaacucuagcaucgaagaggccugccaguccgaaucuaauaaagcguguaaguuuggaaugccggagcccugccacauuccugucacgaacgcucgcaccuucagcuccgagauggaauauaaugacuuugccaucuguucuaaaggcgagaaggauacaagcgacaaggaugggaaccaugacaaucaggaacacgccuccggaaucucuagcuccaaauacugcugugauaccggcaaccaugggagcgaggacuuccugcucgugcuggacugcugugaucugucuguucucaagguggaggaagucgacguggcugccguucccggacuggagaaauuuacaagauccccugaacuuaccguggucagcgaggaguuccggaaucaaauugugcgcgagcuggugacacuccccgcuaacagauggcgggagcagcuggauuauuacgcccgcugcucucaggcgccuggcuguggcgaacuucuguuugacaccgauacguggucccuccagaucagaaagaccggggcccaaacagcuaccgacuucccgcacgccauucggaucugguauaaaacaaagcccgagggacgcagcgucaccuggacguccgaucagucuggcagaccuugcguuuacacaguggggagccccauuaauaaccgggcucuguuuccuugucaggaacccccgguggccauguccaccuggcaggcgacaguccgcgccgcugccagcuucgugguucugaugucuggagaaaauuccgcuaagccuacccaacucugggaagagugcagcucuugguauuacuacgugaccaugcccaugccugccagcacauuuacgaucgccgucggcugcuggaccgagaugaaaauggaaacaugguccucuaacgaccuggcuaccgagagacccuucagccccuccgaagcgaauuuccggcacguggggguuuguagccauauggaguauccuugccgcuuucagaacgccucugcuacaacccaggaaauuaucccgcacagaguguucgcccccgucugucuuacgggagccugccaagagacacugcuccggcugaucccucccugucuuuccgcugcccauagcgugcugggcgcgcacccuuuuucuagacucgauguccugauugugcccgcuaacuucccgucccugggcauggccagcccucacaucauguuucucucccagucuauucugaccgggggaaaucaucuuugcggcacccgccugugucacgagaucgcccaugcuugguucgggcucgccauuggagcucgggacuggacagaagaguggcugagcgaaggcuuugccacccaccuugaggauguuuucugggcgacagcccagcagcuggcucccuacgaggccagagaacaacaggagcuccgcgcuugccugcgguggagacgccugcaggacgaaaugcaguguuccccugaggaaaugcaagugcuccgguuuccccaugucgggggaugcucuggcagcuucuccuga

SEQ ID NO: 66752 - RNA, 1386 nt, Artificial Sequence
  derived and/or modified sequence opt5 from C9orf43__Homo_sapiens__NP_001265558
auggaccugcccgaugagagccagugggacgaaaccacaugcggccucgccgugugucaacacccucagugcugggcuacgaucagacggauugagcgcgggcauccgagaauccugggauccucuuguaagacaccccuugaugccgaagacaaacugccuguccucaccguuguggauauucuggacagcggcuucgcggcucaccaucuucccgagugcaccuuuacaaaggcccacucccugcucucucagagcuccaaauucuacucuaaguuucaugggcggccucccaaaggacugccugauaagagccugaucaacuguaccaaucgccucccgaaguuccccgugcugaaccuuaaugaaacacagcugccuugccccgaggacgucagaaacauggugguucucuggauuccugaggaaaccgagauccacgugucccaacacggcaaaaagaaacggaagaauagcgccgucaaaucuaaguccuuucuggggcuuagcggaaaccagucugcuggcacgcgcgugggcacccccgggaugaucguuccgccucccacaccugugcagcuguccgaacaguucagcucugauuuucucccccugugggcccaauccgaggcucugccccaggaccuccugaaggagcuucugccuggaggcaaacagaccaugcucuguccggaaaugaagauuaaacuggccaugaugaagaaaaaucuuccccuggagaagaacagaccugauagcgucaucuccucuaaaauguuccucagcauucaucggcugacacuggaacgccccgcgcucagauauccugagcggcugaagaaacuucacaaucugaaaaccgaaggguaccgcaagcagcaacagagacagcaacagcagcagcaacagcagaaaaaggugaaaacgcccaucaagaagcaggaggccaaaaagaaagcuaaguccgacccgggcauucaaagcacaucucauaaacacccugugaccacaguccacgaucggcucuauggauaccgcacccugcccgggcagaacuccgacaugaagcagcagcaacagauggagaagggaaccacaagcaaacaggacucuacggaaagaccuaagaugaauuauuacgaucaugccgacuuucaccauagcguuaaaucccccgagcuuuaugaaaccgagccuacaaacaaggauaucucugcucccguggacgccgugccggaagcgcaggccgcucggcaaaagaagauuagcuucaauuuuuccgagaucauggccagcaccggcuggaacucugagcugaagcuccugagaauccugcaggauacagacgaugaagacgaggaagaucaguccagcggcgcugaguga

SEQ ID NO: 66753 - RNA, 888 nt, Artificial Sequence
  derived and/or modified sequence opt5 from C9orf66__Homo_sapiens__NP_689782
augagacacagcguggcccggcccacccgccugccuagacggcucuccccguucugggaccccgcuacaugcaagaaccuggagggcggggccggagaagucguucgcggcagagauccucggcgccuuagaacgucucggagcaccgagauccugggggaagaccucgcgggacccuccgcuggcgccgccgcucgcccugccgcucccccuccgcagcccagagagccuggggcccccggacugcggcgcgcgccucccagaacacggauggauucuagcggccuuggcccguguuccgaagccccucugcauaccucugcugggcucagcggacgcaaucugagagccgcuggcggggugcugcccguggaccucgagcgggagagagccgcgcugugcgcccgccaauccggacacggcccucccgcuguccgguggcuucuggggagcagaggagccgaaucuggcggccucgcucgccggagaguggccgccgagcaugcucagcccuccgcgaaccugguuugucgcagcgcccuugaaacaucugcuuuuccuccguccaaacccaagagcccucgggggagagugcgcgcccggucuuccgauggaagacugcgccaccccgccuggcgggcuggcagcgggggaagaggcgggcggggaccuuccgccgagcucgcgucucgcuacuggggcagacggagagcucugcccggcgccgccgaccugcgcccgaaaggggcucgggccgaugacagacgcccucucagagcuggacggaagcugcaucuucccgaggccgcgcgccugccuggcaaugucgggaaaagcggagaaccccacaaggccggcgagguggggaaccacccuagagauuccuga

SEQ ID NO: 66754 - RNA, 1446 nt, Artificial Sequence
  derived and/or modified sequence opt5 from C9orf72__Homo_sapiens__NP_060795
augagcacccugugucccccuccgucccccgccguggcuaagacagagaucgcccucucuggcaaaagcccucugcuugcggcuacguucgccuacugggacaacauucuggggcccagaguccggcacaucugggccccuaagaccgaacagguucuccuguccgauggagagauuacauuucuugcuaaucauacccugaacggcgaaauccuccgcaaugccgagucuggggcuauugacgugaaauucuuugugcugagcgaaaagggagucaucaucgugucccugauuuucgauggcaacuggaauggggacagaucuacauauggacucagcaucauucugccccaaaccgagcuuuccuuuuaccugccucuccaccggguuugcguggaucgccugacacauaucauuagaaaaggccggaucuggaugcacaaggagcgccaggaaaacguccagaagauuauccuugagggcaccgaaagaauggaggaccaggggcaaagcaucauuccgaugcugacgggagaggugauccccguuauggaacuccugucuuccaugaaaagccauucugugccugaggaaauugauaucgccgacaccguccugaaugaugacgauauuggcgacuccugccacgagggguuccuccugaacgcgaucagcucucaccuucagacauguggaugcuccgugguggucggcagcuccgccgaaaagguuaauaaaaucgugcggacccugugucucuuucugacacccgcugagcgcaagugcucuagacuuugugaggccgaaagcuccuucaaauaugagagcgggcuguuugugcagggacuccugaaggauucuaccggcuccuucguccugccuuuucgccaggugauguacgcucccuauccgacgacacauauugacguugacgugaacaccgucaagcaaaugccucccugccacgaacauaucuacaaucagcggagauauaugcggagcgagcucacagccuucuggcgcgcgaccucugaagaggauauggcccaggacaccauuaucuacacagaugagagcuuuacgccugaccugaacauuuuccaggaugugcuucacagagacacccugguuaaggcuuuccucgaucaaguguuucagcugaaacccggccuuucccugcggucuacauuccucgcccaguuucugcugguccuccacagaaaagcucugacccuuaucaaguacaucgaagacgauacacaaaaagggaagaaacccuucaagagccugcgcaaucucaagauugaccuggaucugaccgccgagggagaccuuaacaucauuauggcccucgcugagaaaaucaagccuggccugcauuccuuuauuuucgggcggccguuuuauacgagcgugcaggaaagagacguccugaugacauucuga

SEQ ID NO: 66755 - RNA, 474 nt, Artificial Sequence
  derived and/or modified sequence opt5 from C9orf85__Homo_sapiens__NP_872311
augagcucccagaagggcaacguggccagaucucggccccaaaaacaccagaauaccuucagcuuuaagaacgacaaauucgauaaguccguccagacgaaaaagaucaaugcuaagcugcaugacgggguuugccagcgcuguaaagaggugcucgaauggagagugaaguacucuaaauauaagccucugagcaaaccgaagaagugcgucaaaugucuucaaaagacagugaaagauuccuaccacauuaugugccggcccugugccugcgagcuggaaguuugugcgaagugcggcaaaaaggaggacaucgugauuccucucaacaaagaaaccgagaagaucgagcauacagaaaauaaccugucuagcaaucaccgcagauccugucggcgcaacgaggaaagcgaugacgaucuugacuuugauauugaccuggaggauaccggaggggaccaucagaugaauuga

SEQ ID NO: 66756 - RNA, 1029 nt, Artificial Sequence
  derived and/or modified sequence opt5 from C9orf91__Homo_sapiens__NP_694590
auggccugcgagccccagguggacccuggcgcuaccgggccgcugcccccuagcucccccggauggucugcccucccuggcgggagcccucccggauggggccaagaacugcacaacgggcagguccuuacaguucugagaaucgauaauacgugugcgccgauuuccuucgaccucggagcugccgaggaacagcugcagaccuggggcauccaagugcccgccgaucaguaccggucucuugcugagagcgcccugcucgaaccucaggugcgcagauauauuaucuacaacucccggcccaugcgccuggcuuuugccgucguguucuauguuguggucugggcgaauauuuacucuacaagccagauguuugcccugggcaaccauugggcugggaugcuccuggugacccuugccgcuguuucccugacacucacccuggugcuugucuucgagagacaccaaaagaaagccaauacaaacaccgaccugcggcucgcggccgcuaauggagcccugcugcgccauagagugcuccugggcgugacggauaccgucgaggggugccagagcguuauccagcuuugguuuguguauuucgaccuggaaaacugugugcaguuucucucugaucacguccaagagaugaagacaucccaggaaagccugcuucggucucgccugucccagcucugcgugguuauggagaccggagugagcccugcuacagccgagggccccgaaaaucuggaggacgccccgcugcucccugggaacucuugucccaaugaaagaccucugaugcaaaccgagcuucaucagcugguccccgaagcugagcccgaggaaauggcgcggcagcuccuggccguguucggaggcuacuauauccgccuucugguuacgucccagcucccucaagcuaugggcacaagacacaccaacagcccgcggauucccugcccuugucagcugaucgaggccuacauucuggggacaggaugcugucccuuucucgcccgcuga

SEQ ID NO: 66757 - RNA, 507 nt, Artificial Sequence
  derived and/or modified sequence opt5 from C9orf9__Homo_sapiens__NP_061829
augaacgaggugaaggaaagccugagauccaucgagcagaaauacaaacucuuccaacagcagcagcugaccuuuacagccgcucuugaacacugccgggagaaugcccaugacaagauucgccccaucucuagcauuggccaaguccaguccuauauggaacacuacuguaacucuagcacggauagacggguucugcucauguuccuggacaucugcuccgagcuuaauaagcugugucagcauuuugaggcggugcacucugggaccccugugacaaacaaucuccuggaaaaaugcaagacccuggucagccaguccaacgaucucagcucucugcgcgcuaaguauccgcaugacgugguuaaucaccuuuccugugaugaggccagaaaccacuacggaggcguggucagccugauuccccucauccuggaccuuaugaaagaauggaucgcccauucugagaagcugccucggaaagugcuccaacacgggacaaccuga

SEQ ID NO: 66758 - RNA, 987 nt, Artificial Sequence
  derived and/or modified sequence opt5 from CA10__Homo_sapiens__NP_001076003
auggagaucgugugggaaguccuguuccuccugcaggccaacuuuauuguuugcaucagcgcucaacaaaauucccccaagauucacgagggcuggugggccuacaaagaaguggugcaggggucuuucgucccugugccgagcuuuuggggacuuguuaacuccgcguggaaucuguguucugugggcaagagacagagccccgucaacaucgagaccucccauaugauuuucgacccuuuucucacaccccugcggaucaauaccgggggacgcaaagugucuggcacgauguauaacacagggagacacguuagccuucggcuggauaaggaacaucucgugaauaucuccggaggcccuaugaccuacagccaccgccuggaggagauuagacugcauuucggcucugaagacucccaggggagcgagcaccuccugaacggacaggcuuuuucuggcgaaguccagcuuauccacuauaaucaugagcuguacacaaacgugaccgaggccgccaaaucccccaaugggcucguggucguuagcauuuucaucaaggugucugauuccagcaacccuuuucugaaucggaugcuuaaccgcgacacaauuaccagaaucacguauaagaaugaugcuuaccugcuccagggacugaacauugaggaacuguauccggaaaccuccucuuucaucacauacgacggcagcaugaccauucccccuugcuacgagacagccuccuggaucaucaugaacaaacccguguauauuacccggaugcaaaugcacagccuccgccugcuuucucagaaucagccuucccagaucuuucugagcaugucugauaacuucagacccguccaaccgcucaauaaccgguguauucgcacgaauaucaacuuuagccugcaggggaaggacugcccuaauaacagagcucagaaacuucaauaccgggugaaugaauggcugcucaaguga

SEQ ID NO: 66759 - RNA, 987 nt, Artificial Sequence
  derived and/or modified sequence opt5 from CA11__Homo_sapiens__NP_001208
augggcgccgcugccagacugagcgcgccccgggcucucgugcugugggccgcccuuggggcugccgcucacaucggaccugccccggaccccgaggauuggugguccuacaaggacaaccugcagggcaauuucgucccugggcccccuuuuuggggacucguuaacgcggccuggucucugugcgcugugggcaaacgccaaagccccguggaugucgaacuuaagagagugcuguaugacccuuuccucccgccccugcggcuguccaccgggggagagaaacuccgcggcacacuguacaauacgggcagacauguuucuuuucuuccugcuccccggccuguggucaacgugagcgggggaccccugcucuauucccaccgccugucugaacuuagacuccuguucggcgcccgggauggggccggaagcgagcaucagauuaaucaccagggcuuuuccgcggaaguucagcugauccauuucaaccaagagcuguacgggaauuuuagcgccgcuucucgcggaccgaacggccucgccauucugucccuuuucgugaaugucgcuagcaccucuaacccuuuucuguccagacuccugaaucgggacacaaucacccgcauuagcuauaagaacgaugccuacuuccuucaggaccugucucucgagcugcuguuucccgaauccuucggcuuuaucacauaucaggggagccucuccaccccucccuguucugagacagugaccuggauccugauugauagagcccuuaauaucacgagccugcagaugcacucccuccggcugcuuagccaaaaucccccuucucagauuuuccagucccugagcggaaacucucgcccgcuccagccccuggcucacagagcgcugcggggcaacagagacccucgccaucccgaacggagaugccgcgggccuaacuaccggcuccacguggauggagucccccauggcagauga

SEQ ID NO: 66760 - RNA, 1065 nt, Artificial Sequence
  derived and/or modified sequence opt5 from CA12__Homo_sapiens__NP_001209
augcccagacggagccugcacgccgcugccgugcuccugcuugucauccugaaggagcagccuuccucuccggcgcccguuaacggcagcaaauggaccuacuucgggccugacggagaaaauuccuggucuaagaaauaucccagcugcggcgggcuccugcaauccccuauugaucuucauucugacauccugcaguacgaugcuagccucacaccccuggaguuucagggauauaaccuguccgccaauaagcaguuccuccugacgaacaauggccacagcgugaaacuuaaccugccuucugacaugcauauucaagggcuccagucccgcuacagcgccacccagcugcaccuucauuggggaaauccgaacgauccccacggcucugaacacacaguguccggccagcauuuugcugccgagcugcacaucguccauuauaauagcgaccucuacccugaugcuucuaccgccuccaacaagagcgaagggcuggcggugcuggccguucucauugagaugggauccuucaaucccucuuaugacaagaucuuuagccaucugcaacacgugaaauacaagggccaggaggcuuucgucccuggguuuaacaucgaggaacuucugcccgaaagaacagccgaguacuaucgguaccgcggaucccucaccacaccgccuuguaaucccaccgugcuguggacgguuuucagaaacccugugcagauuagccaggagcaacuucuggcucucgaaaccgcccuguauugcacacacauggaugaccccucuccccgggagaugaucaauaacuuucgccagguccagaaauucgaugaaagacugguguacaccuccuuuagccaagugcaggucuguacagcggccggccucucucuggggauuauccuuagccuggcucucgccggcauucugggaaucugcauuguugugguggucuccaucuggcuuuuccggcgcaagucuaucaaaaagggcgacaacaagggggugauuuauaaaccugcuaccaagauggagacggaagcccacgccuga

SEQ ID NO: 66761 - RNA, 789 nt, Artificial Sequence
  derived and/or modified sequence opt5 from CA13__Homo_sapiens__NP_940986
augagcagacuguccuggggcuaccgggagcacaacgggcccauccauuggaaggaguucuuuccuauugccgacggagaucagcaaucuccgaucgaaauuaaaaccaaggaagugaaauaugacagcucccuccgcccccugucuaucaaguacgauccuagcuccgcuaaaauuaucucuaauagcggccacuccuucaacgucgacuuugaugacacagagaauaagagcguucuuagagggggaccccugacgggcucuuaucggcuccgccaggugcaucugcacuggggguccgccgaugaccauggaagcgaacacaucguggauggcgucucuuacgcggcugagcuucacgugguucauuggaacuccgacaaguauccuagcuucguggaggccgcccacgaacccgauggccuggcuguccucgggguguuucugcagauuggagagccuaauucucagcugcagaaaaucaccgacacacucgauuccauuaaggaaaaaggcaagcaaaccagauucacaaacuuugaccugcuuagccugcucccgcccuccugggacuacuggaccuauccugggucucugacaguucccccucuucuggagagcgugaccuggaucguccucaaacagcccauuaauaucuccagccagcaacuggccaaguuccggucucugcucugcacggcugagggagaagccgcggccuuucugguguccaaccaucgcccgccucagccccuuaagggcagaaaagugcgggcuagcuuccacuga

SEQ ID NO: 66762 - RNA, 786 nt, Artificial Sequence
  derived and/or modified sequence opt5 from CA1__Homo_sapiens__XP_011515886
auggccagccccgacuggggcuacgaugacaagaacgggccugagcagugguccaaacuguauccgaucgcuaauggaaacaaucaaucucccguggauauuaagaccagcgaaacaaaacacgacacgucccucaagccuaucucugucagcuacaaccccgccaccgcgaaagagauuaucaauguuggccauuccuuccacgugaacuuugaagauaaugacaacagaucugugcugaaagggggaccuuucagcgauuccuaucggcuuuuucaguuccauuuucacuggggcagcacaaaugagcaugggucugaacacaccgucgacggagugaaguacuccgcugagcugcacguugcccauuggaacagcgccaaguauucuucccucgcugaggccgcuagcaaggccgauggccuggcggugauuggcguccuuaugaaagugggggaagccaaucccaagcugcagaaaguucucgacgcucugcaggccaucaagacaaagggaaaacgcgcuccuuucaccaacuuugauccgucuacacugcuccccuccagccuggacuucuggaccuacccuggcucccuuacgcaucccccucuguaugagucugugaccuggaucauuugcaaggaaagcaucuccgucagcucugagcaacucgcccaguuuagaucccugcuuagcaauguggagggggauaacgcggugcccaugcagcacaauaaccggccgacacagccucugaaaggacgcaccgucagagccucuuucuga

SEQ ID NO: 66763 - RNA, 783 nt, Artificial Sequence
  derived and/or modified sequence opt5 from CA2__Homo_sapiens__NP_000058
augagccaccauuggggcuacgggaagcacaacggacccgagcauuggcacaaagacuucccuaucgccaagggcgaaagacaguccccgguggauauugacacccauacagcuaaauaugaucccucucugaagccucucagcgucuccuacgaccaagccacgucucugcggauccuuaauaacgggcacgcguuuaauguugaguucgaugacagccaggauaaagcugugcugaagggaggcccccucgacgggaccuaucgccugauucaguuucacuuccauuggggaucccuugauggccagggcucugaacacacaguggacaagaaaaaguacgccgccgagcugcaucucguccacuggaacaccaaauauggggauuuuggaaaggcugugcaacagccugacggccuggccguucuggggaucuuccucaaagugggaagcgcuaagcccggccugcagaaggucguggauguucuugacuccauuaaaacaaaggggaaaagcgccgacuuuaccaauuucgauccuagaggacugcucccggaaucucuggacuacuggacauaucccggcucccuuaccacgccuccccugcucgagugcgugaccuggaucguccugaaggagccuaucagcgugucuuccgaacaggugcugaaauuucggaagcucaacuucaauggcgagggggaacccgaggagcugauggucgauaacuggcgcccggcgcaaccucuuaaaaauagacagauuaaggccagcuuuaaguga

SEQ ID NO: 66764 - RNA, 783 nt, Artificial Sequence
  derived and/or modified sequence opt5 from CA3__Homo_sapiens__NP_005172
auggccaaggaguggggcuacgcuagccacaacgggcccgaccauuggcacgaacuguucccuaaugccaaaggagagaaccaguccccgguggaacuccauaccaaggauaucagacacgaccccucucugcaaccuuggagcgucuccuaugauggcgggucugcgaaaacaauucuuaauaacggaaagacgugccggguuguguuugacgauaccuacgaccgcagcaugcugagaggcgggccccucccuggacccuaucggcugcgccaguuccaucuucacuggggcuccucugaugaccacggcagcgagcauacaguggauggggucaaauacgcugccgaacugcaccucgugcauuggaauccuaaguauaacaccuuuaaggaggcccugaaacagagagacggaaucgcuguuauuggcaucuuccugaagauugggcacgagaauggagaauuucagaucuuccucgaugcccuggacaaaaucaagacaaaaggcaaggaggcuccguuuaccaaguucgaucccuccugucuuuuuccugccugccgggacuacuggacauaucaagggagcuucaccacgcccccuugugaagagugcauuguguggcugcuccugaaagagcccaugaccgucucuuccgaccagauggcgaaacuucgcagccugcucucuuccgccgaaaacgagccgccugugccccugguuagcaauuggagaccuccccagcccaucaacaaucgggugguccgcgcuucuuuuaaguga

SEQ ID NO: 66765 - RNA, 939 nt, Artificial Sequence
  derived and/or modified sequence opt5 from CA4__Homo_sapiens__NP_000708
augagaaugcugcucgcccugcuugcucugagcgccgcgcggcccuccgcuucugccgagagccacuggugcuacgaagugcaggccgaguccucuaacuauccuugucucgucccgguuaaguggggcgggaauugccaaaaagaccgccagagccccaucaacauugugaccacaaaggcuaaaguggauaagaaacugggaagauucuuuuucuccggcuacgacaagaagcagacguggaccguccagaauaacgggcauucugugaugaugcuucuggaaaauaaagccagcaucuccggaggcgggcucccugcucccuaucaagccaagcagcugcaucugcacuggagcgaucucccuuacaaaggaucugagcacucccuggacggcgaacauuuugcgauggagaugcacauuguucacgagaaggaaaaaggcacaagccggaacgugaaggaggcccaggaucccgaagacgagaucgcuguccuugccuuccugguggaggcugggacccagguuaaugaaggauuucaaccucucguggaggcccugucuaacauuccgaagcccgaaauguccacaaccauggcggagagcucucuucuggaucuccugccuaaagaagagaagcugcgccauuauuucagauaccucggcucccugacaacccccacgugugacgagaaagucguguggaccguguuucgggaaccuauccagcuucaccgcgagcagauccuggccuucagccagaagcucuauuacgauaaagaacaaacagucuccaugaaggacaauguuagaccccugcagcagcuugggcaacggaccgugauuaaaucuggagcuccgggccgcccucugcccugggcccucccugcucugcuggggcccaugcucgccugccugcuugccggauuucugagauga

SEQ ID NO: 66766 - RNA, 918 nt, Artificial Sequence
  derived and/or modified sequence opt5 from CA5A__Homo_sapiens__NP_001730
augcugggcagaaacaccuggaagacaagcgccuucuccuuucucguggagcagaugugggcuccccuguggucucggagcaugcgcccugggagauggugcucccaacggucuugugccuggcagacgagcaauaacacccuucacccgcuguggacaguccccguuuccgugccuggaggcacccgccagucucccaucaauauucaguggagagacagcguguacgauccucaacucaaaccccugcgggucuccuaugaagcggcuagcugccuuuacaucuggaacacaggguaucuguuccagguggaguuugacgaugccaccgaagccucuggaauuuccggcgggccucucgagaaucauuaccgccugaagcaguuccacuuucauuggggagcuguuaacgaaggcggcagcgagcacacaguggacgggcaugccuauccggcugagcugcaccucguccacuggaacucugugaaauaccagaauuauaaggaagccguugugggagagaauggccuggcggucaucgggguguuccuuaaacugggagcccaucaccaaacccuccagagacugguggauauucuucccgaaaucaagcauaaggacgcucgggccgcuaugcgcccuuuugaucccuccacgcugcucccuaccuguugggacuacuggacauacgccggcagccugaccacacccccgcugaccgagucugucacguggaucauucagaaagagccuguugaaguggcgcccucccagcucagcgccuucagaacacugcuguuuuccgcucuuggggaggaagagaagaugauggugaacaauuaucggccucuccaaccccugaugaaccgcaaagucugggccucuuuccaggcuaccaaugaaggaacaagaagcuga

SEQ ID NO: 66767 - RNA, 885 nt, Artificial Sequence
  derived and/or modified sequence opt5 from CA6__Homo_sapiens__XP_011540385
augugcagcaccaugagagcccuggugcuccugcuuucccuguuccuccugggcgggcaggcucaacacgucucugacuggacauacagcgagggagcccuugaugaagcgcauuggccccagcacuauccugcuuguggcgggcagcggcaguccccgaucaaccugcaacgcacgaagguuagauacaaucccucucucaaaggacugaacaugaccggcuaugagacacaggccggggaauuuccuauggugaauaacggacauaccgugcagauuagccugcccuccacaaugcggaugaccgucgccgacggcacaguguacaucgcucagcaaaugcacuuccauuggggcggggccucuagcgagauuuccggaagcgaacacaccguugauggcauccgccacgugauugagauccauaucguccacuauaauucuaaguacaaauccuaugacauugcucaggaugccccugacgggcucgcggugcuggccgcuuuuguugaggugaagaacuaccccgaaaauacguacuauagcaacuucaucucucaucuugccaauauuaaauacccuggacagagaaccacacugaccggccucgauguccaggacaugcugccgcggaaccuucaacacuauuacacauaucacgggucccugaccacgcccccuugcacagagaaugugcauugguuugugcucgcugauuucgucaagcugagccgcacccagguuuggaagcuggaaaacucucuccuggaccacagaaauaaaacaauccauaacgauuaccggcgcacccagccccuuaaucacagagugguggaguccaacuuuccuaaccaagagaauuguauucccgccggacugaucuga

SEQ ID NO: 66768 - RNA, 873 nt, Artificial Sequence
  derived and/or modified sequence opt5 from CA8__Homo_sapiens__NP_004047
auggccgaccugagcuucaucgaggauaccguggcuuuucccgaaaaggaggaagacgaggaagaggaggaagagggcgucgaauggggguacgaggagggaguugaauggggccucguguucccugaugccaacggggaguaucaguccccgauuaaucugaacucuagagaagcgcgguacgaccccagccuucuggaugugcgccucuccccuaauuaugucgugugcagagacugugagguuacaaacgauggacacacgauccaagugauucugaaaucuaagagcguccuuuccggcgggccccugccucagggacaugaauuugagcucuacgaggugcgguuccacuggggccgcgaaaaucagagaggcucugagcauaccguuaacuuuaaggcuuuccccauggaacugcaccugauccauuggaauagcacacucuuuggguccauugacgaggccgugggaaaaccucacggcaucgccaucauugcucuguucguccagaucgggaaagaacacgugggacuuaaggccgugaccgagauucugcaagauauccaguauaagggcaaaagcaagacaauuccgugcuuuaaccccaauacccuccugccugacccccuucugcgggauuacugggucuaugaggggucucucacaaucccucccuguuccgaaggaguuaccuggauucuguuccgcuacccgcugacgaucagccagcuccagaucgaggaauuuagacggcugcgcacccaugugaaaggcgcugagcuuguggaaggcugcgacgggauucugggagauaacuucagaccuacacaaccccucucugaccgggucauccgcgccgcguuucaguga

SEQ ID NO: 66769 - RNA, 1026 nt, Artificial Sequence
  derived and/or modified sequence opt5 from CAB39__Homo_sapiens__NP_001124322
augcccuucccuuuuggcaagagccacaaauccccggccgacaucgugaagaaccugaaagagucuauggcuguccucgaaaagcaggauauuagcgacaaaaaggccgagaaggcgaccgaagagguuuccaaaaaucugguggcuaugaaggaaauccuuuacgggacaaacgagaaagagccccaaacggaagccguggcccagcuggcucaggagcucuauaauucuggacugcuuagcacccuggucgccgaucuccagcugauugacuucgaaggcaagaaagauguggcucaaaucuuuaacaauauucugagacggcagaucgggacacgcaccccuacaguugaguacaucugcacccagcagaacauucucuucaugcugcuuaagggauaugagucccccgaaaucgcccugaauuguggcauuaugcucagagagugcauccggcaugaaccucuggcgaagauuauccuuuggucugagcaauuuuacgacuucuuucgcuauguggaaaugagcacauucgauauugccuccgacgcuuuugccaccuucaaagaucugcucacgagacacaagcugcugagcgcugaguuucucgagcagcauuacgaccgguucuuuucugaauaugagaaacugcuucacuccgaaaacuacgucaccaagcgccagagccugaaacuccugggggagcuucugcucgauagacauaauuucacaaucaugaccaaguacaucucuaaacccgaaaaccugaagcugaugaugaaucuccugcgggacaagucccgcaacauucaguucgaggccuuucacguguucaaaguuuuuguggcgaauccuaacaagacacaaccgauccuugauauucugcucaaaaaucaggccaagcugaucgaguuccuuagcaaauuucagaacgacagaaccgaagacgagcaauucaacgaugaaaagacguaucuggucaagcagauucgggaccucaaacgccccgcucagcaggaggccuga

SEQ ID NO: 66770 - RNA, 1014 nt, Artificial Sequence
  derived and/or modified sequence opt5 from CAB39L__Homo_sapiens__NP_001274268
augaagaaaaugccccuguucagcaagucccacaaaaacccugccgagaucgugaagauucucaaagacaaucuggcuauccuugaaaagcaggauaagaaaaccgacaaggccucugaggaagucagcaaaucccugcaagcgaugaaggagauucucugcggcacaaacgaaaaagagccgcccacggaggcuguugcccagcuggcccaggaacuuuacucuagcgggcugcucgugacccugaucgcugaucugcagcucauugacuuugagggaaagaaggaugugacacaaaucuucaauaacauccugagacggcagauuggcacccgcuccccuacagucgaauauaucucugcccauccccacauucuuuuuaugcugcucaaaggguacgaggcuccucagaucgcccugagauguggaauuaugcuucgggagugcauccgccaugaaccccuggcgaagauuauccucuucagcaaucaguuuagagacuucuuuaaauauguggagcuguccaccuucgauaucgccagcgacgcuuuugccacauucaaggaucugcucacccggcacaaaguucugguggcugacuuucuugaacaaaacuacgauacgauuuucgaggacuaugaaaagcugcuccagucugagaauuacgucaccaaacgccagucccugaaacuucugggcgagcucauccuggauagacauaacuuugccauuaugacaaaguauaucagcaagccugaaaaucugaagcucaugaugaaccugcuucgggacaaaucuccgaauauucaguucgaggcguuccacguguuuaagguuuucguggccagcccccacaaaacccaaccuaucgucgaaauccugcucaagaaccagcccaagcugauugaguuucuuuccucuuuccagaaagaacgcacagacgaugagcaauuugcugacgagaagaauuaccugaucaaacagauuagagaucucaagaaaaccgccccuuga

SEQ ID NO: 66771 - RNA, 6663 nt, Artificial Sequence
  derived and/or modified sequence opt5 from CABIN1__Homo_sapiens__NP_036427
augaucagaauugcugcucugaaugccuccuccaccaucgaggacgaucacgaaggcucuuucaagagccauaaaacccagacgaaggaggcgcaagaagcugaggccuuugcccucuaccacaaagcucuggaccuucagaagcaugaucgguucgaagaguccgccaaggcuuaucacgagcugcucgaagccucucugcuuagagaggcggugagcuccggggacgaaaaggagggacugaagcaucccggccucauucugaaauacucuaccuauaagaaucuggcccagcucgcugcccagagagaggaucuggaaaccgcuauggaguuuuaccuugaagccgugaugcuggacagcaccgauguuaaucucugguauaaaaucgggcacguggcgcugcggcuuauucgcaucccucuggccagacacgcuuucgaggaaggacuccggugcaauccggaccauuggcccugucuggauaaccugaucacagugcucuacacccuguccgacuauacaaccugccuuuacuuuauuuguaaggcccuggagaaagauugccgcuacagcaagggccucguccugaaggagaaaaucuucgaggaacaaccuugucuuagaaaggacucucugcggauguuucucaaaugcgauauguccauucacgacgugagcguuucugcugccgaaacgcaggccaucguggacgaggcucuggggcugcgcaagaaaagacaggcgcucauuguccgggaaaaggagcccgaucugaaacuugugcagccuauccccuucuuuaccuggaagugucugggagagucccuccuggccauguauaaucaucuuacaaccugcgaaccuccgcgccccagccugggcaagagaauugaccucucugauuaccaagacccuucccagccccuggagagcuccaugguugugacaccugucaacgugauccagcccucuaccgugagcacgaauccggcugucgccguugccgaaccugugguguccuauacaagcgucgcuaccacaucuuucccccugcacuccccuggccuccuggagaccggggcccccgugggagauaucagcggcggggacaaaucuaagaaaggaguuaagcggaaaaagauuagcgaagaguccggcgagaccgcgaagcgcagaucugcucgggugagaaacacaaaauguaagaaagaagagaaggucgauuuucaggaacuucugaugaaauuccuccccagccgccugcggaagcuggacccugaggaggaagaugacuccuuuaauaacuacgaggugcaaagcgaagccaaacuugagucuuucccguccaucgggccccagagacucagcuucgauucugccacguuuauggaauccgagaaacaggacguucacgaguuccugcuggaaaaucucaccaacggaggcauucuggagcuuaugaugcgcuaucugaaggcuaugggccauaaauuucucgugcgguggccucccgggcuggccgaagucgugcugagcgucuaccacuccuggagacgccauucuacaagccuuccuaauccccuccugcgggacugcuccaacaagcacaucaaagauaugaugcugaugucucucagcuguauggagcugcaacuugaccaguggcugcucaccaagggaagauccagcgcugugucuccgcgcaauugcccugccggcaugguuaacgggcgguucggacccgauuuuccuggcacacauugccugggggaccugcuucagcucuccuucgcgagcucucagagagaucuguuugaagacggauggcuggaguucgugguccgcguguauuggcucaaggcccgguuucuggcccuucaaggcgauauggagcaggcccuggaaaacuacgacauuuguaccgagaugcuccaguccagcacggcuauccagguugaagccggcgcggagagacgggauaucgugauucgccugcccaaucugcacaacgacucugucgugagccuugaagagaucgauaaaaaucucaagucccuggagagaugccaaagccuggaagagauucagcggcucuacgaagccggggacuauaaagcugugguucaucugcuuagaccuacacuguguaccucuggauucgaucgcgccaagcaucucgaguuuaugaccuccauccccgagcggccggcucagcugcugcuucugcaggacagccuccugagacucaaagacuaccgccaaugcuucgaauguuccgaugucgcccugaacgaggccgugcagcagauggucaauucuggcgaagcugcggccaaggaggaaugggucgcuacagugacccagcuucugauggggauugagcaagcccucagcgccgacuccucuggaagcauccugaaaguuuccucuagcacaacgggccuggugagacuuaccaacaaucugauccaggucauugauugcuccauggcugugcaggaggaagccaaggagccucacguuagcucugugcuccccuggaucauucugcaucggaucauuuggcaagaagaggacacauuucacucccucugucaccagcagcagcugcaaaaccccgcggaagaggggaugagcgagaccccuaugcuuccgucuucccugaugcuccugaauacagcucaugaauaucugggccgcagaagcuggugcuguaacucugauggagcccuucugcgguucuacguccgcgugcuccagaaggagcuggccgcuuccaccagcgaagacacgcaccccuauaaagaggaacucgagaccgcccuggagcagugcuucuacugucuuuauuccuuuccuagcaagaaaucuaaggcgagauaccuggaggaacacagcgcucagcaaguugaucugaucugggaagacgcccucuucauguuugaguacuucaaacccaagacacugccugaguuugauuccuauaagaccucuacagugagcgccgaccuugcuaaucugcucaaacggauugccaccaucgucccccgcacggaaagaccugcucugucccucgauaaggugucugccuacaucgagggcacaagcaccgaagugcccugccugccggagggggcggacccuucucccccugucguuaacgaacuuuauuaccugcuggccgauuaucacuucaaaaauaaggagcagagcaaagcuauuaaguuuuacaugcaugacaucugcauuugucccaaccgguucgacagcugggccggaauggcucucgcccgcgccuccagaauccaggauaagcugaauagcaacgagcuuaaaucugacggcccgauuuggaagcacgcuacaccugugcugaacugcuuucggagagcgcucgaaaucgauuccagcaaucugucucucuggaucgaguaugggaccauguccuacgcccugcacagcuucgcuucccgccagcuuaaacaauggcggggagaacugcccccugagcuggugcagcagauggaaggcagacgcgacucuaugcucgagaccgccaagcauuguuuuacaagcgccgcucggugcgagggggauggcgacgaagaggaauggcugauucacuacaugcuuggaaaagucgccgagaagcaacagcagccgcccacgguguaucugcuccauuacagacaggcgggccacuaucugcaugaagaggcugcccgcuacccuaagaaaauccacuaucacaacccgcccgagcucgccauggaagcucuggagguuuacuuccggcuucaugccuccauucugaagcugcucgggaaaccugauagcggagugggcgcggaaguccuggugaauuuuaugaaggaggcugccgaggggcccuucgccagaggagaagagaaaaacaccccuaaggcuucugaaaaagagaaggccugucuuguugacgaagauucccacagcucugcuggcacacugcccgggccuggcgccagccucccguccucuagcggacccggccugaccuccccucccuauacagcgaccccuaucgaccaugauuacgugaagugcaaaaagccccaccaacaggccacgccggacgaccgcucucaggauagcacagcugucgcccuguccgacuccucuuccacccaggauuucuuuaaugagccuaccagccuccuugaggggucccggaaaucuuacacagaaaagagacugcccauucugagcucccaagcuggagccaccggcaaagaccuccagggggccacagaggaacggggaaagaacgaggaaucucuggagagcacggagggcuuccgcgcugcggaacagggggugcagaagcccgccgcugagaccccugccuccgccuguauccccggcaaaccuagcgcuucuacaccgacccuuugggauggaaagaaaagaggcgaccugcccggggaaccuguugccuuuccccaaggacucccugcgggcgcugaggaacagcggcaguuccugacagagcagugcaucgccuccuuucgccugugucucagcagauucccccaacacuauaagucucuuuaccggcuggccuuucuguauaccuacuccaaaacgcauagaaaucuccagugggcucgcgaugugcugcuugggagcucuauuccguggcagcaacugcagcacaugccugcccagggacucuucugcgagcggaacaagaccaacuuuuucaacggcaucuggcgcauucccgucgacgaaaucgaucgcccuggcagcuuugcguggcauaugaaucgguccauugugcugcugcucaaggugcuugcccagcugagagaccacucuacacugcucaaagucagcuccaugcugcaacgcacccccgaucaggggaagaaauaucuucgggacgcugauagacagguucuggcccagcgcgcuuucauccucacagugaaggugcuggaggacacccugagcgaacucgccgagggauccgagagaccuggccccaaagucugugggcuuccgggagcucggaugacaaccgacgugucucauaaggccagcccugaagauggccaagaggggcugccccagcccaagaaaccuccgcuggcggacggauccggccccggcccugaacccgggggaaagguuggccuccugaaccaccgcccuguggccauggaugcuggggacucugccgaucagagcggagagagaaaagacaaggaaagcccccgggcuggcccuacggagccgauggauacaucugaggccaccgucugccacagcgaccuugaacgcacacccccucugcuccccgggagaccugcccgggauagaggacccgagucccgcccgacagaacugagccuggaggaacucucuaucuccgcucggcagcaaccuacaccccuuacgcccgcgcagccugcccccgcuccugccccggccacaaccacaggcaccagagcuggcgggcaucccgaggagccucugagccgccugucucggaaaagaaagcuccuggaagacacagaguccggaaagacccuucugcucgaugccuaccggguguggcagcaaggccagaaagggguugcguaugaccugggacgcguggaaagaauuaugagcgagacguacaugcugaucaagcaggucgaugaagaggccgcucucgagcaggccgugaaauucugccaaguccaccuuggcgcugccgcgcagcggcaggccucuggggacacccccacaaccccuaagcaucccaaagacucccgcgaaaacuuuuucccggugacaguugugccuaccgcucccgauccuguccccgccgacagcgugcagagaccuuccgaugcucacacgaagccccggccggcccuggcugccgcgacaaccauuaucacauguccucccagcgccucugcuagcacccuggaccaauccaaagaucccggaccuccgcgcccccacagaccugaggccacccccucuauggcuagccucggcccugaaggcgaggagcuggcccggguugccgaagggacauccuuucccccucaggagccccgccauucuccccaggugaagauggcgccuacgagcucccccgcugaaccucacugcuggcccgccgaggcugcccuuggaaccggcgccgaaccgacauguucucaggaggggaagcugagaccugagccccggagagacggagaagcucaagaggccgcgagcgaaacccagccccucuccagcccucccacagccgcuucuuccaaagccccuagcucuggcuccgcucagccgcccgaggggcauccuggaaagcccgaaccuagccgcgccaaaucccggccccugccuaacaugccgaagcuggucauucccucugcggccaccaaauucccucccgagaucacggugacaccucccaccccgacccuccuuagcccuaagggcuccauuagcgaggaaacaaagcagaaacugaagucugcuauccuguccgcccaaagcgcugccaaugugagaaaagagucucucugccagcccgcucuggaaguucuugagaccagcucccaggaaucuagccuggaguccgagacagaugaagacgaugacuacauggauaucuga

SEQ ID NO: 66772 - RNA, 1902 nt, Artificial Sequence
  derived and/or modified sequence opt5 from CABLES1__Homo_sapiens__NP_001094089
auggccgcugccgcggcugccgccaccacagcugccugcagcuccggcucugcugggacggacgccgcgggagccagcggccugcagcaacccccuccgcagccccagccucagcccgcugccgcugccccugcgcaacccccuccggagcccccuagaaagccccggauggauccucgcagacggcaggccgcucucuccuuccugaccaacaucucucuugacgggcgccugcccccgcaggaugccgaauggggaggcggggaggaaggaggcgcugccaagccuggcgccgggggagcuuguggcgcgagaacacgguuuagccuccuggccgcugccgagcgcgggggaugcauugcccuugcugcccccggcaccccugcggcugggcuggccgccggauccggccccugucucccccagccuucuagccugccgccccugaucccuggcgggcacgcuacaguguccggacccggcgucgccagaggguucgcuagcccucucggagccggccgggcgucuggggaacaauggcagcccccgcgcccugcuccccuggccgccugcgcucagcuucagcugcucgacggauccggcgccgcgggccaagaggagcuggaagaggaugacgccuuuauuagcguucaggugccugcugccgcuuuccuugggucuggaacccccggcuccgggagcggaucuagaggccggcuuaauuccuuuacacaggggauccucccuauugccuucagccgccccaccucccaaaacuacuguucucuggaacagccgggccagggaggcagcacguccgccuuugagcagcugcaaagaagccggcgcagacucaucucucagcgguccagccuggagacccuugaagauaucgaggaaaaugcuccucugagacgcugccggacacucucugggagccccagacccaagaacuucaaaaagauucauuuuaucaaaaauaugcgccagcacgacacccggaacggaagaauugugcugaucuccggccgccggucuuucuguagcauuuucuccguccuuccuuauagagauagcacacaggugggggaccugaagcucgauggaggccgccaaucuaccggggcgguuucccugaaggagaucauuggccuggaaggaguggagcucggcgccgacgggaaaacggucagcuacacacaguuccugcuuccgaccaaugcuuuuggagcccggagaaacacaaucgauucuaccuccagcuucucccaguuccgcaaucugucucaucggagccucuccaucggcagagccucugggacccagggaagccuggacacaggcuccgaccuuggggauuuuauggacuaugaucccaaccugcucgacgauccucaauggcccugcggcaagcacaaacgggugcugauuuucccuagcuacaugacgaccguuaucgacuaugugaagcccucugaucugaaaaaggacaugaaugagacauuuaaggaaaaauucccucauauuaagcucacccuguccaaaauccgcagccuuaagagagagaugcggaaacuggcucaggaagauuguggacucgaggaacccacagucgccauggcguuuguguacuucgagaagcuggcucugaaaggcaagcugaacaagcagaauagaaaacucugcgccggggccugugugcugcuggcugccaagauuggaucugaccucaaaaagcacgaggucaaacaccugaucgauaaacuugaagagaaguuucgccugaaccggagagaacucaucgcguucgaguuuccgguucugguggcucuggaauuugcccuucaucucccugagcacgaggugaugccccauuaucgcagacugguccaguccagcuga

SEQ ID NO: 66773 - RNA, 663 nt, Artificial Sequence
  derived and/or modified sequence opt5 from CABP2__Homo_sapiens__NP_057450
augggcaacugcgccaagagacccuggcggcgcgggccuaaagacccgcugcaguggcucggaagcccucccagaggcuccugucccucuccuagcuccucucccaaggagcaaggggauccugcuccgggagugcagggcuacagcguccuuaauucccugguugggcccgccugcaucuuccugcggccuucuauugcggcuacccagcucgaccgcgaacugagacccgaggaaaucgaggaacuucagguggccuuucaagaguucgaucgggaccgcgauggauauauuggcuguagagagcugggcgccugcaugcggacacucggguacaugccuacggaaauggagcugaucgaaauuagccagcagaucuccggaggcaaaguggacuuugaggauuucgucgagcugauggggcccaagcuccuggcugaaaccgccgacaugaucggagugcgcgagcuuagagaugcuuuucgggaguucgacacaaacggcgaugggcgcauuagcguuggagaacugagagccgcgcucaaagcccugcuuggcgaacggcugucucagcgcgagguggacgagauccuccaagaugucgaccugaauggcgacgggcugguggauuuugaagaguucguuagaaugaugucccgguga

SEQ ID NO: 66774 - RNA, 513 nt, Artificial Sequence
  derived and/or modified sequence opt5 from CABP4__Homo_sapiens__NP_001287824
augaccgagcccuggcuggcccucggcacaagcuggacgcugccucuucaggacagagaacuggggccggaggaacucgaugagcugcaagcugccuucgaagaguuugacaccgaucgggacggauacaucucccaccgcgagcuuggcgauugcaugagaacacugggguauaugcccaccgaaauggagcuccuggaagugucucagcauauuaagaugcggaugggaggccgcgucgacuucgaggaguuuguugaacugaucgggccuaaacucagagaggaaacagcgcacaugcugggagugcgggagcuucgcauugcuuucagagaauuugaucgggaccgcgauggcagaaucaccguggccgagcugcgggaggccguccccgcucuccugggcgaaccucuugccgggcccgagcuggacgaaaugcuccgcgagguggaucugaacggagacggcacaguugauuucgacgaauuugugaugaugcugagcagacauuga

SEQ ID NO: 66775 - RNA, 1188 nt, Artificial Sequence
  derived and/or modified sequence opt5 from CABS1__Homo_sapiens__NP_149113
auggccgaggacggccugcccaagaucuacagccacccuccgaccgaauccucuaaaacacccacggcugccaccauuuucuuuggggcggauaacgcuaucccuaagagcgagacaaccauuacauccgaaggagaccaugugaccucugucaaugaguauaugcucgaaagcgauuucuccacaaccacggacaacaaacugaccgccaagaaagagaagcugaagucugaggaugacaugggcacagauuuuaucaaaagcaccacacaccuucagaaggaaauuaccucccucacggggacaaccaauagcaucacaagagacucuaucaccgagcauuucaugcccguuaaaauuggaaacaucuccagcccugugaccacagugucucugauugauuuuuccacggacaucgccaaggaagauauucuucuggcuaccaucgacacaggcgaugccgagauuagcaucaccucugaggucuccgggacacucaaagacagcuccgcuggaguggccgacgcgcccgccuucccucggaagaaggaugaagcugacaugucuaauuacaacagcuccaucaaaagcaauguuccggccgaugaggcugugcaagucaccgacucuacgauucccgaagccgagaucccucccgcgccugaagaguccuuuacaaccauucccgauaucaccgcccuggaggaagagaagauuacagaaaucgaccugagcgugcucgaggaugacaccucugcuguugccacacugacggauagcgacgaaaaauucaucaccguguuugagcuuacaaccuccgcugagaaggauaaagacaagcgcgaagacacacugcucaccgaugaggaaacgaccgagggcgccucuauuuggauggaaagagacacagccaacgaggcugagacccacagcguccugcuuacagcgguggaaucccgguaugauuucguggucccggccagcaucgcuaccaaucugguugaggaaucuuccacggaggaggaccucagcgaaacagauaacaccgagacagugccuaaaauuaccgaacccuuuucuggcaccacauccgugcuggacacgccugauuacaaggaggacaccagcacaaccgaaacagauaucuucgagcugcucaaggaggaacccgacgaguuuaugauuuga

SEQ ID NO: 66776 - RNA, 1482 nt, Artificial Sequence
  derived and/or modified sequence opt5 from CABYR__Homo_sapiens__NP_036321
augaucagcuccaagcccagacugguggugccuuacggccucaaaacccugcuugaggggauuucucgggccguucugaagacaaacccgagcaauaucaaccaguucgcugccgcguauuuucaagaacucacgauguaccgcggaaauaccacaauggacauuaaagaucuggugaagcaguuccaccagaucaaaguggagaagugguccgaaggcaccacaccccagaagaaacuugagugccugaaggaaccugggaaaaccucugucgagagcaaggugcccacacaaauggagaaauccaccgacacggaugaagacaacguuaccagaacagaguauucugauaagaccacacaguuuccuagcguguacgcuguccccggaaccgaacagacggaggccgugggcgggcucuccagcaagccugccacaccgaaaaccacaacacccccuucuucucccccucccaccgcuguuagcccggaguucgccuaugugccugcugaccccgcccagcuggcggcccaaaugcugggaaaggucucuuccauucauagcgaucagucugacgugcucaugguggaugucgcuaccuccaugccuguugugaucaaagaagugcccagcuccgaggccgcugaagacgucaugguggccgcgccccugguuuguucuggcaaggugcuugagguccaggugguuaaucagacgagcgugcacgucgaucugggcucccaaccuaaagaaaacgaggccgagccgagcaccgcuucuuccgugccccuccaggacgaacaggagccucccgccuacgaucaagcuccugaagucacacugcaggccgacaucgaggugaugagcaccguucauauuucuagcguguauaaugacguccccgugacagaagggguuguguacaucgagcagcuuccggagcagauugucaucccuuuuaccgaucaaguggccugccugaaggaaaacgagcaguccaaagaaaaugagcagucuccccgggugagcccuaaguccguugucgaaaagacgacaagcggaaugucuaaaaaguccguggagagcgugaaacucgcucagcuggaggaaaacgcgaaguacucuuccgucuauauggaggccgaagcuaccgcccugcucagcgacaccucccugaaaggccaacccgaggugccugcccagcuucuggaugcugagggggccauuaagaucggaucugaaaagagccuccaccuggagguugaaauuacauccaucgugucugacaauaccggccaggaggaaagcggggagaacuccgucccccaggagauggaaggaaaaccggugcuuagcggcgaggcggcugaagccguucauucuggcacauccgucaagagcuccuccgggccuuucccucccgcccccgagggacugacggcuccggaaaucgagcccgagggcgaaagcaccgccgaguga

SEQ ID NO: 66777 - RNA, 6786 nt, Artificial Sequence
  derived and/or modified sequence opt5 from CACNA1A__Homo_sapiens__NP_001120693
auggccagauucggcgacgaaaugcccgcucgguacgggggaggcgggagcggagccgcggcuggcguggucguuggguccggaggcggccgcggggccggaggcucuagacaagggggacaaccuggcgcccaacggauguauaagcagagcauggcucagcgcgccagaaccauggcucuguacaacccgauccccgugcggcaaaauugccucacagugaaccgcucccuguuucuuuucucugaagauaaugucgugagaaaauaugccaagaaaauuacggaauggccucccuuugaauacaugauccuggcgaccauuaucgccaacuguauuguucucgcucuggagcagcaccuuccugacgaugacaagacccccaugagcgaacggcuggaugacaccgaaccuuauuucaucgggaucuuuugcuucgaggccggaauuaaaaucauugcucuuggcuuugccuuccauaagggcuccuaccugcgcaauggguggaacgugauggauuuugucgugguucugacaggaauccucgcgaccgugggcacagaguucgaccugagaacccuucgggccguccgcgugcugagaccgcucaagcuggugucugggauucccagccuucaggucguucugaaauccaucaugaaggcuaugauuccucuccugcagaucggacugcuccuguuuuucgccauccuuauuuuugcuaucauuggccuggaguucuauauggggaaauuccacacgaccuguuuugaagagggaacagaugacauccaaggcgagagccccgccccuugcggcaccgaagaaccugcccggacauguccgaaugggaccaagugccagccuuacugggaaggacccaacaauggcauuacgcaguucgauaacauccucuuugcugugcugacaguguuccaguguaucaccauggagggguggacagaccuucuguacaauucuaacgaugcguccggaaauaccuggaacuggcucuauuuuauuccucugaucauuaucggcagcuucuuuaugcugaaucucguccugggggugcuuucuggcgaguucgccaaagagcgcgagagaguugaaaaccggagagcuuuucugaagcuccgccggcaacagcagauugagagagaacugaacggauacauggaguggaucuccaaggccgaagaggugauccuugccgaggacgaaaccgacggcgagcaacgccaucccuucgauggggcucugcggagaacaacgauuaaaaagagcaaaaccgaccuccugaaucccgaagaggccgaagaucagcuggcggacaucgcuucugucggauccccuuuugcccgcgccagcauuaaguccgcuaaacucgagaacucuacauucuuucacaagaaagagcggagaaugcgcuucuauauccggagaauggugaagacccaggccuucuacuggacaguucugagccuuguggcucugaauacccucugcgucgccauugugcauuauaaccagccggaauggcuguccgauuuucuguacuaugcggaguucaucuuucuuggccucuucaugagcgaaauguuuauuaagauguacgggcugggaacgcgccccuacuuccacucuuccuuuaauuguuucgacugcggcgucaucaucgggagcauuuuugaggugaucugggccguuauuaaaccuggcacaucuuucggaaucagcgugcugcgggcucucagacugcuucggauuuuuaaggucaccaaauauugggccucccugcgcaaccucgugguuucucugcugaauagcaugaaguccaucaucagccuucucuuccugcuguuucucuucauuguggucuucgcucugcuuggcaugcaacuguuugggggacaguucaacuuugaugagggcacacccccuacaaauuucgacaccuuucccgccgcgaucaugacaguguuccagauucucacgggggaagauuggaacgaggugauguacgacggaaucaaaucucagggcgggguucaaggcggaauggucuuuuccauuuauuucaucgugcugacccuguuuggcaauuacacacuucucaacguguuccuggccaucgcugucgauaaucuggccaacgcucaggaacucaccaaggacgagcaggaagaggaggaagccgccaaucagaagcuggcgcuucagaaagcuaaggagguggccgaaguuagcccgcugucugcugccaacauguccauugccgugaaagagcagcagaagaaccagaaaccugcuaagagcgucugggaacaaagaacauccgagaugcggaagcagaaucuccuggccucuagagaggcgcuguauaacgaaauggaccccgaugagcgcuggaaagcugccuacacccggcaccuuagaccugacaugaagacgcaucucgaucgcccccuggugguugacccucaggaaaauagaaacaauaacaccaauaaaagccgggccgcugagcccacaguggaucaacgccuggggcagcagagagccgaagacuuucuccggaagcaggcgcgcuaucacgauagagcucgggacccguccggaucugccggccuggaugcccgcagaccuugggcugggagccaagaggccgagcuuucccgggaaggacccuacggccgcgagagcgaccaucacgcuagagaagggucucuggagcagcccggcuucugggagggagaagccgagcggggcaaagcgggggauccucacagacgccauguccaccggcagggaggcuccagagaaagccgcucuggguccccgcggaccggagccgacggcgagcauagacgccaccgggcucauagacgccccggcgaagaggggccugaggauaaggccgaacggagagcucggcaccgcgagggaagcagacccgcccggggcggggaaggagagggcgaagggccugacggaggcgagcgcagacggagacaccgccauggcgcccccgcuacauacgagggggacgcgcggagagaagauaaggagcgccggcacagacgccggaaagaaaaccagggaucuggcgugccuguuagcgggcccaaucucuccaccacgagaccgauccaacaggaccugggacgccaggauccuccccuggccgaggacauugauaacaugaagaauaacaaacuugcuacagccgaaagcgccgcuccucauggcucucuggggcacgccggacucccccaguccccggcgaagaugggcaauagcaccgacccuggccccaugcuggcuaucccugccauggccacaaacccccaaaaugcugccuccagacggacccccaacaacccugggaauccgucuaaccccggaccucccaaaaccccugagaauagccucauugugacaaaccccuccggcacgcagaccaauucugcgaagacagcucgcaaaccugaucacaccacagucgacaucccgcccgccuguccucccccucugaaccauaccguggugcaggucaauaagaacgccaaucccgauccgcuuccuaagaaagaggaagagaagaaagaagaggaggaagacgauagaggggaggacggacccaagcccaugccucccuauagcuccauguucauccugucuacgacaaacccucuccggcgccugugccacuacauucugaaucuuagauauuuugaaaugugcauccugaugguuauugcuaugagcuccaucgcccucgcugccgaggauccggugcaacccaacgcgccucggaauaacgugcugagauacuucgacuaugucuuuaccggcguguucaccuuugaaaugguuauuaaaaugaucgaccucgggcuggugcuucaucagggagccuacuuccgcgaucuguggaauauucucgacuuuaucgucgugagcggcgcucugguugccuucgcuuuuacaggcaacucuaaggggaaggauaucaacaccauuaaaucccugcgggugcuuagaguccugcgcccccucaagacaaucaaacggcugccuaagcucaaagccguguucgacuguguugugaauagccugaagaacgucuuuaauauucuuaucguguauaugcuguucauguuuauuuucgccguggucgcuguucagcuguucaagggaaaauuuuuccacugcacggaugagucuaaggaguuugaaaaagacuguagaggcaaguaccuccuguacgagaaaaacgaagugaaggcgcgggaucgcgaguggaagaaauaugaguuccauuacgacaaugugcuuugggcccugcucacccuguuuacagucuccaccggggagggauggccccaggugcucaagcacagcguugaugcuacauucgagaaccaaggcccgucuccuggguauagaauggaaauguccaucuuuuacguggucuauuucgugguuuuucccuucuuuuucgugaauaucuuugucgcccugauuaucauuaccuuccaggagcagggagacaaaaugauggaagaguacagccuugaaaagaacgagcgggccugcaucgauuucgcuauuuccgccaaaccucugacgcgccacaugccccagaauaagcagagcuuucaguauagaauguggcaguucguggucucuccucccuuugaguacaccaucauggcgaugaucgcucugaacacaauugugcucaugaugaaauucuacggcgccagcguugccuaugaaaaugcucugcggguguuuaacaucgucuucaccucccucuuuucucuggagugugugcucaagguuauggccuucggcauucugaauuacuuucgcgacgcguggaacaucuucgacuuugugacaguccucgggagcauuaccgauauccuggugacagaguucggaaauaacuuuauuaaucuuuccuuccugagacuguuccgggccgcucgccucaucaagcugcuuagacagggcuauaccauccggauucugcucuggacguuugugcaaucuuucaaagcccugccguacguuugccuccugaucgcuaugcucuuuuucauuuaugccaucauugggaugcaggucuuuggaaacaucggcaucgacguggaggaugaggacagcgaugaagacgaguuccagauuacagaacauaacaauuuuagaaccuucuuucaggcucugaugcugcuuuuccgcuccgccaccggggaggcguggcacaacaucaugcugucuugucuuagcggaaagccuugcgauaaaaauuccggcauucugacacgggaauguggcaacgaguuugccuacuucuauuuugugagcuucaucuuccucugcucuuuucugaugcugaaucucuucgucgcugugauuauggacaacuuugaguaccuuaccagagauuccagcauccuggggccccaucaccuggacgaauacguucgcgugugggccgaguaugaucccgcugccuguggacggauccauuacaaggacauguauucucuccugagagucauuuccccuccgcuuggccuggggaaaaagugcccccaccgcguggccugcaagcggcuccugagaauggaucugccuguugcugacgacaauacggugcacuucaacagcacacucauggcgcuuauccgcaccgcccuggauauuaaaaucgcuaagggaggcgccgacaaacaacagauggaugccgaacugcggaaggagaugauggcuauuuggcccaaucucucccagaaaacacuggaccuucuggucaccccucauaagucuacagaucucaccguggggaagaucuacgccgcgaugaugauuauggaauauuacagacaaagcaaagccaagaaacugcaggcuaugcgcgaggagcaggaccggacgccccugauguuucagagaauggaaccuccgucccccacccaagagggaggcccuggccagaacgcccuccccagcacacagcuugauccugggggagcucugauggcccacgaaucuggccugaaggagucccccagcuggguuacccagcgcgcgcaagaaauguuccagaaaacagggaccuggucuccggagcagggaccucccacggacaugcccaauagccagccuaacucccaaucuguggagaugagagaaaugggccgggauggguauagcgacuccgagcauuaccuccccauggaaggccagggacgcgccgcuucuaugccuagacugccggccgagaaucagcggagacggggccgccccagagggaacaaucuuagcacaaucuccgauaccagcccuaugaagcggucugcuuccguccugggacccaaggcccgcagacucgacgauuacagccuggagcgggugccucccgaagagaaccaacgccaccaccagagacggcgcgacagaucccaucgggcuucugaacgcagccugggcagauauacagacguggauaccgggcucggaaccgaccuuuccaugacaacgcagucuggcgaucugccgagcaaagagcgggaccaggaacgcgggagaccuaaggaucggaaacacagacaacaucaccaucaccaccaucaccaucaccacccucccccgcccgacaaggaucgcuacgcccaggagcggcccgaccauggcagagcgcgcgcccgggaucagagauggucccgcagccccucugagggacgggaacacauggcucauagacaguga

SEQ ID NO: 66778 - RNA, 7020 nt, Artificial Sequence
  derived and/or modified sequence opt5 from CACNA1B__Homo_sapiens__NP_000709
auggugagauucggagacgagcucgggggacgguacggcgggcccggaggcggggaacgcgccagaggaggcggcgcugggggagccggcgggccuggaccgggcgggcuccaacccggacaacggguccuguauaagcagagcaucgcgcagcgcgcuagaaccauggcucuuuacaacccuauucccguuaaacagaauugcuuuacagugaaccggucccuguucguguuuucugaggauaaugucgugcgcaaguaugccaaaagaaucacggaauggccucccuucgaguacaugauucucgcuaccaucauugccaacuguaucguucuggcucuugaacaacaucugccugacggcgauaagacaccgaugagcgagcggcucgacgauaccgagcccuauuuuaucggcauuuucugcuuugaagccgggaucaaaauuaucgcgcugggauucguguuucacaagggcuccuaccugcgcaauggguggaacgucauggacuucgugguugugcucacaggcauucuggccaccgcuggcacagauuuugaccuuagaacccugcgggccguccgcgugcucagaccucugaaacuugugucugggauccccagccugcaggucguucucaaauccauuaugaaggcuauggugccucugcugcagaucggacuccugcuuuucuuugccauccugauguucgcgauuaucggccucgaguucuauaugggcaaauuucacaaggccuguuuccccaauucuacggaugcugaaccggugggggacuuuccuugcggaaaagaggcccccgcucggcugugugagggcgauaccgaaugccgcgaguacuggccugggcccaacuucggaauuacaaauuuugacaacauccuuuucgccauucugaccgucuuucaguguaucacaauggaaggcuggaccgauauccucuacaauacgaacgacgccgcugggaauacauggaacuggcuguauuucauuccccugaucauuaucggcagcuuuuucaugcucaaucuggugcuuggaguucuguccggcgaguuugcgaaggaaagagagcggguggagaacagacgcgccuuccucaagcugcggagacaacagcagauugaacgcgagcuuaacggguaccuggaauggaucuuuaaagcugaggaagucaugcucgccgaggaggaccggaaugccgaagaaaagagcccucuggaugugcugaaaagagcugccaccaagaaaucucgcaacgaccucauccaugcggaagagggagaagaucgguucgcugaccugugcgccguuggcuccccguucgccagagcuagccuuaagucugggaaaacagaguccagcucuuauuuucgccggaaggagaagauguucagauuuuucauucgccggauggugaaagcccaguccuuuuacugggucgugcugugugucguggcucucaauacccugugcguugccauggugcacuauaaccaacccagacggcugaccacaacgcuuuacuucgcggaauuugucuuccucggacuguuucugaccgagaugagccucaagauguauggccuggggccucgcuccuacuucagaucuagcuuuaauuguuucgauuuuggcgugaucguuggauccguguucgaagucgugugggccgcuauuaaacccggcagcucuuucgggaucuccgugcuucgggcccugagacuccugcgcauuuuuaagguuacaaaauacuggagcucucugcggaaccuugucgugagccuccuuaauuccaugaagucuaucauuagccugcuguuccugcuguuucuguucaucguggucuuugcucuccugggaaugcagcuguucggcgggcaguuuaacuuccaagacgagaccccuacaaccaauuuugauacguuccccgccgcgauccuuacaguguuucagauucucaccggagaggacuggaacgccguuauguaucauggcaucgaaucccaagggggagugagcaagggaauguucucuuccuucuacuuuauuguccugacccuguucggcaauuauacacuccugaacguguuucuugcuaucgccguugauaaucuggcuaacgcccaggagcucaccaaagacgaagaggaaauggaggaggccgcuaaucaaaagcuggcgcugcagaaagccaaggaaguggcugaggucagcccgaugucugccgccaacauuuccaucgcugccagacagcagaacagcgcgaaagcucgcuccgugugggaacaaagagccucucagcuucggcuccagaaucugcgcgccagcugcgaggcucuguacuccgaaauggauccugaggagagacuccgguucgccacaacgcgccaccugagacccgacaugaagacccaccuugaccggccucugguuguggaacucgggcgcgauggagcgagaggccccgucgggggaaaggcucggccugaggccgccgaagcucccgagggcguggacccgccucgcagacaucaccggcauagagauaaagacaagacacccgccgcuggggaucaggaccgcgccgaagcgcccaaagccgagucuggcgagccuggagcucgggaagagagaccgcgcccccaccggagccacuccaaggaagccgcuggcccucccgaggccagaagcgagcgcgggcggggaccuggccccgaagggggaagacgccaucaccggagaggcucuccugaggaagccgcugagcgggaaccccgcagacaucgggcgcaccgccaucaagauccguccaaagagugcgccggcgcuaagggggagagacgggccagacaccgcggaggcccucgggccgggcccagagaagcugagagcggagaggagccugcccgccggcacagagcgcgccauaaggcucagcccgcccacgaagccguggagaaagagaccacagaaaaggaggcuaccgaaaaagaggccgaaaucgucgaggcggacaaggagaaagaacugcggaaccaucagccgagagagccucacugugaucuggaaacgucuggcaccguuacaguggggcccaugcacacccuuccuuccacaugccugcagaagguggaggagcaacccgaagacgcugauaaucagcgcaacgucaccagaaugggaagccagcccccugacccgaauacgauugugcauauccccguuaugcucacaggcccucugggcgaggccaccgugguccccucugggaacguggaucucgaaagccaagccgagggcaagaaggaaguugaggcugacgacgugaugcgguccggcccucgccccauugucccuuauagcucuauguuuugucuguccccgacaaaucuucugagacgguucugccacuacaucgugaccaugcgcuauuuugagguugugauucucgucgugaucgcccugagcuccaucgcucuggccgcggaagaucccgugagaaccgacucuccucggaacaaugcccuuaaguaccuggauuacauuuucacaggggucuuuacguucgagaugguuaucaaaaugauugaccucggacugcuccugcaucccggcgcuuauuuuagagaucuuuggaacauccuggacuucauuguggugagcggggcccucgucgcuuuugccuucuccggaucuaagggcaaagauaucaauaccaucaagagccugcgcgugcugcggguucuuagaccucugaaaacaauuaagcgccuccccaagcugaaagccguguucgacugugucgugaacucccucaagaauguucugaacauccuuauuguguacaugcuguuuauguucaucuuugcugucauugcggugcagcuguucaaaggcaaguuuuucuauugcaccgaugaaucuaaagagcucgaacgggacuguagagggcaguaccuggauuaugagaaggaggaagucgaggcccagccgcggcaauggaagaaauacgacuuucacuaugauaaugugcuuugggcucugcucacacuguucaccguuagcacgggagaaggcuggccuauggugcucaagcauuccgucgacgccacauacgaggaacaggggcccagccccggauaccgcauggagcugucuaucuuuuaugugguuuacuucguggucuuuccuuucuuuuucgugaacauuuucguggcccuuaucaucauuaccuuucaggagcagggcgacaaaguuauguccgaaugcagccuggagaagaacgaaagagcuuguaucgauuucgccauuucugcgaaaccccugacccgguauaugccucaaaaucgccaguccuuucaguacaagacauggaccuucgucgugagcccgcccuuugaguauuucaucauggcuaugauugcccucaacacagugguccugaugaugaaguuuuacgacgccccuuaugaguacgaacuuaugcugaaaugccucaauaucguguucacgucuauguuuuccauggaguguguucugaagaucauugcuuucggggugcucaacuacuuuagagaugccuggaaugucuucgacuuugugaccguucugggaagcaucacagauauucuugugaccgaaaucgcggagacaaacaauuucauuaaccuguccuuccugcggcucuuucgcgccgcuagacugaucaaacuucugcggcagggcuauaccauccgcauucuccuguggacguucguccagagcuuuaaggcccuccccuacgugugccugcuuaucgcuaugcuguucuuuauuuaugccaucauuggcaugcagguuuucgggaauaucgcucuggacgaugacaccucuauuaacagacacaauaacuuucggacauuccuccaggcccugaugcuucuguuuagaagcgcgaccggagaagccuggcacgagaucaugcucuccugccugucuaaucaggcuugugaugagcaggccaacgcuacagaaugcggcagcgacuucgccuacuuuuauuucguguccuuuaucuuccuguguucuuuccucaugcuuaaucuguuugucgccgugauuauggauaacuucgaguaccugacccgcgacagcuccauccucgggccucaucaccuggacgaauuuauucgggugugggcugaguaugaucccgcggccugcggaagaaucucuuacaacgacauguucgaaaugcuuaaacauaugagcccgccucugggccucgggaagaaaugucccgcucgcgucgccuacaagcggcugguuagaaugaauaugccuauuuccaacgaggauaugacagugcacuuuaccagcacgcugauggcccucauccgcacagcucuugagaucaagcuggcccccgcgggaaccaaacagcaucagugcgacgccgaacugcggaaggagauuucuguggucugggcuaaucucccucagaaaacccuggaucuucuggugcccccgcacaagccugacgaaaugacaguuggcaaaguguaugccgcucucaugaucuucgauuuuuacaagcaaaacaagaccacgagagaccagaugcagcaagcccccggcgggcugucccagaugggacccgucagccuguuccacccucucaaagcgacacuugagcagacccagccggccgugcugcgcggcgcucggguuuuucugagacaaaagucuuccacaagccucuccaaugggggagccauucagaaccaggaaucuggcaucaaagagagcguguccugggggacccagcgcacacaagaugcuccccaugaggcccggccuccccuggaaagaggacacagcaccgagauuccugucggccgcucuggcgcucuugccguggacguccagaugcaguccaucacgagacgggggcccgauggagaaccucaaccgggccuggagagccaggggcgcgcggccucuaugcccagacucgcugccgagacccagccugugacagacgcuagccccaugaagcgguccaucucuacccuggcccagagaccucggggaacacaucuguguagcaccacgcccgaucgcccgccucccucccaagccucuagccaccaccaucaccauagaugccaccggcgcagagaccggaaacagcgcucccucgaaaagggccccagccuuucugcggacauggauggggcuccuuccagcgccguuggacccggccugccuccgggcgaggggcccacaggauguagacgggaacgcgagagacggcaggaacgcggcagaucccaggagcggcgccaaccuucuagcuccucuagcgagaagcagagauucuauuccugcgaccgguuugggggaagagaacccccuaaacccaagccgagccugucuucccauccuaccagccccacagcuggccaggagccugggccccacccucagggcucuggauccgugaauggcagcccccuccugucuaccagcggggccuccaccccgggacgcggcgggcggagacaacuuccucagacaccccugacgccccgcccuucuauuaccuacaaaacagccaacagcuccccgauccacuucgcuggagcccagaccagccuccccgcguuuuccccuggccggcugucuagagggcugagcgaacauaaugcccuccuucaacgcgauccccugucccagccucuggcucccggcucucggauuggaagcgacccuuaucucggccagagacuggauuccgaggccucugugcacgcccuucccgaagacacacugaccuucgaggaggccgucgcgacgaacagcgggcgcuccagccggacaucuuacguuuccagccucaccucucagucccauccgcugagacgcgugccuaauggauaucacuguacccugggccucagcucugggggacgggccagacacuccuaccaucaccccgaucaagaccauuggugcuga

SEQ ID NO: 66779 - RNA, 6417 nt, Artificial Sequence
  derived and/or modified sequence opt5 from CACNA1C__Homo_sapiens__NP_000710
auggugaacgagaauaccagaauguacauccccgaagagaaccaccagggcagcaauuauggguccccucggccggcccaugcuaacaugaaugccaacgcggcugccggacuggcccccgaacacauuccuacacccggcgcugcccucucuuggcaagcugccaucgacgcggcccgccaggcuaagcugauggggagcgccggaaaugcuacgauuuccaccgucucuagcacacagagaaaacggcagcaauacggcaagccuaaaaagcagggguccaccacagccacccgccccccuagagcgcuucugugccucacacugaaaaacccgauccggcgcgccuguauuucuaucguugaguggaagcccuucgaaaucauuauccuucugaccauuuuugcuaauugcguggcccucgcuaucuauauuccuuuccccgaggaugacagcaacgccacgaauuccaaccuggagagaguggaauaccuguuucucaucauuuucaccgucgaggccuuucugaaggugaucgcuuauggacuucuguuccauccuaaugcguaccuccggaacggcuggaaucugcuugauuuuaucauuguuguggucggccuguucagcgccauccucgaacaggcuacaaaagccgacggggccaacgcucugggaggcaagggggccggauuugaugugaaagcgcugcgcgcuuucagaguucuccggccccugcgccuugugucuggcgucccgucccugcagguggugcucaacagcauuaucaaggccauggucccucugcuucacauugcccugcucguucuguuugugaucaucauuuaugcuaucauugggcuggagcucuucaugggaaaaaugcauaagaccuguuacaaucaagagggcaucgccgacgugcccgcugaagaugacccuucucccugcgcccuggagacaggccacgggagacagugucagaacggaaccgucugcaagcccggcugggaugggccuaaacacggaauuacgaauuuugacaacuucgcguucgccaugcuuacaguguuucaguguaucaccauggaaggcuggacagauguucuguacugggugaaugacgcugucgggcgggauuggccguggaucuauuucgugacccucauuaucauuggauccuuuuucguucugaaccuugugcugggcguccucagcggcgaguuuucuaaggaacgcgagaaagccaaggcuagaggggacuuccaaaaacugcgggagaagcagcagcuggaagaggaccucaaaggauaccuggauuggaucacccaagccgaagacauugaucccgagaaugaagacgagggcauggaugaggaaaagccuagaaacauguccaugcccacaagcgagacggaauccgugaauaccgagaacgucgcggggggagacaucgaaggcgagaauugcggggcccgccuugcucaucggauuucuaagagcaaauuuuccagauauuggcgccgguggaacagauucugucgccggaagugcagagccgcugugaaaagcaauguuuuuuacuggcuggugaucuuccucgucuuucugaacacacugaccaucgccucugagcacuauaaucagccuaacuggcuuacagaagugcaggauaccgccaacaaggcucuccuggcgcuguucacggccgagaugcuccugaaaauguacucccuuggccugcaggcuuauuuuguuagccucuucaaucgcuucgacuguuuuguggucugcggaggcauucuggaaacaauccugguggagaccaagauuaugucuccccuugggaucagcgugcuccggugcguuagacugcugcgcauuuucaagaucacccgguacuggaacucccucucuaaucuggucgccagccuucugaacuccgugagaagcaucgccucucuccugcugcuucucuuucuguucauuaucauuuuuucccugcucggaaugcaacuguucggcgggaaauuuaauuucgaugagaugcagacacggcgcagcaccuuugacaacuucccgcagucucuucugacaguguuucagauccucacgggagaagauuggaauuccgucauguacgacggcauuauggcuuaugggggcccuagcuuccccggaaugcugguguguaucuacuuuaucauucuguucaucugcggcaacuauauucuucucaauguuuuccuggccaucgcgguggacaaccuggcugaugccgagucccucaccucugcccaaaaggaagaggaagaggagaaagaaagaaagaaacuggcucggacagccagcccugagaagaagcaggaacuugucgagaaacccgcggugggggaauccaaggaggagaaaauugaacugaagucuaucaccgcugacggagagagcccucccgccacaaaaaucaauauggaugaccuccagccgaacgaaaaugaggauaaguccccuuaccccaaccccgaaaccacgggcgaggaggacgaagaggaaccugagaugccgguugggcccagaccucgcccccugagcgagcugcaucuuaaggaaaaagccgugccuaugcccgaggcuucugccuuuuucauuuuuuccagcaauaaccgguucagacugcagugucaccgcaucgucaacgauaccauuuuuacaaaucucauccuguucuuuauucuccugucuuccaucagccuugcugccgaagacccugugcaacacaccucuuucagaaaccauauucuguuuuauuucgauaucguuuuuacaaccaucuucacgauugagaucgcgcucaagaugacagccuacggagcuuuccugcacaaaggcagcuuuugccggaauuauuucaacauucuggaccuucugguggucuccgugagccucaucucuuuugggauucaguccagcgccaucaauguggucaagauccugcgcguucucagagugcugcggccccuucgcgcuauuaacagagccaaaggccugaagcaugugguccaguguguguucguugccauccggaccauuggaaauaucgugauugucacaacccuccugcaguuuauguucgcuugcaucggcgugcaacuguuuaaagggaagcuuuacaccuguuccgauucuagcaagcagacagaagcggagugcaaaggaaacuacaucacguauaaggacggcgagguugaucacccgauuauccagccucgcuccugggaaaauucuaaauucgacuuugacaacgugcuggccgcuaugauggcccucuucaccgucagcacauuugagggguggcccgaacugcucuacagauccauugauucucauaccgaggacaagggaccuaucuauaauuaccggguggaaauuagcaucuucuuuauuaucuauaucauuaucauugccuucuucaugaugaacaucuuuguuggcuucgugauugucacauuucaagagcagggggagcaggaauacaaaaauugugagcuggauaagaaccagcgccaaugcguggaauaugcucuuaaggccagaccccugcggagauacaucccgaaaaaucagcaccaguacaaggugugguaugucguuaacuccaccuacuucgaguaucugauguuugugcucauccugcuuaacacgauuugucuggcgaugcagcacuacggccaaagcugccucuucaaaaucgcuaugaauauucugaacaugcucuuuacaggacuguucaccguggaaaugauccuuaagcugauugccuuuaaaccuaagcauuauuucugcgacgccuggaauaccuuugaugcucugaucgucgugggcucuaucguugacauugccaucacagaggugaaccccgcggagcacacccaguguuccccuagcaugaaugcugaagagaacucucgcauuuccaucacauucuuucggcucuucagagucaugcgccuggugaagcuucugagccggggggaaggaauuagaacgcuccuguggaccuucaucaaaucuuuucaggcccuccccuacguugcccugcuuauugugaugcuguucuuuaucuaugcugucaucggcaugcagguguucgggaagauugcccugaaugauacaaccgagaucaaccgcaauaacaauuuucaaacauucccccaggcuguccuccugcuuuuucggugcgccaccggagaggcguggcaggacauuaugcuggccuguaugccuggcaaaaagugcgcuccggaauccgagcccagcaacuccacggaaggcgagaccccuugugggagcucuuucgccguguuuuacuucaucagcuuuuacaugcucugcgcuuuccugauuaucaaucucuuuguugccgugaucauggauaacuucgacuaucugacaagagauugguccauucuuggaccccaucaccuggacgaauucaaacgcaucugggccgaguacgauccugaggcuaagggccggauuaagcaccuggacgucgugacccuccugagacggauccaacccccucuuggguuuggaaaacuguguccgcaucgcguugcgugcaagagacucgugucuaugaauaugccccugaacagcgacggcacagucauguucaaugccacccuguuugcucucgugcggacagcccuucgcauuaaaaccgaagggaaccuggagcaggccaacgaagagcugagagcuaucaucaagaaaauuuggaagcggacguccaugaaacuccuggaucaggugguuccucccgccggagacgaugaagucacagugggcaaguucuaugcgaccuuucuuauccaggaguacuucagaaaguuuaaaaagcgcaaagagcaaggccugguggggaagccuucucagcggaaugcucucagccugcaggccggacugagaacccuccacgacauuggccccgaaauccgccgggccauuuccggggaucuuacagcugaggaagagcuggacaaagccaugaaggaagcggucucugccgcuagcgaggaugacaucuucagacgcgccggaggccuguuugggaaccauguguccuauuaccagagcgauggacggucugcuuucccgcaaaccuuuacgacacagagaccucuccacauuaauaaggccggcuccagccagggcgacaccgagucucccucccaugaaaaacugguugauagcacauucacccccuccucuuauagcuccacagggagcaacgcuaauaucaacaaugccaacaauaccgcgcuuggacgccugccuagacccgccggcuacccuucuacgguguccaccgucgaggggcacggaccgccccucagcccugcuauccgggugcaggaaguugccuggaagcugucuagcaaccgcugucacuccagagagucucaagcugccauggccggccaggaggaaacaagccaggacgagaccuacgaagugaaaaugaaucaugacacagaggcuugcuccgaacccucucugcucagcaccgagaugcuuuccuaucaggaugacgagaaccggcaacugacgcugccugaagaggauaagcgcgacauuagacagagccccaaacggggguuucucagaucugcgucccugggacgccgggccagcuuccaccuugaaugucugaagagacagaaggaucgcggcggcgacaucucccaaaaaacaguccucccgcugcaucuggugcaccaucaggcucucgccguugccgggcuuucuccucugcugcagcggagccacucccccgcuucuuucccuagacccuuugccaccccucccgcgacaccgggaagccggggcuggccuccccagcccgugccuacccuccgccuggagggggucgaauccagcgagaagcuuaauucuuccuucccgagcauucacugcggaucuugggccgagaccacacccggcgggggaggcuccagcgcugccagacgggugcgcccugugucucugaugguccccagccaagcuggcgccccugggagacaguuucauggauccgcgucuagccucguugaagccgugcugaucuccgagggccuggggcaguucgcucaggaucccaaauuuauugaagugacgacccaagagcucgccgacgcuugcgauaugacaaucgaagagauggagagcgccgcugacaacauccuuuccggaggcgccccucagucuccgaauggggcgcugcugcccuucgucaacugucgggaugccggacaggaccgcgcuggcggcgaagaggaugccgggugcgugagagcucggggacgcccuagcgaagaggagcuccaggacuccagaguuuacgugucuagccuguga

SEQ ID NO: 66780 - RNA, 6546 nt, Artificial Sequence
  derived and/or modified sequence opt5 from CACNA1D__Homo_sapiens__NP_000711
augaugaugaugaugaugaugaagaagaugcagcaccaaagacagcagcaggccgaccaugcuaacgaggccaauuacgcgcggggaacccgccugccccugagcggggaaggaccuacaucccaaccgaacucuagcaagcagacggugcuguccuggcaggcugccaucgaugccgcuagacaggccaaagcugcccaaaccaugucuacaagcgcgcccccucccgugggcucccuuucucagcggaagcgccagcaguacgccaaaagcaagaagcaaggaaauuccagcaacucuagaccugcucgggcccuguucugccucucccugaauaaccccauucgcagagcuuguaucagcauuguugaguggaaaccuuuugacaucuucauucuucuggccaucuuugcgaauugcguggcccucgcuaucuacauuccguuccccgaagaugacucuaacuccaccaaucacaaccuggagaagguggaauaugccuuucugaucauuuucacagucgagaccuuucucaaaaucauugcuuacggacugcuucugcauccuaaugccuaugugcggaacggcuggaaucuccuggauuucguuaucgugauugucgggcuuuuuagcgugauccuggagcagcucacaaaggaaaccgagggaggcaaccacucuuccggcaaaagcgggggauucgacguuaaggcccugcgcgcuuuuagagugcugcggccccuccgccuggucuccggcgugccuucucuucaggugguccugaauagcaucauuaaggcgaugguuccccuccugcauaucgcccuucugguccucuucgugauuaucauuuacgcuaucaucgggcuggaacuguuuauuggaaaaaugcacaagacguguuucuucgccgauuccgacaucguggccgaggaggauccggcuccuugcgccuuuagcggcaacgggagacaauguaccgcgaacggaacagaaugccggucuggcugggugggccccaaugggggaauuaccaacuucgacaauuuugcuuucgccaugcucacaguuuuucaguguaucaccauggagggcuggacggaugugcuguauugggucaacgacgccauugggugggaauggccuuggguguacuucguuucccuuaucauccugggguccuucuucgugcucaaucugguccuuggcgugcugucuggggaguuuagcaaagaacgcgagaaggcuaaagccagaggagauuuccagaagcuccgggagaaacagcaacuggaagaggaccugaagggcuaccucgacuggauuacacaggcugaagauaucgaccccgagaacgaagaggagggcggggaagagggaaagagaaauaccuccaugcccacaucugaaaccgagagcgucaacaccgaaaauguguccggcgagggggagaaccgcggaugcuguggcagccuguggugcugguggcggagacgcggggccgcgaaagccggcccuucuggaugucggagauggggccaggcuauuuccaagagcaaacuuucucgccgguggagacgcuggaaucgguuuaacagacgccggugcagagccgcuguuaaguccgugacauucuauuggcuggucaucgugcucguuuuucugaauacgcugaccauuagcuccgaacacuacaaccagccggauuggcuuacacaaauccaggacauugccaauaaagugcuccuggcgcuguuuaccugcgagaugcucgucaagauguauucucuggggcuucaggccuacuucgugagccuguuuaaccgguucgauuguuuugugguuugcggaggcaucacagaaaccauccucgucgagcuggagauuaugagcccccuggggaucucuguguuccgcugugugagacuucuccggauuuuuaaggucacgagacauuggacaagccuguccaaccugguggcuagccuccucaauucuaugaaauccaucgccagccuucugcuccugcuguuccuuuuuauuaucaucuucucucuccugggaaugcagcuguuuggcgggaaguucaacuuugacgaaacccaaaccaaacgcuccacauucgauaauuuuccucaggcucuccugaccguuuuccagauucuuacaggcgaggacuggaacgccgugauguaugauggaaucauggccuacggcgggcccagcucuagcggaaugauugucugcaucuauuucauuauccuguuuaucuguggcaauuacauucuccugaacguguuccuggcuaucgcgguugacaaucuugccgaugcugaaucccucaacacggcccagaaggaggaagccgaggagaaagaacggaagaagauugcuagaaaagagagccuggaaaauaagaaaaacaauaagccugaggugaaccaaaucgccaauucugacaacaaagucaccauugacgauuaccgcgaagaggacgaggauaaggaccccuauccgccuugcgaugugcccguuggggaagaggaagaggaagaggaggaagacgagccugaagugcccgcgggaccuagaccccggcgcaucuccgagcugaauaugaaggagaaaaucgcuccgauuccugaaggcagcgccuuuuucauccucuccaagacaaaccccauuagagucgggugucacaaacugaucaaccaucacauuuuuaccaaucuuauccugguguucauuaugcucucuagcgccgcucuggccgcggaggaucccauccggucccacucuuuucgcaacacaauccugggcuacuucgacuaugcuuuuaccgccauuuucacgguggaaauccuucugaagaugaccacauuuggagccuuccuccauaaaggcgcuuucugcagaaauuacuuuaaccugcucgauaugcuggucguuggggugagccuuguguccuucggcauucagucuagcgccaucuccgucgugaagauucugcggguucuccgcgugcugagaccucugcgggcuaucaaucgcgccaaaggccuuaagcacgucgugcaguguguuuuuguggcgaucagaaccauugggaacaucaugauugucacaacccugcuccaauucauguuugccugcaucggagugcagcuguucaagggcaaauuuuaucgguguacggacgaggcuaagagcaauccggaagagugcagagggcuguucauucuguacaaagauggcgacguugauucucccgugguccgcgagcggaucuggcagaacuccgacuuuaauuucgacaacgugcuuagcgccaugauggcucuguuuacagugucuaccuucgaaggauggccugcccuccuguauaaggccaucgauuccaauggcgagaacauugggcccaucuacaaucauagagucgaaauuagcaucuuuuucauuaucuacauuaucaucguugcuuucuuuaugaugaacauuuucgugggauuugugaucgucacauuccaggagcaaggcgaaaaagaguauaagaauugcgagcuggacaagaaccagcgccaguguguggaauacgcgcuuaaagcccggccucugagacgcuauauucccaagaacccuuaccaguauaaauuuugguacguugucaauucuucccccuucgaguauaugauguuuguccucaucaugcugaacacccucugccuggcuaugcaacacuacgaacagagcaagauguucaaugaugccauggacauucuuaacaugguguuuaccgggguuuucacaguggagaugguccugaaagugaucgccuuuaagccgaagggauacuucuccgaugcuuggaauacguuugacagccugaucgucauuggcucuaucauugauguggcccucagcgaagcggacccuaccgaguccgagaacguucccgugccuacagcuacccccggcaauucugaagagagcaaccggaucuccauuacauucuucagacuguuucgcgucaugcggcuugugaaacugcucucuagaggggaaggaauccggacccugcucuggacguucaucaagagcuuucaggcccugccguauguugcccuucugauugcuaugcuguucuuuaucuacgccgugauuggcaugcagauguucgggaaagucgcgaugcgcgauaauaaccaaaucaauagaaacaauaacuuucagacauucccucaggcugugcuccugcuuuuucggugugccaccggagaggccuggcaagagauuaugcuggcuugccuccccggcaagcugugugacccugaauccgauuauaaucccggggaggaauauaccugcggaucuaacuucgccaucguguauuuuauuagcuucuacaugcucugugcuuuucugaucaucaaucuuuucguugccgucauuauggacaacuucgauuaucugacacgcgacugguccauccugggcccccaucaccucgacgaguuuaaaagaauuuggagcgaauacgauccugaggcgaagggccggaucaagcaccuggacguggugacccuucugagacgcauucagccgccccucggguucggaaaacugugcccucaucgggucgccuguaagagacucguggcuaugaacaugccccucaauucugauggcacaguuauguuuaacgccacgcuuuucgcucuggugcgcaccgcccugaaaaucaagacagaggggaaucucgaacaggccaacgaggaacugcgggcugucaucaaaaagauuuggaaaaagaccuccaugaaacuucuggaccaggugguuccucccgcgggagaugacgaggugacagucggcaaauuuuacgccaccuuccucauccaagauuauuuuagaaaguucaaaaagcgcaaagaacaggggcuggugggaaaguacccugcuaagaauacgaccauugcccugcaggccggccuccggacacuucacgacaucggcccggagauuagacgcgcuaucagcugcgaucugcaggacgaugagcccgaagagaccaaaagagaagaggaagacgacguuuuuaagcggaacggggcccugcucggaaaucaugugaaccacgucaauucugaucgcagagacucccugcaacagacaaacaccacacaccggccucuucaugugcagcgccccagcaucccucccgcguccgauaccgagaaaccgcuguucccucccgcuggcaauucugugugucacaaccaucacaaucauaacagcauugggaagcagguccccacguccacaaaugccaaccucaacaaugccaacaugagcaaagcugcccacggaaagagaccuucuaucggcaaucuggagcacguuuccgaaaacgggcaucacagcucucauaagcacgaccgggagccccaaagacgcagcuccgugaaacggaccagauauuacgaaaccuauauucgcucugauagcggagacgagcagcugccuacaaucugccgggaggauccggaaauucauggcuacuuuagagacccccacugccucggcgagcaggaauauuucuccucugaggaauguuacgaggaugacagcuccccuaccuggagccggcagaauuacggguauuacucucgcuaucccggaagaaacaucgauuccgagcggccucgcggcuaccaccauccccaaggguuucuugaagacgaugacagcccggugugcuaugacuccagacggucuccucgcagacggcugcugcccccuacgcccgcgagccaccgcagauccucuuucaauuucgagugucuccggagacagagcucccaggaagaggucccuagcucucccauuuuuccgcaucgcacagcccugccucuucaccugaugcaacagcagaucauggcuguggccggacucgauuccagcaaggcucagaaauacucucccucccacagcacccggucuugggccacacccccugcuaccccgcccuauagagacuggacaccuugcuacacaccccugauccaaguugaacagagcgaggcccuggaucaggugaacggcucccucccuucucuucaucgcagcuccugguacacggacgagcccgauauuagcuaucggaccuucaccccugcgucccugaccgucccgucuagcuuuagaaauaagaacuccgacaaacagcgcucugccgauagccugguggaagcuguucucaucuccgaggggcugggacgguacgccagagaccccaaguucgugucugcuacaaagcacgaaauugccgaugccugugaccuuaccaucgaugagauggaaagcgcugcguccacgcugcucaauggcaacguccgcccucgggccaauggcgacguggggccccugagccauagacaagauuaugagcugcaggacuuuggaccuggcuacucugacgaggaacccgauccggggcgcgacgaggaagaucucgcugacgagaugauuugcaucacaacccuuuga

SEQ ID NO: 66781 - RNA, 6813 nt, Artificial Sequence
  derived and/or modified sequence opt5 from CACNA1E__Homo_sapiens__NP_000712
auggccagauucggagaagcuguggucgcccggcccggguccggagacggcgauuccgaccagucucgcaacagacaagggaccccuguucccgcgagcggacaggcugccgccuacaagcagacaaaagcucagcgggcccgcacgauggcucuguauaaucccaucccugugagacaaaacugcuuuaccgugaaucggucccucuucauuuuuggcgaagauaacaucguccgcaaguacgccaaaaagcugauugacuggcccccuuucgaguauaugauccuugcgacaauuaucgccaauuguaucgugcuggcucucgaacagcaucugcccgaggaugacaaaaccccuaugucuagacggcuugaaaagacagagccguacuuuauugggaucuucugcuuugaggccggaauuaagaucguugcucugggcuucauuuuucacaaaggcagcuaucuccgcaacggguggaaugugauggauuucaucgucgugcuguccggcauucuggccaccgcgggcacacacuuuaacacccauguugaccucagaacgcugcgggccgugcgcguccuuagaccccugaagcucgugucugggaucccuagccugcagaucgugcuuaaauccauuaugaaggcuauggucccccugcuccagaucggacugcuccuguucuuugccauucugauguucgcuaucauuggccuugaguucuacagcgggaaacugcaccgggccuguuuuaugaauaacucuggaauccucgagggcuucgauccuccccauccgugcggcguucaaggguguccugccggauaugaaugcaaggacuggaucggccccaaugaugggauuacccaguuugacaacauccuguucgcugugcuuacaguguuucaguguauuaccauggagggauggacaaccguccuguacaauacgaacgaugcgcucggcgccacauggaauuggcuguacuucaucccucugauuaucaucggguccuuuuucgugcucaaccugguucuuggagugcugagcggcgaguuugcuaaggaacgcgagagagucgaaaaccggagagccuucaugaaacuccgccggcagcaacagauugagagagaacugaauggcuaucgcgccuggaucgacaaggcugaggaggugaugcuugccgaagagaacaaaaaugcggggaccucugcucuggaaguucuccggagagccacaauuaagcgcucccggaccgaggccaugaccagagacagcucugaugaacacugcguggacaucuccagcgucggaacaccccuggcucgcgccuccauuaaaucugcuaagguggauggcgucagcuacuuucggcacaaagagagacugcuccgcaucuccauucggcauauggugaagucccagguuuucuauuggaucgugcugucucuugucgcccugaacacggcguguguggccaucguucaccauaaucaaccccaguggcucacccaucugcuguacuaugcugaguuucuuuuccucgggcuguuccugcucgaaaugucccugaagauguacggaaugggcccuagacuuuauuuucacagcucuuucaacugcuuugacuucggggugacagucggcagcauuuuugagguggugugggccaucuuccggccgggaaccuccuuuggcauuucuguucugcgcgcucucagacugcugcggaucuucaaaauuacaaaguacugggccagccuuagaaaucucgucgugucccugaugagcucuaugaaauccaucaucagccugcucuuucugcuuuuccuguuuauuguggucuucgcgcuccuggggaugcagcuguuuggaggccgcuucaacuucaaugaugggacccccucugccaacuuugacacguucccugcugccaucaugacaguguuucagauucuuaccggagaagauuggaaugagguuauguacaacggcauccggucccaagggggcgugagcuccggaauguggucugcuauuuauuucaucguccucacccuguuuggcaauuacacacugcucaacguguuccuggccaucgccguugacaaucuugcuaacgcgcaggaacugaccaaggaugagcaggaggaagaggaagccuuuaaccagaaacacgcucuccaaaaggccaaggaggugagccccauguccgccccuaauaugcccucuauugagagagaccgcagacggcgccaccauaugagcaugugggaaccgagauccagccaucugcgggagcgcagacggcgccaucacaugucugucugggaacagagaacaucccagcugcggaaacacaugcagaugagcucucaagaggcucuuaaccgcgaagaggccccuacgaugaauccccucaacccucugaauccccuguccagccucaacccucugaaugcgcaucccucucuuuauagacggccgagagcuaucgaggggcuggcccucggacuggcccuggaaaaguucgaggaagaacgcauuagccggggcgggucccuuaaaggagauggcggggacagaagcucugcucuggacaaccagcgcaccccucucucccugggccagcgggaaccgcccuggcucgccagaccuugucacggaaauugcgauccgacacagcaagaggcgggcgggggagaggcugugguuaccuuugaagaccgcgcccggcauagacagagccagcgccgguccagacaccggcgcgugagaacagagggcaaggaaucuagcuccgccucucggagccgcuccgcuucucaagagagaagccuggaugaagccaugcccaccgagggggagaaagaccacgaacuucggggaaaccauggcgcuaaggagccuacgauccaggaagagagagcccaggaucugcgccggaccaauucccucauggucagcagagggucuggccuggcgggaggccuggacgaggccgauacaccccuugugcugccucaccccgaacucgagguggggaagcaugucguucugaccgaacaggagccugaaggauccagcgagcaagcucuccugggcaacgugcagcuugacauggggcgcgugauuucucaguccgagcccgaucugagcugcaucacagccaauaccgacaaagcuacgacagaaucuaccuccgucacaguggccaucccggauguugacccucucguggauagcaccgucgugcacauuuccaacaagaccgacggagaggccagcccccugaaagaagcugagauccgggaagacgaggaggaaguugagaagaaaaagcagaagaaagaaaagagagagacaggcaaagcgauggugccucauucuagcauguucauuuuuagcacgaccaaucccauccgccgggccugucacuacauugucaaccugagauauuucgaaaugugcauccuucuggugauugcugccucuagcaucgcccucgcugccgaggauccgguucugacaaacuccgagcgcaauaaggugcucagauacuucgacuaugucuuuaccggcguguucacauuugaaauggugaucaaaaugauugaucaagggcugauccuucaggacggaucuuacuuccgggaucuguggaacauucuggacuuugucguuguggugggcgcgcucgucgcuuucgcccuggccaaugcucuugggaccaacaagggacgcgauaucaaaacgauuaagagccugagagugcuccggguucugcgcccucucaagacaaucaaaagacugcccaaacuuaaagccguguuugacugugucgugaccucccugaagaauguuuucaacauccugauuguguacaaacucuuuauguucaucuuugcggucauugcugugcagcuguucaagggcaaguuuuucuauugcaccgauucuagcaaagacacagagaaggaauguaucgggaauuacgucgaucacgagaaaaacaagauggaggugaaaggacgggaauggaagagacaugaguuccacuaugacaauauuaucugggcccuucugacccucuuuacaguuuccacgggcgaaggcuggccucaggugcugcaacauagcgucgaugugaccgaggaagaccgcgggcccucucgguccaacagaauggagaugagcaucuucuacguuguguauuuugucguguuccccuuuuucuuugugaauauuuucguugcccucaucauuaucacauuucaggagcagggagacaagaugauggaagagugcucucuggagaagaacgagcgcgcuuguauugauuucgccaucuccgcuaagccucuuacccgguacaugccgcaaaauagacacacauuucaguaucgggucuggcauuucguggugagccccuccuuugaauacaccauuauggccaugaucgcgcugaacacggucgugcugaugaugaaauacuauucugccccuugcaccuacgagcucgcucugaaguaucuuaauaucgccuucacaaugguuuucagccuggagugugugcucaaagucauugcuuuuggcuuccugaacuacuuucgcgacaccuggaacaucuucgauuuuauuacagugaucggguccauuaccgaaaucauccucacagacagcaagcugguuaauaccucuggauucaacauguccuuucuuaagcuguucagagccgcccggcugauuaaacuccugcgccagggcuauacgauccggauucuucuguggacauuugugcagagcuucaaggcucuccccuacgucugccugcugaucgcgaugcucuuuuucauuuaugccaucaucgggaugcaaguguuuggaaauauuaaacuugaugaggaaucucacaucaacagacacaauaacuuccgcagcuucuuuggcucccugaugcuccuguucagaucugcuaccggcgaggccuggcaggaaauuaugcugagcugucuuggggagaagggaugcgagccugacaccacagcccccuccggccagaaugaaaacgagcggugcgggaccgaucuggcuuacguuuacuuugugucuuucaucuuuuucuguagcuuucucaugcugaaucuguucgucgccgugauuauggacaacuuugaauaucucacgcgcgauuccagcauccuuggaccucaucaccuggacgaguucgugagagucugggcggaguacgaucgggcugccugcggccggauucacuauacagaaauguacgagaugcugacccucaugucuccgccccuggggcuuggaaaacgcuguccuuccaagguugccuauaaacggcuggugcucaugaauaugcccguggcugaagacaugacaguccacuuuaccagcacacugauggcccugaucagaaccgcgcucgacaucaagauugccaagggcggcgcugaucgccagcaacuugacuccgagcugcagaaagaaacgcuggccaucuggccucaccucucucagaagaugcuggaucuucuggugcccaugccgaaagcuagcgaccucaccguugggaagauuuacgccgcuaugaugaucauggauuauuacaaacaguccaaggugaagaaacaacggcagcagcuggaggagcagaagaacgccccuauguuccaaagaauggaacccucuagccugccccaggagauuaucgcgaaugccaaagcucucccuuaccuucagcaagaccccgucuccggacugagcggccgcucuggguauccuuccaugagcccgcugucuccccaggauaucuuucagcucgccugcauggacccugcugaugacggacaguuccaagaacggcagucccuggugguuacagaucccagcucuaugagacgcagcuucuccaccauucgggacaagagaucuaacagcuccuggcuugaggaauuuagcauggagcgcuccucugagaauacauacaaaagccggagacgcuccuaucauucuagccugagacucuccgcccaccggcugaacucugauagcggccauaaguccgacacccaccgcagcgggggaagagaacggggcagaucuaaggagcggaaacaucugcucuccccugacgugagccgcuguaauucugaagagagaggcacgcaggccgauugggaaucccccgagcggcgccagagcagaucuccguccgaggggcggagccaaacaccuaaccgccagggaaccggcucccuuagcgaaucuagcauccccuccgucucugacacaagcaccccuagacggucccgcagacagcugcccccugugcccccgaagccucggccccugcucucuuacagcucccugauucgccacgcugggucuaucuccccucccgcggauggauccgaggaaggcagcccgcuuaccucucaggcccuggaguccaacaaugcuugccucacagagagcucuaacagcccccacccucaacagagccagcaugccagcccccaaagauauauuucugaaccuuaccuggcccugcacgaggacagccaugcuuccgauuguggggaagaggaaacgcucaccuucgaggccgcggucgccacaagccuuggacggucuaauaccaucggcuccgcucccccucugcgccacagcuggcagaugccgaacggccacuauagacggagacgcagagggggacccggcccugggaugaugugcggagccgugaauaaccugcucucugacacagaggaagaugacaaauguuga

SEQ ID NO: 66782 - RNA, 5901 nt, Artificial Sequence
  derived and/or modified sequence opt5 from CACNA1F__Homo_sapiens__NP_001243718
augagcgaguccgaaggcgggaaggacaccacacccgagccuucuccggccaacggagcuggccccgggccugaauggggacugugccccggcccucccgccguggagggggaaagcuccggagcgucuggccucggcacgccuaaaagacggaaucagcacagcaagcauaaaaccgucgcuguugccuccgcccaacgcucuccgagagcucuguucugucuuacacuggccaacccccuccggcgcagcugcaucuccauuguggaguggaagccuuuugauauccugauucuucugaccaucuucgcuaauuguguggcccucggggucuacauucccuuuccugaggacgauagcaacacagcgaaucacaaccuggaacagguggaguauguuuuccuggugaucuuuaccgucgaaacagugcucaaaaucguugccuacggacuggugcuucaucccucugcuuauauuagaaauggcuggaaccugcucgacuucaucauugucgugguggggcuguuuuccguccuucuggagcagggaccgggccggccuggggaugccccccacaccggaggcaagccuggcggguucgacguuaaggcucuccgcgccuuuagagugcugcggccccugcgccucgugagcggaguccccucucugcauaucgugcuuaauuccauuaugaaagcgcugguuccucuccugcacaucgcccuucuggugcucuucgucauuaucaucuacgcuauuaucggccuggagcuguuucucgggagaaugcacaagacgugcuauuuccugggaagcgauauggaagccgaggaagacccgucucccugugcuuccagcggcuccgggcgggccugcacccuuaaccagacagagugucgcggaagauggccuggccccaauggcgggauuaccaacuuugauaauuucuucuuugccaugcugacaguguuccaaugcguuaccauggaaggauggacggacgugcucuacuggaugcaggaugcuaugggcuaugagcugccuugggucuacuuugugucucuugucaucuucgggagcuuuuucgugcugaaccucguucugggagugcuguccggcgaguuuagcaaagaacgggagaaggcgaaagcccgcggggacuuccagaagcagagagaaaagcaacagauggaggaagaucuccggggcuaccuggacuggauuacacaggcugaggagcuugacauggaagaucccucugccgacgauaaucugggaccgcagcucgccgagcugaccaacagacgccggggcagacugcgcugguuuucccauagcacacggucuacccacagcaccuccucucaugcuagccuuccugccuccgacacagggagcaugacggaaacccaaggagaugaggacgaagaggagggcgcgcucgcuucuuguacaagaugccugaacaaaaucaugaagacccgcgucugucggagacugcgccgggccaauagagugcuccgcgcccggugcagacgggcuguuaaauccaacgccugcuauugggcugugcugcuucuggucuuccucaauacacugaccaucgccagcgaacaccacgggcagcccguguggcugacgcagauucaagaguacgcgaacaaggugcuucucugucuguuuacaguugaaaugcugcucaaacuguauggacuuggcccuucugccuacgucuccagcuucuuuaaucgcuucgauugcuucguggugugugggggcauccuggagaccacccucgucgaggugggagcuaugcagccccugggcauuuccguucugagaugcgugcggcuucucagaaucuuuaaggucacacgccauugggccucucugagcaaccugguggcuucccuccugaauucuaugaaaagcauugccucccuucugcuccugcuguuccuuuuuaucaucauuuucagccuccuggggaugcagcuguuuggaggcaaguucaacuuugaccagacccacacaaagcggucuacguucgauaccuuuccucaagcgcuccugacaguuuuccagauccuuaccggggaagacuggaauguggucauguaugauggaauuauggccuacggcgggcccuuuuucccgggcaugcugguguguaucuauuuuauuauccucuucauuugcggaaacuacauccugcugaauguuuuccuugcuaucgccguggacaaccuggcuuccggcgacgccgggacagccaaagauaagggaggcgagaaaagcaaugaaaaggaccucccucaggagaacgaagggcugguccccggaguggagaaagaggaagaggaaggcgcuagacgcgagggggcggauauggaagaggaggaagaggaagaggaagaggaggaagaggaagaggaggaagagggcgccggaggcguggaacuccugcaggaggucguucccaaggaaaagguggugccuauuccggaggggucugcuuuuuucugucuuucccaaaccaauccccugagaaaaggaugccauacgcucauccaccaucacgucuuuaccaaccugauucugguguucaucauucuuagcucuguuagccuggccgccgaggacccuauccgggcucacuccuuucgcaaccauauccucggcuacuucgauuaugccuuuacaagcauuuucaccguggaaauccugcucaagaugacagucuuuggggcguuccugcacagaggaucuuuuugucgguccugguucaauaugcuugaccugcucgugguuagcgugucccugauuucuuucggcauccauagcuccgcuauuucugucgugaaaauccugcgcguucuuagagugcugcggccccuccgcgccaucaacagagccaagggccugaaacacgucgugcagugcguguuugucgcuauucggaccaucgggaauauuaugaucguuacgacacuccugcaguucauguuugccuguauuggagugcagcuuuucaagggcaaguuuuacaccugcacagaugaggcgaaacacaccccucaagaaugcaaggggagcuuccugguguaucccgacggagaugucucccgcccucuggugagagagcggcucuggguuaacucugacuuuaauuucgauaacgugcugagcgcuaugauggcccuuuuuaccgucuccacauucgaaggcuggcccgcccugcucuacaaagcuaucgacgccuaugcugaggaucaugggccgaucuacaauuauagaguggagauuagcguuuuuuucaucguguacauuaucauuaucgccuuuuucaugaugaacauuuucgucggauuugugaucaucacguuccgcgcgcagggcgaacaggaguaccagaauugugaacuggacaagaaccaacggcagugcgucgaguaugcccucaaagcucagccucugagacgcuacauucccaagaauccucaccaauaucgggugugggccaccguuaacucugcugccuuugaauaccuuauguuccugcugauccuccugaauacaguggcccuugcuaugcagcauuaugagcagaccgcgcccuuuaacuacgccauggacauucugaauauggucuucacaggccucuuuaccaucgagauggugcugaagauuaucgcuuucaaaccgaagcacuauuuuacggaugccuggaacacauucgacgcccucaucguugugggguccauugucgauaucgcugugaccgaagugaacaauggaggccaucugggggagagcucugaagacuccagcagaauuucuaucaccuuuuuccgccuuuuucggguuaugagacuggucaaacugcucuccaagggagagggcauucgcacacugcuuuggaccuucaucaaaagcuuccaggcccugccuuacguggcgcuccugaucgcuaugauuuuuuucaucuacgccgugauugggaugcaaauguuuggaaaggucgcccuccaggauggcacacagaucaaccggaauaacaauuuccagacguuuccccaagcugugcugcuucuguucagaugugccaccggcgaggcguggcaggaaauuaugcuggcuucccucccugggaaccggugcgaccccgagagcgauuuuggacccggcgaagaguucacaugugggucuaauuuugccaucgccuauuucauuagcuuuuucaugcugugcgcuuuucuuaucaucaaccuguucguugccgugauuauggacaauuucgauuaccucacccgcgacugguccauccugggaccucaccaccuggaugaauuuaaaagaauuuggucugaguaugacccgggcgcuaaggggcggaucaagcaucucgaugucguggcccuucugcgcagaauucagcccccucugggauucggcaaacucuguccccaccggguugcgugcaagagacugguggccaugaacaugccucuuaauagcgacggcacagucaccuuuaacgcuacgcuguucgcccucgugcgcaccucccugaaaaucaagacagaggggaaucuggaacaggcuaaccaagagcuccggaucguuauuaaaaagaucuggaagagaaugaaacagaagcuucuggacgaagugauucccccuccggaugaggaagaggucaccgugggaaaauuuuacgccacauuccugauccaggacuauuuucgcaaguuccggagacgcaaagagaagggccuccuggggaaugaugccgcucccucuaccagcuccgcgcuucaagccggacugcggucucuccaggaccugggcccugaaaugagacaggcucugacaugugauaccgaggaagaggaagaggaggggcaggaaggaguggaggaagaggacgagaaggaucucgaaacgaacaaagccacaauggucagccaacccuccgcccgcagaggcagcggcauuucuguuucccuuccugugggggaccggcugcccgauagccugucuuuuggaccguccgacgaugaccgcggcaccccuaccagcucccagcccucugugccccaggcugggagcaacacacauagacggggauccggcgcccucaucuucaccaucccugaggaagggaauagccagcccaagggaacgaaaggccaaaacaagcaggacgaggaugaagaggucccugaccgccugucuuaccuugaugagcaggcgggcacaccgcccugcuccgugcugcucccuccccacagagcucagcgguauauggacgggcaucugguuccuagacgccggcugcuccccccgaccccugccggaagaaaacccagcuuuacaauucaaugucuucagcgccagggcucuugcgaagaucugccuauccccgggaccuaccaccggggaagaaauagcggcccuaaccgggcccagggguccugggcuacacccccgcaacgcggaagacugcucuacgccccucugcuucugguggaggaaggcgcggccggcgagggguaucucggacggucuagcggcccccugcgcaccuucacgugccugcacguccccgggacccauuccgacccuucucacggaaagagaggcagcgcugauucccucguggaagccguucuuauuagcgaggggcugggccuguuugcucgggacccgcgcuucguggcccucgcuaagcaggagaucgccgaugcguguagacugacacuugacgaaauggauaaugccgcuucugaccugcucgcccagggaaccuccagccuguacuccgaugaggaaucuauucugagccgguucgacgaggaagaccucggcgaugagauggcuugcguccaugcccuuuga

SEQ ID NO: 66783 - RNA, 6945 nt, Artificial Sequence
  derived and/or modified sequence opt5 from CACNA1G__Homo_sapiens__NP_001243253
auggaugaagaagaggauggcgcuggggcugaagagagcggacagcccagauccuucaugcggcugaacgaccugucuggcgccgggggaagaccuggcccggggagcgcggaaaaggaucccggauccgcugacucugaggccgagggccugccuuaccccgcccuugcuccuguggucuuuuucuaucugagccaagauuccagaccccggucuuggugccucagaaccguuuguaauccuugguuugaaagaaucagcaugcuggugauucuucugaacugcgugacacucggcauguuccggccgugugaggacaucgccugcgauucccagcgcugucgcauucugcaggcuuuugacgauuucaucuuugccuucuuugccguugaaauggugguuaaaaugguggcccuggggauuuucggaaagaaaugcuaccucggcgacacguggaaucggcuggacuuuuucaucgucaucgcugggaugcuugaguauagccuggaccuccagaacgugucuuuuuccgccguucgcaccgugagaguccugcggccccuucgcgcuauuaauagagugccuagcaugcggauccuggugacccuccugcuggauacccuccccaugcugggaaacguccuucugcucuguuucuucgucuuuuucauuuuuggcaucgugggggugcaacugugggccggacuucugcgcaauagaugcuuccucccugagaacuuuucucugccccuguccgucgaccucgaacgguacuaucagacagagaaugaagacgagagcccguucauuuguucucagccuagagaaaacggcaugcgcuccugccggagcgugcccacccugagaggcgaugggggaggcgggccucccuguggacuugacuacgaggcguauaauuccucuagcaacacaaccugcguuaauuggaaccaguacuacacgaauugcuccgccggcgagcacaaccccuuuaagggggcuaucaacuucgauaauauuggauaugccuggaucgcuaucuuucaagugauuacccuggaaggcugggucgacaucauguacuucgugauggaugcccacagcuuuuauaacuucauuuacuuuauccuccugauuaucguuggcucuuucuucaugaucaaucuuugucugguggucauugccacacaguuuuccgagaccaaacagcgcgaaagccagcucaugcgggagcaaagagugcgcuuccugucuaacgcuagcacacuggcguccuuuucugaaccugggagcugcuaugaggagcuccugaaguaccuugucuauauccugcggaaggccgcuagacgccucgcccaggugucccgggccgcuggaguuagagugggccugcugagcucuccggccccucuugggggacaggaaacccaacccuccagcucuuguucccgcagccaccggagacucuccguccaucaccuggugcaucaccaccaucaccaucaccaccauuaccaccugggcaaugggacgcuccgggcgccccgcgcuucuccugagauucaggacagagaugccaacggcagccggagacugaugcuucccccgccuuccacacccgcccugucuggagcuccucccggcggggccgaaagcguucauuccuucuaccacgcugacugccaucucgagccugugcgcugucaggcgcccccgccucggagccccucugaagcguccggaagaaccgucggcagcgggaaaguguaucccacagugcacaccucuccuccgcccgagacccugaaggagaaagcccugguugaagucgcugccuccagcggaccucccacacuuacgucucucaauaucccucccggcccuuacagcuccaugcacaagcugcuggagacccagagcacaggggcuugccaaucuuccuguaaaauuagcucccccugccucaaggccgauucuggcgcguguggaccggacagcugcccuuauugugcccgcgcuggcgccggggaaguggagcuggcugauagagagaugcccgacuccgacucugaagccguguacgaguuuacccaggaugcccagcauagcgaccuucgggauccucacucccgcagacagcggucucugggacccgacgcugaaccgagcuccguccucgcguucuggcgccugaucugcgauacauuuagaaagaucguggacagcaaauauuucggccgggggauuaugaucgccauucugguuaacacccuuucuaugggaaucgaguaccaugaacaaccugaggagcucacgaaugcucuggaaauuuccaacaucguguuuacaagccuguucgcccucgagaugcugcuuaagcugcucgucuauggccccuuuggguacauuaaaaauccuuacaacaucuucgauggcgugaucguugugauuucugucugggaaaucgugggacagcagggcgggggacuguccguucugcgcaccuuuagacuuaugcgggugcucaagcugguccgcuuccugcccgcccuccagagacaacugguggugcuuaugaaaaccauggacaaugucgcuacauucugcaugcugcucaugcuguuuauuuucaucuuuagcauucugggcaugcaccuuuucggguguaaguuugccucugagcgggauggagacacccugcccgaucgcaagaacuucgacucccuccugugggcgaucguuacaguguuucagauccucacgcaggaagauuggaauaaggugcuguauaacggcauggcuagcaccuccagcugggccgcccuuuacuucauugcucugaugacauuugggaacuauguccucuucaaucugcugguggccauccuuguugagggcuuucaggcggaggaaauuucuaagcgcgaggacgcuagcggacaacuguccugcauccagcucccuguggacucucagggcggggaugccaacaaaagcgaauccgagccggacuucuucucucccagccuggauggagacggcgaucggaagaaaugucucgcccuggucucccuuggggaacacccugagcugagaaagucucuccugcccccucugauuauccauaccgcugccacacccaugagccuuccuaaauccaccagcacgggacugggcgaggcucucggcccggccucucgccggaccuccagcucuggguccgcggaacccggagccgcucacgagaugaaaagcccucccuccgccagaucuagcccucauucccccuggagcgcugccucuuccuggacaagccgccggucuagcagaaauucccugggccgcgccccgucucucaagcggagaagcccuuccggggaacggcgcucucugcuuagcggagagggccaagagucccaggacgaagaggaaagcucugaggaagagagagcuucccccgcggggagcgaucaccggcaucgcggaucccuggagagagaagccaaaucuagcuuugaccugcccgauacccuccaggugccuggccugcaccggacagcuuccggcagagggucugccagcgagcaccaggacugcaacggaaaguccgccagcggccgccuugcucgggcccugagacccgaugacccuccgcucgauggggacgacgcggaugacgaaggaaaucugucuaaaggcgagcgcguucgggcuuggaucagagcccgccuccccgccuguugccuggaacgggauuccuggagcgcuuacauuuucccuccccaaucuagauuucgccuucugugucauagaaucauuacccacaagauguucgaccaugugguccuggugaucauuuuucucaacugcaucacgaucgccauggagcggccuaaaauugauccccacuccgcggagcgcaucuuccugacacuuagcaauuauauuuuuaccgcuguuuuccuggccgaaaugacagugaaggucguggcccucgggugguguuuuggagagcaggcuuaccugagaucuagcuggaacgugcucgacggccugcuuguccugaucuccguuauugauauccuggugucuauggugagcgacuccggcaccaagauucucgggaugcugcggguccuucgccugcucagaacccugcggccgcucagagugaucagccgcgcccagggacugaaacuuguuguggaaacacugauguccucucugaagccuaucggcaauauugucgugaucugcugugcuuucuuuauuaucuucgggauucucggaguucagcuguuuaaaggcaaguucuucgugugccaaggggaggauacgcggaacaucaccaauaaaagcgacugcgccgaagcguccuauagauggguccgccauaaguacaacuuugauaaucuuggacaggcccugaugucucucuucgugcuggcuagcaaggacggcugggucgacaucauguacgauggccuggacgccguggggguugaucagcagcccauuaugaaccacaauccuuggaugcuccuuuauuuuaucuccuuccugcugauuguggccuuuuucguccucaacauguuugugggaguuguggucgagaacuuccacaaaugucggcaacaucaggaggaagaggaagccagacggcgcgaggagaagagacugcggcgccuugagaaaaagagacggaaagcccagugcaagcccuacuauucugacuacagccgcuuuagacugcucgugcaccaucuguguacaucccacuaucuggaucucuucaucaccggcgugauugggcuuaauguugucacaauggcuauggagcacuaccaacagccucagauccuggacgaagcgcugaaaaucugcaacuauauuuuuaccgugaucuucgugcucgagagcgucuuuaagcugguggccuucggauuccggcgcuuuuuccaggauagauggaaucaacuugaccuggcuauuguucuccugucuaucaugggcauuacgcuggaagagaucgaggugaacgccucccuccccauuaauccgacaaucauccggauuaugagaguccuucgcaucgcccgggugcugaagcugcucaaaauggcuguugggaugagagcccugcuugauaccgugaugcaggcgcugccucaggucggaaaccucggccugcuguuuaugcuccuuuucuuuauuuucgcugcccugggcguggaacuguuuggggaccucgagugugaugaaacccaucccugcgagggacugggccgccacgccacauuccggaauuuugggauggcuuuccuuacccuguuuagaguuagcacaggagacaacuggaauggcaucaugaaggauacgcuccgcgacugugaccaggaaucuaccugcuacaacacagugauuucccccaucuacuucgucagcuuugugcugaccgcccaauucgugcuggucaauguugugaucgcggugcucaugaaacaucuugaggagucuaacaaggaagccaaagaggaagcugagcuggaagccgagcuggagcucgaaaugaagacacuguccccucagccgcacagcccccuuggguccccuuuccuguggcccggagucgagggcccugauagccccgacucuccuaagccgggcgcucuccaucccgccgcucacgcccggagcgcgucccacuuuucucuggaacauccuaccgauagacagcuguucgacacgauuagccuccuuauccaggggucccuggagugggagcugaaacucauggaugaacuggccggacccggcgggcaaccuucugcuuuucccagcgccccgucccuuggaggcucugacccucagaugcagccccaccccaccgagcugccugggcccgaucuccugacagugcgcaagagcggaguuucccggacccauagccugccuaaugacucuuauauguguagacacggcuccacagcugaaggcccgcucgggcaccgcggauggggccuucccaaagcccagagcgggucugugcuguccguccauagccaaccugccgauaccuccuacauucugcagcuccccaaggacgcuccucaucugcuucagccccauucugcgccgacauggggaaccaucccuaaacugcccccucccggccggagcccucucgcccaaagaccccugcgcagacaggcugccauucggacggauucccuggacgugcaggggcucggcagccgcgaggaucuucuggccgaaguuucuggaccguccccuccccuggcuagagccuauagcuucuggggccagucuagcacacaagcgcagcagcacucccggucucauagcaagaucuccaagcacaugacacccccugccccgugccccgggccugagcccaacuggggaaaaggcccucccgagaccagaucuagccucgaacuggacacagagcuuuccuggaucagcggggaccugcucccucccggaggccaggaggaaccgccuucuccccgggaucugaagaaauguuacuccguggaagcucaaagcugccagcgcagaccuaccuccuggcuggacgagcagcggcgccacucuauugccgucagcugccucgauuccgggucucagccccaucuuggcacggacccgagcaaucugggaggccaaccucucgggggacccggcuccagacccaagaaaaagcucagcccucccucuaucacaauugauccuccggagucccaggggccccggaccccucccagcccuggaaucugucugcgcagacgggcucccucuuccgacagcaaggauccucuugccucuggcccgcccgacuccauggcggccagcccuucucccaaaaaggaugugcugagccucuccgggcugagcuccgacccugcugaucuggaccccuga

SEQ ID NO: 66784 - RNA, 7044 nt, Artificial Sequence
  derived and/or modified sequence opt5 from CACNA1H__Homo_sapiens__NP_001005407
augaccgaaggcgcccgcgcugccgacgaagugcgggucccccugggggcgccuccgcccggaccugcugcccucguuggcgccagccccgaauccccuggggcucccggacgcgaagccgagagaggcucugaacugggggugagcccuuccgagucuccggcugccgagcggggagcggaacuuggcgccgacgaggaacagcgcgugcccuacccugcucuggccgcuacagucuucuuuugccucggccaaacgaccagaccccggagcuggugucugcgccuugugugcaacccuugguucgagcacguuuccaugcuggugaucaugcucaauugugucacacuggggauguuuagacccugcgaggacguggaauguggaucugagcggugcaacauucuggaagccuucgaugcguuuaucuucgccuuuuucgcuguugagauggugauuaagauggucgcccucggccuguuugggcagaaauguuaucuuggagacaccuggaaucgccuggauuucuuuaucgugguggcuggcaugauggaauacagccucgacgggcauaacgucucccugagcgccauuagaacaguucgggugcuucgcccgcugagagccaucaaucgggugccuucuaugcgcauccucgucacccugcugcucgauacacugcccaugcuuggaaacgugcugcuccugugcuucuuuguuuucuucauuuuuggcaucgugggcguccagcuuugggcugggcugcucagaaaucgguguuuccuggacuccgcguuugugagaaacaauaaccugaccuuccuccgcccuuauuaccagacggaggagggagaagagaaucccuuuauuugcagcucucggagagauaacggcaugcaaaaguguucccacauccccgggcgccgggaacugagaaugccuugcacccuuggaugggaggccuauacacagccgcaggcugaaggcguuggggccgcccgcaaugcuugcauuaacuggaaucaguacuauaacgugugucggagcggagacucuaacccccauaauggcgccaucaacuucgauaauauuggcuacgcguggaucgcuaucuuucaagucauuacccuggagggguggguggacaucauguacuaugucauggaugcccacuccuucuacaacuuuauuuauuucauccuccugauuaucgugggcagcuuuuucaugaucaaucuuugccugguugugauugccacacaguuuuccgagaccaaacagagagaaucucagcucaugcgcgagcaacgggcuagacaucugagcaacgacuccacgcuggccagcuucucugaaccuggcuccuguuacgaggaacuccugaaguaugucgggcacaucuuccgcaaagugaagcggagaagccuucggcuguacgcucgcuggcagucuagauggcggaagaaaguugaccccagcgccgugcagggacaaggcccugggcacagacagcgccgggcgggcagacauacagccuccguccaccaucucguguaucaccaccaucaccaucaccaucaccacuaccauuuuucucacggaagcccccgcagaccgggcccugagcccggggcuugcgauacccggcuggugcgcgccggagcuccucccuccccucccagcccgggcagagggccucccgacgccgagucuguucauuccauuuaccacgcggauugucacaucgaaggaccccaggagcgggcccgcgucgcucaugccgcugccacagccgcugcgagccugagacuugccaccggccucgggaccaugaauuauccuacaauucugccgucuggcgugggauccggcaaggggagcacgucccccggaccuaaaggcaagugggcugggggacccccuggcaccgggggccacggaccccugucucucaacagcccugaccccuacgagaagaucccgcauguggucggcgagcacgggcugggacaggccccuggccaucuuuccgggcugucugugcccugcccucuccccagcccgccugccggaacacugaccugugagcugaaguccugccccuauuguacacgggcucuugaagauccugagggcgaacucagcgggucugaguccggcgacagcgauggacgcggcguuuacgaguucacccaagacgugagacacggggaucggugggaccccacgagacccccuagagccacagauaccccgggacccggcccugggucuccccagcggagagcgcagcagcgcgcugccccuggagagcccggcuggaugggccggcugugggucaccuuuuccgggaagcugagacgcaucguggacagcaaauauuucucucggggaauuaugauggccauccucguuaauacacugagcaugggcguggaguaccacgaacaaccugaggaacuuaccaacgcucuggagauuuccaauaucgucuuuacaagcauguucgcccucgaaaugcugcugaaacuucucgcgugcgggccgcugggauauauuagaaaccccuacaauaucuuugacggcauuaucgugguuaucucugugugggagauugucgggcaggcugauggaggccuguccgugcuccgcacguuccggcugcuuagagugcugaaacucguccgcuuucugccugcccugcggagacagcuuguugugcucgugaagaccauggacaacgucgccacauucuguacccugcugaugcucuuuaucuucauuuuuagcauccugggcaugcaucuuuucgggugcaaauucucccugaagacagauaccggagacacggugcccgaucggaaaaauuuugacucucuccugugggcuauuguuaccguguuccagauccugacacaagaggauuggaacgucgugcuuuacaacggcauggccagcaccuccucuugggcugcccuguauuuuguugcgcucaugacauucgggaauuacgugcuguuuaaccuccuggucgccauccuuguggaaggauuccaggcugagggcgacgccaaucgcagcgauaccgacgaagauaagacguccguucacuuugaggaagacuuccauaagcugagagagcuccagacaaccgagcugaaaaugugcucucuggcugugacaccuaacgggcaccuugaaggacggggcagccugagcccgccccucauuauguguaccgccgccaccccuaugcccacacccaagagcucuccuuuucuggaugcugcgcccucccucccugacagccgcagaggaucuuccagcucuggggacccgccccugggagaucagaaaccucccgccucccuucggagcuccccuugcgcucccuggggcccgagcggggccuggucuagcagacgcuccucuuggagcucccugggacgggccccuucucucaagagacgcggccaauguggggagcgggaaagccugcuguccggagagggcaaaggcucuacggacgaugaggcugaagacgggagagccgcgcccggaccucgcgcuacaccccuucggagagccgagagccuggauccucgcccccucagaccggccgcucugccucccacaaagugccgggaccgcgauggccaggucguggcccuccccuccgacuucuuucugagaaucgauagccaucgggaagacgcggcugagcuugaugacgauucugaagacuccuguugccugcgccugcacaaggugcucgagccuuauaaaccgcagugguguagaagccgggaggccugggcccuguaccuuuucucuccccaaaauagauuccgcgucuccugccagaagguuauuacccacaaaauguuugaccauguggugcuggucuucaucuuucucaacugugugacaauugcucuggaacggccugauaucgaccccgggagcaccgagagaguuuuccucuccgugucuaauuauaucuuuacggccauuuucgucgcugaaaugauggugaagguuguggcccugggacuucugagcggcgagcacgcguaccugcaguccagcuggaaccuccuggaugggcuucugguccucgugucucuggucgacaucgugguugccauggcuuccgccggaggcgcuaaaauucucggcgugcugcgcguccuucggcugcugagaacacuccggccucugcgcgugaucagcagagcccccgggcuuaagcugguuguggaaacccucauuucuagccugcggccuaucggaaauaucguccucauuugcugugccuuuuucaucauuuuuggcauccugggggugcagcuuuucaagggaaaauuuuauuacugcgagggcccggauacccgcaacauuuccacaaaggcucaaugcagagcggcccauuaccggugggugcgcagaaaauauaauuucgacaaccuggggcaggcucugaugucucucuuuguucugagcuccaaggauggaugggucaauaucauguacgacggccuugaugccgugggcguggaccagcagcccguccaaaaccacaauccuuggaugcugcucuauuucauuucuuuccugcugaucgugagcuuuuucguucucaacauguuugugggggucgugguugagaacuuccacaaaugucggcagcaucaggaagccgaggaagcucgcagacgggaggaaaagagacuucgccggcuggagagacgccggagaaaggcccagcgccggcccuacuaugcggauuacuccccuaccagacgcagcauccacucucugugcacaucccauuaucucgaccuguuuauuacguucaucauuugugugaaugucaucaccaugagcauggagcacuacaaccaacccaaaucccuugacgaagcucugaaguacugcaauuauguguuuacaauuguuuucguguuugaggccgcccucaaacuggucgcuuucggauuucggagauucuuuaaggaucgcuggaaccagcuggaccucgccaucgugcuucugucucugaugggcaucacccucgaagagauugagaugagcgcggcccugccgaucaauccuacaauuauccggauuaugagagugcuucgcaucgcuagaguccugaaacuccugaagauggccaccgggaugcgggcucugcucgauacgguugugcaggcccuuccccaagugggaaaccugggccuccuguucaugcugcuuuucuuuaucuacgcugcccugggggucgaacucuucggacgccuggaguguuccgaagacaaucccugcgagggccugucuagacaugcgaccuuuagcaacuucggcauggccuuucucacacuuuuccggguguccaccggggauaauuggaacggaauuaugaaagacacacugagagaauguagccgggaggauaagcacugccugucuuaucucccugcucugucccccguuuacuuugugaccuucguccuuguggcccaguuuguucuggugaaugucguggucgcugugcucaugaagcaccuggaggaaagcaacaaagaggcccgcgaagacgccgagcuggaugcugaaaucgagcucgagauggcgcagggcccugggucugccagacggguugacgcugaucgcccgccccuuccucaggaaucccccggagccagagacgccccuaaucugguggcucggaaggugagcgucucucgcaugcugagccuccccaacgauuccuauauguucagaccgguugugccugccucugcgccccauccucggccccugcaagagguggaaauggagacauacggcgccgggaccccucuuggcagcgucgcuuccgugcacucucccccggccgaauccugugcuucccugcagauuccucucgccguuagcucccccgcgcgcucuggagagccccugcaugcccugagcccuagaggcacggcucgguccccgucucucagccgccuucugugcagacaggaggccgugcacacagacucccuggaagggaaaaucgacagcccccgggauacccucgacccugcugagcccggagaaaagaccccuguccgccccgugacacagggcgggucucugcaauccccucccagaagcccgcggccugccucugucagaacccgcaaacacacguuuggacagcgguguguguccagcagacccgcugccccuggcggggaggaggcggaagccucugaucccgcugacgaggaaguuucccauauuacaagcuccgccugcccguggcagccuaccgcugagccccacggccccgaagccagcccuguggccggaggcgagcgcgaucuucggagacuguauucugucgacgcgcagggguuccucgauaagcccggacgcgcugacgagcaauggcggccuagcgccgaacugggcuccggggagccgggagaagcuaaggccuggggccccgaggccgaaccugcucugggggccagacgcaaaaagaaaaugucucccccuugcaucagcguggagcccccugcggaggaugaaggcuccgcccggccgucugcugccgagggaggcagcacaacccucagacgccggacacccuccugugaagcuaccccucauagagacucucuugagcccacggaagggagcggagccggcggggauccugcggccaagggagagcgguggggccaggcuuccugcagagccgagcaccugaccguucccagcuuugcuuucgaaccgcuggaccucggcgugccuucuggggaucccuuccuggacggaucccauagcgucacacccgagucucgcgccuccagcuccggcgcuauugugccucuugaacccccugagucugagccgcccaugccugugggggaucccccugaaaaacggagaggacuguaccucaccguuccccaguguccgcuggagaagccuggcagccccuccgccaccccugcgcccgggggaggcgccgaugacccggucuga

SEQ ID NO: 66785 - RNA, 6672 nt, Artificial Sequence
  derived and/or modified sequence opt5 from CACNA1I__Homo_sapiens__NP_066919
auggccgaguccgcuucucccccuagcagcuccgccgcggcuccggccgccgaacccggcgugaccacagagcagccugggccccgcucuccucccagcuccccucccggacuggaagaaccccucgacggcgcugauccucacgucccccauccugaccuggcccccaucgcuuucuuuugucuucggcaaacgaccucuccgcgcaauugguguaucaagaugguuugcaauccuugguucgaaugugugagcaugcuggugauccuccugaacugcgucacacuugggauguaccagcccugugaugacauggauugccuguccgacagauguaaaauucuccagguguuugaugacuucaucuuuauuuucuuugccauggagaugguucugaagaugguggcccugggaaucuucggcaagaagugcuaucucggggauaccuggaaucggcuggacuuuuucaucgucauggccggaaugguggaguacagccuugaucugcagaacauuaaucucucugcuauccgcacaguuagagugcugcggccucuuaaagccauuaaccgcguccccuccaugagaauccuggugaaucuccugcuggacacccuccccaugcugggcaacgugcuucugcucugcuuuuucgucuuuuucauuuucggcaucauugggguucaacugugggcuggacuucugcggaaucgcugcuuucucgaagagaacuucacaauccagggcgauguggcccugccuccguauuaccagcccgaagaggacgacgagaugccuuuuaucuguagccugucuggggauaauggaauuaugggcugccacgaaauucccccucucaaggagcaggggagagaaugcugucuguccaaggacgauguguaugacuucggagcgggccggcaagaucuuaacgccagcggccugugcgucaauuggaaccgcuacuauaauguguguagaaccgggucugcuaacccccauaaaggagccauuaacuuugacaauaucggcuacgcuuggauuguuaucuuccaggugaucacgcucgaggggugggucgaaauuauguacuaugugauggaugcccacuccuuuuacaacuucaucuauuuuauucugcuuaucauuguuggcagcuucuuuaugaucaaucugugccucguggucaucgccacccaguucuccgagacaaagcagcgggagcaucgccugaugcuggaacaaagacagcgguaccucucuagcuccaccguggcuagcuaugcggagccgggcgacuguuacgaagagauuuuucaguaugucugccacauccugagaaaagccaagcgccgggcucuugggcuguaccaagcccuccagucuagacgccaggcccugggaccugaagcucccgccccugcgaaacccggcccucacgcuaaggagccccggcauuaccacggcaagacaaaagggcagggagaugagggcagacaucuggggucccgccacugucaaacccuucacggaccggccagcccuggcaacgaccauucugggcgggaacucugcccccagcacagcccccuggaugccacgccucauacacuggugcagccgauucccgcuacccucgccuccgacccugcuucuugucccugcugucagcacgaggacggcagacgcccuagcggacugggcuccacagauagcgggcaagaaggaucuggcuccgggagcucugccggaggcgaggacgaagcggauggggacggcgcccgguccagcgaggauggagcuuccucugagcuuggcaaggaagaggaagaggaggaacaggccgacggggcuguuuggcugugcggagauguguggagagagacccgcgccaaacuccggggcaucgucgacagcaaguauuucaauagagggauuaugauggcgauccuggugaacaccguuuccaugggaauugaacaucacgagcagcccgaagaacugacaaauauccuugagaucugcaacguggucuucacgucuauguuugcccucgaaaugauucugaaacuggcugccuucggccucuuugauuaccugcggaauccuuauaacaucuucgacagcauuaucgugauuaucuccaucugggagauuguggggcaggcugauggcggacuuagcguucugcgcaccuuuagacuccugcggguccugaaacuugugagauucaugcccgcccuccgccggcaacuggugguccugaugaaaacaauggacaauguggccaccuuuuguaugcuccugaugcuuuucaucuuuauuuucucuauccugggcaugcacauuuuugggugcaaguucucccucagaacagauaccggagacacgguuccggaccgcaagaacuuugauagccugcugugggcuaucgugacagucuuccagauccuuacccaggaagacuggaaugugguucucuacaacggcauggcgucuaccuccccuugggccagccuguauuucguggcucugaugacauuugggaauuacguccucuucaaccugcuuguggccauucugguugagggauuucaggccgaaggcgaugcuaacagaucuuauagcgacgaggaucaauccagcucuaauaucgaggaguucgacaaacuccaggaggggcuggauuccagcggcgaccccaagcuguguccuauucccaugaccccgaacggacaucuugauccuucccugccccucggcgggcaccugggaccugccggcgcggcugggcccgcgccccggcucucucugcagccugacccgaugcuuguggcccugggaagccgcaaauccucugucaugagccucggcagaauguccuacgaucaacggucucugagcuccagcagaucuuccuacuauggccccugggggagaagcgcugccugggcgucucggcgcuccagcuggaacucucugaagcauaaaccucccuccgcugaacacgagagccuucuguccgccgaaagaggaggcggggcccgggugugcgagguggcugccgacgagggaccuccccgcgcugccccucuccacacaccgcaugcgcaccauauccaccauggcccccaccuggcccacagacaucggcaccauagacgcacgcucagccuggauaaccgggacucugucgaccuugcugaacugguuccugccgugggggcucaccccagagccgccuggcgcgcugcgggaccugcccccggccaugaggauuguaauggccggaugccgagcauugcuaaggacguguuuaccaagaugggggauagaggagaccgcggcgaagaugaggaggaaaucgacuacacacucugcuuccgggucagaaaaaugaucgauguguauaagccugacuggugugagguucgcgaagauugguccguguaccuguuuucucccgagaaccgguucagaguccugugccagaccauuaucgcccacaaacuuuuugacuaugugguucuggccuucauuuuucucaauuguaucacaauugcucuggaacggccccagaucgaggccgggagcaccgagcgcauuuuccucacgguguccaacuacaucuucaccgcgaucuuugucggagaaaugacacugaaggugguuucucuuggccuguauuucggggagcaggcuuaccugagaagcuccuggaaugugcucgauggauuucuggucuucgugucuauuaucgacauuguggucagccuugccuccgccggcggcgcuaaaauccuggggguucuccgggugcugcgccuccugagaacccuucggccucugagagugauuagccgcgcccccggacugaagcucgucguggaaacacugaucucuucccuuaagccuaucggcaacauuguucugaucugcugugcguuuuucauuaucuuugggauucucggagugcaacuguucaaaggcaaguuuuaccacugccucggggucgacacccggaauaucacgaacagaagcgauugcauggcugccaauuaucgcugggugcaucacaaauacaacuucgacaaucugggacaggcccuuaugucucuguuuguucuggcuuccaaggauggcugggugaacaucauguauaacggccucgacgccgucgcuguggaucagcagccggucacaaaucauaaccccuggaugcugcuuuacuucauuagcuuucugcucaucguguccuucuucguucugaauauguuugugggggucgugguugagaacuuccacaaaugucggcaacaccaggaagccgaggaggcgagacgccgggaagagaagagacuccgcagacuggaaaagaaacggcgcaaggcccagagacuuccuuauuacgcuaccuauugccauacacggcugcugauucacucuauguguaccagccauuaccucgacaucuuuauuaccuucaucauuugccugaauguggucacaaugucccuugagcacuacaaccagcccacgagccuggaaaccgcccucaaauauuguaauuacauguuuacaaccguguucgugcuggaggcuguucugaagcucgucgccuuuggacuucgcagauucuuuaaagaucgguggaaccaacuggaccuggccaucgugcuccugucugugaugggcaucacacuugaggaaauugagaucaaugcugcgcugccuauuaaccccaccaucauuagaaucaugcgcguccuccggaucgccagagugcugaagcugcucaaaauggcuacggggaugcgcgcccuucuggauacaguugugcaggcccugccgcaggucggaaaucucggccugcuuuucaugcugcucuuuuucauuuaugcugcccuggggguggaacuguuuggaaagcucguuugcaacgacgagaauccuugugagggcaugucccggcaugcgaccuucgaaaacuucggcauggcuuuucuuacccuguuccaagugagcacaggggauaauuggaacggaaucaugaaggacacccugagagauugcacacacgacgagcggucuugucucagcucccugcaguuugucucuccccuuuacuucgugagcuuuguucugacggcccaguucgugcucauuaacgucgugguggccguccugaugaaacaccuggacgauuccaauaaggaagcucaggaggacgccgaaauggaugcggagcucgagcuugaaauggcccauggccuggggccuggaccccgccugccuaccggcucucccggggcuccgggaagaggcccuggcggggccggaggcgggggagacacagagggcgggcucugccggcgcuguuauagccccgcucaagaaaaccuguggcuugauuccguuagccugaucauuaaagacucucucgagggagaacugaccaucaucgauaaucuguccggcagcauuuuucaccauuacuccucucccgccggcugcaagaaaugccaccacgacaagcaggaggugcagcucgcugagacagaagccuucagccuuaacuccgauagaucuagcuccauccugcugggggacgaucucagccuggaggacccuaccgcguguccgcccggacggaaggauucuaaaggcgaacuugacccucccgagccuaugcgcgugggggaccugggagaaugcuuuuucccccucuccagcacggccgucucuccugauccggagaauuuucugugugagauggaagagauucccuucaacccugugagauccuggcugaagcaugacagcucucaggcucccccuagccccuuuuccccggaugccucuagcccucuccuucccaugcccgcugaguucuuccacccugccguuuccgccagccaaaaaggccccgagaaggggaccggcacaggaacccugccuaaaaucgcucugcagggcuccugggcgucucuccggagcccgcgcgugaauugcacacugcuuagacaggccaccggguccgacacaucucuggaugcuagccccuccucuagcgccggaucccuccagaccacgcuggaggacagccugacacucucugauuccccucggagagcccuuggacccccugcucccgccccggggccucgcgcgggacugagccccgccgcucggagacgccugucucuccggggcagagggcuguuuucccuucgcggccugcgggcccaucaaagaagccacucuuccggaggcagcaccuccccuggguguacccaucacgacagcauggaucccucugacgaagagggacgcggcggggcuggaggcgggggcgccggaagcgaacacuccgagacacucucuagccugucccugaccucucucuucugcccucccccgccuccgcccgcgccuggccuuacgccggcccggaaguuuagcuccacaucuagccuggcugcccccgggagaccucaugcugccgcucuggcccacggacucgcgcgcucccccagcugggccgcugaucggucuaaggacccucccggcagagccccucugcccauggggcuuggaccgcuggcuccucccccucagccccucccgggcgaacuggagccuggcgacgccgccuccaaacgcaagagauga

SEQ ID NO: 66786 - RNA, 5622 nt, Artificial Sequence
  derived and/or modified sequence opt5 from CACNA1S__Homo_sapiens__NP_000060
auggagcccagcuccccucaggacgaaggccugagaaagaaacaaccgaagaaacccgugccugagauccucccccggccuccccgcgcccuguucugccuuacccuggaaaacccucucagaaaggcuuguauuucuaucgucgaguggaaaccguuugaaacaauuauccugcuuacgauuuucgccaauugcguugcgcuggcuguguaccuccccaugccugaggaugacaacaauagccugaaccuggggcucgagaagcuggaauauuuuuuccuuaucguguuuuccaucgaggccgccaugaagauuaucgcuuacggauuccuguuucaccaggaugccuaucuccggucuggcuggaauguccuggacuucaccauuguguuucuugggguuuucacagugauccuggaacaggucaacgugauucagagccauaccgcucccauguccucuaaaggagccggccucgauguuaaggcgcugcgcgccuuuagagugcugcggccucuccgccuggucagcggggugcccucccuucaagugguccugaauagcaucuucaaagcuaugcucccgcuguuucacauugcccuucugguucucuucauggugaucaucuacgcuauuaucggacuggagcuguucaagggcaaaaugcauaagacauguuauuuuauuggcaccgacaucguggccacagucgagaacgaagagccuucucccugcgcgagaaccggguccggacggcgcuguacgauuaauggcagcgaaugcagagggggauggccuggccccaaccacgggaucacccauuucgauaauuuuggauucucuaugcucacaguguaccaguguaucaccauggagggcuggacagacguucuguauugggugaacgaugccauuggcaaugaauggcccuggaucuacuuugucacccuuauucugcucggguccuucuuuauccugaaccuugugcugggaguucucagcggcgaguucacgaaggagcgggaaaaagcuaagucucgcgggacauuucagaaacugagagagaagcagcaacuggacgaagaucuccggggauacauguccuggauuacccagggcgaggugauggacgucgaagauuuccgcgaggggaaacugagccuugacgagggaggcuccgacacagaaucucuguaugagaucgccggccucaauaagaucauucaguuuaucagacacuggcggcaguggaacagaauuuuccgcuggaaaugccacgauaucgugaagagcaaggucuuuuacuggcuggugauucugaucguugcucuuaacacccucuccauugccagcgaacaucacaaucaaccucuguggcugacccggcuccaggacaucgccaacagagugcugcuuucucuguucacaacggagaugcucaugaaaauguaugggcugggacugcgccaguacuucauguccaucuuuaaucgguucgauuguuuugucgugugcagcggcauucuugaaauccuccugguugagucuggggcuaugaccccgcugggaauuagcgugcucagauguauccgccugcuucggauuuucaagaucacaaaauauuggaccucccugucuaaccucgucgcgagccugcugaauuccaucagaagcauugccucucuucuccugcugcucuuucuguucaucgugauuuuugcucuucugggcaugcaacucuucgggggccgcuacgacuuugaggauacagaagugcggagauccaacuucgacaauuuuccccaggcccugaucagcguuuuccagguccugaccggagaggauuggacgucuaugauguauaacggcauuauggccuacgggggaccuuccuaccccggcaugcuugugugcaucuauuuuaucauucucuucgugugcgggaauuacauccugcugaacgucuuccucgcuauugccguggacaaucuggcggaagcugagagccuuacauccgcccagaaggccaaagcugaggaaaagaagcgccggaaaaugucuaagggacugccugauaaaagcgaggaagagaaguccaccauggccaaaaagcucgaacaaaagcccaaaggcgaggggaucccgaccacagcuaagcugaaaauugacgaguuugaaucuaacguuaaugaggugaaggauccuuaucccagcgccgacuucccuggcgacgaugaagaggacgaacccgagaucccucugucccccagaccgcggccucuugcggagcugcagcucaaagaaaaggccguccccauccccgaggcuagcucuuuuuucauuuuuuccccuaccaacaagauccgcgugcugugucauagaauuguuaaugccacaugguucacgaacuuuauccuccuguucauucuucugagcucugcugcccucgcggccgaagauccgauccgggcugacuccaugagaaaccagauucugaaacacuuugauaucggauucaccagcguguuuacagucgagaucgugcugaagaugaccacauacggcgccuuccuucacaaagggucuuucugccgcaauuauuuuaacaugcuggaccuccugguuguggcugucagccucauuuccaugggacuggaaagcucugccaucuccguggugaagauucuucggguccugagaguucuccgcccccugagagccaucaaucgggcuaaaggccugaagcauguggugcaguguauguucgucgcgauuagcaccaucgggaacaucgugcuuguuacgacccugcuccaauuuauguucgccugcauuggagugcagcuguuuaaaggcaaguucuuucgcuguacagaucucuccaagaugaccgaggaggaaugcagaggguacuauuacgucuacaaagacggcgauccuaugcagaucgagcugcggcaccgcgaaugggugcauucugacuuccacuuugauaauguucuuagcgcuaugaugucccuguucacagugucuaccuuugagggauggccccagcugcucuauaaggccauugacagcaacgccgaggaugucggcccuaucuacaauaacagaguggaaauggcuauuuucuuuaucaucuauauuauccugauugccuucuucaugaugaauaucuuuguuggguucgugauugucacguuucaagagcagggagaaacagaguacaaaaacugugaacuugacaagaaucagcggcagugcgugcaauaugcgcugaaagcucgcccccucagauguuacaucccuaagaaccccuaucaguaccaggugugguacauugucaccuccucuuauuucgaguaccugauguuugcccucaucaugcugaauacaaucugccuuggcaugcaacauuauaaccagagcgagcagaugaaucacauuuccgacauccugaacguugccuucaccauuaucuuuacccuggaaaugauucucaagcugauggcuuucaaagcccggggguacuuuggagauccguggaacguguucgacuuucuuaucgugaucggcagcauuaucgaugucauucugucugagaucgacacauuccucgcguccagcgggggccuguauugucucggaggcgggugcggaaauguggauccugacgaaucugcucgcauuuccagcgccuuuuucagacuguuccggguuaugagacuuaucaagcugcugucucgcgccgagggcgugcggacgcuccuguggaccuuuaucaaauccuuccaggcucuucccuacgucgcccugcucauugugaugcuguuuuucaucuaugcuguuauugggaugcaaauguuuggaaagaucgcccucguggauggcacacagauuaacagaaauaacaauuuccagaccuuuccucaggcgguccugcuucuguuccgcugcgccacaggcgaagcuuggcaagagauccugcucgccuguagcuacgggaaacugugcgaccccgaguccgauuacgcuccgggagaagaguauaccuguggcacgaacuuugccuacuauuacuucauuagcuuuuauaugcuuugcgccuuccuggugaucaaucucuuugucgcugugaucauggacaacuucgauuaccugacacgggacuggucuauucuggggccucaccaucucgaugaauucaaggcgaucugggccgaguaugaccccgaagcuaagggaagaauuaaacaccuugacguugugacccugcugcgccggauccagccuccccucggcuuugggaaguucuguccccauagagucgccugcaaacgccuggugggaaugaauaugccucuuaacagcgauggcaccguuacauuuaaugccacccuguucgcucucgugcggacagcccugaagauuaaaacggagggcaacuuugagcaggcgaaugaagagcugagagcuaucaucaagaagauuuggaaacggaccuccaugaagcuccuugaccaggucaucccgcccauuggggaugacgaagugacagugggaaaauucuacgccaccuuucugauccaagagcacuuccgcaaguuuaugaaaagacaggaggaauacuauggcuaccggccuaagaaagauauuguucagauccaagccgggcugcgcacaaucgaggaagaggcugcccccgaaauuuguagaaccgucucuggagaccucgcggcugaggaggaacuggagcgggccaugguggaagccgcuauggaggaaggcaucuucagacgcacggggggacuuuuuggccagguggauaacuuccuggagcggaccaauagccucccucccgucauggccaaccagagaccucugcaguuugcugagauugaaauggaggaaauggaguccccgguguuccuggaagacuucccccaagauccucgcacaaacccccucgcccgggcgaauaccaacaaugccaacgcuaauguugccuauggcaacucuaaucacagcaacucccauguguuuucuagcguccacuacgagagagaguucccugaagagacagaaacccccgcuacacgcgggcgggcccuuggacagccgugcagagugcugggcccucauuccaagcccuguguugagaugcugaaggggcuccugacccagcgcgccaugcccagaggacaggcuccucccgcgccuugccaauguccgcggguggagagcucuaugcccgaagaccgcaaauccagcacgccuggcucucuucacgaggaaacaccccauuccagaagcacccgggagaauaccucccgcugcucugccccugcuacagcccugcucauccagaaggcccuggucagagggggacugggcacccucgcugccgaugcgaacuuuauuauggcuacgggccaggcccuugccgacgcuugccagauggaacccgaggagguggaaaucauggccacagagcugcugaaagggcgggaagcgccggagggaauggccagcucccucggcugucugaaucuugggagcucucugggaucccucgaccaacaccagggcagccaggaaacccugauuccucccagacuguga

SEQ ID NO: 66787 - RNA, 3276 nt, Artificial Sequence
  derived and/or modified sequence opt5 from CACNA2D1__Homo_sapiens__NP_000713
auggccgcuggcugccugcucgcccugacccuuacacuguuccagagccuccugaucgggcccuccucugaggaaccuuuuccgagcgcggugacgauuaaguccugggucgacaaaaugcaagaggaucuuguuacccuggcuaagacagccucuggagugaaccagcucguggacaucuacgaaaaauaucaggaucuguacaccgucgagcccaauaacgccagacagcugguggaaauugcugcccgggacaucgagaagcuccugagcaaucgcuccaaagcucuuguuagacuggcccucgaggcggaaaaggugcaagccgcucaccaguggcgggaggauuucgccucuaacgaagucguguauuacaaugcuaaggacgaucuggacccugagaaaaacgauagcgagcccggcucccagcgcauuaagccuguuuuuaucgaagacgccaauuucgggagacagaucagcuaucaacaugcggccgugcacauucccacagauaucuacgagggaucuaccauuguccuuaacgaacugaauuggacauccgcucucgacgagguguuuaaaaagaaccgggaagaggauccuagccugcuguggcaaguguucggcucugccaccgggcucgcucgcuauuacccggccucccccugggucgacaauagcagaacgccuaacaaaaucgaccuguacgauguucggcgcagacccugguauauucagggagccgcuucuccuaaggacaugcuuauccugguggauguguccggcagcgucuccggccucacccugaaacuuauucggacaucugugagcgagaugcuggaaacccucuccgacgaugacuuuguuaauguggcgagcuucaacucuaaugcccaggaugucuccuguuuucagcaucuggugcaggcuaacguucgcaacaagaaggugcugaaagacgccgucaauaacaucacagccaaggggaucaccgauuacaaaaagggauucagcuuugcuuucgagcagcuccugaauuauaacgugucuagagccaauugcaacaaaauuaucaugcuuuuuacggacggcggggaggaacgggcgcaagaaauuuucaauaaguacaacaaggauaaaaagguccgcguguucacauuuagcguuggacagcacaauuaugacagaggccccauccaguggauggcuugugagaacaaaggguacuauuacgagauuccguccaucggagccauccggauuaauacccaggaauaccuggacgugcucggcagaccuaugguccuggccggcgauaaggcuaaacaagugcaguggacaaacguuuaucuugacgcccuggagcucgggcuggugaucaccggaacccugcccgucuucaauauuacaggccaguuugaaaacaagacgaaucucaagaaccagcugauccuuggggugaugggaguggauguuucucuggaggacauuaaacgccucaccccucgguucacacugugccccaacggcuacuauuuugcuaucgaucccaauggguacguccugcuucauccuaaccuccaaccgaagaaucccaaaagccaggaaccugugacccuggacuuccuggaugccgagcucgagaacgacaucaagguggaaauuagaaauaaaaugaucgauggagaguccggcgaaaagacauuucgcacccuggucaagagccaggacgagcgguauauugauaaaggcaacagaacguacacauggacccccgugaaugggaccgacuauucucuugcgcugguucucccuacauacuccuucuacuauaucaaggccaaacuggaggaaaccauuacacaggcucgcagcaagaaaggaaagaugaaggauucugagacgcugaaacccgacaacuuugaagaguccggcuacaccuucaucgccccgcgggacuauuguaaugaucuuaagauuagcgacaacaauacagaauuucuccugaacuucaaugaguuuaucgauagaaaaaccccuaacaaucccuccugcaacgcugaccugaucaaccgcgugcuccuggaugccggguucacaaaugagcuuguccaaaacuacuggucuaagcagaaaaauauuaagggagugaaagcgcgguucguugugaccgacggcgggaucacgagagucuauccuaaggaagccggcgagaacuggcaggaaaaucccgagaccuacgaagauagcuuuuauaagcgcucccuggacaacgauaauuacguguucacagcuccuuacuuuaacaaaucuggacccggcgccuaugagagcgggauuaugguuuccaaggcuguggagaucuacauucagggaaaacuccugaagccggccgucgugggcaucaaaaucgacgugaauagcuggauugaaaacuucaccaagacaucuauccgggauccuugugccgggcccgucugcgacuguaagagaaauuccgauguuauggacugcgugauucuggacgauggaggcuuucuucucauggcuaaccacgacgauuauaccaaucaaaucgggcgguucuuuggcgagauugaccccagccugaugcgccaccuggugaacaucucugucuacgcguucaauaaauccuaugauuaccagagcgugugugaaccuggagccgcuccgaagcagggcgccgggcauagaucugccuauguucccagcguggcugacauccuccaaauuggauggugggccacggcggcugccugguccauccugcagcaguuucuucugagccucacauucccucggcugcuggaggccgucgaaauggaggaugacgauuuuaccgcuucucuuuccaaacagagcugcauuacagagcaaacccaguacuucuuugacaacgauuccaagucuuucagcggcgugcucgacugcgggaacuguuccagaaucuuccacggagaaaaacugaugaauaccaaccugauuuuuaucaugguugagucuaagggcacaugccccugugacacgcgccuccugauccaggccgaacagaccagcgaugggccuaaucccugcgacauggugaagcaaccucgguacagaaaaggccccgaugucuguuucgacaacaaugugcuugaggauuauacagacugcggaggcguuuccgggcugaacccgucucucugguacauuaucggcauucaguuucugcugcuuuggcuggugagcggauccacccaucgccuccuguga

SEQ ID NO: 66788 - RNA, 3438 nt, Artificial Sequence
  derived and/or modified sequence opt5 from CACNA2D2__Homo_sapiens__NP_001005505
auggccgugcccgcuagaaccugcggcgccagccggccugggccggcgcgcacagcuagacccuggccuggauguggcccccacccugggcccggaacgcggcgcccuaccuccggcccgcccagaccucuguggcuccugcuuccccugcucccucugcuugccgcccccggggcuucugccuacagcuucccgcagcaacauacaaugcagcacugggcucggcgccuggagcaggaagucgacggaguuaugagaaucuuuggcggcgugcagcaacuccgggagauuuauaaggauaaccgcaaucuguucgaagugcaggagaacgaaccucagaaacuggucgagaagguggccggggacaucgagucccuccuggauagaaaaguucaggcgcuuaagcggcuggccgacgcugccgaaaauuuucaaaaagcucaucgcuggcaggauaacauuaaggaggaagacaucguguacuaugaugccaaggcggacgccgagcucgaugaccccgagucugaagaugucgagagaggaagcaaagccuccacccugcggcuugacuucauugaagauccuaauuuuaagaacaaagugaauuacucuuaugccgcuguucagauccccacagacaucuacaagggcagcaccgugauucugaacgagcucaauuggacagaagcccuggagaacgucuucauggagaaucgcagacaggaccccacccugcucuggcaaguguuuggguccgccacgggagugacccgguauuacccugcuacaccguggagagcgcccaaaaagaucgaucuguacgacguccgccggagaccuugguauauucagggcgccagcucucccaaggauaugguuaucauuguggacguguccgggagcgucucuggacuuacccugaaacucaugaagacauccgugugcgaaaugcuggauacccuuagcgacgaugacuacguuaacguggcuucuuucaaugagaaagcccagccugucuccuguuuuacgcaccuggugcaagccaacguucgcaauaagaaaguguucaaggaagcuguccagggcaugguggccaaaggcacaaccggguauaaggcgggauuugaguacgcuuucgaucagcuccagaacagcaacaucacacgggccaauugcaacaagaugauuaugauguuuaccgacggcggggaagauagaguccaagacguguucgagaaauauaauuggcccaaccgcaccguucggguguucacauuuuccgucggacagcauaauuacgacgugacgccgcugcaguggauggccugugcuaacaagggcuauuacuucgagaucccuucuaucggggccauuagaaucaauacccaggaauaccuggauguucucggacgccccauggugcuggcuggcaaagaggccaagcaaguccaguggacaaacguguaugaagacgcgcuuggccuggggcucgugguuaccggaacacugccugucuuuaaucuuacccaggauggccccggggagaaaaagaaccagcugauucucggagugaugggcaucgacguggcccugaaugauauuaagcggcugacgccuaacuacacacucggggcuaauggcuaugucuucgccaucgaccugaacggauacgugcuucugcaccccaaucucaaaccgcaaaccaccaacuuuagagaaccuguuacacuggauuuccuggacgcugagcuugaggaugaaaacaaggaggaaauccgccggagcaugauugacggcaauaaagggcacaagcagaucagaacccucgugaaaucccuggaugagcgguauauugacgaggucacacgcaacuacacgugggugcccaucagaagcaccaauuauucucugggacucguucugcccccuuacuccacauuuuaccuucaggccaaccugagcgaucagauucuccaagugaaguauuucgaauuucugcugccgucuagcuucgaguccgaaggccaugucuuuaucgcgccccgggaguacugcaaggaccuuaaugccucugacaacaauaccgaguuccucaaaaacuuuaucgaacugauggagaaggugacaccugauagcaaacaguguaauaacuuccugcuccacaaucugauucuugacaccgggaucacgcagcaacugguugaaagaguguggcgcgaucaggaccucaacaccuauucccugcuggcugucuucgccgcuacagauggaggcauuacccggguguuucccaauaaggccgccgaggacuggacagaaaacccugagcccuucaaugcuagcuuuuacagacgcucucuugauaaccauggguauguguucaaaccuccccaccaggacgcgcuccugagaccgcuggaacucgagaacgauaccgucggcauccugguuuccacggccguggagcuuagccugggacggcgcacacucagaccugcuguggucggcgugaagcuggaccuggaagccugggccgagaaguuuaaaguucuugcuucuaaucggacccaccaggaucaaccccagaagugcgggccuaacucccauugugaaauggacugcgaggugaauaacgaagaucuccuguguguccugauugacgacggaggcuuccucgugcugagcaaucagaaccaccagugggaucaaguugggcgcuuuuucuccgagguggacgccaaucuuaugcuggcgcucuacaacaauucuuuuuauacaagaaaagagagcuacgauuaccaggcugccugcgcuccccagccgccuggaaaccugggcgcugcgccccgcggggucuucgugccuaccguugccgacuuucugaaucuugcuugguggaccuccgccgccgcuuggucucuguuccagcaacuccuguauggccucaucuaccauagcugguuucaggccgaucccgcugaagccgagggaucccccgaaacacgggagagcucuugcgugaugaagcagacgcaauauuacuucggcuccgucaacgcgagcuauaaugccauuaucgacugugggaacugcucuagacuguuccacgcucagcggcuuaccaauacaaaccugcucuuugugguggccgagaaaccucuguguucccagugcgaagcuggacgccugcuucagaaggagacccauuguccggccgauggccccgaacaaugcgagcugguccagagaccucgguacagacgcgggccccacaucuguuucgacuauaacgccacagaagauaccagcgacugcggacggggcgcuucuuuuccucccagccucgggguucuggugucccuccagcugcuucugcuccugggccugccuccgagaccccagccucaagugcuuguccacgcgagccgccggcuguga

SEQ ID NO: 66789 - RNA, 3276 nt, Artificial Sequence
  derived and/or modified sequence opt5 from CACNA2D3__Homo_sapiens__NP_060868
auggccggccccgggagcccuagacgggcuucccgcggagccucugcgcugcucgcugccgcccugcuuuacgcugcccugggcgacguggucagaagcgagcagcaaaucccgcucuccguugugaagcugugggcuucugccuucgggggagaaauuaaaagcaucgcggccaaguauuccggcucucagcuucugcagaaaaaguacaaagaguaugaaaaggauguggcuauugaggaaaucgacgggcuccagcuggucaagaaacuggccaagaacauggaggagauguuucacaaaaagagcgaagcugugcggcgccucguugaggccgcggaagaggcccaucugaaacacgaguucgaugcugaccuucaauacgaauauuuuaaugccgugcugauuaacgagagagauaaggacggaaauuuccucgaacugggcaaggaguuuauccuugcucccaacgaucauuucaauaaccugccugucaauaucucccucagcgacgugcagguucccaccaacauguacaauaaagauccugccauugugaacggcgucuauuggucugaaucccugaauaagguguuuguggacaacuucgaucgggaccccagccugaucuggcaguacuuugggucugccaaaggauucuuucgccaguacccuggcauuaagugggagccggaugagaauggggucaucgcuuucgacugcagaaaccggaaaugguauauucaagcggccacaucccccaaggacguugugauccucguggaugucagcggaucuaugaaaggccugcgccuuacgauugcuaagcagaccguguccagcauccuggacacacucggggaugacgacuuuuucaauaucauugccuacaacgaggaacugcacuauguugaaccuugucuuaacggaacccuggugcaggccgauagaacaaauaaggagcauuuccgggaacaccucgauaaacuguuugcuaagggcaucggcaugcuggacauugcccucaacgaggcguucaauauccuguccgauuuuaaccacaccgggcagggaucuauuugcagccaagcuaucaugcuuaucacagacggcgccgucgauaccuacgacacgauuuucgccaaauauaauuggcccgaccgcaaggugagaaucuuuaccuaccugauugggcgggaggcugccuucgcugauaaccucaaauggauggccugugcgaauaagggauuuuucacacagaucuccacccuggccgacguucaggaaaacgugauggaguaucuucauguccugagccgcccuaaggugauugaucaagaacacgacgucguguggacagaggcuuacaucgauucuacccucccccaggcccagaaacugacggacgaucagggcccgguucugaugacaaccguggcuaugccugucuuuuccaagcaaaaugaaacaagaagcaaagggauccuccugggagugguuggcaccgacgugcccgucaaggagcuucugaaaaccauuccuaaguacaagcucggcauccauggguaugccuucgcgauuacaaacaauggauacauccugacgcaccccgagcugcggcuucucuaugaagagggcaaaaagagacgcaaacccaacuacucuagcguggaucuguccgaaguggagugggaggaccgggaugacguucugagaaaugccauggucaaccgcaagaccgggaaauuuucuauggaagugaagaagacaguggauaaaggaaagcggguccucgugaugaccaaugacuauuacuauacagacauuaaaggcaccccuuucagccuggggguugcucuuuccagaggccacggaaaguacuuuuuccgcggcaacgugacgaucgaggaagggcugcaugaucucgagcacccggacgucagccuggccgaugaauggucuuacugcaacacagaccugcaucccgagcaccggcaucuuucccagcucgaggcuauuaaacuguaucugaagggaaaagaaccucuccugcagugugauaaggagcuuauccaggaagugcuguucgacgccguugugagcgcccccaucgaggcuuacuggaccucucucgcgcugaauaaguccgaaaacagcgauaaaggcgucgagguggccuuucuggggaccagaacaggacuuucccgcauuaaucucuucguuggcgcugagcaacugaccaaccaggacuuucugaaggccggggauaaagaaaauaucuucaacgccgaccacuuuccucucugguaucggagagcugccgagcagauucccggcucuuucguguacagcaucccguuuuccacaggaccugucaauaagucuaacguggugacggcgagcaccuccauucagcugcuugaugaacgcaaaagccccgucguugcugccgugggcauccaaaugaagcuggaguucuuucagcggaaguucuggacagccucuagacagugcgcuucccucgacgggaaauguagcaucucuugcgaugacgaaaccgugaauuguuaucugauugacaacaauggauuuauccuggucuccgaggauuacacacagaccggcgacuucuuuggggagauugaaggagccgugaugaacaaacuucucacgaugggcagcuucaagcggaucacccuguaugauuaccaagcgaugugccgcgcuaauaaggagucuagcgacggggcccacggccugcucgauccuuacaacgccuuccuguccgcuguuaaauggauuaugacagaacuugugcuguuucucgucgaguucaaucuguguagcugguggcauucugacaugaccgccaaggcucagaagcugaaacagacacuugagcccugcgauaccgaauauccugccuuuguguccgagagaacgaucaaggaaacaaccggaaacaucgcgugcgaggacuguagcaaauccuucguuauucaacagauccccucuagcaaccuguuuaugguggucguggauuccucuugccucugugaaagcguugccccgauuacaauggcuccuaucgagauucgguacaaugagucccugaagugcgaaagacucaaagcccagaagauccgccggagacccgagucuugucacggcuuccaucccgaagagaacgcucgcgaaugcgggggagccccuagccugcaggcccaaaccgugcuucugcuccugccgcugcuucugaugcucuuuuccagauga

SEQ ID NO: 66790 - RNA, 3414 nt, Artificial Sequence
  derived and/or modified sequence opt5 from CACNA2D4__Homo_sapiens__NP_758952
auggugugcggcuguagcgcccugcucccccugccuaacccgagacccaccaugccugcuacacccaauuuccuugccaacccuuccucuagcucccgguggaucccccugcagccuaugccggucgcgugggcuuuuguucaaaagacgucugcccuccuguggcuucugcuccuggggaccagccugucccccgccuggggacaggcuaagauuccucucgagacagugaagcugugggccgacaccuucggcggggaucuuuacaauacagugaccaaauauucuggaagccugcuccugcagaagaaauacaaggacgucgaauccagccuuaagaucgaggaaguggauggccuggagcucguucgcaaauuuucugaagacauggagaacaugcugagacggaagguggaggcuguccagaaucugguggaagccgcggaggaagccgaucucaaccacgaguucaaugagucccugguuuuugacuauuacaacagcgugcuuauuaaugaacgcgaugagaaagggaacuucgucgaacugggagcugaguuucuccuggaaucuaaugcccauuucuccaaccuucccgugaauacaagcaucucuuccgugcaacugccuaccaacgucuauaauaaggaccccgauauucucaacggcguuuacaugagcgaggcucugaacgccguguuuguggagaauuuccagagagacccgacgcugaccuggcaguauuuuggcuccgcgacaggguucuuucggaucuacccuggaaucaaauggacccccgaugaaaacggcgucauuacauucgacugccgcaauagagggugguacauccaggccgcuaccucuccuaaggauauugugauccucguugacgugagcggauccaugaagggccugcggaugacgauugccaaacacacaaucaccacaauucuugacacccugggggagaacgauuucaucaauaucauugcuuauaacgacuacguccauuauaucgaacccuguuuuaagggcauucucgugcaagccgaucgcgacaauagagagcacuucaaacugcuuguugaagaacugauggugaagggagucggcguggucgaucaggcccuccgggaggcuuuucagauccugaaacaguuccaagaagcgaagcaggggagccugugcaaccaggccauuaugcucaucucugacggagcuguggaggauuacgaacccguuuuugagaaauauaauuggccugacuguaaggugcgcgucuucaccuaccugaucggcagagaaguguccuuugccgaucggaugaaguggauugccugcaacaauaaaggguauuacacacaaaucagcacgcuugcugacacccaggagaacguuauggaguaccugcaugugcucucucgcccgauggucauuaaucacgaucacgacaucauuuggacagaagccuauauggacagcaagcugcuguccucucaggcgcagagccuuacccuccugacaaccguggcuaugcccguguucuccaaaaagaacgagacgagaagccauggaauccugcucggcguugucgggucugauguggcccugcgggaacuuaugaaacuggccccuagauacaagcucggagugcacggcuaugcuuuucugaauacaaacaacggcuacauccugucccaucccgaccuucgcccucucuaucgggaggggaagaaacugaagcccaaaccgaauuacaacagcgucgaucugucugagguggaaugggaggaccaagccgaaucccucagaaccgcuaugauuaaucgcgagaccggaacacugagcauggauguuaaggugccuauggacaaaggcaagcggguccuuuuccugaccaacgauuauuucuucacagacaucuccgauacgcccuuuucucucggggugguucugagcagaggacacggcgaauacauucugcuugggaauaccuccguggaggagggccuccacgaccugcugcauccugaucucgcccuggcgggagacuggaucuacuguauuacagauaucgaccccgaccaccgcaaacuuucucagcuggaagccaugauucgguuccucaccagaaaggauccugaccuggagugcgaugaggagcugguccgcgaagugcuuuucgacgcuguugugacagcccccauggaggcuuauuggaccgcccucgcgcugaacaugagcgaggaauccgagcaugucguggauauggccuuucugggcacgcgggcugggcuccugagaagcucucuuuucgugggauccgaaaaggucagcgaccgcaaauuucugaccccggaggaugaagccucuguuuucacacucgaccgguuuccucugugguacagacaggcuuccgagcaccccgccggcagcuucguguuuaaucugcggugggccgaggggcccgaaucugcuggagagccuaugguggucaccgcgagcacagccguggcuguuaccguggauaagcgcacggccaucgccgcugccgcgggcguccagaugaaacuugaauuucugcaaagaaaguuuugggcugccacacggcaguguuccaccguggacgggccgugcacacagagcugugaggauucugaccucgauugcuucguuaucgacaacaauggcuuuauucugaucuccaagagaagccgcgagaccggacgguuccucggcgaaguggacggggccguccugacccagcuucuguccaugggaguguuuucucaaguuacaauguaugauuaccaggcuaugugcaaacccagcucccaucaccacucugccgcgcagccucucgugagccccauuuccgcuuuccugacggccaccagauggcugcuucaggagcugguccucuuccugcucgaauggucuguguggggcagcugguaugaccgcggggccgaggcuaaguccguguuucaucacagccauaaacacaagaaacaagauccucugcagcccugugacacagaauacccugucuucguuuaucagcccgccaucagagaggcuaacggaauuguggagugcggcccgugucaaaagguguuugucgugcagcagaucccuaauucuaaccuucugcuccugguuaccgaucccacaugcgacuguuccaucuucccucccgugcugcaggaagccaccgaggucaaauacaaugcgagcgugaagugcgaucggaugcgcucucaaaaacuuagacggcgcccggacuccugucacgccuuucauccugaagagaacgcucaggauugcgggggcgccagcgacacgucugcuuccccuccccugcuccugcuccccguuugugccuggggacugcuuccccagcugcugagauga

SEQ ID NO: 66791 - RNA, 1797 nt, Artificial Sequence
  derived and/or modified sequence opt5 from CACNB1__Homo_sapiens__NP_000714
auggugcagaagaccagcauguccagaggccccuacccuccgucucaagagauccccauggaagucuucgacccuagcccccaggggaaauauuccaagcggaaaggacgcuuuaagagaucugauggcagcacauccucugacacgaccagcaacuccuucguucggcaggggagcgccgagucuuacacaucccgcccuagcgauucugacgugucccuggaagaggauagagaagcucuccggaaagaggccgagcgccaggcgcuggcucaacuugaaaaggccaagaccaaacccguggccuuugcugucagaacaaaugugggauauaacccuagcccgggcgacgagguucccgugcagggggucgccauuaccuucgaaccuaaggauuuucugcacaucaaagagaaguacaauaacgacugguggauuggacggcucgugaaagagggcugcgaaguuggcuucauccccucuccugugaagcuggauucccuucgccugcuccaggagcagaagcugagacaaaaucggcuggggagcuccaaaucuggagacaacagcuccagcucucucggcgaugucgugacagggacccgcagacccacgccgccugcuuccgccaagcagaaacaaaagagcaccgaacaugugcccccuuaugacgucguucccucuaugcggcccauuauccuggugggaccuagccuuaaaggcuacgaggugacagauaugaugcagaaggcgcuguuugacuuccucaaacaccgcuuugacgggagaaucuccauuacccgggucacagccgauaucucucuggcuaagagaagcgugcuuaauaacccguccaagcauauuaucauugaacgcagcaauacccggucuucccuggccgagguucagagcgagaucgaaagaauuuucgagcucgcucgcacgcugcagcugguggcccucgacgcggauacaaucaaccaccccgcccagcugucuaaaaccucccuugcuccuaucauugucuauaucaagauuacaagccccaaagugcugcaacggcucaucaaguccagaggaaaaucucagagcaagcaucugaauguucagauugccgcuuccgaaaaacuugcccaguguccucccgagauguuugacaucauccuggaugaaaaccaacucgaggacgccugcgagcaccuggcugaauaccuggaggcguacuggaaggccacccacccgccuucuagcacacccccuaauccccuccugaaccgcaccauggcuacggccgcccuugcugccuccccugcgcccgugagcaaucugcagggcccguaucucgcuucuggcgaucagccucuggaacgggccaccggggagcaugccuccaugcacgaauaccccggagagcuuggccagcccccugggcuguauccgagcucucaucccccuggcagagcuggaacacuccgcgcccugucccggcaagacaccuucgaugcugacacacccgggagcagaaacucugccuacaccgagcugggagauagcugugucgacauggaaacggacccuuccgagggccccggccucggggauccugcgggaggcgggacacccccggcccgccagggaagcugggaagacgaggaggaagauuaugaggaggaacugaccgacaaccggaauagaggccggaacaaggcucgcuacugcgccgaagggggcggaccugugcuuggcagaaauaaaaacgagcuggagggguggggacggggcgucuauauuagauga

SEQ ID NO: 66792 - RNA, 1818 nt, Artificial Sequence
  derived and/or modified sequence opt5 from CACNB2__Homo_sapiens__NP_000715
augcagugcuguggccuggugcacagacggcgcgucagaguuagcuacggguccgccgacucuuauaccagccggcccuccgauucugacgugagccucgaggaagaucgcgaggcugugagacgggaagccgagcgccaagcgcaggcucagcuggaaaaggccaaaacaaagccugucgccuucgcugugagaacgaacguuuccuacucugccgcucaugaggacgaugugccgguccccggaauggccaucagcuuugaggcgaaagacuuccuucacgugaaggaaaaauuuaauaacgauugguggauuggccggcugguuaaggaggggugcgaaaucggauucauuccuucccccgugaagcucgagaauaugcgccugcagcaugagcaaagagccaaacagggcaaguuuuauagcucuaaauccgggggaaacagcagcuccagccuuggcgacaucgucccuucuucccgcaagagcacacccccuuccucugcuauugauaucgacgccaccggccuggaugcugaagagaaugacaucccggccaaccaccggagccccaaaccuuccgcgaauagcgugaccucuccccauuccaaggaaaagagaaugccuuucuuuaaaaagacagagcacacacccccguacgauguggucccuagcaugcggcccguugugcucguggggccuucucugaaaggauaugaagucaccgacaugaugcagaaggcccuguucgacuuucucaaacaccgcuucgagggcagaauuagcaucacccgggugacggcugauauuucccuggccaagagaucuguucuuaacaaucccagcaaacaugcuaucauugagcgcuccaacacccggagcucucuggccgaagugcaguccgagaucgaaagaauuuuugagcucgcccgcacacugcaacuugucgugcuggacgcugauaccaucaaucaccccgcgcagcucagcaagacaucucuggccccuaucauuguuuacgugaagaucuccagcccgaaaguccugcagcggcucauuaaguccagagggaaaucucaggcuaagcaucugaacgugcaaauggucgccgccgacaaacuugcucagugucccccugaacuguucgaugugauccucgacgagaaucagcuggaggaugccugcgaacaccuugcggacuaucuggaggcuuacuggaaggccacccaucccccuagcuccucucuccccaacccgcugcugagccgcacgcucgccacauccagccugccucuuucucccacccuggcuuccaauagccaaggaucucagggcgaucagcggacagacagauccgccccuauucgcagcgcuucucaggccgaagaggaacccagcguugagccugugaagaaaucccaacaccggucuucuuccagcgcgccccaccauaaccacagauccgggaccucucgcggacucagccggcaggagaccuuugauuccgaaacacaggagucuagagacagcgccuacgucgaaccgaaggaggacuauucccaugaucacguggaccacuacgcuucucaucgggaucacaaccaucgcgacgagacgcacggcagcuccgaucacagacaucgggaaagcagacaccgcucucgggacguugauagagagcaggaccauaaugaauguaacaaacaacgcuccagacacaagagcaaagaucgguauugcgagaaggacggcgaagugaucucuaagaaacgcaaugaggccggggaguggaacagagaugucuacauccggcaguga

SEQ ID NO: 66793 - RNA, 1455 nt, Artificial Sequence
  derived and/or modified sequence opt5 from CACNB3__Homo_sapiens__NP_000716
auguacgacgauagcuaugugcccggcuucgaggacuccgaagccgggucugcugauagcuacaccuccagaccuucucuggacagcgaugucucccucgaggaagaccgggagucugcccgcagagaaguugagagccaggcgcaacagcagcuggagcgggcuaagcacaaaccgguggccuuugccgugcgcacaaacgucuccuauugcggagugcuugaugaagagugucccguucagggcagcggggugaauuucgaagcuaaggacuuucugcauaucaaagagaaguacucuaacgauugguggauuggaagacucgucaaagagggcggggacaucgccuucauuccuagcccccaacggcuggaauccauccgccuuaagcaggagcagaaggcuagacggucuggaaauccuuccagccugucugauauuggcaaccgcagauccccucccccgagccucgccaaacagaagcaaaaacaggcggaacacgugcccccuuaugacguugugcccuccaugcggccugucgugcuggugggccccucucugaagggguacgaggucacggauaugaugcagaaagcccucuuugacuuccugaagcaucgcuuugacggaagaaucagcaucacccggguuacagcugaucuuucccuggccaagcgcagcgugcucaauaacccgggcaaaagaaccauuaucgaacggucuuccgcuagaagcucuauugccgaggugcagagcgagaucgaacgcauuuucgagcuggcgaagucccuucaacuggucgugcucgacgccgauacaaucaaucacccugcucagcuggccaaaaccucucuggcucccauuaucguuuuugugaaggucagcuccccuaaagugcuccagcggcugaucagaagccgcgggaagucucaaaugaaacaucuuacaguucagaugauggccuaugacaagcuggugcagugcccucccgaauccuucgaugucauucucgacgagaaccagcuggaagaugccugugagcaccuugcugaguaccuggaaguguacuggcgggcgacccaccaucccgccccgggacccggccuccuggggccucccagcgcuaucccuggacugcaaaaucagcagcuccugggcgagagaggcgaggaacacucuccccuugaacgcgacucccugaugccgagcgaugaggccuccgagucuagccggcaggccuggacgggguccucucaaagaagcucccgccaucucgaagaggacuaugcugaugccuaccaggaccuguaucagccucaccggcagcacaccagcggacuucccucugcgaacggccaugacccucaagauagacugcucgcucaggacuccgaacacaaucauagcgaucgcaacuggcagcggaauagacccuggccuaaggacucuuacuga

SEQ ID NO: 66794 - RNA, 1563 nt, Artificial Sequence
  derived and/or modified sequence opt5 from CACNB4__Homo_sapiens__NP_000717
augagcuccucuagcuacgccaagaacggcaccgcugacgggccccacuccccuacaucucagguggccagaggaacgaccacacggcgcagcagacugaaacgguccgauggcucuaccacaagcaccuccuucauccuccgccaagggagcgcggacucuuauacauccagaccgagcgauucugacgucucccuggaggaagaucgggaggcuauucgccaggaaagagagcagcaggccgccauccaacuugaacgggcuaagagcaaacccguugccuuugcugugaagaccaaugugucuuacugcggagcccuggacgaggaugucccugugcccuccacggcgauuagcuucgacgccaaagauuuucuccauaucaaggagaaguauaacaaugacugguggauuggccgccugguuaaagaagggugugagaucggauucaucccuuccccgcuuagacuggaaaacauucggauccagcaggagcagaagcgcggcagauuucacggcgggaaaucuagcggaaauuccagcagcucccucggcgagauggugagcgggaccuuccgggcuacaccuaccucuacagccaagcaaaaacagaaggucaccgaacauauuccgcccuacgaugugguuccuagcaugcgccccgugguccuggugggaccuucccugaagggcuaugaggugacggacaugaugcagaaagcucucuuugauuuccugaagcacagauuugacgggcggaucucuauuacaagagucaccgccgacaucagccuugcgaaacgcuccguucugaacaaucccagcaagcgggccauuaucgaaagaucuaacacacgcuccagccucgcugaggugcagucugaaaucgagcggauuuucgagcuggccagaucccuucaacuggugguccucgaugcugacaccaucaaucauccggcccagcugauuaaaaccagccuggccccuaucauugugcacguuaagguguccucucccaaaguccuccagcgccugaucaagagccggggaaagucccaaucuaaacaccuuaacgugcagcugguugcugcggauaagcucgcccagugcccucccgaaauguuugacgugauccuggaugagaaucagcuugaagacgcuugugagcaucugggcgaauaccucgaggccuauuggagagccacacacacgaccagcuccacacccaugaccccucugcugggccgcaaccucgggagcacagcucugucuccguaccccaccgccauuuccggacuucaaagccagcggaugagacauucuaaucacuccacggagaacagcccuaucgaacgccggucucugaugacaagcgaugagaauuaccacaacgaaagagcgcggaaaucccgcaacagacucucuucuuccagccagcauucccgggaccacuauccccuggucgaggaagauuacccugacucuuaucaggauaccuacaagccccauagaaaucgcggcagccccgggggauauucccacgacucucggcauagacuuuga

SEQ ID NO: 66795 - RNA, 972 nt, Artificial Sequence
  derived and/or modified sequence opt5 from CACNG2__Homo_sapiens__NP_006069
augggccuguucgacagaggggugcagaugcuccugaccacagucggagccuuugcugccuucagccuuaugacgaucgcgguuggcaccgauuacuggcuguauucccgcggggugugcaagacaaaaucugugagcgagaacgaaaccuccaagaaaaaugaggaagucaugacacacucuggacucuggcggaccuguugccuggagggcaacuuuaaggggcuuuguaaacaaauugaccauuuccccgaagaugcugacuacgaggccgauacagccgaguauuuucugagagcugugcgggccagcuccaucuucccuauucucucuguuauccugcuguuuaugggaggccucugcauugcugccagcgaauuuuacaagacccgccacaauaucauccuguccgcgggcauuuucuucgugagcgccgggcuuucuaacaucauuggaaucauugucuauaucuccgcuaaugccggcgacccgagcaagucugauuccaaaaagaacagcuacucuuaugggugguccuuuuacuucggagcucugagcuuuauuaucgccgagauggugggcguucucgcggugcauauguucaucgacagacacaaacagcugcgggccacggcucgcgccaccgauuaccuucaggcuuccgccauuacaagaauccccucuuaucgguaccgcuaucagagacggagccgcuccagcucuagauccaccgaaccuagccauucucgggacgccagccccgucgggauuaagggauucaauacacugccuuccaccgagaucucuauguacacgcucagccgcgauccccugaaagcugcgacaaccccuacagccaccuauaacuccgacagagauaauagcuuucugcaagugcacaacuguauucagaaggagaauaaggacucucuccacuccaacaccgcuaaucggagaacaacgccgguguga

SEQ ID NO: 66796 - RNA, 948 nt, Artificial Sequence
  derived and/or modified sequence opt5 from CACNG3__Homo_sapiens__NP_006530
augagaaugugcgaccggggcauccagaugcugauuaccacagugggggccuucgcugccuuuagccucaugacgaucgcggucggaaccgauuacuggcuguauucccgcggcguuuguagaacaaagucuaccagcgacaacgagacaucccggaaaaaugaagaggugaugacccacucugggcuuuggcgcacaugcugucuggaaggagcuuucagaggcgugugcaagaaaauugaucauuuucccgaggacgccgauuacgaacaagacaccgccgaguaucuccugcgggcuguccgcgccagcuccguguucccuauccuuucuguuacgcugcucuuuuucgggggacuguguguggcugccagcgaguuucacagaucccggcauaacgucauucugagcgcgggcaucuucuuugugucugccggccucuccaauaucauugggaucauuguuuacaucagcgcuaacgccggagauccgggccagcgcgacucuaagaaauccuauagcuacggguggucuuucuauuuuggagcuuucuccuuuauuaucgccgaaauugugggcgucguggcggugcacaucuacaucgagaagcaucagcagcugagagccaagagccacuccgaguuccuuaaaaagucuaccuucgcucggcugcccccuuaccgcuauagauuucggcgcagaagcuccagccggucuacagaacccagaucccgcgaucucagcccuauuucuaaaggguuccacaccauccccagcacagacauuuccauguuuacccugucucgggauccuagcaagaucacgaugggaacacuucucaauuccgacagagaucaugccuuccugcaauuucacaacagcaccccgaaagaguucaaggaaucucugcauaauaaccccgcuaaucgccggacaaccccugucuga

SEQ ID NO: 66797 - RNA, 984 nt, Artificial Sequence
  derived and/or modified sequence opt5 from CACNG4__Homo_sapiens__NP_055220
auggugagaugcgaccggggccugcagaugcuccugaccacagccggggcuuucgccgcguuuagccuuauggcuaucgccauuggaacggauuacuggcuguauuccucugcccacaucuguaacggcaccaaucucacaauggacgaugggcccccuccgcgcagagcucggggagaccugacccauagcggccuuuggcgcgucugcuguauugaggggaucuacaagggacacugcuucagaauuaaccauuuucccgaagauaaugacuaugaucacgacuccucugaguaccugcuccggaucguucgcgccagcuccguguucccuauccugucuacaauucugcuccugcuuggcggccuguguaucggggcuggaagaauuuauagccggaaaaacaauaucgugcucuccgccggcauucuguuugucgcggccgggcuuagcaacaucauuggaaucaucguguacauuucuuccaauaccggcgaucccagcgacaagcgcgaugaagacaaaaagaaccauuauaauuacggguggucuuucuacuuuggagcucuguccuucaucguugccgagacagugggcguccucgcugugaacauuuauaucgagaaaaauaaggaacugagauuuaagaccaaacgggaguuccugaaggccucuagcuccagcccuuacgcgcgcaugcccuccuauagauaccggcgcagacggucuagaagcuccagccgcucuacggaagccuccccuagccgggauguuucuccgaugggccucaaaauuaccggggcuauccccaugggagagcugagcauguauacacuuuccagagaaccucugaaggugaccacagccgcuucuuacagccccgaccaagaggccuccuuucuccagguccacgacuucuuucagcaggaucugaaagagggcuuccacgugagcaugcuuaaccgccggaccacgccuguguga

SEQ ID NO: 66798 - RNA, 828 nt, Artificial Sequence
  derived and/or modified sequence opt5 from CACNG5__Homo_sapiens__XP_011522915
augagcgcuugcggcagaaaggcucugacccuccuguccucuguguucgccgucugugggcuuggacugcucggcaucgcgguuagcacagacuacuggcuguaucuugaggaaggggugauugugccccagaaccaauccacggagaucaaaaugucucugcacagcggacucuggcgggucugcuuucuggcuggcgaggaacgcgggagauguuucaccauugaauacgugaugccuaugaauacacagcugaccuccgagucuacaguuaacgugcucaagaugauccggagcgccaccccguuuccccuggucucccuuuucuuuauguucauuggauuuauccugaauaacaucggccauauucgcccucacagaacaauccucgccuucgugagcggcaucuuuuucauucugucugggcuuucccugguugugggacucguccuguauauuagcucuaucaaugaugagaugcugaaccggaccaaagacgcugaaacguacuuuaauuauaaguacggcugguccuucgccuuugcugccauuagcuuccuccugaccgagucugcgggggugauguccguguaucuuuucaugaaacgcuacacagccgaagauauguacagaccccauccuggauuuuaucggccccgccugagcaacugcuccgacuacucuggccaguuccuccacccugaugcuugggucagagggcggagcccguccgacaucagcucugaggccucccugcagaugaauagcaacuaucccgcccuucugaaguguccugauuacgaccaaaugucuagcucccccugcuga

SEQ ID NO: 66799 - RNA, 570 nt, Artificial Sequence
  derived and/or modified sequence opt5 from CACNG6__Homo_sapiens__NP_114103
augauguggagcaacuucuuucugcaggaggaaaauagacggcgcggcgccgcugggagacggcgcgcccacggacaaggcagauccgggcucacccccgagcgggaaggaaaggugaaacuggcgcuucugcucgcugccgucggcgccacacuggcuguucuuucuguggggacggaguucuggguggaacugaacaccuacaaggccaauggaagcgcugucugcgaggccgcgcaucucggccuguggaaagccuguacaaagcgccuguggcaggcugacgugccuguugacagagauaccugcggcccggccgagcuccccgggggacugcuucugcucgugucccuggaagucuuucggcacucugugcgcgcccuucugcagagaguuagcccugagcccccucccgcuccucggcucacauaugaauacuccuggucucugggcuguggggugggagcgggccugauccuccugcuuggggccggaugcuuccugcuccugacccuuccgagcuggcccuggggcucccuguguccuaaacgcggccauagagcuacauga

SEQ ID NO: 66800 - RNA, 1110 nt, Artificial Sequence
  derived and/or modified sequence opt5 from CACUL1__Homo_sapiens__NP_722517
auggaggaaagcauggaggaagaggaaggcggguccuacgaggccaugauggacgaucagaaccacaauaacugggaggcugccguggacggauucagacaaccccugccuccgcccccucccccuucuagcauccccgcgccugcucgggaaccgcccggcgggcagcuccuggccgucccugccguuuccguggaucgcaagggacccaaagagggccuuccuauggggccccagccgccucccgaagcuaauggagugauuaugaugcugaagucuugcgacgccgcugccgcggucgccaaagcugccccugcucccaccgccagcuccacaaucaacauuaauacgucuaccagcaaguuucucaugaacgugaucacaauugaggauuauaaauccaccuacuggcccaagcuggacggcgcgaucgaucagcuucugacacaaagcccuggcgacuauaucccgauuucuuacgagcagaucuauuccuguguuuacaagugcgugugucagcagcauagcgaacaaauguauucugaucucauuaaaaagaucaccaaucaccuggagagagucuccaaagaacugcaggccucucccccugaccucuacauugagcgguucaacaucgcucuggggcaguacaugggagcccuucagagcauugugccccuguuuaucuauaugaauaaguucuacaucgaaacaaaacucaaccgcgaucugaaggacgaucuuauuaagcuguuuaccgagcauguugcugagaaacacaucuauucccucaugccucugcugcucgaagcccaaagcacgcccuuccaggugaccccguccacaauggccaauauugucaagggccuguacacccuuagaccugagugggugcagauggcucccacacuguuuucuaaauucaucccuaacauucugcccccugcgguggaaagcgagcucuccgaauaugccgcucaagaccagaaguuucagcgggagcuuauccagaauggguucacccgcggagaccaaagcagaaaacgggccggcgaugagcuggccuacaacucuuccagcgcuugcgccucuagccgcggguauagauga

SEQ ID NO: 66801 - RNA, 558 nt, Artificial Sequence
  derived and/or modified sequence opt5 from CACYBP__Homo_sapiens__NP_001007215
augcagcaaaagagccagaaaaaggccgagcugcucgacaacgaaaaacccgcugccguggucgcgccuaucaccacaggcuacacgguuaagauuuccaauuaugggugggaucagucugacaaauucgugaagaucuacauuacccugacaggagugcaccaggucccgaccgagaacgugcaaguucauuuuacagaacggagcuucgaucuucuggugaagaaucucaacggcaaauccuauucuaugaucgucaauaaccugcuuaagcccauuagcguggagggguccucuaaaaagguuaaaaccgacacagugcugauccucugcagaaagaaggucgaaaauacccgcugggauuaccugacccagguggagaaagaguguaaggaaaaagagaagccuagcuaugacacggaaacagaucccuccgagggacugaugaacgugcucaaaaagaucuacgaggacggcgaugacgauaugaaaagaaccauuaauaaggcuugggucgaaagccgggagaagcaggccaaaggggacacagaauuuuga

SEQ ID NO: 66802 - RNA, 6678 nt, Artificial Sequence
  derived and/or modified sequence opt5 from CAD__Homo_sapiens__NP_004332
auggccgcucuggugcucgaggacggcagcguccugagagggcagcccuucggagccgcgguuuccaccgcuggcgaagugguguuucaaacagggauggucggauacccugaggcccuuacggauccgucuuauaaggcccagauccuggugcucaccuacccccugauuggcaacuaugggaucccucccgacgaaauggaugaguucggacuuugcaaaugguuugaaagcuccggcauucacguugcugcccugguggucggcgaguguugcccuacacccucucauuggagcgcuacccggacacuccacgaguggcugcagcagcaugggaucccuggacugcaaggcguggacacccgcgaacucacaaagaaacugagagagcaggggucccuucugggaaagcucguucagaauggcaccgaaccgucuagccugcccuuccuugauccuaacgcccggccccuggugccugaggucuccauuaaaacgccccgcguguuuaauaccgggggagcgccgagaauccucgcccuggacuguggccugaaguacaaccagauccggugccucugucaacgcggcgcugaggugacagucguuccuugggaucacgcccuggacagccaggaauaugaggggcuuuuccugucuaauggacccggcgauccugcuuccuaccccagcguggugucuacccucuccagaguccugagcgaacccaacccucggccgguguuugggauuugccuuggacaucagcugcucgcccuggcgaucggcgccaagacauauaaaaugcgcuacgggaauagaggacacaaccagcccugucugcucguuggcucuggccggugcuuccugaccucccaaaaucacggguuugcuguggagacggacagccuuccugccgauugggcuccccuguucacaaacgccaaugacggauccaacgaaggcauuguccauaauucucucccuuuuuucagcgugcaguuucaccccgagcaucaggccgggccguccgauauggagcugcuuuucgacaucuuccuggaaaccguuaaggaggcuacagcgggaaacccuggcgggcaaaccgugcgcgaaagacucaccgagcggcugugucccccuggcauucccacaccuggaagcggccugcccccgccucgcaaaguccucauccuggggucuggaggccuuuccauugggcaggccggagaauuugacuacagcggcucucaggcuaucaaggcccugaaagaggagaauauccagacgcuccugauuaaccccaacaucgccaccgugcaaacaagccaggggcuggcugauaaggucuauuuccuucccauuaccccucacuacgugacacagguuaucagaaaugaacggccggacggcgugcuccugaccuuuggaggccagacggcccugaacugcggggucgagcucacaaaggcgggagugcuggcuagauauggcguucgcgugcuugggacccccgucgaaaccauugagcugacagaagaucggagagccuucgccgcucgcauggccgagaucggagagcacguggcuccuuccgaagccgcgaauucucucgagcaagcccaggcugccgcugaacggcugggcuaccccgugcugguuagagccgcguuugcccuugggggccucggaagcggcuucgcuuccaaccgcgaggagcugagcgcccuggucgcuccugccuuugcccauaccucucaggugcucguggacaaaucccugaagggguggaaagaaaucgaguaugaagucgugcgggaugcuuacggaaauuguguuacagugugcaacauggagaaucuugacccccugggcauucacacgggggaaagcaucgucguggcgccuucucagacccucaacgauagagaguaucaacugcugcgccagacagccauuaagguuacccagcaucuuggaaucgugggcgagugcaauguccaguacgcucucaaccccgaauccgagcaauacuauauuaucgaagugaaugcccggcugagcagauccucugcccuggcuagcaaagccacaggguacccgcucgcguauguugcugccaagcuggcccuuggcaucccucugcccgagcuccgcaacuccgugaccggaggcacggcugccuucgaaccuucugucgacuacuguguggugaaaauuccccggugggaucugagcaaguuucugagagucuccaccaagaucgggagcugcaugaaaucuguuggagaggugaugggcauugggcgguccuucgaggaagcguuucagaaggcucuucgcaugguggacgagaauugugucggauucgaucacacagugaaaccgguuagcgacauggaacucgagaccccuacagacaagagaaucuuuguggucgccgccgcucugugggccggcuauucuguggaucggcuguacgaacucaccagaauugaccgcugguuccugcaucggaugaaaagaaucauugcucacgcccagcuucuggagcaacaccgcggccagccccucccucccgaucugcugcagcaggcgaagugccuuggguucuccgacaagcaaaucgcccuggcuguucucagcacggagcuggccgugagaaaacuccggcaggaacugggaaucugucccgcugucaagcagauugauacaguggccgccgaguggccugcucagaccaacuaucuuuaccugacauacuggggcaccacccaugaccucacauuucgcacgccgcacguucuggugcuggggucuggagucuauagaaucggcagcuccguggaauucgauuggugcgcggugggguguauucaacagcuucggaaaaugggauacaagaccaucauggucaauuauaaccccgagacaguuagcaccgacuacgauaugugcgaccgccuguauuuugaugagauuucuuucgaaguggugauggacaucuacgagcucgaaaacccugagggcgucauccuguccaugggcgggcagcuccccaauaacauggccauggcucugcauagacagcaaugucgggugcuuggaacaagcccugaagccauugauuccgccgagaaucgcuuuaaauucucuagacugcucgacaccaucggcauuagccagccccaguggcgggagcuguccgaccuggaaucugcucgccaauuuugccagacgguuggguauccuuguguggucagaccgagcuacgugcuuuccggagccgcgaugaacguugcuuacacagauggcgaccuggagcgguuccucucuagcgccgccgcuguguccaaggaacaccccgucgugaucagcaaguuuauucaggaggccaaagaaaucgaugucgacgcgguggcuucugaugggguuguggccgccaucgcuauuuccgagcacgucgagaaugccggagugcauagcggcgacgcuacccugguuaccccuccccaggauaucacagccaagacccucgaaagaauuaaagcgaucgugcacgccgucggccaagagcugcaggugacagggccuuucaaccuucagcugauugcuaaggacgaucagcugaaagugaucgaaugcaauguucgcgucucucgguccuuucccuucgugagcaagacgcucggaguggaccuggucgcccuugcuaccagagugaucaugggcgaggaaguugagccgguggggcugaugacaggaucuggcgucguggggguuaaggugccucaauuuuccuucagccgccucgccggagccgaugucgugcugggcguugagaugaccuccacaggcgaaguggcuggguucggagagagccggugcgaagcguaucucaaagccaugcugucuaccggcuuuaagauucccaaaaagaacauccuucugacgauugggagcuacaaaaauaaguccgagcugcuccccaccgucagacugcuugagucucugggauauagccucuacgcuucccugggcacagccgacuucuauaccgaacauggggugaaagugacagccgucgauuggcacuuugaggaagcuguugacggagaguguccuccccagcgcucuauccucgaacagcuggccgagaagaacuucgagcuugugauuaaucugagcaugcggggcgcgggcgggagacgccuguccucuuuugugaccaagggauaccggacaagacggcucgcugccgacuucagcgucccucugaucauugauaucaaaugcaccaagcuuuuuguggaagcccugggccagaucgggccggcucccccucucaaaguucauguggacuguaugacgucccaaaagcugguccgccuccccggacugauugaugugcacguucaccuuagagagccuggcgggacacauaaagaagacuucgccagcggaaccgcggccgcucuggccggcggcaucaccauggugugcgcuaugcccaacacacggccgccuauuaucgaugcccccgcucuggcccucgcgcagaagcuggccgaggcuggggcccgcugugacuuugcucuuuuccugggagccucuuccgaaaaugccggcacccucgggacggucgcuggaagcgcggccggccugaagcuguaucucaacgagacauuuucugagcuuagacuggauuccgugguccaguggauggaacacuucgagaccuggccuagccaucugcccauuguggcucacgccgaacagcaaacaguugccgcugugcucaugguggcccagcugacccagcgguccguccauaucugccacguugcgagaaaagaggaaauccuucugauuaaggccgcuaaagcccgcgggcucccugugacaugugagguggcuccccaccaucuguuccugucucacgacgaucucgagcggcuuggaccgggcaagggcgaagucagaccugagcuggggagccgccaagacguggaagcccugugggagaauauggcgguuaucgauugcuuugccuccgaccaugcuccccacacccucgaggaaaaauguggaagccggcccccuccgggcuuccccgggcuggagacgaugcuuccucugcuccugaccgccgugucugaaggaagacugucccucgacgaucuucugcagcgccugcaccauaacccccggagaauuuuucaccucccuccccaggaggacacauacgucgaaguggaucuggagcaugaguggaccaucccuagccacaugccguucucuaaggcucauuggacacccuuugaaggccagaaggucaaagggaccgugcgcagaguugugcuucggggcgaggucgccuacauugacggacaagugcugguuccucccggcuaugggcaggaugugcgcaaguggccucagggagcugucccccagcucccgccuagcgcccccgcgacguccgaaaugacaaccacacccgagagaccucggcgcggcauccccgggcugccugacggaagauuccaccugccgccccggauccacagagccucugauccuggccuccccgcugaagagccuaaagagaagagcucccgcaaaguggccgaacccgagcuuauggggaccccggacggcaccugcuacccucccccucccgugccucggcaagcuucuccccagaaccugggaacaccgggccugcuccauccucagacgagcccccugcuucacucccugguugggcagcauauucucagcguccaacaguuuaccaaggaucagaugucucaccuguucaauguggcccacacacugagaaugauggugcaaaaggaacgcucccucgacauccuuaaaggaaaggucauggccagcauguuuuaugagguuuccacccggacaucuagcuccuucgcggcugccauggcuagacugggcggggccgugcugucuuuuagcgaagccaccuccagcgugcagaaaggagagucucucgcugauuccguccagacgaugagcuguuacgccgacgugguugugcugcggcauccccagccuggcgcggucgagcuugccgcuaagcacugccgcagaccggugauuaacgccggggauggcguuggagaacaucccacacaagcucugcucgacaucuucaccauucgggaggaacugggcaccgugaaugggaugacaaucaccauggucggagaccugaaacacggccgcacagugcauucucucgccugccuucugacgcaguauagagugucccugcgguacgucgcgccucccagccuccgcaugccucccaccguuagagccuuuguggcuucucgggggacaaagcaggaggaguucgaaagcauugaggaagcccugccugauaccgacgugcuuuauaugacacgcauccagaaagagagauucggauccacccaagaauacgaggcuuguuuuggccaguucauccugacgccccacauuaugacccgggccaagaagaaaauggucgugaugcacccgaugccuagaguuaacgagaucucuguggaagucgauagcgacccccgcgcugccuacuuucggcaggcggagaauggcauguauauuagaauggcccuccuggcuacagugcuggggcgcuucuga

SEQ ID NO: 66803 - RNA, 1245 nt, Artificial Sequence
  derived and/or modified sequence opt5 from CADM1__Homo_sapiens__NP_001091987
auggccagcgugguccugcccuccggcucucagugcgcugccgcggcugccgccgcugccccuccggggcucagacugcggcuucugcuccugcuuuucagcgcugccgcgcugauccccaccggagacggccaaaaccucuuuacaaaggauguuacggugauugagggggaaguggccaccaucuccugucaggucaauaaaucugacgauagcgugauucagcugcugaacccuaaucgccagacaaucuacuucagagacuuucggccccucaaggauucccgcuuccaacugcuuaacuuuucuagcuccgagcugaaaguuagccucaccaaugugucuauuuccgacgaaggaagauauuucugccagcuguacacagauccuccccaggagagcuauaccacaaucaccguccuugugccuccgcggaaccugaugaucgacauucagaaggauacggcuguugaaggcgaggagaucgaagugaauuguaccgccauggcuucuaaacccgccacaaccauucgcugguuuaaggggaacacagagcucaagggaaaauccgaagucgaggaguggagcgacauguacaccgugacgucucaacugaugcugaaggugcacaaagaagaugacggcgucccuguuaucugccagguggagcaucccgcggugacaggcaaucuccagacccagagauaucuggaaguccaauacaagccucaggugcacauucagaugacauauccccuucaagggcugacccgggagggagaugcccucgaacugaccugugaggcuaucggcaaaccgcagccuguuauggugacauggguccgcguggacgacgagaugccccagcaugccguucuuuccgggccuaaccuguucauuaauaaccucaauaagacggauaacggaaccuacagaugcgaagcuagcaauaucgugggcaaggcccacuccgacuacaugcuguaugucuacgauucucgggccggggaggaaggaagcauccgcgcuguggaccaugcggucauuggcggcgugguugccguggucguguuugcuaugcugugucuccugaucauucuugggagauauuucgcccggcacaaaggaacauacuuuacccacgaggccaagggcgcugaugacgccgcggaugcugacacagccaucauuaacgccgaagggggacagaacaauuccgaggagaaaaaggaauauuucaucuga

SEQ ID NO: 66804 - RNA, 1308 nt, Artificial Sequence
  derived and/or modified sequence opt5 from CADM2__Homo_sapiens__NP_001161146
augaucuggaagagaagcgccgugcugcgguucuacuccgucugcggccuccugcuucaggggucucaaggacaguuuccccugacccagaacguuacagugguggagggcgggacggcuauucucaccugucgcgucgaccagaaugauaacacaagccugcaaugguccaauccugcccagcagacccuuuauuucgacgauaaaaaggcgcugagagacaaccggaucgaacucgugcgcgcuucuuggcacgagcugagcauuuccguuucugaugugagccuguccgacgaaggacaguacacaugcagccucuuuaccaugccggucaaaacaucuaaggccuaucugaccgugcuuggcguucccgagaaaccucaaaucuccggguucagcucucccgugauggaaggagaucugaugcagcucacguguaagaccuccggcagcaagccugccgcugacauuagaugguuuaaaaaugauaaggagaucaaagacgucaaguaccugaaagaggaagaugccaaccggaagacauucaccgugucuuccacacuugacuuucgcguggauagaagcgacgacggcgucgcuguuaucugccggguggaucaugagucccugaaugccacgccccagguggcgaugcagguccucgaaauucacuauaccccuucugugaagaucauuccgagcacacccuucccucaagaggggcagccccugauccugaccugugaguccaaaggaaagccucuccccgaaccgguucuguggacaaaagacggcggggagcuuccugaucccgaccgcaugguggucagcggaagagaacugaacauucucuuucugaauaagaccgauaacggcaccuaccggugcgaggccacaaauacgaucgggcagucuuccgcugaauaugugcuuauuguucaugacgugccuaacacccugcuccccacaaccaucauccccagccugacaaccgccacggucacaaccaccguggcuauuacaaccucuccuacaacgagcgccaccacauccucuauccgcgauccgaaugcgcuggccggacaaaacggccccgaccacgcucucauuggcgggaucgucgccgugguuguguucgucacccuguguagcauuuuucuucugggaagauaccucgcucggcauaaaggcacauaccugaccaaugaggccaagggggccgaggaugcuccugacgcggauacggccaucaucaacgcugaaggaucccaggugaacgccgaggagaaaaaggaauauuucauuuga

SEQ ID NO: 66805 - RNA, 1197 nt, Artificial Sequence
  derived and/or modified sequence opt5 from CADM3__Homo_sapiens__NP_001120645
augggcgcccccgcugccagccugcuccugcuucugcuccuguucgcgugcuguugggcuccugggggagccaaccuuucccaggacgauucucaaccguggaccagcgacgagacaguggucgccggcgggacgguugugcugaagugccaggugaaagaucacgaagacuccucucuccaguggagcaaucccgcucagcaaacccuguacuuuggagagaagagagcccugcgggauaaccgcauccagcucgucacauccaccccucaugaacugucuauuagcaucuccaauguggcucuugccgacgagggcgaauauacauguagcauuuucaccaugcccguuagaacagcgaaaucucuggugaccguccucgggaucccucagaagcccauuaucacgggauacaaauccagccugcgggagaaggauaccgccacacuuaacugccagucuuccggcagcaagccugcugcccgccugaccuggagaaaaggcgaccaagagcuccacggggaaccgacacggauccaggaggaucccaauggaaagaccuuuacggugucuuccagcguuacauuccaggugacccgcgaagacgauggcgcuuccauugucuguucugugaaccaugagagccugaaaggggccgacagauccacaagccagcggaucgaggugcuguauaccccuaccgcgaugauucgccccgauccuccccacccgagagaaggacaaaagcuccugcuucauugcgagggccgggggaauccugucccccagcaguaccugugggaaaaagagggaucuguuccuccccucaagaugacacaagaauccgcccugaucuuucccuuccuuaacaagagcgacucuggcacguauggcuguaccgcuacaagcaauaugggguccuacaaagccuauuacacccugaacgugaaugacccuucuccggugcccagcuccagcucuacauaccacgcuauuaucggaggcauugucgccuuuaucguguuccuccugcugaucaugcucauuuuucuggggcacuaucuuauccgccauaagggaaccuaccugacgcacgaggccaaaggcuccgaugacgcuccugaugcggacacagccauuaucaacgcugaagggggacagagcggcggcgaugacaagaaagaguauuucauuuga

SEQ ID NO: 66806 - RNA, 1167 nt, Artificial Sequence
  derived and/or modified sequence opt5 from CADM4__Homo_sapiens__NP_660339
augggcagagcccggcgcuuccaguggccccugcuccugcuuugggcugccgcggcugggccuggagccggccaagaggugcagaccgaaaacgucacaguugccgaagggggaguggcugagaucacgugcagacugcaccaguacgacggcagcauuguggucauccagaauccggcccggcaaacccucuuuuucaacgggacacgcgcucugaaggaugagagauuucagcuugaagaguucucccccagacgcgugcggauucggcugucugacgcccgccucgaggaugaaggaggcuauuuuugucagcuguacaccgaggacacacaucaccagaucgcgacccugacaguucucguggccccugaaaaucccgucguggagguuagagagcaagcuguggaaggcggggaggucgaacugagcugccuugugccucggucccgccccgccgcuacccugagaugguaucgggaucgcaaagagcucaagggagugucuagcucccaggaaaacggcaaagucuggucuguugccagcacggugagauuccggguggacagaaaggaugacgggggaauuaucaucugugaggcgcagaaucaggcccugccuuccggccauagcaaacaaacccaguacguccuugaugugcaguauucuccgacagcucgcauucacgccucccaagcuguugugcgggagggggacacccugguccucacaugcgccgugaccggaaaccccagaccuaaucagauccgcuggaaccggggcaaugaaagccugcccgagagagccgaagcuguuggcgagacgcugacacucccugggcuggugucugcggauaacggaaccuacacaugugaagccuccaauaagcauggccacgcucgcgcccuuuauguccugguggucuacgaccccggggccgugguugaggcucagaccagcgugccguacgccauugucggaggcauccucgcgcugcuuguguuucugauuaucugcguucucguggggauggucugguguucugugcggcagaagggauccuaucugacccacgaggcuagcggccuggaugaacaaggcgaggccagagaagccuuccucaacggguccgacggacauaaacgcaaggaggaauuuuucauuuga

SEQ ID NO: 66807 - RNA, 3768 nt, Artificial Sequence
  derived and/or modified sequence opt5 from CADPS2__Homo_sapiens__NP_001009571
augcuggaccccagcuccucugaggaagagagcgaugaaggccucgaggaagaguccagagacgugcuggucgccgcugggucuagccagcgggccccuccggcgcccacccgcgagggaagacgggaugcuccuggccgcgccgggggaggcggggccgcuagauccguuucucccagcccuuccgugcuuagcgaaggacgggacgagccccaacgccagcuggaugacgaacaggagagacggauccgccuccagcuguacguguucgucgugagaugcauugccuauccuuuuaacgcuaagcaaccgacagauauggcccggcgccagcagaaacuuaauaagcagcaacugcagcuccugaaagagagauuccaggcguuucugaacggcgaaacgcagaucguugccgacgaggcuuucuguaaugccgugcggucuuacuaugaagucuuucucaaguccgaucgcguggcuagaaugguucaaagcggcgggugcucugccaacgacuuccgggagguguuuaaaaagaauauugaaaagagaguccgcucccugcccgagaucgauggacuuagcaaagagaccgugcugucuuccuggauugcgaaguacgacgccaucuaucggggcgaagaggaucucuguaaacagccuaacagaauggcucugagcgccguguccgaacuuauccugucuaaggagcagcucuacgaaauguuccaacagauucuggggaucaaaaagcuggagcaccagcuccuguauaaugcuugccagcuugacaacgccgacgagcaagccgcucagauucgccgggaacuggauggaagacuccagcuggcggacaagauggccaaagagcgcaaguuucccaaauucaucgcuaaggauauggaaaauauguacauugaggaacuucggagcuccgucaaccugcucauggccaaucuggagagccugccuguuucuaaaggcgggcccgaguuuaagcuccagaaacugaagagaucccaaaacagcgccuuccuugacaucggagaugaaaaugagauucagcugucuaagagcgacguggugcucuccuuuacacuggaaaucgucaucauggaggugcagggccuuaaaucuguugcuccgaaccgcauuguguacuguaccauggaggucgaaggcgagaagcugcagacagaucaagccgaagcgagccggccucagugggggacccagggagacuucacaaccacgcaucccagaccugugguuaaagugaaacucuucaccgaguccacaggcguccuggcucuggaagauaaggagcucgggcgcgugauccuguaucccaccagcaauucuuccaagagcgccgagcuucaccggauggucgugcccaagaacucucaggacuccgaucugaaaauuaagcucgccguuagaauggacaaaccugcucauaugaagcacagcggauaccuguaugcccugggccaaaaaguguggaagcgguggaagaaacgcuacuuuguccuugugcagguuucccaguauacauucgcuaugugcucuuacagagaaaagaaaagcgagccgcaagaacucaugcagcuggagggguauaccguggacuacacggauccccauccuggacugcagggcggcuguauguuuuucaacgccgucaaggaaggggacacagugaucuuugcguccgaugacgagcaggaucggauucucugggugcaagccauguacagagcuaccggacagucuuauaaacccguuccugccauccagacacagaagcugaaucccaagggcgggacccuucacgcugacgcccaacuguacgcggaucgcuuccagaaacacggaauggacgaguuuaucagcgccaacccgugcaagcucgaucaugcuuuccuguuucggauucugcagagacagacccuugaccaccgccucaaugauuccuauagcugucugggcugguucucuccugggcaagucuuugugcuggacgaauacugcgccagauauggcgugcggggaugucaucgccaccucugcuaccuggcugagcuuauggaacacuccgagaacggcgccgucaucgaucccacacugcuccauuauagcuucgccuuuugcgcuucucacgugcaugggaauagaccugacggaauuggcacgguuuccguggaagagaaagagcgguucgaagagaucaaggaacgccugagcucucugcuugagaaccagauuagccacuucagauacuguuuucccuucgggcggccugagggagcgcucaaagccacccugucccugcucgaacgcguccugaugaaggacaucgcuacacccaucccggccgaggaagugaaaaagguugugagaaagugccuugagaaagccgcucugauuaauuacacccggcucacagaauaugccaagaucgaggagaccaugaaccaggcgagcccugcucgcaaacuggaagagauucugcaucuugccgaacucuguaucgagguccugcaacagaaugaggagcaccacgccgaggcuuuugccugguggcccgaucugcucgcggaacaugcugagaaguucugggcccuguuuacgguggacauggauacagcccuugaagcucagccccaggacucuugggauuccuucccucuguuucaacuccugaacaauuuccugagaaacgacacccuucugugcaauggcaaauuucacaagcaucuccaggagauuuucguuccgcuggugguccgguacguggaucucauggaaagcuccaucgcccagucuauucacagaggguuugagcaggagaccuggcaacccgugaacaauggcagcgcuacauccgaagaccuguucuggaagcuggaugcccuucagauguuugucuucgaccuccacuggccugagcaggaguucgcgcaucaccuggaacagcgccugaaacuuauggccucugauaugcuggaggcuuguguuaagcggaccagaacagccuuugaacucaaacugcaaaaggcuagcaaaacgaccgaccuccgcauccccgccuccgugugcacaauguucaacgugcuggucgaugccaagaagcagucuaccaaacuuugugcucuggacggaggccaggaguuugggagccaguggcaacaguaucauuccaagaucgacgaucucauugacaacagcgugaaagaaaucauuucucugcugguuuccaaguucgugagcguccuugagggagugcugucuaaacucucccgguacgaugaaggcacauuuuucagcucuauccuguccuuuaccguuaaggcggccgcuaaguauguggacgucccuaaacccgggauggaucucgccgacacguacauuauguucgugagacagaaucaagauauccugcgcgagaagguuaacgaggaaauguauaucgagaaacuuuuugaccagugguacagcuccagcaugaaggugauuugcgucuggcugaccgaucggcuggaccuccagcugcacaucuaccagcuuaaaacacugauuaagaucgugaaaaagaccuauagagauuuccgccuccaaggagugcuggaaggcacacucaauucuaagaccuacgacacgguccaucggagacugacaguugaggaagccaccgcuagcguguccgaagggggcggacuucagggcauuacaaugaaagacucugaugaggaagaggaaggguga

SEQ ID NO: 66808 - RNA, 4062 nt, Artificial Sequence
  derived and/or modified sequence opt5 from CADPS__Homo_sapiens__NP_003707
augcuggaccccagcuccucugaggaagagagcgaugaaaucguggaggaagaguccggcaaggagguccucgggucugccccuagcggagcuagacuguccccgucucggaccagcgaaggcuccgccgggagcgcgggacuuggcgggggaggcgcuggcgccggggccggaguuggcgcugggggaggcgggggaucuggcgccuccagcggcgggggagcuggcgggcugcagcccucuucccgcgccggaggcgggagaccuagcucucccuccccuagcgugguguccgagaaagaaaaggaggagcucgaacggcugcaaaaagaggaagaggaacgcaagaaaagacuucagcuguacgucuucgugaugcggugcauugcguaucccuuuaacgccaagcagccuacagacauggcucgcagacagcaaaagaucucuaaacagcagcuccagacgguuaaggaucgguuccaagccuuucugaauggagagacccagauuauggcugacgaggccuucaugaacgcggugcagagcuacuaugaagucuuucugaaauccgaucgcguggccagaaugguucagagcggcggcuguucugcuaaugacucccgggagguguucaagaaacacaucgaaaagcgcgucagaagccucccggagauugaugggcugucuaaggaaacagugcuuagcuccuggauggccaaauuugacgcuaucuaccggggagaggaggauccccgcaagcaacaggccagaaugaccgccucugcugcgagcgaacugauccucuccaaagagcagcuguaugaaauguuccaaaacauucuuggcaucaagaaauuugagcaucagcugcucuacaaugccugccagcuggacaacccugaugaacaggcugcccaaauucggagagagcuggacgggcgccuccagauggccgaucagaucgcucgggagagaaaguuccccaaauuugugagcaaggaaauggagaauauguauauugaagaacugaagucuuccgucaaccuucugauggccaaucucgagagcaugccuguuucuaaaggaggcgaguucaagcugcagaaacuuaagcgcucccacaacgcgagcaucauugacaugggggaggaauccgagaaucaacugucuaaaagcgacguggugcucuccuuuucucuggaagucgugaucauggagguucagggccuuaagagccucgcucccaaccggaucguguacuguacaauggaggucgaaggaggcgagaagcugcagaccgaucaggccgaagccuccaaaccgacaugggggacccaaggagacuucagcacgacccaugcucugccugccgugaagguuaaacuguucacagagucuaccggcgugcucgcucuggaagauaaggagcuugggagagucauucugcaccccacaccuaauucccccaaacagagcgaguggcauaagaugaccgugucuaagaacugccccgaccaggaucucaaaaucaagcuggccguccgcauggacaaaccucagaauaugaagcacuccggauaccugugggcgauuggcaaaaacguguggaagcgguggaagaaaagauuuuucguucucgugcaagucagccaguauacguuugccauguguucuuaccgcgaaaagaaagcugagccgcaggaacugcuucaacuggauggguauacaguggacuacaccgauccccagccuggccucgagggaggccgggccuucuuuaacgcuguuaaggaaggggacacagugaucuucgccagcgaugacgagcaggaccgcauucuguggguccaggcgauguauagagccaccggacaaucccacaaacccgugccucccacccaggugcagaagcugaaugcuaaaggcgggaacguuccgcagcuugaugccccuaucagccaauuuuacgcugaccgggcccagaagcauggaauggaugaguucaucucuuccaaucccugcaacuuugaccacgccagccucuucgaaaugguccagagacugacacuggaucaucggcucaaugacuccuauucuugucugggcugguuuagcccuggccagguguucgugcuugaugaguacugcgcucgcaacggggucagaggaugucaccggcaccugugcuaccucagagaccugcuggaacgcgcggagaauggcgccaugauugaucccacgcuucuccauuauuccuuugcuuucugugccucucacgugcaugggaaccggccugacggaaucggcaccguuacaguggaggaaaaggagagauucgaagagauuaaagaacgccugagaguccugcucgagaaucaaaucacccacuuucgguacugcuuccccuuugggcgcccggagggagcccugaaggcuacacuuagccugcucgaaagagugcugaugaaagauauuguuaccccugugccccaggaggaagucaagacggugauccggaaaugccuggagcaggccgcgcuuguuaacuauucccgccucucugaauacgcuaagaucgaggagaaucaaaaggacgccgaaaacgugggcagacugauuacacccgccaaaaagcuggaggauaccauccggcucgcugaacuggucauugaggugcuucagcagaaugaggaacaucacgccgagccucacguggacaaaggggaagcguucgcuugguggagcgaccugauggucgagcaugccgaaaccuuucucucccuguucgccguugauauggacgcugcccuggaggugcagccgcccgauacaugggacagcuuuccucuuuuccaacuccugaacgauuuucugcgcaccgacuauaaucucuguaacggcaaguuccacaaacaucugcaggaucuuuuugcuccccugguggucagauacguggaccucauggagucuuccaucgcccagagcauucaccggggauucgaacgcgagucuugggaaccuguuaagucccugacaagcaaccugcccaaugugaaccuuccuaaugucaaccugcccaaggugccgaaucucccuguuaacaucccccugggcauuccucagaugcccacguuuucugcgccguccuggauggccgcuaucuaugaugccgacaaugggagcggaaccuccgaggaucucuucuggaaacuggacgcccuucaaacauucaucagagaucugcacuggccugaagaggaguuuggcaagcaucucgaacagcggcugaaacugauggcuagcgacaugauugagucuugcgugaagagaacccgcaucgccuucgaagucaaacuucagaagacaagccgguccaccgacuuuagagugccccagucuauuuguacgauguucaacguuaugguggaugcuaaggcgcaaagcaccaaacugugcuccauggagauggggcaggaacaccaguaccauucuaagaucgacgagcucauugaggaaacagucaaagagaugaucacccugcucguggccaaguuugugacaauccuggaaggaguccuugcuaaacugagccgcuacgaugagggcacccucuucuccucuuuucugagcuucacgguuaaggccgccuccaaauauguggacgugccuaagcccggcauggaugucgcugacgccuacgugacauuuguucggcacagccaggaugugcugagagacaaggucaaugaagagauguauauugagcgccuuuucgaucaaugguacaacucuuccaugaaugugaucuguaccuggcugacagaccggauggaucuccagcugcauauuuaucagcucaaaacccugaucagaaugguuaagaaaaccuaccgcgacuuucggcuucaaggggugcuggacagcacacugaacucuaagacguaugaaaccauuagaaaucggcucacagucgaggaagcgaccgcuuccgugagcgagggaggcgggcugcagggaaucuccaugaaagauucugacgaggaagaugaggaagacgauuga

SEQ ID NO: 66809 - RNA, 2520 nt, Artificial Sequence
  derived and/or modified sequence opt5 from CAGE1__Homo_sapiens__NP_001164163
augaacaaggacuaccagaaauucuggagcucccccucugauccugugcacuuugaggucgacaccagccaugaaaagguugaguccaugucugaaagcgauacaaugaauguguccaaccugucucaaggcgugaugcucagccacuccccgaucugcauggagacgaccgggacaaccugugaccugccccagaaugaaauuaaaaacuucgagagagagaaugaauaugagagcacacuuugcgaagaugccuacggaacccuggacaaccuccugaaugauaacaauaucgagaacuauucuacaaaugcucuuauucagccugucgacaccaucuccauuagcucucugcggcaguuugagacgguguguaaguuccauuggguugaagccuuugaugacgagaugaccgaaaaacccgaguuccaaucccagguguacaacuaugcgaaggauaauaacaucaagcaggacagcuuuaaagaagagaauccuauggagacaucugucuccgcuaacaccgaucagcucggcaacgaauacuuccgccaacccccuccgagaagcccuccccugauccacugcuccggggagaugcugaaguuuacagaaaaaucucucgccaagagcauugccaaagaguccgcucugaaucccagccagccucccucuuuccuuuguaagaccgccgugccguccaaggaaauccagaacuauggagagauuccugagaugagcguuucuuacgaaaaagaggugacggcugaaggcgucgagcggcccgaaaucgugagcacaugguccucugccgggauuagcuggcgcuccgaggcgugcagagagaauugugaaaugccugacugggagcagagcgccgaaucucugcaacccgugcaggaggacauggcucucaacgagguccugcagaagcugaaacauaccaaucggaagcaagaaguucgcauccaggagcugcagugcuccaaccucuaccuggaaaagagagugaaggagcugcagaugaaaauuacaaagcaacagguguuuaucgaugucaucaauaagcucaaagaaaacguggaggagcugauugaagacaaguauaaaaucauucuugagaagaaugauaccaaaaagacccugcagaaccucgaagagguucuggccaauacacagaagcaccuucaagaaagccggaacgacaaagagaugcugcagcuccaguucaagaaaaucaaggcuaauuacgugugucugcaggagcgcuauaugacggaaaugcaacagaaaaacaagucugucucccaguaccuggagauggauaagacccucagcaaaaaggaagaggaaguggagagacugcagcaacuuaaaaaggagcuggaaaaagccacagcguccgcccucgaccugcuuaagcgggagaaggaagcucaggagcaggaguuucugucucuccaagaagaguuccagaaacuggaaaaggagaaucuggaagaacgccagaaacucaagagcagacuggagaaacuucugacccagguucggaaccuccaauucauguccgaaaacgagcgcacaaagaauauuaaacugcagcagcagaucaacgaagugaagaaugagaacgccaagcugaaacaacaggucgcuagaucugaggagcagaauuaugugcccaaguuugagaccgcccagcuuaaagaucaacucgaagagguccuuaagagcgacaucacgaaagauacaaagaccacccacuccaaccugcucccugacugcagcccgugugaggaacggcugaaucccgccgauauuaagagagcuucucagcuugcguccaaaaugcauagccugcucgcccugauggugggacugcuuacaugccaggacaucauuaacucugacgcugaacacuucaaggaguccgagaaaguuagcgauaucaugcuccaaaagcugaaaucucugcaucucaagaagaaaacccuggacaaggaacuucugaaacacaaggaucgcauuacaacguuucgggagcucaucgccaaagaaaaggccuuccaggaccacgcuaucaaggugauugauugcgacagcgaugaggccaaauccaucagagacgucccuacccugcugggcgcgaaacuugauaaauaccauagccucaaugaggaacuggacuuucugauuacaaagcucggccaucugcuugagucuaaagaaaaccacuguaaucgccugaucgaggaaaacgauaaguaucagcggcaccucgggaaucugauuaaaaaggugaccuccuacgaggagaucauugaaugcgcugaccagagacuggccaucagccauucccaaaucgcccaccuugaggaacgcaacaagcaccucgaggaucugauucggaaacccagagaaaaggcucgcaaaccucggucuaagagccuggagaaucaucccaaauccaugacaaugaugccggcccucuucaaggagaacagaaacgaccuggacuga

SEQ ID NO: 66810 - RNA, 786 nt, Artificial Sequence
  derived and/or modified sequence opt5 from CALB1__Homo_sapiens__NP_004920
auggccgagagccaucugcaguccucucucaucaccgcuagccaauucuuugaaauuuggcugcacuucgacgccgauggcuccggguaccuugagggaaaggaacugcagaaccucauccaggagcugcagcaagcgcggaaaaaggcuggccuugaacugucucccgagaugaaaacauuuguggaccaguaugggcagagagaugacggaaagauuggcaucgucgagcucgcccacguucugccuacggaagagaauuuccugcuccuguuucgcugccagcaacuuaaaagcugugaagaguucaugaagaccuggagaaaguacgauacagaccauuccggguuuauugagaccgaagaacugaaaaacuuccucaaggaucugcuugaaaaagccaauaagacaguggacgauaccaaacuggcugaguauacagaccucaugcugaagcuguuugauucuaacaaugacggaaagcucgaacugaccgagauggcccggcuucugccggugcaggagaacuuccuccugaaauuucagggcaucaagaugugcggcaaagaguucaauaaggcuuuugagcuuuacgaucaggacgggaacggauauaucgacgaaaaugagcuggaugcccuccugaaagaccugugugaaaagaacaaacaagaucucgacauuaauaacaucacgaccuacaagaagaauauuauggcgcugagcgauggcgggaaacuuuaucgcacagaccuggcccucauccugugcgcuggagauaacuga

SEQ ID NO: 66811 - RNA, 816 nt, Artificial Sequence
  derived and/or modified sequence opt5 from CALB2__Homo_sapiens__NP_001731
auggccggcccccagcaacagccuccguaccugcaccucgcugagcugaccgccagccaguuccuugaaaucuggaagcauuuugacgcggaugggaacggauauauugagggcaaagaacuggagaauuucuuucaggaacucgagaaggcuagaaaaggguccggaaugaugucuaagagcgacaacuucggcgagaaaaugaaggaauuuaugcaaaaguacgauaaaaauuccgacgggaagaucgagauggccgaacuggcccagauucuucccacagaggagaacuuccugcucugcuuucggcagcacgugggaucuagcgcugaguucauggaagccuggcgcaaauaugauacggacagauccggcuacaucgaagcuaaugagcugaagggcuuucugucugaucuccugaaaaaggccaaccggccuuaugacgaacccaaacuucaggaguacacccaaacaauucugcgcauguucgaucucaauggggacggaaagcugggccuuagcgagauguccagacugcucccuguccaggaaaacuuucugcugaaguuccaggggaugaaacucaccagcgaggaauuuaaugcgaucuucacauucuaugauaaggaccggucuggauacaucgaugagcaugaacuggacgcccuucugaaagaccucuacgagaagaacaaaaaggagaugaauauucagcaacugaccaacuaucgcaaguccguuaugagccuugcugaagccggcaaacuguacagaaaggaucucgagaucgugcuguguucugaacccccuauguga

SEQ ID NO: 66812 - RNA, 387 nt, Artificial Sequence
  derived and/or modified sequence opt5 from CALCA__Homo_sapiens__NP_001029125
augggcuuccagaaguuuagccccuuccuggcccucuccauccuggugcuucugcaagcugggucucuccacgccgcgccuuuuagaagcgcucuggaguccucuccggccgaccccgccacccuuagcgaagaugaggcucggcugcuccuggccgcucugguccaggacuacguucagaugaaagccuccgaacucgagcaggaacaagagcgcgagggaucuagaauuaucgcgcagaagcgggccugcgauacagcuacgugugugacccaucgccuggccggccuucugagcagauccgggggaguggucaaaaacaauuucgugccuacaaacguuggcagcaaggcuuuugggcggcgcagacgggaccuccaggccuga

SEQ ID NO: 66813 - RNA, 384 nt, Artificial Sequence
  derived and/or modified sequence opt5 from CALCB__Homo_sapiens__NP_000719
augggcuucagaaaguuuagccccuuccuggcccucuccauccuggugcuuuaccaggcugggucucugcaagccgcgccuuuucggagcgcucucgaguccucuccggaccccgccacccugagcaaagaagaugcccgccuucugcucgcugcccugguccaggacuauguucagaugaaggcuuccgagcugaaacaggaacaagagacacagggaucuagcuccgccgcgcagaagagagccugcaacacggcuaccugugugacacaccggcucgccggccugcuuagccgcucugggggaauggugaaauccaauuucgucccuaccaacgugggcagcaaggcuuuugggagacggcgcagagaucugcaggccuga

SEQ ID NO: 66814 - RNA, 1821 nt, Artificial Sequence
  derived and/or modified sequence opt5 from CALCOCO1__Homo_sapiens__NP_001137154
auggaggaaagcccccuguccagagccccuucucggggcggggugaacuuccucaaugucgcucgcaccuacaucccgaacacaaagguugagugccacuauacgcugcccccuggaaccaugcccagcgccuccgacuggauuggcaucuuuaaaguggaagcggcuugugugagagauuaccauacauucgucuggucuagcgugccugaguccaccacagacgggucucccauucacaccagcguucaguuucaagaaccucggccgauggaugagcuugugacacuggaggaagccgacggaggcuccgauauccuccuggucgugcccaaggccaccguucuucagaaucagcuggacgagagccagcaagaacgcaacgaucucaugcagcugaaacugcagcucgagggacaggugacggagcugagaucucggguccaagaacuugagcgcgcucuggccaccgcuagacaggaacauacagagcucauggaacaguauaaggggauuucccggagccacggcgagaucaccgaggaacgcgacauccugucuagacagcaaggcgaucauguggcccggauucuugagcuggaagacgauauccagacaauuuccgagaaagugcucaccaaggaagucgagcuggaccgccugagagauacgguuaaggcgcucacacgggagcaggaaaaacugcuugggcaacugaaggaggugcaggccgacaaagaacagagcgaggcugaacucgagccucugaaggagcagcuucgcggagcccaagaacuggcugccucuucccagcagaaagcgacccuccugggcgaggaacuggccagcgcugccgcugccagagaccggacaaucgccgagcuccacagaucccgccuggagguggcugaagucaaugggcggcuugcggagcugggacuccaccugaaggaagagaagugccaguggucuaaagaaagagccggccuucugcaaagcguggaggcugagaaggauaaaauucucaagcuguccgccgaaauccugcgccucgagaaagccguucaggaggaacggacccagaaccagguguucaagaccgaacuggcuagagagaaagacagcucucuuguccaacuguccgagagcaagcgcgaacucacagagcugcggucugcccugagagugcuucagaaggaaaaagagcagcuccaggaagagaagcaagagcugcuggaauacaugcgcaaacucgaggcgcggcuggaaaagguugcugaugagaaauggaaugaggacgccacgaccgaagaugaggaagccgcuguggggcuuagcugucccgccgcucugacagacuccgaggaugaaucuccugaggacaugagacugcccccguauggacucugcgagcgcggcgauccuggcagcucccccgccgggccucgggaagcgagcccccuggucgugauuucucagcccgccccuaucuccccgcaucuuagcggacccgcugaggacucuuccagcgauuccgaagccgaggacgaaaagucuguccucauggcugccgugcagagcggcggggaggaggcgaaccugcugcucccugaacugggauccgccuuuuacgacauggcuucuggcuucaccguugggacacuuagcgagaccuccacgggaggccccgccacaccuaccuggaaggaaugucccaucugcaaagagagauuuccggcugaaagcgauaaggacgcccuggaggaucacauggacggccauuucuuuuucucuacccaagauccuuuuacauucgaguga

SEQ ID NO: 66815 - RNA, 1413 nt, Artificial Sequence
  derived and/or modified sequence opt5 from CALCOCO2__Homo_sapiens__NP_001248319
auggaggaaaccaucaaggaucccccuacaagcgccgugcugcucgaccacugccauuucucccaggucauuuuuaacucuguugagaaauucuacaucccgggcggggacgugacgugucacuauaccuuuacacaacauuucauucccagacggaaggauuggaucggaauuuuucgcgcuuucaaaugcuuucaggacaagcuggaacaggagcuucugaaauggagaagccagggccaaaagcuccaggugggguggaagaccacacgggaauacuauaccuucaugugggucacacugccuaucgaucuuaauaacaaauccgccaagcagcaggaggugcaauuuaaagcguacuaucugcccaaggacgaugaguacuaucaguucuguuacguugacgaagauggagugguccgcggcgcuucuaucccuuuucaguucagacccgagaaugaagaggacauucucgugguuaccacgcagggggagguggaagagaucgaacaacacaacaaagagcugugcaaggaaaaucaggagcugaaggauagcuguauuucccuccagaaacaaaacucugacaugcaggccgagcugcagaagaaacaggaggaacuugaaacccugcaaagcaucaauaagaaacucgagcugaaggucaaagaacagaaggauuacugggagacagagcuucugcagcucaaggaacagaaccagaaaauguccagcgagaaugaaaagaugggcauucggguggaccaacugcaggcccagcugucuacccaagagaaagaaauggagaagcucgugcagggagaccaggauaaaacagagcagcuggaacaacuuaagaaggagaacgaccaucuguuucucucccugaccgaacagcgcaaagaucagaagaaacuugagcaaacggucgagcagaugaagcagaaugaaacaaccgcuaugaaaaagcagcaagagcugauggacgaaaacuucgaucucagcaagagacugucugagaaugaaaucauuugcaacgcccugcagcggcagaaagagcgccucgagggcgaaaaugaccugcuuaagagagagaacucccggcugcucagcuauauggggcuggauuucaacucucuuccuuaccagguuccgacauccgacgaaggaggcgcucgccaaaaucccgggcuggccuauggaaacccuuacagcggcauccaggaguccucuagccccuccccucucagcaucaaaaagugucccauuugcaaagcggaugacaucugugaucacacccuggaacagcagcaaaugcagccgcugugcuuuaauuguccuauuugcgacaagaucuuccccgccaccgagaagcagauuuuugaggaccacguguucugccauucucucuga

SEQ ID NO: 66816 - RNA, 1527 nt, Artificial Sequence
  derived and/or modified sequence opt5 from CALCR__Homo_sapiens__NP_001158209
augcaguucagcggcgagaagaucuccgggcaaagagaccugcagaaaucuaagaugcgguuuaccuucacaagccgcugccucgcccuguuucuucugcucaaccaccccacgccuauucugccggcuuucuccaaucagaccuaccccacaaucgaaccuaaacccuuucuuuauguggucggaagaaagaaaaugauggaugcccaguacaaguguuaugaccggaugcaacagcugccugcguaccagggcgaggggcccuauugcaaccgcaccugggauggauggcucuguugggacgauaccccugcuggcguucugucuuaccaguucugcccggacuauuuucccgauuucgacccuagcgaaaaggugacaaaauacugugaugagaagggggugugguuuaaacaucccgaaaauaacagaacaugguccaauuacaccaugugcaacgccuucacgccugagaagcugaaaaaugccuauguccucuacuaucuggcuauugugggacacucucuuagcaucuuuacccugguuauuucccucggcaucuucguguuuuuccggaagcugacaaccaucuucccccuuaacuggaaguaccgcaaagcccugagccucggcugucaaagagucacacugcauaagaauauguuucugaccuauauucucaacucuaugaucauuaucauucaccugguggagguugugccgaauggggaacuuguccggcgcgacccuguguccugcaaaauccugcauuucuuucaccaguacaugauggcuuguaacuauuucuggaugcucugcgagggaauuuaccugcacacgcuuaucguggucgccguuuuuacagaaaagcagagacugcggugguacuaucuccugggcuggggguucccccuggugccuaccacaauccaugcgauuacccgcgccguguacuuuaaugauaacuguuggcucagcgucgagacccaucugcuuuauaucauucacggacccgugauggcugcccugguugugaauuucuuuuuccuccugaacaucgucagagugcuuguuacaaaaaugcgggagacgcacgaagcugagucucacauguaccugaaggccgugaaagcgaccaugauucucgucccccugcugggcauccaguuuguggucuucccuuggcgcccguccaacaagaugcucgggaagaucuaugacuacgugaugcauagccugauucacuuucaaggauucuucguugccacaaucuauugcuuuugcaauaacgaagugcagaccacagucaaaagacagugggcucaauucaagauucaguggaaucagcgguggggcagacgccccucuaaccgguccgccagagcugccgccgcugcggccgaggcuggcgauaucccuauuuacaucugucaucaggaacuucgcaaugagcccgccaacaaucaaggggaggaaagcgccgagaucauuccucugaacaucauugaacaggaguccucugcuuga

SEQ ID NO: 66817 - RNA, 1386 nt, Artificial Sequence
  derived and/or modified sequence opt5 from CALCRL__Homo_sapiens__NP_005786
auggagaagaaaugcacccuguacuuccucgugcugcuucccuuuuucaugauccuggucacagccgaacucgaggaaagcccugaggacuccauucagcugggcguuacgagaaacaagaucaugaccgcucaauaugaauguuaccagaaaauuaugcaggauccgauccagcaagccgaggggguguauugcaaucggacaugggacggauggcuuuguuggaacgauguggcggcuggcaccgagucuaugcagcugugccccgacuacuuucaggauuucgacccuagcgaaaaggucacaaaaauuugugaucaggacgggaauugguuucgccaccccgccuccaacagaaccuggacaaauuauacccaaugcaacgugaauacgcaugagaagguuaagaccgcccucaaccuguucuaccugacaaucaucggacacggccucucuauugcuagccugcuuaucucccuggggaucuuuuucuauuuuaaaucucucagcugucagcggauuacccugcauaagaaucuuuucuuuuccuucgugugcaacagcgucgugacaauuauccaccugaccgccguugcuaauaaccaggcccucguggcgacgaauccugucucuuguaaagugucccaguuuauucaucuguaccugaugggaugcaacuacuucuggaugcucugugaaggcaucuaucugcacacacuuaucguggucgccguuuucgcugagaagcaacaccugaugugguacuauuuucucggcuggggguucccccugauuccugccugcauccaugcuauugcccgcagccuuuacuauaaugauaacugcuggaucucuuccgacacccaucugcucuacauuauccacggaccgaucugugcggcccugcuggugaaccucuuuuuccugcuuaauauugugagaguccugaucacaaaacucaaggugacccaccaggcugagagcaaccuguauaugaaggccguucgggcuacccuuauucuggugccccuccugggcaucgaauuuguccugauuccuuggcgccccgaggggaaaaucgccgaagagguguacgauuacaucaugcacauucucaugcauuuccagggacugcuuguuucuacaaucuuuugcuucuuuaauggcgaagugcaagccauucugagacggaacuggaaucaguauaagauccaguucgggaacuccuuuagcaauuccgaggcucuccgcucugcgagcuacacggucuccaccauuagcgacggaccuggcuauucucacgauugucccuccgagcaucugaacggcaaaagcauccacgacauugaaaaugugcugcuuaagccggagaaccucuacaauuga

SEQ ID NO: 66818 - RNA, 1617 nt, Artificial Sequence
  derived and/or modified sequence opt5 from CALD1__Homo_sapiens__NP_004333
auggacgauuucgagagacggcgcgaacugagacggcagaagcgcgaggaaaugagacucgaggccgaacggaucgcuuaccaacgcaacgacgaugacgaggaggaagccgcgagagagcggcgcagacgggcucgccaggaaagacugcggcagaaacaggaggaggaaagccuuggccaagugaccgaucaggucgagguuaaugcccagaacuccgugcccgacgaagaggccaagacaacgaccacaaauacccagguggaaggggaugacgaggcugccuuucuggagcgccucgcuagacgggaagagagacgccaaaaacggcugcaggaagcccuugagagacagaaggaguucgauccuacaauuaccgacgcgucucugagccucccgucccgccggaugcagaacgauacagccgagaaugagaccacggaaaaagaggaaaagucugagagcagacaagaacgcuaugagaucgaggaaaccgagacagucaccaaguccuaccagaaaaacgacuggcgggaugcugaagagaauaagaaagaggacaaggaaaaagaggaagaggaagaggagaagcccaagagaggaucuauuggcgaaaaccagaucaaagacgagaagauuaaaaaggauaaagaaccuaaggaggaagugaaauccuuuauggaccgcaagaagggguucacagagguuaaaagccaaaauggagaguuuaugacccacaagcugaaacauacggaaaacacauucagccggcccggcgggagagccucuguggauaccaaggaggcugaaggagccccucaggucgaggcgggcaaacgccuggaagaacuccggagacggcgcggcgagacagaauccgaggaauuugagaagcugaagcagaaacagcaagaggccgcucuugaacuggaggaacucaagaaaaagagagaggaacggagaaaagugcuggaggaggaagaacagcgccggaagcaggaagaggccgacagaaaacuucgcgaagaggaggaaaagagacggcugaaggaggaaaucgagcgcagacgggcugaagccgccgagaaacgccagaagaugcccgaggaugggcucagcgacgauaaaaagccuuucaagugcuuuaccccgaaaggaucuucccugaagaucgaagagagagcugaguuccugaauaaaagcguucaaaagucuuccggcgugaaaagcacccaccaggcggccauugucuccaagaucgacucucggcucgagcaguauacaagcgcuauugaggggacgaaauccgccaagcccaccaagccugccgcuagcgaucugcccgugccugccgaaggagugcgcaacaucaaaucuaugugggagaagggcaaugucuuuuccagccccacagcggcugggaccccgaacaaagaaacagccggacuuaagguuggcgugucuagcagaauuaaugaguggcugaccaaaacgccugacggcaacaagucccccgccccuaagcccucugaucuccggcccggggacgugagcuccaaacgcaaccugugggaaaagcagagcgucgacaaagugacaucuccuaccaagguuuga

SEQ ID NO: 66819 - RNA, 1041 nt, Artificial Sequence
  derived and/or modified sequence opt5 from CALHM1__Homo_sapiens__NP_001001412
augauggacaaguucagaaugaucuuucaguuccugcaaagcaaccaggaguccuuuaugaauggcauuugcgggaucauggcccucgcuucugcccagauguacagcgcguucgauuuuaacugucccugccugccuggauauaaugcugccuacuccgccggcauucuucuggcuccgccccucgugcuguuccuucuggggcucgucaugaacaauaacguuucuaugcuggccgaagaguggaaacggccucugggacgcagagcuaaggaccccgccgugcuccgguauauguuuuguagcauggcgcagcgcgcccugaucgcuccuguggucuggguggccguuacccuucuggauggcaaaugcuuccucugugcuuuuugcacagccgugcccgucuccgcgcuggggaauggaucucuugccccuggccugccggcucccgaacucgccagacugcuggcucgggugccuugucccgagauuuacgacggcgauuggcuccuggcccgcgaaguugccgugagauaucuucggugcaucagccaagcucuggggugguccuucguccuccugacgacccuucuggcguuuguggugcgcagcgucagaccuuguuucacacaggccgcuuuucucaagucuaaauacuggucccacuauaucgacauugagcggaagcuguucgaugagaccugcacagaacaugccaaggccuucgcuaaaguuuguauccagcaguuuuucgaggccaugaaccacgaccuggaacucggacauacccacggcacacuggcgaccgcucccgccagcgccgcugccccgacgaccccugauggggcugaggaggaacgcgagaaacuuagaggaauuacagaccaaggcaccaugaaucggcugcucacaucuuggcauaagugcaagcccccucugcgccuugggcaggaggaaccuccccugaugggaaacggcugggccggcgggggacccagaccgccccggaaagaaguggcgaccuacuuuuccaagguguga

SEQ ID NO: 66820 - RNA, 972 nt, Artificial Sequence
  derived and/or modified sequence opt5 from CALHM2__Homo_sapiens__XP_006717946
auggccgcucugaucgccgagaacuucagauuucucagccuguucuuuaaguccaaagacgugaugauuuucaauggccuugucgcgcuggggaccguuggaucucaggaacucuuuagcgugguggcuuuccacugccccuguuccccugcccggaacuaccuguauggccuugccgcuaucggggucccggcccuggugcucuuuauuaucggaauuauccugaauaaccauacauggaaucugguugcugagugccaacaccgcagaacgaagaacuguucugccgcgcccaccuuccuccugcuuagcuccauccugggccgggccgcuguggccccugucacauggucugugauuagccuccugcgcggggaggcuuacguuugcgcccuuuccgaguuuguggaucccagcucucugaccgcgagagaagaacauuucccuuccgcccacgcuacagagauccucgcccgguuucccuguaaagaaaauccugacaaccugagcgauuuccgcgaggaagucucuagacggcugcgcuaugagucccagcucuuuggauggcugcuuauuggcgugguggcuauccuggucuuccucaccaagugccugaaacauuacuguagcccgcuuucuuauagacaggaggccuacugggcccaguaucgggcuaaugaagaccaacuguuccagcgcacagcggagguucacuccagagugcucgccgcuaacaaugugcggcgcuuuuucggcuuugucgcccugaacaaggaugacgaggaacugauugccaauuuccccguggaagggacccagccuagaccccaguggaacgcuaucacgggaguuuaccucuaccgggagaaucaaggccugccucuuuauagcagacugcacaagugggcccaggggcucgcgggaaacggcgcugcccccgauaacguggagauggcccugcuuccguccuga

SEQ ID NO: 66821 - RNA, 1035 nt, Artificial Sequence
  derived and/or modified sequence opt5 from CALHM3__Homo_sapiens__NP_001123214
auggacaaguucagaaugcuguuucagcacuuccaaagcuccucugagagcgugaugaacggcaucugccuccugcuugccgcugucaccguuaaacuguacuccucuuuugauuucaauugucccugccucgugcauuauaacgcccuguacgggcuuggacugcuccugacaccuccgcuggcgcucuuucuguguggccuucuggcuaaucggcagagcguggucaugguggaagaguggcgcagacccgccgggcaccggcgcaaggacccuggaauuaucagauauaugugcuccucuguucuccagcgggcccuggcugcuccccuuguguggauucugcucgcccugcuggauggcaaauguuucgucugcgccuuuagcuccagcguggacccugaaaaguuccucgauuuugcgaacaugacgcccucucagguucaacuguuccuugccaaagugccuuguaaggaggacgaacugguccgcgauuccccggcuagaaaggccgugagccgguaccuccgcugccugucucaggcuaucgggugguccgugacccuucugcucauuaucgccgcguuucuggccagaugucugcggcccugcuucgaccagacagucuuucuccagcgcagauauuggagcaauuacguugaucuggagcaaaaacuuuucgacgagaccuguugcgaacaugcucgggauuucgcccaccgcugcgugcugcacuuuuucgcuucuaugagauccgagcuccaggcccggggacugagacgcggcaacgccggccggagacuugaacugccugcugugcccgagccucccgaggggcucgacagcggauccggcaaggcgcaucugcgcgccaucucuagccgggaacaggucgauagacugcucuccacaugguauagcucuaaaccgccucuggaccuugcugccucccccgggcuguguggaggcgggcucagccaccgcgccccuacccuggcucugggaacacggcuuucucagcauaccgacguguga

SEQ ID NO: 66822 - RNA, 450 nt, Artificial Sequence
  derived and/or modified sequence opt5 from CALM2__Homo_sapiens__NP_001734
auggccgaccagcugaccgaggaacaaaucgcugaguucaaggaagccuuuagccucuucgauaaagacggcgaugggacaauuacgaccaaggagcugggaacagugaugagaucccuuggccagaaccccaccgaagcggagcugcaggacaugaucaaugaggucgaugcugacgggaacggaacaauugauuuuccugaguuccucaccaugauggcccggaaaaugaaggacacagauucugaagaagagauccgcgaggccuuuagaguuuucgacaaagauggcaauggguacauuagcgcugccgaacugcggcacgugaugaccaaccuuggagagaagcugacggacgaagagguggaugaaaugauccgcgaggcugacaucgacggcgauggccaggucaauuaugaggaauuugugcaaaugaugaccgccaaguga

SEQ ID NO: 66823 - RNA, 450 nt, Artificial Sequence
  derived and/or modified sequence opt5 from CALML3__Homo_sapiens__NP_005176
auggccgaccagcugaccgaggaacaagugacagaguucaaggaggcuuuuagccucuucgauaaagacggcgaugggugcaucacgaccagagaacugggaacagucaugcggucccuuggccagaaccccaccgaagccgagcugcgcgacaugaugucugagauugauagagacgggaauggaacaguugauuuuccugaguuccucggcaugauggcgcggaagaugaaagacaccgauaacgaagaagagauccgcgaggcuuuuagaguguucgacaaggaugggaauggauuugugagcgccgccgaacugcggcacgucaugacacgccuuggcgagaaacuguccgacgaagagguggaugaaaugauuagagcugccgacaccgacggcgaugggcagguuaacuacgaggaguucgugcggguccucgugucuaaguga

SEQ ID NO: 66824 - RNA, 441 nt, Artificial Sequence
  derived and/or modified sequence opt5 from CALML5__Homo_sapiens__NP_059118
auggccggcgagcugacccccgaagaggaagcucaguacaagaaagccuucagcgcgguggacacagaugggaacggaacgaucaaugcucaagagcucggcgccgcccugaaggcuaccgggaaaaaccuuuccgaagcccagcugagaaagcucauuucugaggucgacagcgauggagacggcgagaucuccuuucaggaguuccugacagcugccaaaaaggcgcgggccgggcuugaagaucugcagguugcuuuucgcgccuucgaccaagauggagacggccacauuaccguggaugaacucagacgggcuauggccggccuggggcagccucugccgcaggaggagcucgacgcgaugauccgcgaagccgauguggaccaggauggaagagucaauuaugaggaauuugcucggaugcuggcccaagaguga

SEQ ID NO: 66825 - RNA, 660 nt, Artificial Sequence
  derived and/or modified sequence opt5 from CALN1__Homo_sapiens__NP_001017440
augcccuuccaccaugugaccgccggccugcucuacaaggggaacuaucugaauagaagccuuuccgcuggaucugacagcgagcagcuggccaacaucuccgucgaagaacucgaugaaauucgggaggcguuucgcguucuggacagagauggcaauggguucaucucuaaacaagaacuuggaauggcuaugcggagccugggcuacaugccuuccgagguggagcucgccauuaucaugcagcgccuggacauggauggggacggacagguggauuuugacgaguucaugacaauucugggcccgaagcucgucucuagcgagggcagagauggguuucugggaaacacgaucgacuccaucuucuggcaguuugauaugcaacggauuacccuugaggaacugaaacacauccucuaucaugccuuccgcgaccaccugacaaugaaggauauugagaauaucauuaucaacgaagaggaaagccuuaaugagaccucuggcaacugccagacagaauuugagggggugcauucccagaaacagaauagacaaaccuguguucgcaagagccugauuugcgcuuucgccauggcuuuuaucaucucugugaugcucauugccgcgaaccagauccugcgguccggaauggaguga

SEQ ID NO: 66826 - RNA, 1155 nt, Artificial Sequence
  derived and/or modified sequence opt5 from CALR3__Homo_sapiens__NP_659483
auggccagagcucuggugcagcucugggccaucugcaugcugcgggucgcgcuugcuaccguuuacuuccaagaggaauuucuggacggcgagcacuggcgcaacagauggcuccagagcacaaaugauucccgguucgggcauuuucgccugucuagcggaaaguucuauggccacaaagaaaaggacaaagggcuucagacgacccagaacggaagauuuuacgccauuuccgcccgguucaagcccuuuucuaauaaaggcaagacacuggugauccaauauaccgugaagcaugagcagaaaauggauugugggggaggcuacauuaaggucuucccugcugacaucgaucagaaaaaccucaauggcaagagccaguauuacauuauguuugggccggacaucugcggauucgauaucaaaaaggugcacguuauucugcauuuuaagaacaaauaucacgaaaauaagaaacugauccgcuguaagguggacggcuucacacaccucuacacccugauucuuagacccgaucuguccuacgacgucaaaaucgaugggcaaucuauugagagcggauccaucgaguaugacuggaaccucacaagccugaagaaagaaaccucuccugccgaguccaaggauugggaacagacgaaggacaauaaagcucaggacugggagaagcauuuucuugaugccagcaccucuaaacaguccgacuggaacggcgaucuggacggggauuggcccgcgccuaugcuccaaaagcccccuuaccaggacggacugaaaccggagggcauucacaaggauguguggcugcaucggaagaugaaaaauacagacuaucucacccaguacgaucugagcgaguucgagaacaucggcgccaucgggcuugaacuguggcaaguucgcucuggaacaauuuucgacaauuuucucaucaccgaugacgaggaauaugcugacaacuucggcaaggccacguggggagagacaaaagggcccgagagagaaauggaugcuauucaggccaaggaggaaaugaaaaaggcgcgggaggaagaggaggaagaacugcuuuccggcaagaucaaucgccacgaacacuacuuuaaccaguuccauagacggaacgagcuguga

SEQ ID NO: 66827 - RNA, 1254 nt, Artificial Sequence
  derived and/or modified sequence opt5 from CALR__Homo_sapiens__NP_004334
augcugcucagcgugccccugcuucugggccuccuggggcuugccgucgcugagccugccguuuacuucaaggaacaguuucuggacggagauggcuggaccuccagauggaucgagucuaaacacaagagcgacuucgggaaauuugugcucuccucuggaaaguucuauggcgaugaagagaaagacaaggggcugcaaacaagccaggaugcgcgguuuuacgcucuguccgccucuuucgaaccguuuagcaacaagggacagacgcucgugguccaguucaccgugaaacaugagcaaaauauugacugcggcggcggguauguuaagcuguuucccaacucccuugaucagacagacaugcacggagauagcgaguacaauaucauguucggcccugacauuugugggcccggaaccaaaaaggugcaugucaucuuuaacuauaaaggcaagaaugugcugauuaacaaggauauccgcugcaaagacgaugaguucacacaccucuacacccugaucguuagaccugacaauacauaugaagugaagauugacaacucucaggucgaauccgggagccuugaggaugacugggauuuucugcccccuaaaaagaucaaagacccggaugccucuaagcccgaggacugggaugaacgggcuaaaauugacgauccuaccgacuccaagcccgaggauugggacaagccugaacauauccccgacccggaugccaaaaagccugaggacugggaugaagagauggacggagagugggaacccccugugauucagaaucccgaguacaaaggcgaauggaagccccgccaaaucgauaacccugacuacaaaggcacguggauucacccggagaucgauaaucccgaauauagcccugaccccucuaucuacgcuuaugauaacuucggggugcucggacuggaccuguggcaggucaaguccggcaccauuuucgauaauuuucucaucacaaacgacgaggccuacgcggaggaguucgggaaugaaaccuggggaguuacaaaggccgcugaaaaacagaugaaggauaaacaggacgaggaacaaagacugaaggaggaggaagaggacaaaaagcggaaggaagaggaggaagccgaggauaaagaagacgaugaggacaaggaugaagacgaggaggaugaagaggacaaagaagaggaugaagaggaggacgugccuggccaggcuaaggaugaacuuuga

SEQ ID NO: 66828 - RNA, 948 nt, Artificial Sequence
  derived and/or modified sequence opt5 from CALU__Homo_sapiens__NP_001124146
auggaccugagacaguuccucaugugccugagccuuuguaccgccuuugcucuguccaagcccacagagaaaaaggaucgggugcaccaugaaccucaacucucugacaaaguccacaacgaugcccagagcuucgacuacgaucaugacgcguuucugggcgcugaggaagccaagacguucgaucagcuuaccccggaggaauccaaagagcgccuggggaugaucguugacaagauugaugccgacaaggauggauuugugacagagggcgaacucaaaucuuggaucaagcacgcucagaaaaaguauauuuacgacaauguggagaaccaauggcaggaguucgauaugaaucaggacgggcugaucagcugggacgaauauagaaacgucaccuacggaacauaucuggaugaccccgauccugacgauggcuuuaauuacaaacagaugauggugcgggacgagcgcagauucaagauggccgauaaggacggggaucucauugcuaccaaagaagaguuuacagccuuccugcaucccgaagaguaugacuacaugaaggauaucguugugcaagaaaccauggaggacaucgacaaaaacgcggauggauuuauugaccuugaggaauacaucggcgauauguauucccacgacggcaauacggaugagccugaaugggucaagaccgagcgggaacaguucguggaguuucgcgacaaaaacagagaugggaagauggacaaagaggaaacaaaggauuggauucugcccucugacuacgaucacgccgaggcugaagcccggcaucucguuuaugagagcgaccagaauaaggauggaaaacugaccaaggaagagaucguggacaaauacgaccuuuucgucggcucccaggcuacagauuucggggaggcccuggugcgccacgacgaauuuuga

SEQ ID NO: 66829 - RNA, 654 nt, Artificial Sequence
  derived and/or modified sequence opt5 from CALY__Homo_sapiens__NP_056537
auggugaagcugggcugcagcuucuccgggaaacccggaaaggacccuggcgaucaggacggggccgcuauggauucugucccgcucaucagcccccuggacauuucccaacuucagccuccccugccugaucagguugugaucaaaacccagacagaguaccaacucucuagccccgaccagcagaacuuuccugaucuggaaggacagagacuuaauuguucccacccggaggaaggccggcgccugcccacggccagaaugauugcguucgcuauggcccuccuggggugcgugcugaucauguauaaggccauuugguacgaccaauuuaccuguccugauggauuccuccugcggcauaaaaucugcacaccccuuacccuggagauguauuacacagaaauggacccugagcgccacagaucuauccucgcugccauuggcgcuuauccccugagccggaagcauggcaccgagacaccggccgcguggggagauggguaccgcgccgcuaaggaagagagaaaaggcccuacccaggccggggcugccgcggccgcuacggaacccccuggaaagcccuccgccaaagcugagaaggaggccgcccggaaagcugcgggcagcgccgcucccccuccggcccaguga

SEQ ID NO: 66830 - RNA, 1074 nt, Artificial Sequence
  derived and/or modified sequence opt5 from CAMK1D__Homo_sapiens__NP_065130
auggccagagagaacggcgaaagcuccucuagcuggaagaaacaggcugaggacaucaagaaaauuuucgaauuuaaggagacccuggggacaggagccuucuccgaagugguccucgcggaggagaaagcuacgggcaagcuguuugccguuaagugcauccccaaaaaggcccuuaaagggaaggaaucuagcauugagaaugaaaucgcugugcugcggaaaauuaagcacgagaacaucguggcccucgaggauaucuacgaauccccuaaucaucuguaucuugucaugcaacuggugucuggaggcgaacucuucgaccgcauuguugagaagggguuuuacaccgagaaagaugcuagcacacugaucagacaggugcuggacgccgucuauuaccuccaccggaugggaauugugcaucgcgaucugaagccggaaaaccuucuguauuacucccaggacgaggagagcaaaaucaugauuucugauuucggccucuccaagauggaaggcaaaggggacguuaugagcaccgcguguggaacacccggcuauguggccccugagguccuggcucagaagcccuacucuaaagccguggauugcugguccaucggggugauugcuuacauccuucuguguggauauccucccuuuuacgacgaaaaugauagcaaacucuucgagcaaauccugaaggccgaauaugaguuugacucuccuuacugggaugacauuuccgacagcgcgaaagauuucaucagaaaccugauggagaaggacccgaauaaacgguauaccugcgaacaggccgcucgccaccccuggauugccggcgauacagcucucaacaagaauauccaugaguccgucucugcccagauuagaaagaacuuugccaagagcaaguggcggcaggcuuucaaugcgaccgccguugugcgccacaugagaaaacugcaccuuggguccagccuggacucuuccaacgcuagcgugucuagcucccucucucuggccagccaaaaggauugugccuacgucgcuaaaccugaaucccuuagcuga

SEQ ID NO: 66831 - RNA, 1431 nt, Artificial Sequence
  derived and/or modified sequence opt5 from CAMK1G__Homo_sapiens__NP_065172
augggcagaaaggaggaagacgauugcagcuccuggaaaaagcagaccacaaacauccggaaaacguucauuuuuauggaggugcuggggucuggagccuucagcgaagucuuucucguuaagcaacgccugaccggcaaacuuuucgcucugaaguguaucaagaaaucccccgccuuuagagacucuagccucgagaaugaaauugcggugcugaagaaaaucaagcacgagaacauugugacacuugaggauaucuacgaauccaccacacauuauuaccuggucaugcagcucgugucugggggagagcuguucgaccggauccuggaacgcggcguuuauaccgagaaagaugcuagccucgugauucagcagguccuguccgccgugaaguaccuucacgagaaugggaucguucauagagaccugaagccugaaaaccuccuguaucuuacaccggaggaaaauagcaaaauuaugaucaccgauuuuggacugucuaagauggagcaaaacggcauuauguccacggccugcggcacccccggguacguggcuccugaaguccucgcccagaaacccuauagcaaggcuguggacuguuggucuaucggagugauuacauacauccugcugugcggcuacccucccuucuaugaggagaccgaauccaaacucuuugagaagaucaaagaaggguacuaugaguucgaaagcccuuuuugggaugacauuucugaguccgccaaggauuucaucugucaucugcuugagaaggacccgaaugaacgguacacaugcgagaaagcgcugagccaccccuggauugauggaaacaccgcccuccaccgcgacaucuauccuuccgucucucugcagauucagaagaauuuugcuaaaagcaaguggagacaagccuucaacgcugccgcgguugugcaccauaugcggaaacuucacaugaaucugcauucccccggcgugcgcccugaagucgagaacagacccccggaaacgcaggccagcgagacaucucggccuuccagccccgagaucaccaucacagaagcuccugugcucgaccacucuguugcccugcccgcucugacccagcuccccugucagcacgggcgcagaccuaccgccccgggaggccggagccugaauugccuugugaacggcucccugcauauuucuagcucccucguccccaugcaccaagggagccuggccgcuggaccuuguggcugcuguucuuccugccuuaauaucgggagcaagggaaagucuuccuacugcagcgagcccacacugcucaaaaaggcgaacaaaaagcagaacuucaaauccgaagugaugguuccugugaaggccucuggcagcucccauugucgcgcugggcagacgggagucugccugauuauguga

SEQ ID NO: 66832 - RNA, 1113 nt, Artificial Sequence
  derived and/or modified sequence opt5 from CAMK1__Homo_sapiens__NP_003647
augcugggcgccguggaggggcccagauggaagcaggcugaagacauccgggauauuuacgacuuccgcgauguccucggaaccggcgccuuuagcgagguuauccuggcggaagacaaaagaacacaaaaacuuguggcuauuaaaugcaucgccaaggaggcccuggaagggaaagagggauccauggagaacgaaauugcugugcuccacaagaucaagcauccuaauaucgucgcccuggaugacauuuaugagucuggcgggcaccuuuaccugaucaugcagcucgugagcggaggcgaacuguucgaucggauuguugagaaaggcuuuuauacggagcgcgacgcuuccagacugaucuuccaggugcucgaugccgucaaguaccugcaugaccuugggauugugcaccgggaucugaaaccggaaaaccuccuguauuacucucuugacgaggauagcaagaucaugauuuccgacuuuggacugucuaaaauggaagaccccggcagcguucucuccaccgcgugugggacaccuggauauguggcccccgagguccuggcucagaagccuuacagcaaggccguggauugcuggucuaucggcgugaucgcuuacauucugcucuguggguaucccccuuucuacgacgaaaaugaugccaaacuguuugagcaaauccuuaaggcggaguaugaguucgacuccccguacugggaugacauuagcgauucugccaaagacuuuauccgccaucugauggaaaaggaucccgaaaagagauuuaccugcgagcaggcucuccagcacccuuggauugccggagacacagcucuggauaagaacauccaccaguccgucagcgaacaaaucaaaaagaauuucgccaagucuaaauggaagcaggccuucaacgcuaccgcgguugugcggcauaugcgcaaacuucagcugggcacaucccaggagggccaagggcagaccgccagccacggagagcuccugacgcccguggcuggcgggccugccgccggauguugcuguagagacugcugugucgaacccggcaccgagcuguccccgacacucccucaucagcuguga

SEQ ID NO: 66833 - RNA, 1470 nt, Artificial Sequence
  derived and/or modified sequence opt5 from CAMK2A__Homo_sapiens__NP_057065
auggccaccaucacaugcacgagauucaccgaggaauaccagcuguuugaggaacucggcaagggggcuuucagcgugguccggcgcuguguuaaagugcuggccggacaagaguaugcggcuaagauuaucaacacaaagaaacuuuccgccagagaccaccagaaacuggaacgggaggcccgcauuugcagacuccugaagcaucccaauaucgugcggcuucacgauucuauuagcgaggaaggccaucacuaccugaucuuugaccucgucaccgggggagagcuguucgaagauaucguggcucgcgaguauuacuccgaggccgacgcuucucauuguauucagcagauccuggaagccguucuccacugccaccaaaugggcgugguccauagagaucugaagccugagaaccuucugcucgcgagcaaacugaagggggccgcugugaaacuugccgacuuuggacuggcuauugaaguugagggcgaacagcaggccugguucggcuuugcggggacaccgggauaucucucccccgaggugcugcggaaggauccuuacggcaaacccgucgaccugugggccuguggggugauccucuauauucugcuugugggauacccucccuucugggaugaggaccagcaccgccuguaccaacagaucaaggcuggcgccuaugauuuuccuucuccggaaugggacaccgucacacccgaggcuaaggaucucauuaauaaaaugcugaccaucaacccuagcaagagaaucacggccgccgaagcucuuaaacaucccuggauuucccaccggagcaccguugcgucuugcaugcaccgccaggagacaguggacugucugaagaaauucaaugccagacggaagcucaaaggggcuauccugaccacaaugcuggccacccgcaacuuuuccggaggcaagagcggcgggaauaagaaaucugacggagugaagaaaagaaaguccucuagcuccguccagcucauggaaagcuccgagucuacgaacacaaccauugaggaugaagacacaaaagugcggaagcaagagaucauuaagguuaccgaacagcugaucgaggccaucagcaauggcgauuucgaauccuacaccaaaaugugcgacccugggaugacagcuuuugagcccgaggcccuuggaaaccugguggaaggccucgauuuccauagauucuauuuugagaaucuguggagccgcaacucuaagccgguccacacgaccauucuuaauccucauauccaccugaugggggacgaauccgcguguauugcuuacauccggauuacacaguaucucgaugccggaggcauccccagaaccgcccaaagcgaggagacacgcguguggcaucggagagacggcaaauggcagaucguucacuuccaccgcucuggggcuccuagcgugcugccccauuga

SEQ ID NO: 66834 - RNA, 2001 nt, Artificial Sequence
  derived and/or modified sequence opt5 from CAMK2B__Homo_sapiens__NP_001211
auggccaccacagugacgugcaccagauucacagacgaguaccagcuguaugaagauaucggcaagggggccuuuagcgucguucggcgcugugugaaacucugcaccggacacgaguacgccgcgaagauuaucaacaccaaaaagcuguccgcuagagaccaucaaaaacuugaacgggaggcccgcauuuguagacugcucaagcacucuaauaucgugcggcugcaugauagcauuuccgaagagggcuuccacuaucuugucuuugaccuggugacagggggagaacucuucgaggauaucguugcccgcgaguacuauucugaagcugacgccagccauugcauccagcagauucuggaggcugugcugcacugucaccagaugggcgucgugcauagagaucucaagcccgagaaccugcuucuggccuccaaaugcaagggggcggccguuaaacucgcugacuuuggacuggccaucgaagugcaaggcgaucagcaggcuugguucggcuuugccgggacaccuggauaccuuucuccggagguccugcggaaggaagcguauggcaaacccguggacauuugggccuguggggugauccucuacauucugcuggucggauacccucccuucugggaugaggaccagcacaagcucuaucaacagaucaaggcuggcgccuacgauuuuccuagccccgaaugggacaccguuacgccugaggcuaaaaaucugauuaaccagaugcuuaccaucaauccggccaagcgcaucacagcccaugaggcucugaaacaccccugggugugccagagauccaccguggcgagcaugaugcaccggcaagaaacagucgagugucucaagaaauucaacgcccgcagaaagcugaaaggggcuauucuuaccacgaugcuggccacacggaauuuuucugugggacgccagaccacagccccugcuaccauguccaccgccgcgagcggcacaacgaugggccucguugaacaggcuaagucucugcugaacaagaaagccgacggggugaagccccaaaccaauuccaccaaaaacagcgccgcugccacaucuccuaagggaacacugcccccggcugcccuggagccucagaccacggucauccauaaucccguggauggcauuaaagaauccagcgacuccgcgaacacaaccaucgaggaugaggacgccaaggcuccuagaguucccgauauucuuucuagcgugcggagaggguccggagcccccgaagcugagggcccucugccgugccccagcccugcccccuucucuccucuccccgcgccguccccucgcaucagcgacauccucaauucuguccggagagggagcggaacccccgaagccgagggcccucuuuccgcugggcccccucccugucugucuccggcccuccugggcccucugagcucccccagcccccgcauuucugauauccucaacuccgugcggagaggaagcggcacaccugaagcugaggggccgucucccgucggaccucccccuugccccuccccuaccauucccggcccgcugccuacacccagccgcaagcaggagaucauuaaaacgaccgaacagcuuaucgaggccgugaauaacggggacuuugaagccuaugcuaagaucugcgauccuggccugacauccuucgagcccgaggcgcucggaaaccugguugaaggcauggacuuccaccgguuuuacuucgagaaucugcuugccaaaaacucuaagccgauucauaccacaauccucaauccucacgugcaugucauuggggaagaugcugccuguaucgccuauauuagacugacccaauacaucgacggacagggccgcccccggacgagccaguccgaggaaaccagaguguggcaccgccgggacgggaaauggcagaacguucacuuucauugcucuggagcuccuguggcuccccugcaauga

SEQ ID NO: 66835 - RNA, 1500 nt, Artificial Sequence
  derived and/or modified sequence opt5 from CAMK2D__Homo_sapiens__NP_001212
auggccagcaccacaacgugcaccagauucacagacgaguaccagcuguuugaggaacucggcaagggggcuuucuccgugguccggcgcuguaugaaaauccccaccggacaagaauaugccgcgaagauuaucaacaccaaaaagcugucugcuagagaucaccagaaacuugagcgggaagcccgcauuugcagacugcucaagcauccuaauaucguucggcugcacgacagcauuuccgaggagggcuuucauuaccuuguguucgaucuggugacagggggagaacucuuugaggacaucgucgcccgcgaauauuacucugaggcugaugccagccacuguauccagcagauucuggaguccgugaaccauugccaccugaauggcaucguucacagagaccucaagccggaaaaccugcuucuggcuucuaaaagcaagggggccgcggugaaacucgccgauuucggacuggcuauugagguccaaggcgaccagcaggccugguuuggcuucgcugggacacccggauaucuuuccccugaagugcugcggaaggaucccuacggcaaaccuguugacaugugggccuguggggugauccucuauauucugcuggucggauaucccccuuuuugggaugaggaccagcaucgccucuaccaacagaucaaggcgggcgccuacgauuucccgagccccgaaugggacaccgugacgccugaggcuaaggaccugauuaauaaaaugcuuaccaucaaccccgccaagagaaucacagcuucugaggcccugaaacacccuuggauuugccagcgguccaccguggccagcaugaugcaucgccaggaaacagucgauugucucaagaaauuuaaugcuagacggaagcugaaaggggcgauccuuaccacgaugcuggccacacgcaacuucucugcugccaagucccuccugaagaaacccgacggaguuaaggagagcaccgaaucuuccaauacaaccauugaggaugaagacgugaaagccagaaagcaagagaucauuaaagugaccgagcagcugaucgaagcuaucaacaauggcgauuuugaggccuacacaaagauuugcgacccgggccucacggcguucgaaccugaggcucuggggaaccuugucgaaggaauggauuuccaccgguuuuauuucgagaaugcccugagcaaguccaacaaacccauccacaccauuauccucaauccucaugugcaccugguuggcgacgaugccgcuuguauugccuacaucagacuuacacaguauauggacgggucuggaaugcccaagaccaugcaaagcgaggaaacacgcguguggcaucggagagauggcaaauggcagaacguccacuuucaucgcuccgggagccccaccgugccuaucaagccgcccugcauuccuaacggaaaagagaauuucucuggcggcacgucccuguggcagaacaucuga

SEQ ID NO: 66836 - RNA, 1488 nt, Artificial Sequence
  derived and/or modified sequence opt5 from CAMK2G__Homo_sapiens__NP_001213
auggccaccacagcuacgugcaccagauucacagacgauuaccagcuguuugaggaacucggcaagggggccuucagcgugguccggcgcuguguuaaaaagaccuccacacaagaguaugcggcuaaaaucauuaacaccaagaaacugucugccagagaccaccagaaacuugaacgggaggcccgcaucugcagacugcucaagcaucccaauauugugcggcugcacgauagcaucuccgaagagggauuucauuaccuuguguucgaccuggucacaggcggggagcucuuugaagauauuguggcucgcgaguauuacucugaagccgacgcuagccacuguauccaucagauccuggaguccguuaaccacauucaccagcaugauaucgugcacagagaccugaagccugagaaucuccugcuugccucuaagugcaaaggagcggccgucaagcuggcugauuucggccucgccauugaagugcaaggggagcagcaggcuugguuuggauucgccggcaccccgggcuaucugagccccgaaguucuucggaaagacccuuacgggaagcccguggauaucugggcguguggagucauucuguauauccuccuggugggcuacccucccuuuugggacgaggaucagcauaagcuguaccaacagauuaaagccggggcuuaugacuucccuuccccggaaugggacacggugacccccgaggccaagaaccucaucaaucagaugcugacaaucaacccugcuaaacgcauuaccgccgaucaggcccuuaagcaccccugggucugccaaagaagcacaguugcuucuaugaugcaccggcaggagaccguggaaugucugcgcaaauuuaaugcgagacggaagcucaaaggagccauccugacgacaaugcuugugucccgcaacuucagcgcugccaagucucugcucaauaagaaauccgacggcggggucaaggagccucagaccacagugguucauaacgccaccgauggaauuaaaggcagcaccgaaucuugcaauacaacgaccgaggacgaagaucugaaggugagaaaacaagagaucauuaagaucacagagcagcugaucgaagcuauuaacaauggcgacuuugaggccuacaccaagaucugugaucccgggcucacauccuucgaaccggaggcgcugggaaaccuugucgaaggcauggacuuccacaaauuuuauuucgagaaucugcucagcaagaacuccaaaccuauucauaccacgauccugaacccccacgugcauguuauuggggaggaugcugccugcaucgccuacauccggcuuacacaguauauugacggacagggcagaccucgcaccucucaaagcgaagagacccggguguggcacagacgcgaugggaaguggcugaauguccacuaccauuguuccggagcucccgccgcuccccuccaguga

SEQ ID NO: 66837 - RNA, 1422 nt, Artificial Sequence
  derived and/or modified sequence opt5 from CAMK4__Homo_sapiens__NP_001735
augcugaaggugaccguccccagcugcuccgccucuagcuguuccucuguuacagcuagcgccgcgccuggcacggcuucccucgugccggacuacuggaucgaugggucuaacagagacgcccugagcgauuucuuugagguggaauccgagcuuggacggggcgccaccagcauugucuaucgcugcaaacagaaggggacacaaaaacccuacgcucugaaggugcucaaaaagaccguugacaagaaaaucgugagaacagaaauuggaguccugcuucggcugucucacccuaauaucauuaagcucaaagagaucuucgaaacccccacagagaucucccuggugcuggagcucguuaccggcggggaacuguuugaucgcauuguggagaagggauauuacagcgaaagagacgccgcugaugccgucaaacagauccuugaggcgguggccuaucugcaugagaacggcauugugcaccgggaccucaagccugaaaaucugcuuuacgcuacgcccgccccugaugcuccgcugaagaucgccgacuucggccucucuaaaauugucgagcaucagguucugaugaagaccgugugugggacacccggauauugcgcgccugaaauccugcgcggcugugccuacgggcccgagguggauaugugguccgucggaauuaucaccuacauccuccugugcggcuuugaaccuuucuaugacgagagaggggaucaguuuauguuccggcgcauucuuaacugugaguacuauuuuaucagccccuggugggacgaagugucucugaaugcuaaagaccucguuagaaagcugauugugcuugauccgaaaaagcggcugacaaccuuccaagcccuccagcacccuugggucacgggaaaagcugccaacuuugugcauauggacacagcccagaagaagcugcaggaguucaaugcucgcagaaaacugaaggcggccguuaaagcuguggucgccuccagccggcucggcuccgccucuagcucccacggcagcauccaagaaucucacaaggcuucccgcgaucccagcccuauucaggacgggaacgaggauaugaaagccauccccgaaggagagaagauccagggcgacggggcgcaggcugccgugaagggagcccaagcugagcugaugaaaguccaggcccuugaaaaggugaaaggcgcugauauuaaugccgaggaagcgcccaagaugguuccuaaagccguggaggacgggaucaaggucgcugaucuggaacucgaggagggacuggccgaagagaaacuuaagaccguggaagaggcugccgcgccgagagagggccagggcucuagcgccguuggguuugaagugccccaacaggacgucauucugccugaguacuga

SEQ ID NO: 66838 - RNA, 1518 nt, Artificial Sequence
  derived and/or modified sequence opt5 from CAMKK1__Homo_sapiens__NP_757343
auggagggcgggcccgccgugugcugucaggacccuagagcugaacuggucgagcggguugccgcgaucgaugugacccaccucgaagaggcugacggaggcccggaacccacacgcaacgggguggauccucccccuagagcccgggccgcuagcgucauucccggauccacgucucgccugcuuccugccagaccgagccuguccgcucggaagcucucucugcaagagcgccccgccggcagcuaccuugaggcgcaggccgggccuuaugcuaccggacccgccucccauaucucuccuagagcuuggcggcgccccacaauugaaagccaccauguggccaucuccgacgcggaggauugcguucagcugaaucaguacaaacuccaaagcgaaauuggcaagggcgccuaugggguggucagacuggcuuacaacgagucugaggaccggcacuaugccaugaaagugcuguccaagaaaaagcuccugaagcaguacggauucccgcgcagaccucccccucggggcagccaggcugcccaagggggacccgccaaacagcuucugccccucgaacgcguuuaucaggagaucgcuauccugaagaaacuugaucaugugaaugucgugaagcugauugaagugcucgacgauccugcggaggacaaccuguaccuggucuuugaucuccugagaaaaggcccgguuauggaagugcccugugacaagccuuucucugaggagcaggcccggcuuuaccugagagaugugauccucgggcuggaauaucuucacugccagaagauuguccaccgcgacaucaaacccuccaaucugcuccugggagacgauggccaugugaagauugcugacuuuggcguuagcaaccaauucgaggggaaugaugcccagcugucuuccaccgccggaaccccugcuuuuauggcccccgaagcgaucagcgacuccggccagucuuucagcgggaaagcucucgaugugugggccacaggagucacacuguacuguuuuguguauggcaagugcccguucauugacgauuuuauccuugcccugcaccggaaaaucaagaacgagccuguuguguuccccgaagaaccugagauuuccgaggagcucaaagaccugauccuuaagaugcuggauaagaaucccgaaaccagaauuggggucccugacaucaaacuccaucccugggugacgaagaacggagaggaaccgcugccuagcgaggaggaacacuguucugucguggagguuaccgaagaggaggugaaaaauuccguccgccugauucccagcuggacaaccgugauccucguuaagucuaugcugcggaaacgcagcuuuggcaaccccuucgaaccucaagcuagacgggaggaaagauccaugucugccccgggcaaucuucuggugaaggagggguuuggagaaggcggaaagagccccgagcucccugggguccaggaggaugaagcugccuccuga

SEQ ID NO: 66839 - RNA, 1767 nt, Artificial Sequence
  derived and/or modified sequence opt5 from CAMKK2__Homo_sapiens__NP_001257414
augagcuccugcgugucuagccagcccuccucuaacagagccgcuccucaagacgagcugggcgggcggggaagcuccucuagcgaaucccagaagccgugugaggcccuccgcggccugagcucucuuuccauccaccuggggauggaauccuucauugucguuaccgagugcgaacccggaugugcgguggaucucggccuggcuagagaccggccucuugaggccgaugggcaggaggugccccuggacacaucuggaucccaggcccgcccucaucucagcggcagaaaacugucucugcaagaacggucccagggcgggcucgcugccggaggcagccuggauaugaaugggcgcugcaucugucccucccuuccuuacucuccggucagcagcccccagagcucuccuagacugccccggcgcccuacgguggagucccaccauguuagcauuaccggaaugcaggacugcgugcaacucaaccaguauacacugaaggaugaaaucggcaaagggucuuacggagucgugaaacuugcuuauaaugagaacgacaauaccuacuaugccaugaagguucugagcaagaagaaacucauuagacaggcgggcuuuccccggcgcccgccucccagaggcacacggccugcccccgggggauguauccagccccgcggcccuaucgagcaaguguaccaggaaauugcuauccugaagaaacuggaucacccgaacgucgugaagcucguggagguccuggacgaucccaaugaagaccaucuuuauaugguuuucgagcuggugaaccaggggccugugauggaaguccccacccucaaaccucuguccgaggaucaagccagauuuuacuuccaggaccuuauuaagggaaucgaguaccugcacuaucagaagauuauccaccgggacauuaaacccucuaaucuccuggugggcgaagaugggcauaucaagaucgcugacuuuggaguuagcaacgaguucaaaggcuccgaugcccugcucagcaauacagugggcaccccggcguuuauggccccugaaucucuguccgagacgagaaagauuuucagcgggaaagcucuugacgucugggccaugggagugacccuguacugcuuuguuuucggccagugucccuuuauggaugaacgcaucaugugccuccacucuaagauuaaaucccaagcucuggaguucccugaccagcccgauaucgccgaggaccuuaaggaucugauuacacggaugcucgacaagaacccugaaagcagaaucgugguccccgagaucaaacugcauccgugggugacccgccacggggccgaaccucugcccuccgaggaugaaaauuguacacucgucgaggugaccgaggaagagguugaaaacucugugaagcacauucccagccuggcuacggucauccuugugaaaacaaugauucggaagagauccuuuggaaauccuuucgagggcucucgccgggaggaaagaagccuguccgcgccggggaaccuccugaccaaaaagcccacacgcgagugcgaaagccugucugagcuuaaggaagcccggcagagacgccagccucccggccaucggccugcucccagaggaggcgggggauccgcccucguucggggcagcccuugcguggagucuuguugggcccccgcuccgggguccccugcccgcaugcacccccugagaccugaggaagcgauggagcccgaauga

SEQ ID NO: 66840 - RNA, 972 nt, Artificial Sequence
  derived and/or modified sequence opt5 from CAMKMT__Homo_sapiens__NP_079042
auggagagcagaguggccgacgcuggcaccggggaaacagcccgggcggcuggaggcucccccgccgucgggugcacgacccgcggaccuguugugucugccccgcugggcgcugccagauggaagcuccugcgccaggugcuuaaacaaaagcaccuggaugacugucuccggcaugucagcgugagacgguucgaguccuuuaaccuguucucuguuacagaagggaaagagcgcgaaaccgaggaggaagugggagcuuggguccaguacacaagcaucuuuugccccgaguauuccauuucucuuagacacaauagcggcucccugaacguggaagauguucucaccagcuucgacaauacaggcaacguguguaucuggccuucugaggagguccuggccuacuauugccugaagcauaauaacauuuuucgggcgcucgccgugugugaacuugggggaggcaugaccugccuggcugggcugaugguggccaucuccgcugaugucaaagagguucuccugacggacggaaaugaaaaggccauucgcaacgugcaggauaucaucaccagaaaucagaaggcgggcguguucaaaacacaaaagauuagcucuuguguccuucggugggacaacgagaccgaugugucccagcuggaagggcacuuugacaucguuaugugcgccgauugucucuuccuggaccaguaccgcgcuagccugguggaugccauuaaaagacuccugcagccccggggaaaggcuauggucuuugccccucgcagaggcaauacacuuaaccaauucugcaaucuggccgagaaagcuggcuuuuguauccagcggcaugagaacuaugacgaacacauuucuaauuuccacuccaagcucaagaaagagaaccccgacaucuacgaagagaaccugcauuauccucuucugcucauucugaccaagcacggguga

SEQ ID NO: 66841 - RNA, 891 nt, Artificial Sequence
  derived and/or modified sequence opt5 from CAMLG__Homo_sapiens__NP_001736
auggagagcauggccguggcuaccgacggcggggaaagacccggagucccugccggcuccgggcugucugcgagccagcggcgcgcugagcucagacggcgcaagcugcuuaugaacuccgaacaaagaaucaaucggauuaugggauuccaccgcccgggcucuggggccgaggaagagagccagacaaaauccaagcagcaggauucugacaaacugaacagccucuccguucccagcgugucuaagagagugguccugggagauuccgugagcacgggcaccacagaccaacagggcgggguugccgaggugaaaggaacccagcuuggcgauaagcuggacucuuuuaucaagccucccgaaugcuccagcgaugucaaucucgagcugcggcagcgcaacagaggggaccugacagcugauucugugcaacggggaucccgccauggccucgaacaguaccugagcagauucgaggaggccaugaaacuucggaagcagcugauuuccgaaaaaccuucucaggaggacgggaauaccacagaagaguuugauagcuuccgcaucuuuagacucguuggaugugcucugcuugcccugggcgugcgggcguucgucugcaaguaucucuccauuuuugcccccuuccugacccugcaacucgcuuacaugggccuguauaaauacuuuccuaagagcgaaaagaaaaucaagacgaccgugcuuacagccgcucugcuccugucugggaucccggccgaggugauuaacagauccauggacaccuauagcaaaaugggagaggucuucacagaucuuuguguuuacuuuuucaccuuuaucuucugccacgaacugcucgacuauuggggcucugaggugcccuga

SEQ ID NO: 66842 - RNA, 522 nt, Artificial Sequence
  derived and/or modified sequence opt5 from CAMP__Homo_sapiens__NP_004336
augggcaccaugaagacacagagagacgggcacagccugggacgguggucccucgugcugcuucugcucggccuggucaugccccuugccaucauugcucaaguucugucuuacaaagaggccgugcuccgcgcgaucgaugggauuaaccagagaagcuccgacgcuaaucuguaucggcugcucgaucuggacccucgcccgacgauggauggagaccccgauaccccuaagcccgugucuuucacagucaaagaaaccgugugcccuagaacaacccagcagagccccgaggacugugauuuuaagaaagacggccuuguuaagcggugcauggggacagugacccugaaccaagcccgcggauccuucgauaucucuugugacaaggauaauaaaagauuugcccuccugggcgacuucuuucgcaagagcaaagaaaagauuggcaaagaguucaagcggaucguccagagaaucaaggacuuucuucggaaccuggugccucgcacggaauccuga

SEQ ID NO: 66843 - RNA, 4809 nt, Artificial Sequence
  derived and/or modified sequence opt5 from CAMSAP1__Homo_sapiens__NP_056262
augguggacgccagcggcagagcugccgcggagggguggcggaagauggaagcucccccugauggagccgccgaccuggucccgcucgaucgcuacgacgcugccagagcuaaaaucgccgcgaaccugcaguggauuugcgccaaggcuuauggccgggauaauauccccgaggaccuucgcgauccuuucuacguugaccaauaugaacaggagcacauuaaacccccugugaucaagcugcuccuguccucugaacuuuacuguagagugugcagccugauucucaaaggggaucaggucgccgcucugcagggacaucaauccgugauccaggcccugucucggaagggcaucuauguuauggagagcgacgauacccccgugacagaguccgaccucucucgcgcgccuauuaagaugagcgcccacauggcuauggucgaugcccugaugauggcuuacacgguggaaaugaucuccauugagaaaguuguggccagcgucaagagauuuucuaccuucuccgccagcaaagaacuuccguaugaccuggaggacgcuaugguguuuuggaucaacaaggugaaucucaaaaugcgggagauuacagaaaaggaggucaagcugaaacagcagcuucuggaaucucccgcgcaucaaaagguucgcuacagacgggagcaccucuccgcccgccagagcccuuacuucccccugcuggaagaucucaugagagacgggucugauggagcugcccugcuugccgugauccauuauuacuguccugagcagaugaaacuggacgauauuugccucaaggaggugaccuccauggcugacagccuguauaacauccggcuucugcgcgaauuuuccaaugaguaccucaacaaauguuucuaucugacacuggaagauaugcucuacgcuccccugguccuuaagccgaaugugaugguuuuuaucgcggagcuguucuggugguuugaaaacgugaaaccugacuucguccagcccagagaugugcaagagcucaaggacgcuaagaccguucugcaccagaaaucuagccggccucccgugcccauuuccaaugccacaaagagaucuuuucuuggcucuccugccgcuggcacccuggccgagcuccagccgcccguccaacugccugcugaagggugccaccgccauuaucugcaccccgaggaaccugaguaccucggaaaaggcacggccgcguucucccccagccauccgcugcuuccucugcggcagaagcagcagaaaucuauccaaggggaagauauucccgaccagagacaccgcagcaacucccucacccggguggacggacagccuagaggcgccgcuaucgccuggcccgagaagaagacacgcccugcuucucagcccaccccguuugcccugcaccaugcggccagcugugaggucgauccuuccagcggggacucuauuucccuggcucggagcaucucuaaagauucccuugccagcaauaucgugaaccucacaccccaaaaucagccccacccuaccgcuacgaagucccauggaaaaucucugcugagcaacguuuccauugaagacgaggaagaggagcucguggccaucgucagagccgaugugguuccgcagcaggcugaccccgaguucccucgcgcgucuccccgggcccugggccuuacagcuaaugccagaagcccucaaggccagcuggauaccuccgaaagcaagcccgacucuuucuuucucgaaccucugaugcccgccgugcugaaaccggcuaaggagaagcaggucauuacaaaagaagaugagcgcggggagggacggccuagauccaucgugagccggcgccccucugaaggcccucagccccuugugagacggaagaugaccggguccagagaccucaaccgcaccuucacaccgauuccuugcagcgaguuucccaugggaaucgauccuacggaaaccggcccccugucuguugagacagccggggaagucuguggaggcccccuggcgcucggcggguucgacccuuuuccgcaaggacccagcaccgauggcuucuuucugcacguggggcgggcugacgaggacacagagggaagacuuuacguguccugcagcaaaucuccuaacucccaugauagcgaacccuggacccugcuccgccaggacuccgauucugacgucguggauaucgaggaagccgagcacgacuucaugggcgaagcccacccuguuguguuuagcagauauauuggggaggaggaauccgcuaagcugcaggaggauaugaaagucaaggaacaugaggacaaggaugacgccucuggccggagcucccccugucugucuacggcgagccaaauguccagcgugucuauggcuuccggaagcguuaaaaugacaucuuucgccgagcgcaaacuucagagacucaauuccugcgaaaccaagagcucuaccuccagcucccagaagacaaccccugaugccagcgagucuugcccggcuccccugacaacguggcggcagaaacgcgaacaaagcccuucccagcacggcaaggaccccgccucucugcucgcuagcgagcuggugcagcuucauaugcagcuggaagagaaaagacgggccaucgaggcgcaaaagaagaaaauggaagcccucuccgcucgccagagacugaagcuggggaaagccgcuuuucuucacgucgugaagaaaggaaaggccgaggccgcuccuccccuccggccggaacacuucgcgaaggaguacucucagcauaacggcgaagauuguggggacgccguuagcaaaaccgaggacuuucuggugaaggaggaacagcgcgaggaacugcuccacgagccucaagaugucgacaaagaaucccuggcuuucgcccagcagcauaaggccaaagaucccguggcccuucacgagcuggagagaaauaaggugauuucugccgcgcuccuggaagacacagucggagagguuguggaugugaacgaaugcgaccugagcaucgagaaacuuaaugagaccauuuccacacugcaacaggcuauccucaagauuagccagcagcaagaacagcugcucaugaagucucccaccgucccugugcccggcuccaaaaacaauagccaggaucauaagguuaaagccccugugcacuucgucgagccgcugucucccacggggguggccggccaccggaaggcuccuagacuuggacagggccgcaacucccggagcgggagacccgccgaacugaagguuccuaaagaccgcccccaaggauccucucggagcaagaccccgacaccuuccguggagacccucccccaucugagaccuuuucccgcgagcucucacccucgcacacccaccgauccgggccuggacuccgcucuugaaccuagcggggauccccauggaaaaugucuguucgacucuuaucggcuccacgacgagagcaaucagagaacgcugacacucuccucuagcaaggaugccaacauccuguccgagcagaugucucuuaaagaaguccuggacgccagcgugaaggagguuggcuccagcagcuccgaugugagcgggaaagaauccguccccguggaggaaccucuccgcucucgggcuagccugaucgagguggaccuguccgaucuuaaggccccggacgaggauggcgaacuggucucucucgacggaagcgcugaucugguuuccgagggcgaccagaagcccggggugggauuuuucuuuaaagaugaacaaaaggccgaggacgaacucgcgaaaaagagagccgcuuuccugcuuaaacagcagcggaaggccgaggaggcucgcgugagaaagcagcaacuggaagccgaggucgaacugaaacgggaugaggcccgcagaaaggcugaggaagaccgggugagaaaagaggaagagaaggcgcgccgggaacucauuaaacaggaguaccugagacgcaagcagcaacagauccuugaggaacagggccuggggaagccuaaaagcaagcccaaaaagccucggcccaaaucuguucauagagaggaauccugcagcgacucuggaaccaaguguuccagcacaccugauaaucucucucgcacccagagcggcuccucucugagccucgccuccgcugccaccacagagccggaaagcgugcacuccgggggcacgcccucucaacgggucgagagcauggaggcccugccuauucuuuccagaaaccccucucgcagcaccgacagagauugggaaacagcuuccgccgcgucuagccuggcuuccguggccgaguauaccggaccuaagcuguuuaaagaacccagcucuaaguccaauaaaccgaucauucacaacgccaucagccauugcugucucgcuggcaagguuaaugagccucacaaaaacucuauccuggaggaacuugagaagugcgacgccaaccauuacauuauccuguuccgggaugcggggugucaguuucgcgcccucuauugcuacuaccccgacacagaagagauuuauaagcugaccggaacgggccccaaaaauaucacaaagaaaaugauugauaagcucuacaaauauuccagcgacagaaagcaguucaaccugaucccugcuaaaaccaugucuguguccgucgaugcccuuaccauccacaaucaccuguggcagcccaagcggccugcugugccgaagaaagcccaaacacgcaaguga

SEQ ID NO: 66844 - RNA, 4470 nt, Artificial Sequence
  derived and/or modified sequence opt5 from CAMSAP2__Homo_sapiens__NP_001284636
augggcgacgccgcugaucccagagagaugcggaaaaccuucaucgugccugccauuaaaccguuugaccacuacgauuucagccgcgcgaagaucgcuugcaaccuggccuggcucgucgccaaggcuuuugggacagaaaauguucccgaggaacugcaggagccuuucuauacggaccaauacgaucaggaacauauuaagcccccuguggugaaccuucugcucuccgccgagcuguauuguagagcuggaucucuuauccugaaaagcgacgccgcgaagccccuccugggccacgaugccgucauucaggcucuggcccagaaggggcucuacgugaccgaccaagagaaacugguuacagaacgggaucuucauaagaaaccuauccagauguccgcucaccuggccaugaucgacacccucaugauggcguauacaguggagauggucucuauugaaaaggugaucgccugcgcucagcaguacagcgccuuuuuccaagcuaccgaucugccguaugacauugaggaugccguuauguacuggaucaauaaagugaacgagcaucuuaaggacauuauggaacaggagcagaagcugaaagaacaccacacagucgaggcccccggaggccagaaguccccuucuaaaugguuuuggaagcucgugcccgcucgcuacagaaaagaacaaacccugcugaagcagcucccuuguaucccccugguggagaaucuucugaaagacgggacggauggaugcgcgcucgccgcucugauucauuucuauuguccggacgucguucggcuugaggauaucugccugaaggaaaccaugagccucgccgacucccuguacaaccugcagcucauccaagaguuuugucaggaauaucugaaucagugcugucacuucacacuugaggauaugcuguacgccgcuagcucuauuaaguccaacuaucucguguuuauggccgaacuguucuggugguuugagguggucaaaccuagcuucgugcagccccgcguugugagaccucaaggcgcggagcccgucaaggacaugcccucuaucccugugcuuaaugcugccaaacggaacguucuggauuccagcucugacuucccguccagcggcgaaggggccaccuuuacacagucccaucaccaccuccccucucgcuacagcagaccucaggcucauuccagcgccucuggaggcauucggcgcuccagcucuaugagcuauguggauggguucaucggaaccuggcccaaggagaaaagauccucuguccacggcgugagcuuugacauuuccuucgauaaggaagacagcguccagcggucuacgccuaaucgcgggaucacaagauccaucagcaacgagggacugacccugaauaacucucauguguccaagcacauucggaaaaaucucagcuuuaagcccaucaacggcgaagaggaggcugaauccauugaggaggaacugaacaucgacucucauagcgaucuuaaauccugcguuccgcugaauacaaacgagcucaauucuaacgaaaauauucacuacaagcugccuaacggcgcccugcaaaauagaauccuucucgacgaguucgggaaccagaucgaaacccccagcauugaggaagcgcugcagaucauucacgauaccgagaaauccccucauacaccccagccugaccaaaucgccaauggauuuuuccugcacagccaggagaugucuauucucaacuccaauaucaagcugaaccagagcucucccgauaaugugacggacaccaagggcgcucuuuccccgauuacagauaacaccgaagucgacacagggauccaugugccuagcgaggauauccccgaaaccauggacgaggauucuagccugcgcgacuacacgguuucccucgauagcgacauggacgaugccucuaaauuucugcaggacuaugauauucggacaggaaauaccagagaagcucugucccccuguccuagcaccguguccacaaagucucaaccgggcagcuccgccucuagcuccucuggggucaaaaugaccagcuucgcggagcagaaguuucgcaaacuuaaccacacagacggaaaguccagcggcuccuccagccagaagacgacccccgagggcucugaacucaacaucccucacgugguggccugggcucaaauucccgaggaaacagggcugccucagggacgggauaccacacagcugcucgccuccgagaugguucaucugagaaugaaacuugaagagaagcgccgggcuaucgaggcccagaaaaagaaaauggaagccgcuuucaccaagcaaagacagaaaaugggccgcacggcguuucugaccgucgugaagaagaaaggggacggaauuagcccccuccgggaggaagccgcuggcgccgaggaugagaagguguacacagacagagccaaagaaaaggagucucagaaaaccgaugggcagcgcuccaagagccuggcugacaucaaggaauccauggagaauccucaagccaaauggcugaaaagccccacaaccccgaucgauccugaaaaacaguggaaccuugcgucucccagcgaggagacgcucaaugaaggcgagauucuggaauauacaaaguccaucgagaaacugaacucuagccuccacuuccugcagcaggaaaugcaacggcuuucccugcagcaggagaugcucaugcaaaugagagagcagcagucuugggucauuagcccuccccagccguccccucaaaagcagauccgggacuucaagcccucuaaacaggcuggacugagcuccgccauugccccuuuuagcucugauucuccccgccccacccauccuagcccgcagucuuccaauagaaagagcgcuuccuucucugugaaaagccaacggacacccagaccuaacgaacugaagaucacaccccuuaaucgcacccucaccccuccccgguccguugacagccugccuagacugcgcagauuuucuccgucccaggugcccauccagacgcggagcuucgucugcuuuggcgacgauggggagccucagcucaaagaaucuaagcccaaggaggaagugaaaaaggaggagcuggaaagcaaaggaacccuugagcaacgcggccacaacccugaagagaaggagauuaaacccuucgaauccacaguuucugaggugcugagccucccggucaccgaaacagugugccugaccccuaaugaggaccagcugaaccagcccacggaacccccucccaagccuguuuuuccgcccacagccccuaaaaaugugaaccuuaucgaggucucccugucugaucucaagcccccugagaaggcggacgugcccguggaaaaauacgauggggagagcgacaaggaacaguucgaugacgaucaaaaagucuguugcggauuuuucuuuaaggacgaucagaaagcugagaaugacauggccaugaagagagccgcucugcucgaaaagcggcugcgcagagagaaagagacccagcuucggaagcaacagcuggaagccgagauggaacauaaaaaggaggaaacccgcagaaaaacagaggaggaacggcagaagaaggaggacgaacgcgcuagacgggaguucauuagacaggaguauaugcgccggaaacaacucaagcugauggaagauauggacaccguuaucaaaccgagaccucagguggugaagcagaaaaagcagcgccccaaguccauucaccgggaucacaucgagagcccuaaaacacccaucaagggcccucccgucucuucccugagccuugccucccugaacacgggggacaaugaaucugugcauagcggcaaaagaaccccgcgcuccgagucuguugaaggauuucucagcccuucccgguguggcagcagaaacggggagaaggauugggagaacgcgucuacaaccuccagcguggccucuggaacagaauacaccggccccaaacuguauaaggagcccuccgcuaagagcaauaaacacauuauccaaaacgcccucgcucauugcugucuggccgggaaggucaaugaaggacagaaaaagaaaauucuugaggaaauggagaagucugacgccaacaauuuccugauccucuuccgcgauagcggcugccaguuucggucccuguacacguacuguccugagaccgaagagauuaacaaacugacagggaucggcccgaagucuauuaccaagaaaaugaucgaaggacuuuauaaguacaauagcgacagaaaacaguucucccacauccccgcuaagacacugagcgcguccguggaugccauuaccauccauucucaccucuggcaaacaaaacggccuguuacccccaagaagcugcucccuacgaaggcuuga

SEQ ID NO: 66845 - RNA, 5022 nt, Artificial Sequence
  derived and/or modified sequence opt5 from CAMTA1__Homo_sapiens__XP_011539388
auguggagagccgagggcaaguggcugcccaaaaccagccggaaguccgugucucagagcgucuucugcgggacauccacguacuguguucucaacaccgugccuccgaucgaagacgaucacggaaauucuaacagcucccaugugaaaauuuuucugcccaagaaacuucuggagugccucccuaaguguucuagccugcccaaggaacgccacagauggaauacaaacgaggaaaucgcugccuaucuuauuaccuucgagaaacaugaggaauggcugacaaccuccccuaagacacggccccaaaauggcagcaugauccucuacaaccgcaaaaaggucaaauauagaaaggacggguacugcuggaagaaacggaaggauggaaaaaccacgcgcgaggaccacaugaagcugaaagugcagggcguugaaugucuguaugggugcuacgugcauucuuccauuaucccuaccuuucacagacgguguuauuggcuccugcagaauccggauaucguccuugugcacuaccugaacguucccgcgauugaggacugcggaaagccuuguggccccauccucugcagcauuaauacagauaaaaaggagugggcuaaguggaccaaagaagagcugaucggccagcuuaagccuauguuccaugggauuaaauggacauguucuaacggaaauuccagcucuggcuuuuccguggaacaacugguccagcagauccucgacagccaccagaccaagccccaaccgcgcacgcauaacugccugugcacagggucccugggagccggcgggucugugcaccacaaauguaauagcgccaagcauagaauuaucuccccuaagguggagccccggaccggaggcuacggcagccacucugaaguccagcauaacgauguuuccgaggggaaacacgagcauagccacucuaagggaagcucccgcgaaaaaagaaauggcaagguggcuaaaccugugcuccugcaccagucuagcacagaggucuccagcaccaaccagguggaaguucccgacaccacacaaucuucccccgugagcaucucuuccgggcuuaacagcgauccugacauggucgauuccccggugguuacgggagugucuggcauggccgucgcuagcgugauggggucccugucucagagcgccaccgucuucauguccgaggugacaaaugaagcgguuuauaccaugagccccacagccggaccuaaccaucaccuccugucucccgacgcuucccagggccuugugcuggccgucagcucugacggccauaaguuugcuuucccuaccacgggguccagcgagucucucagcaugcugcccacaaauguguccgaggaacugguucucagcaccacccuggauggaggccggaagauuccggagacaaccaugaacuuugacccugauugcuuccuuaauaaccccaaacaagggcagacauacggaggcgggggccugaaggccgaaauggugucuuccaauauccgccacagcccucccggagagagauccuuuucuuucacgaccguccucacaaaagaaauuaagaccgaggacacaagcuuugagcagcagauggcgaaagaagccuauuccucuagcgcugccgcuguggccgccuccucucugacccuuacggcuggcagcucccugcucccuagcgggggaggccugucucccuccaccacacuggagcaaauggauuucagcgcgaucgacucuaacaaggauuacaccuccagcuucucucagacagggcacuccccgcauauucaccagaccccuagccccuccuuuuuccuccaggacgccagcaagccccugccuguggaacaaaauacgcauucuagccuuuccgauucuggaggcacauuuguuaugccgaccgucaaaacagaggcuagcucccagaccucuagcuguuccgggcacguggagacccggaucgaaucuacaagcucccugcaucucaugcaguuccaggccaacuuucaagccaugacggcugagggcgaagugaccauggagacaagccaggccgcggaaggaucugagguccugcugaaguccggcgagcuucaggcuugcagcucugaacacuaucuccagcccgagaccaauggggugaucagauccgccggaggcguuccuauucugcccgggaacgugguccaaggacuguacccuguggcccagcccagccucggcaaugcuuccaacauggaacugucucuugaccacuucgauaucagcuuuuccaaucaguucagcgaccugauuaacgacuuuaucucuguugaggggggcuccagcacaauuuauggacaucaacucgugucuggcgauagcaccgcccugucccagucugaagacggggcucgcgccccuuucacgcaggcggagaugugucugcccugcuguagcccgcagcaaggaucccuucagcucucuagcuccgagggcggggccagcacaauggcuuacaugcacgucgccgaagugguuucugcugccuccgcgcagggaacccugggcaugcugcagcaaagcgggcggguguuuauggucaccgauuacuccccugaguggucuuaucccgaaggcggagugaaagugcucaucacaggcccuuggcaggaggccagcaacaauuacuccugccuguucgaccagaucucuguccccgcuagccuuauucagccggggguucugagauguuauugcccugcccaugauaccggacucgugacacugcaaguggcuuuuaacaaucagaucauuuccaacagcgucguguucgaauacaaggcccgcgcccugcccacgcuuccuucuucccagcacgacuggcucagccuggaugacaaucaauuccggaugucuauccuggagagacucgagcagauggaacgccggauggcugagaugaccggcucccagcagcauaaacaagcgagcgggggaggcucuagcggcgggggauccggcucugggaacggaggcagccaggcccagugugcuuccgggacaggagcccugggcagcugcuuugaauccagaguuguggucgugugcgagaagaugaugucucgcgccuguugggcuaaaagcaagcaccuuauucacuccaagaccuuccggggcaugacacugcuccaucuggccgcggcucagggguaugccacccugauccaaacgcuuauuaaauggagaaccaagcacgccgauucuaucgaccucgagcuggaaguugauccccugaauguggaccauuuuagcugcacaccccucaugugggcuugugcccugggacaccuugaggcggcugucgugcuguacaaaugggaucgccgggccaucuccauuccugacucucucggcagacugccgcuggggaucgcccggagccgcggacacguuaagcuugcugaaugccuggagcaucuccagagagacgaacaggcccagcugggccaaaacccccggauucacuguccugcuuccgaggagcccagcaccgaaucuuggauggcccaguggcauuccgaggcgaucagcucuccugaaauucccaaaggggugacagucaucgccuccaccaauccugagcucagacgcccgcggagcgaacccucuaacuauuacuccagcgagucccacaaggauuacccugcucccaagaaacauaagcugaauccugaguauuuccagacaagacaggaaaaacuucugcccaccgcccucagccuggaggaaccgaacauccgcaagcaaucuccuagcuccaaacagucugugcccgagacgcugagccccuccgaaggagugagagacuuuucucgggagcuuagcccucccacaccugagaccgcugccuuccaggccuccggcucucaaccggucggcaaguggaauagcaaggaucuguacauugggguuuccaccgugcaggugacaggaaaccccaaaggcaccagcgucgggaaggaagcugcgccuucucaggugcgccccagagagccuauguccguucucaugauggccaaucgggaaguggucaacacggagcugggaagcuaucgcgacucugcugagaacgaagagugcggccagcccauggaugacauccaagugaauaugaugacacucgccgaacacauuaucgaggccaccccggauagaauuaaacaggaaaacuuuguuccuauggaguccagcgggcuggagcggacagaccccgcuaccaucuccucuacaaugagcuggcuugccuccuaccuggcggaugcugacugucucccuagcgccgcccagauccgcucugcuuauaaugaaccccugaccccuuccagcaacacgucucugagccccgugggauccccggucucugagauugccuucgaaaagccuaaucuucccagcgcggcugauugguccgaguuucugucugccagcaccuccgaaaaaguggagaacgaguucgcccagcucacacugagcgaccacgaacaaagagagcucuacgaagcugcccggcugguccagaccgcuuuucgcaaguauaagggcagaccccuucgggagcagcaggaaguggccgcggccguuauccaaagaugcuaccgcaaauacaagcaguaugcucuguacaaaaagaugacacaggccgcuauucugauccaaucuaaauuccgguccuauuacgagcagaagaaauuucagcagagcagacgcgccgccgugcucauucaaaaguauuaccgguccuauaagaaauguggcaagagacgccaggcucggagaaccgcggucaucgugcagcagaaacugcgcucuagccuucugacgaagaaacaagaucaggccgcucggaagaucaugagauuccuccggcgcugcagacaucggguuaaggagcugaaaaaggccaaagaacucgaggacauucagcagcacccucuggccauguga

SEQ ID NO: 66846 - RNA, 3693 nt, Artificial Sequence
  derived and/or modified sequence opt5 from CAND1__Homo_sapiens__NP_060918
auggccagcgcuuccuaccacaucucuaaccugcucgagaagaugaccagcuccgacaaagauuucagauuuauggccacaaaugaccugaugacggaacuucagaaggauucuauuaaacuggacgaugacagcgagcggaagguggucaaaaugauccucaagcugcuugaagauaagaacggcgagguucaaaaucuggcggugaaaugccucgggccccugguguccaaggucaaagaauaucagguggagaccauuguugacacacuguguaccaacaugcucucugauaaggagcagcugcgcgacaucagcuccauuggacuuaaaacagugaucggcgaacugccuccggcuagcucuggguccgcccucgccgcuaaugucugcaagaagaucaccggaagacugacaagcgccauugcuaaacaggaggaugugucuguucaacuugaagcccuggacaucauggcggauaugcucucccggcagggcgggcugcuggugaacuuccaucccagcauucucaccugucugcuuccucagcugacgucuccccgccucgccgucagaaagcggaccaucauugcucugggacaccuugugauguccugcggcaauaucguguuugucgaccugauugagcaucuccugagcgagcuguccaaaaacgacucuaugagcacaacccgcacauacauccaguguaucgccgcuauuuccagacaagccggccaccggaucggggaauaucucgagaagauuaucccucugguugugaaauucugcaauguggaugacgaugaacuucgcgaguacuguauucaggcguuugaauccuucgucagacggugccccaaggagguguauccucauguuucuaccaucaucaacauuugucugaaauaccucacguaugacccgaauuacaacuacgaugacgaggaugaagacgagaaugccauggaugcugacggaggcgaugacgacgaucagggguccgacgaugaauauagcgacgaugacgauaugucuuggaaggugcgcagagccgcugccaagugccuggacgccgucgugagcacacggcacgagaugcuucccgaauuuuacaaaaccguuuccccugcucugaucucucgcuucaaggagagagaggaaaacgugaaagcggaugucuuucacgccuaucucagccugcugaagcagacacggcccgugcaauccuggcucugugacccugaugcuauggagcagggagaaacaccccugaccaugcuucagagccaagucccgaauauugugaaagcccugcauaagcagaugaaggagaaaucuguuaagaccagacagugcugcuucaacaugcucacggaacuggugaacguccugccuggcgcccuuacccagcacauccccgugcucguuccugggauuaucuuuucccugaaugacaaauccucuuccagcaaccugaagaucgaugcucucuccugucuguacgugauucuuugcaaucauucuccccaagucuuccacccccacgugcaggcccuggugccuccgguugucgcgugugugggagaccccuuuuauaaaaucacaagcgaggcucuccuggugacccagcagcuggucaaggugauucgcccucuugaccaacccuccucuuucgaugccacaccuuacaucaaggaccucuuuaccugcacgauuaaacggcugaaggccgcugauaucgaccaggagguuaaagaaagagccauuagcuguaugggccagaucaucugcaaccugggcgauaaucucggguccgaccugcccaacacacuucagauuuuccuggagcgccucaagaaugaaaucacccggcugaccacagugaaagcucugacccuuauugccggaagcccgcucaagaucgaucugagaccuguccugggcgagggggugcccauucucgcgucuuuccugcgcaagaaccaacgggcccuuaaacugggaacacucuccgcucuggacauccugaucaagaauuauagcgauucucuuacggccgcuaugauugacgccguucucgaugagcugccuccccugaucuccgaaagcgacaugcaugugucucagauggcgauuagcuuucucaccacacuggccaaagucuacccuuccagccuuucuaagaucuccggcagcauucugaacgagcucaucgggcuggugagaagcccccugcuucagggaggcgcucugucugccaugcucgauuucuuucaggcucugguugugaccggcacaaauaaccucggguacauggaccugcuucgcaugcugaccggaccggucuauagccaauccacggcccucacccacaaacagucuuacuauagcaucgccaaguguguggcugcgcugacacgggccugcccuaaagaaggccccgcuguggucgggcaguucauucaagacguuaagaauagcagaucuaccgauagcauccgccugcuugcccugcucucccugggagaggugggccaucacauugaccucagcgggcagcuggaacuuaagucugugauccuggaggccuuuuccagccccucugaggaagucaaauccgcugccagcuacgcgcucggcucuauuuccgugggaaaccugccugaguaucugccguucguucuucaggaaaucacaagccagcccaagcggcaauaccugcuccugcauucccucaaagagaucauuagcucugcuagcguggucggccugaagccuuauguggaaaauaucugggcccuucugcugaaacacugugagugcgccgaggaagggaccagaaacguuguggcugagugucucggaaagcugacgcuuauugaucccgaaacacugcucccucggcugaagggcuaccucaucuccgggucuagcuacgcccgcuccucugucgugaccgcgguuaaauuuacaauuagcgaccacccccagccuaucgauccccugcuuaagaacugcauuggagacuuccugaaaacccuggaggauccggaccucaaugugagacgggucgcucuggugaccuuuaacuccgccgcccauaauaagccuucucuuaucagagaucugcucgacacagugcugccccaccucuauaacgaaacgaaaguccgcaaggagcugauccgggagguugaaaugggcccuuucaagcauaccguggaugacgggcuugacauuagaaaagcugccuuugagugcauguacacacugcuggauagcugucucgaccgccuggauaucuucgaguuccuuaaucacguggaagacggccugaaggaucacuaugacauuaaaaugcucaccuuucugaugcucgucagacuguccacacuuugccccagcgcugugcugcagcggcuggaucgccucguugagccgcugagagccaccuguacgacaaaggugaaagcgaacucugucaagcaggaguucgaaaagcaagacgaacuuaaacgguccgccaugcgcgcuguggccgcucugcucaccaucccugaggccgaaaagagcccccugaugucugaguuucagucccagauuagcuccaauccugagcuggccgcuaucuucgaaucuauccagaaagauagcuccagcaccaaccucgagucuauggacacauccuga

SEQ ID NO: 66847 - RNA, 3711 nt, Artificial Sequence
  derived and/or modified sequence opt5 from CAND2__Homo_sapiens__NP_001155971
augagcaccgccgcuuuccacaucuccucucugcucgagaagaugacaagcuccgacaaagauuuuagauucauggccacgucugaccugaugagcgaacuucagaaggauuccauucaacuggacgaggauucugaacggaaaguggucaagaugcuccugcgccuucuggaggacaaaaacggcgaaguucagaaucucgcggugaagugccuggggccccugguggucaaggugaaagaguaccagguugagaccaucguggauacacucuguaccaacaugagaagcgacaaggaacagcugcgggauauugcuggaaucggccuuaaaacaguccuguccgagcucccuccggccgccaccgggagcggacuggcuacaaaugugugccgcaagauuaccggccaacuuacgucugccaucgcucagcaggaagacguugccgugcagcuggaggcgcucgauauccuguccgacaugcugagcagacucggggucccccugggagccuuucaugcuucucuucugcacugucuccugccucaacuuuccagcccccggcuggccgugcgcaaaagagcugugggcgcccucggccaucuggcggccgcuugcucuaccgaucuguucgucgagcucgccgaccaccuucuugaccggcugccugggccccgcguuccuacauccccgaccgcuauuagaacacucauccagugucugggaagcgugggccggcaggccgggcaucgccuuggagcccaccuggauagacucgugccccuggucgaagacuuuugcaaccuggaugacgaugagcuccgggaauccugucugcaggcuuucgaggcguuucuucgcaagugcccuaaggaaaugggcccccacgugccuaauguuaccucucugugucuccaauauauuaaacaugaccccaacuacaauuaugauagcgacgaggaugaggaacagauggagacggaagacuccgaguucagcgaacaggagucugaggaugaauacuccgacgacgaugacaugagcuggaaggugagacgggccgcugccaaaugcaucgccgcucugauuucuagcagaccggaucugcuuccugacuuucacuguacacucgcccccguccugauccgccgguucaaggagagagaagagaacgugaaagcggauguuuuuaccgcuuauauugugcugcuccgccaaacacagccucccaagggguggcuggaagccauggaggagcccacccagaccggauccaaucuucauaugcugcggggccaggucccucucguggucaaagcccugcaaagacagcugaaggaccgcucugugcgggcuagacagggcugcuucagccuucucacagaacuggccgggguucugccgggaucccucgcugagcacaugcccgugcuggucagcggcaucaucuuuucucuugccgaucgcuccucuagcuccacgauucggauggacgcgcuggccuuccuccaggggcugcugggaaccgaaccugcugaggccuuccacccccaucuuccuauccuccugcccccggugauggcuugcguugccgauagcuuuuacaagauugcggccgaggcucuggugguccuccaagaacuggugagagcccuuuggccucugcaccgcccccggaugcucgacccugagcccuaugugggcgaaauguccgcuguuacacuggccagacugcgggccaccgaucuugaccaggaggucaaagaacgcgcuaucucuuguauggggcaucucgugggacaccugggcgauagacugggcgacgaccucgagccuacacugcuucugcuccuggaucggcugagaaacgagauuacccgccuucccgcgaucaaggcccugacgcucguggcugucagcccgcugcagcucgaccugcagccuauccuugccgaagcccugcauauucucgcuuccuuccugcggaaaaaucaaagagcccugcgccuugcgacacuggcugcccucgaugcccuggcucagucucaggggcucagccugccucccuccgccgugcaggcgguucuugcugagcugcccgcccucgugaacgaaagcgacaugcacgucgcccaacuggcuguggauuuucuggccaccguuacccaggcucagccggccucucuuguggaggucuccggacccgugcugagcgaacuccugagacuccugcggucuccucuucugcccgcgggcguucuggccgcugccgagggguuccuccaagcucuggugggaacacgcccucccugcgucgacuacgccaagcugaucucccugcucaccgccccuguguacgagcaggcuguggauggcgggcccggccugcacaaacaggucuuucauagccucgcgagauguguugccgcucugucugccgccugcccgcaggaagcugccagcacagcgucccggcuugugugugacgcucgcagcccucacucuuccacgggagugaagguccuggccuuccugagccucgccgaggugggccaaguugcugggcccggacaucagagagaacugaaggccgugcuucuggaggcgcucggcuccccuucugaagauguccgggcugccgccagcuaugcucuggggcgcgugggagccggcucccuccccgacuuucugccguuccuucuggagcagauugaggcugaaccuagacggcaguaccugcuccugcacucucuucgcgaggcccugggggcggcccaacccgauagccucaaaccuuaugcugaagacaucugggcccugcucuuucagagaugcgagggcgcugaggaaggaacccggggcguuguggccgaguguauugggaagcugguccuugugaaucccuccuuccugcugcccagacuccgcaaacagcuggccgcuggacggccucacacaagaucuaccguuaucacagcggugaaguuucuuaucagcgaucagccgcaucccauugacccucugcucaaauccuucaucggcgaauuuauggagagccugcaagaccccgaucugaacguccgccgggccacccucgcuuucuucaauucugccgugcacaacaagccuucccuugugagagaccugcuggaugacauucucccccugcuuuaccaggaaacgaagauccgccgggaucugauuagagaggucgagauggggccuuuuaaacauaccguugacgauggacucgacgugcgcaaggccgcuuucgaaugcauguauagccugcuggagucuugucucggccagcuugauaucugcgaauuucugaaccacguggaggacgggcugaaagaucauuacgacauucggaugcucacauucaucauggucgccagacuggcgacccuuuguccggcucccgugcugcaacggguugaccgccucaucgaaccucugagagccacaugcaccgccaaggugaaagcuggcuccgucaagcaggaguuugagaagcaggaugaacugaaacggagcgccaugcgcgcgguggccgcucuccuuacgauucccgagguuggaaagucuccuaucauggccgacuucuccagccagauuagauccaaucccgaacuggcugcccuguuugagagcauccaaaaagauucugcuagcgccccguccacagacucuauggaacucagcuga

SEQ ID NO: 66848 - RNA, 1206 nt, Artificial Sequence
  derived and/or modified sequence opt5 from CANT1__Homo_sapiens__XP_005257079
augcccgugcagcugagcgagcacccugaauggaacgaguccaugcauucucucagaaucagcgucggcgggcugccgguucuugccuccaugaccaaggcugccgacccccgguuccgcccuagauggaaagugauucugacauuuuucgugggagcggcuauccucuggcugcuuugcucucaccggcccgccccuggccgcccuccuacgcauaaugcccacaacuggagacuggggcaagcuccggccaauugguacaacgauaccuauccccucagcccuccccagcggacacccgcuggcauucgcuacagaaucgccgucauugcggaccuggauaccgaaucccgggcccaggaggaaaauacaugguuuucuuaucugaagaaaggauaccucacccugagcgacuccggggauaagguggcuguugagugggacaaagaucauggagugcuugagagccaccuggccgaaaagggccgcggcauggagcucucugaccugaucgucuucaacgggaaacuuuauuccguggaugacagaacaggaguuguguaccagaucgaaggcagcaaggcuguccccugggugauucugucugauggggacggaaccguggagaagggcuuuaaagccgaguggcucgcggucaaggaugaacggcuguauguugggggacugggcaaagaguggacgaccacaaccggcgacguggugaaugaaaacccggagugggucaaggugguuggguacaagggauccguggaccacgaaaauugggucagcaacuacaaugcccuccgcgcugccgcuggcauccaaccucccggguaucugauucaugagucugccuguugguccgauacacuucagagaugguucuuucugccucggcgcgccagccaggagagauacuccgaaaaagacgaugagcggaagggagcuaaccuccugcuuucugcgagccccgacuucggcgauaucgccgugucccacguuggggcugugguccccacccauggauuuagcucuuucaaauuuauuccuaauacggacgaucagaucauuguggcccugaaguccgaagaggacagcggcagagucgccucuuauaucauggcuuucacacucgauggccgcuuucugcugccggaaaccaaaaucgggagcgugaaguacgagggaauugaguucaucuga

SEQ ID NO: 66849 - RNA, 1941 nt, Artificial Sequence
  derived and/or modified sequence opt5 from CANX__Homo_sapiens__XP_011532966
auguaccagaaggagaacacccaauggcugagaaaucucgccgugacagcucccauccuggaagccagcaacccugucggcgaggggcagggaguuaaaucccggaaggcgccggaaucuagcuccaaaugcauuucuuuccacacgggcgggcuugagaucauggaaggaaaguggcugcucuguaugcugcuugugcugggcaccgcuauuguggaggcccaugacgggcacgaugacgaugucaucgacauugaggaugaccucgaugacgugaucgaagagguugaagauagcaaacccgacacaaccgccccucccuccucuccuaaggugacauauaaggcucccgucccuaccggagagguguacuuugccgauagcuucgaccgcggcacacuguccggcuggauccugagcaaagcuaagaaagaugacaccgacgaugagauugccaaguaugacgggaaaugggaaguugaggaaaugaaggagucuaagcucccgggagauaaaggccuggugcuuauguccagagcgaagcaucacgccaucagcgcuaaacugaauaagcccuuucucuucgacacgaaaccucugauuguccaguacgaagugaacuuucagaaugggaucgagugcggaggcgccuaugugaaacuucugucuaagacccccgagcucaaccuggaucaauuccaugacaagacaccuuacaccauuauguuugggcccgauaaguguggagaagacuauaaacugcacuucaucuuucggcacaagaauccgaaaacaggcauuuacgaggaaaagcaugcuaaacgcccugaugccgaccucaagaccuacuucacggauaagaaaacacaccuguauacccuuauccugaaccccgacaauuccuuugagauccucgucgaccagagcguugugaacucuggcaaucugcuuaacgauaugacaccucccgugaaucccuccagagaaauugaggacccugaggaucggaagccggaagacugggaugagcgccccaaaaucccugaccccgaagcggucaagccugaugacugggaugaggacgcccccgcuaaaauuccggaugaagaggccaccaagccugagggguggcuggacgaugaacccgaguacgugccugaccccgacgcugaaaagccugaggauugggacgaggauauggacggagaaugggaggcuccccagaucgccaacccgagaugcgaaagcgccccuggcugugggguuuggcagcggcccgugauugauaaucccaacuauaaaggaaaguggaaaccuccgaugaucgacaaccccuccuaccaaggcaucuggaagccucgcaaaauucccaauccugauuucuuugaggaccucgaacccuucagaaugaccccuuucucugcgaucgggcuggagcuguggagcaugacauccgauaucuuuuucgacaacuuuauuauuugcgccgaucggcgcaucgucgacgauugggcuaaugacggauggggccucaagaaggccgccgacggcgcugccgagcccggggugguuggacagaugaucgaagcggcugaggaaagaccguggcuguggguggucuauauucuuacgguggcccugccugucuuccucgugauccuguuuuguugcagcggcaaaaagcagaccucugggauggaguacaaaaagacagaugcuccccagccugacguuaaagaagaggaggaagagaaggaagaggaaaaagauaagggagacgaggaggaagagggcgaagagaaacuugaggaaaagcaaaaguccgaugccgaggaagacgggggcaccgugagccaggaggaagaggaucggaaacccaaggccgaggaagacgagauucugaaccgcucuccgagaaaucggaaaccuagacgcgaauga

SEQ ID NO: 66850 - RNA, 1428 nt, Artificial Sequence
  derived and/or modified sequence opt5 from CAP1__Homo_sapiens__XP_011538812
auggccgacaugcagaaccugguggagagacucgaacgggcugucggccgccuggaggccguuagccacaccuccgauaugcauagaggguacgcggacucucccagcaaggcuggagccgccccuuaugugcaggcuuucgauucccuucuggccggcccgguggcugaauaccucaaaaucucuaaggagauugggggagacguccaaaaacacgccgaaauggugcauacaggccugaaacuugagcgggcgcugcucguuacggccagccagugccagcaacccgcugagaauaaacuguccgaucugcucgccccuaucucugaacagauuaaggaggugaucaccuuucgcgaaaagaacagagggagcaaacuguucaaucaccuuuccgcugucagcgagucuauucaggcccugggauggguggcgauggcccccaagccuggccccuauguuaaagagaugaacgacgcugccauguuuuacacaaaucgggugcucaaggaauauaaagaugucgacaagaagcauguggauugggugaaggcuuaccuguccaucuggaccgagcuucaggccuauaucaaggaguuccacacaaccggccuggccuggagcaaaacagggccugucgcuaaggaacucucuggacugccguccggccccagcgcggggucuuguccucccccucccccgccuugucccccucccccucccguuuccaccauuagcugcuccuacgaaucugccagccgcuccagccuguuugcucaaaucaaccagggagagucuauuacgcacgcccucaaacauguguccgacgauaugaagacccacaaaaauccggcccugaaggcucagagcggccccgugagaucugggccuaagcccuucagcgccccuaaaccccagacauccccgucuccuaagcgggcgaccaaaaaggagcccgcuguccuugaacuggagggaaagaaguggcgcguggaaaaccaagagaauguuagcaaccucgugaucgaagacacagagcugaagcaggucgccuacauuuauaaaugcgugaauaccacgcuucagaucaagggcaaaauuaacuccaucacaguugauaauuguaagaaacugggccucguguuugacgacgucguggggaucgucgagauuaucaacagcaaggaugugaagguucaagugaugggaaaagucccuaccauuucuaucaauaagacagacggcugccaugccuaccuguccaaaaacagccuggauugugaaauugugucugcuaaguccagcgagaugaacguucucauccccaccgaagggggagacuucaaugaguuuccugugcccgaacaguucaaaacccuguggaacggccagaaacuugucacaacggugaccgagaucgccggguga

SEQ ID NO: 66851 - RNA, 1434 nt, Artificial Sequence
  derived and/or modified sequence opt5 from CAP2__Homo_sapiens__NP_006357
auggccaacaugcagggccugguggagagacucgaacgggcugucagccgccuggagucccuuucugccgaaagccacagacccccugggaauugcggagagguuaacggcgugaucgcggggguggcuccguccgucgaagccuucgacaagcugauggauucuaugguggccgaguuucucaaaaauagccggauucuggcuggagacguugagacccaugccgaaauggugcacuccgcuuuccaagcccagcgcgcguuucuucugauggccucucaguaccagcaaccccaugagaacgaugucgcugcccuccugaagccuaucagcgagaaaauucaggaaauccagacauucagagagcggaaucgcggcuccaacauguuuaaucaccugagcgcugugucugaauccauucccgcccucggguggaucgcgguuagcccuaagcccggaccuuaugugaaagagaugaacgacgccgcuacguucuacaccaauagaguccugaaggauuauaagcauucugaccuucggcacguggauugggugaaauccuaccugaacaucuggagcgaacuccaggccuauauuaaggagcaccauacaaccggccugacauggucuaaaaccggcccggucgcuuccacaguuagcgccuuuuccgugcuuucuagcgggcccggacugccucccccucccccgccucugcccccucccgggcccccuccccucuucgaaaaugagggcaagaaagaggaauccagcccgucucgcuccgcccuguuugcucaacucaaccagggagaggcgaucaccaagggccugagacacgugacggacgaucagaagaccuacaaaaauccuagccuucgggcccaagggggacagacacagucucccaccaagagccauacaccuucccccaccucuccgaaaagcuauccuucccagaagcacgcucccguccuggaacucgagggcaaaaaguggcgcguggaauaccaagaggacagaaacgaucugguuauuagcgagacggaacuuaaacagguggccuacaucuucaagugugagaagucuacaauucagaucaaaggcaaggucaauuccauuaucaucgacaacugcaaaaagcuggggcucguguuugauaacguugugggaauugucgaagugaucaauagccaggacauucaaauccaggucaugggccgggugccuaccauuucuaucaacaaaacagaggggugucacaucuaucuguccgaagacgcccuggauugcgagauuguuagcgcuaaguccucugagaugaauauccucauuccccaggacggagauuaccgcgaguucccuauccccgaacaguuuaagaccgccugggacggcagcaaacugauuaccgaaccggcggagaucauggcuuga

SEQ ID NO: 66852 - RNA, 1002 nt, Artificial Sequence
  derived and/or modified sequence opt5 from CAPG__Homo_sapiens__NP_001243069
auguacaccgccaucccccagagcggcuccccuuucccggggucugugcaagaccccggacugcacgucuggagaguugagaagcucaaaccugugcccguggcucaggaaaaccagggcgucuuuuucagcggggauuccuaucuggugcuucauaauggaccugaggaaguuucucaucugcaccucuggauuggccagcaaagcucccgggacgagcagggggccugcgcggugcuggcuguccaccuuaacacacugcucggagaacgccccgugcagcauagagagguucagggcaaugagucugaucuguuuaugagcuacuucccucggggccugaaguaucaagaagggggaguggaguccgccuuucacaaaacgagcaccggcgccccggcugccaucaagaaacucuaccaggucaaggggaagaaaaacauucgcgcuacagaaagagcccugaauugggacucuuucaacaccggagauuguuuuauccuugaccugggccagaauauuuucgcguggugcgggggaaaguccaacauccucgagcggaauaaagcccgcgaucuggcucuugccaucagagacagcgagcggcagggcaaggcucaagugcugggccccaaaccugcccucaaggaagggaaccccgaggaagaucugacagcggacaaggccaaugcucaggccgcugcccuguauaaagugucugaugccaccggacagaugaaccucacaaaggucgcugacuccagcccuuuugcgcuggagcuucugauuucugaugacuguuucguucucgacaauggccugugcgggaaaaucuacauuuggaagggacgcaaagccaacgaaaaggagagacaagcugcccuucagguggccgagggcuuuaucucccggaugcaguaugcucccaauacccagguggaaauucugccgcaagggcacgagagcccuaucuucaaacaguuuuucaaggauuggaaguga

SEQ ID NO: 66853 - RNA, 2019 nt, Artificial Sequence
  derived and/or modified sequence opt5 from CAPN10__Homo_sapiens__NP_075571
augagagccggccgcggggcuacccccgcccgggagcuguucagagacgcggcuuuuccugccgccgauagcucccucuucugcgaccugucuacaccgcuugcucaguuucgggaagauaucacguggcgcagaccccaagagauuugugccaccccucggcuguuccccgacgauccucgcgaaggacaggugaagcagggccuccugggggacugcugguuucuuugugcuugcgccgcgcugcagaaaagcagacaccuccuggaucaagucauucccccuggacagccguccugggccgaccaggaguaccggggcucuuucacaugucgcaucuggcaguuugggagauggguugaagugaccacagaugaccggcugcccugccucgcuggacgccuguguuucagcagaugccaacgggaggauguguuuuggcuuccucugcucgagaaggucuaugccaaagugcauggcuccuacgaacaccugugggcuggccagguugccgacgcgcuuguggaucugaccgggggacucgccgagcgcuggaaccugaagggcgucgcugggucuggaggccagcaggacagacccgggcggugggaacauagaacaugucgccaacugcuccaccugaaagaccagugccuuaucagcuguugcgugcuguccccucgggccggagcuagagagcucggcgaguuccaugccuuuauuguuagcgaucugcgcgaacuucagggccaagccgggcagugcauccugcuccugcggauccagaaucccuggggaagacgcuguuggcagggccuguggcgggaagggggagaaggcuggucucaaguggacgcugcggucgccuccgagcuccugagccagcuucaggaaggggaguucuggguggaggaagaggaauuucugagagaguucgaugaacucaccgugggauauccggucacggaggcuggccaucugcagucucuuuacaccgagcgccugcucugccacacacgggcccugccuggcgccuggguuaaggggcaauccgcuggaggcuguagaaacaauagcggguuccccucuaacccuaaguuuuggcugcgcguguccgaacccagcgagguguauauugccguccuccagcgguccagacugcacgcggcugacugggccggacgggcccgcgcucuugugggcgauucucacaccagcuggucccccgccagcaucccugggaaacauuaccaggcuguuggccugcaccucuggaagguggagaaaagacgggucaaucugccgagagugcugucuaugcccccuguugccggaacagcgugccacgccuaugaccgcgaggugcaucuucggugugaacucucccccggcuacuaccuggcugucccuagcaccuuccugaaggaugcccccggggaguuucuccugagaguguucucuacgggacgcgucagccuuuccgcuauuagagccguggcgaaaaacacaaccccgggcgccgcucugccugccggggaguggggaacaguucagcuccggggcucuuggcgcguggggcaaaccgcuggcggaagcagaaauuuugccuccuaucccaccaacccuugcuuccccuuuagcgucccugaaggccccgggccgcggugugugcgcaucacacugcaccagcauugcagaccuucugacacggaguuccaccccauuggauuucauaucuuccagguucccgaaggcgggcggucccaggaugccccuccgcugcuucuccaagagccccugcugagcugugugccucaccgcuacgcucaggaggucucuagacucugccugcuucccgcgggaaccuauaagguggugccuuccacauaccugcccgacaccgaaggcgccuuuacaguuaccauugcuacgcggaucgaucgcccuagcauccacucccaggagaugcucgggcaauuccugcaggaagucucugugauggccgugaugaagacauga

SEQ ID NO: 66854 - RNA, 2010 nt, Artificial Sequence
  derived and/or modified sequence opt5 from CAPN13__Homo_sapiens__NP_653176
auggccuacuaucaggagcccagcguggaaaccuccaucauuaaguucaaagaccaagauuuuacaacgcugagagaccacugccucucuaugggccggaccuucaaggaugagacauuuccugcugccgacagcuccaucgggcagaaacugcuucaggaaaagcgccugucuaacgucauuuggaaaagaccgcaggaucuccccggaggcccuccccauuucauccuggacgauauuagccgguuugacauccaacaagggggagcggcugauuguugguuccuugccgcccugggcucccucacccagaauccucaguaccgccagaagauccugaugguucagucuuuuagccaccaguaugcugggauuuucagauuucgguucuggcagugcggacaauggguggagguggucaucgacgaucgccugcccgugcagggcgacaagugucucuuuguuagaccucggcaucagaaccaagaguucuggccgugccugcuugaaaaagccuacgcuaagcugcucggcuccuauagcgaucugcacuacggguuucuugaggacgcccugguggaccucacaggaggcgucauuaccaauauccaucugcacucuucccccguggaucugguuaaagcggugaagacagccaccaaagcugggagccucauuacgugugccaccccuucuggacccacagacaccgcucaggccauggaaaacggccuggucucccuucacgcguauacagugaccggggccgagcagauccaguaccgcagaggaugggaagagauuaucagccuguggaauccuuggggcuggggcgaggcugaauggcgggggcgcuggucugauggaucccaagagugggaagagacgugcgaccccagaaagagccagcuccauaagaaacgggaagauggcgaguucuggauguccugucaggacuuccagcaaaaguuuaucgccauguucauuugcucugagaucccgauuacacuggaucacgggaacacccuucaugaaggauggagccagaucauguuucgcaaacaggugauucugggcaauacagcugggggaccuagaaacgacgcccaguucaauuuuuccguccaagagcccauggaaggcaccaacguuguggugugugucaccguggccguuacaccuagcaaucucaaggcugaggaugcgaaauucccccuggacuuucaggugauccuggccggcucucagcgguucagagaaaaguuucccccugucuucuuuuccagcuuccgcaacacggugcagucuagcaauaacaaauuucggagaaauuucaccaugacauaccaccucuccccggggaacuauguuguggucgcucaaacccgccggaagucugccgaguuccugcuuagaaucuuucugaagaugcccgauagcgaccgccaccucuccagccauuucaaccugcggaugaaaggaucuccuuccgagcacggcagccagcagucuauuuuuaauagauacgcccaacagcgccuugacaucgaugcuacacagcugcaggggcuccugaaccaagaacugcucaccggacccccuggcgacauguucucccuggaugagugccggagccuuguggcccugauggaacucaaggucaaugggagacuggaccaggaggaauuugcgcgccuguggaaacggcuugugcauuaucagcacguuuuccagaaggugcaaacgucccccggcguccuccugucuagcgaucuguggaaagcuauugagaacacagacuuucucagaggaaucuucauuucccgggagcugcuucaucuggugacccuccgcuacucugauagcguuggcagaguguccuuuccgagccuggucuguuuccugaugcggcuugaagccauggccaagaccuuuagaaaucucucuaaggacgggaaaggacuguaucugacagagauggaauggaugucccucgugauguacaacuga

SEQ ID NO: 66855 - RNA, 2055 nt, Artificial Sequence
  derived and/or modified sequence opt5 from CAPN14__Homo_sapiens__NP_001138594
augagccuguggcccccuuucagaugccgguggaagcucgccccgcgcuacuccagacgggcuucuccccagcaaccucagcaggacuuugaggcccugcuugcggaaugucugcgcaacggcugccucuucgaggauaccagcuuucccgcuacacuguccucuaucgggagcggaucccuucugcagaaacucccucccagacugcaauggaagcggccuccggaacugcacucuaauccccaguucuauuuugccaaagccaagcgccucgaccugugucagggcauugugggggauugcugguuccuugcugcccugcaggcucucgcccugcaucaagacauccuuagcagagucguuccucugaaccaguccuuuacggagaaauacgcgggaauuuuccgguuuugguucuggcacuauggcaauugggugcccguggucaucgaugaccgccucccugugaacgaagccgggcagcugguuuuugugagcucuaccuacaagaaucuguucuggggagcucuccuggagaaggccuaugcuaaacuuuccggcagcuacgaggaucugcagucuggccaagucuccgaagcccucguggacuuuacagggggaguuaccaugacaauuaaccuggcggaggcccauggcaaucuuugggauauccugaucgaagcuaccuauaacagaacacucauugggugucagacccacagcggagagaagauccuggagaauggccugguggaagggcaugccuacacgcucaccggcauucggaaagucacaugcaagcaccgccccgaguaccuggugaaacuuagaaacccguggggaaagguggaauggaagggcgacuggucugauuccagcuccaaaugggagcugcucucuccuaaggaaaagauccugcuucugcggaaagacaaugauggggaguucuggaugacccuccaggacuucaaaacacacuuuguccugcugguuauuuguaagcucacccccggacugcuuagccaagaggcugcccagaaauggacguauacaaugcgcgaaggcagaugggagaagcgguccaccgccgggggacagagacagcugcuccaagacacauucuggaagaacccucaguuucugcugagcguguggcgccccgaagagggccggagaucucuucgccccugcuccgugcucgucagccugcugcagaaaccucggcauagaugucgcaagcggaaaccgcuccuggcuaucggguucuaccuuuauagaaugaauaaguaccacgaugaccagcgccggcugcccccugaauuuuuccaaagaaacacaccccucucucagccugaucgcuuucugaaagagaaggaggugagccaggaacugugccuugagcccggaaccuaucucauuguuccguguauccuggaagcgcaucagaaguccgaguucgugcugcgggucuuuucuagaaaacacaucuucuacgaaauuggcagcaauuccggcgugguuuuuagcaaggagaucgaggaccaaaacgaacggcaggaugaguucuuuaccaaauucuucgaaaagcacccugagauuaacgccgugcagcuccagaaucugcuuaaccaaaugacguggucuucccuggggagccgccagcccuuuuucucucucgaggcuugccagggaauccuggcccugcuugaccucaaugccuccggcaccaugagcauucaagaauuuagagaucuguggaaacagcugaagcucucccagaaggucuuccauaaacaggaccgggggucuggauaucugaacugggagcaacuucacgcugccaugagagaagcgggcaucaugcugagcgaugacgugugccagcucaugcugauccgcuacgggggcccucggcugcagauggauuuugucuccuucauucaucuuaugcucagaguggagaauauggaagacguuuuucagaaccugacacaagacggaaagggcaucuaccugcagaaacccgaguggaugaugauggcucucuauucuuga

SEQ ID NO: 66856 - RNA, 2145 nt, Artificial Sequence
  derived and/or modified sequence opt5 from CAPN1__Homo_sapiens__XP_011543594
augagcgaggaaaucauuacccccguguacugcacaggcgucuccgcccagguucaaaagcagagagcucgggagcuggggcucggacgccacgaaaacgccaucaaauaucugggccaggacuacgagcagcuuagagugcggugucugcaaucugggacgcuuuuccgcgaugaagcguuuccuccggugccccagagccugggauauaaggaccuuggcccuaauuccucuaaaaccuacgggauuaaguggaaaagacccacagagcugcucagcaacccucaguucaucgucgauggagcuacccggacagacauuugccagggcgcccugggcgauuguuggcugcucgccgcuaucgccucccugacccuuaaugacacacugcuccaucgcgugguuccccacgggcaaucuuuucagaacggauaugcuggcaucuuccauuuucagcuguggcaguucggggaguggguggaugucgugguugacgaucuucugccuauuaaggacggaaagcucguguuuguccacagcgccgaaggcaaugaguucugguccgcgcugcuggaaaaagccuacgcuaaggugaacgggagcuaugaggcccucucuggaggcuccaccagcgagggcuuugaagauuucaccgggggagugacggagugguacgaacugagaaaagcuccgucugaccuuuaccaaaucauucugaaggcccucgagcggggcucccugcuugggugcagcaucgauauuucuuccguccuggacauggaagcgaucacauuuaaaaagcucguuaagggacaugccuauagcgugaccggcgcuaaacaggugaauuaccgcgggcaggucgugucccugauuagaaugcggaaccccuggggagagguugaguggacaggcgccuggucugacagcuccagcgaauggaauaacguggauccuuaugagcgcgaccaacugagagucaagauggaagauggcgaguucuggaugucuuuucgggacuucaugcgcgaguucaccagacucgagaucuguaaucugacgcccgaugcucuuaaaucccggacaaucagaaaguggaacaccacacuguacgaggggaccuggcgccggggaagcaccgccggcgggugcagaaauuauccugccacauuuugggugaacccccaguucaaaauucgccucgacgaaacggaugacccggaugacuacggagaucgggagucuggcuguagcuuuguucuggcucuuaugcagaagcacagacgccgggaaagacgcuucgggcgggacauggagaccaucggcuuugcgguguaugaagucccucccgagcuggugggacagccugccguccaccucaaaagagacuucuuucuggcuaaugccucccgcgcccggucugagcaauucauuaaccugagagaagugagcacacgguuucgccucccucccggcgaguacguugugguccccuccaccuucgaaccgaacaaggagggggauuuugugcugagauucuuuagcgagaagucugcuggaacaguugaacuugacgaucagauccaggccaaucugcccgacgaacaggugcucuccgaagaggaaauugaugagaacuucaaagcgcuguuccggcaacuggcuggcgaggacauggaaaucagcgucaaggagcuuagaaccauccucaaucgcauuaucucuaaacauaaggaucugcggacgaaaggguuuucccuggaaagcugcagauccauggugaaccucauggaccgcgauggaaauggcaagcuggggcuuguggaguucaacauucuguggaauagaauccggaacuaccucucuauuuuucgcaaguucgaccuggauaaaagcggcuccaugucugccuaugaaaugagaauggccaucgagagcgcuggauuuaagcugaauaaaaagcucuacgagcucaucauuacacgguauuccgaaccugaccuggccguugauuucgacaacuuugucuguugccuggugcgccucgagaccauguucagauuuuucaaaacccuggacacagaucuugacggcguggucaccuuugaucuguucaaguggcuccagcugacaauguuugcuuga

SEQ ID NO: 66857 - RNA, 1869 nt, Artificial Sequence
  derived and/or modified sequence opt5 from CAPN2__Homo_sapiens__NP_001139540
auggagaucugcgccgacccccaguucauuaucggcggggcuaccagaacagauauuugucaaggagcccugggcgacugcuggcuccuggcggcuaucgccagccuuacgcugaacgaagagauucucgcccggguggucccucugaaucaguccuuucaggaaaacuacgcugggaucuuccacuuucaguucuggcaauauggagaguggguugaagugguggucgaugaccgccuuccgaccaaggauggcgagcugcucuuugugcauucugccgaggggagcgaguucugguccgcucugcuggagaaagccuacgcgaagaucaauggauguuaugaagcccucucuggcggcgcuacaaccgagggguuugaggacuucacaggaggcauugccgaaugguacgagcugaaaaagcccccucccaaccuuuuuaaaaucauucagaaggcucugcagaaggggagccuccugggaugcuccaucgauauuaccucugccgcggacagcgaagccaucacauuccagaaacuuguuaagggccacgcuuauuccgugaccggggccgaggaagucgagagcaauggaucucugcaaaaacucauuagaauccggaacccuuggggcgagguggaauggacgggccgcuggaaugauaacugucccuccuggaauaccaucgacccugaggaaagagagcggcugacacgcagacaugaagauggggaguuuuggaugagcuucucugacuuucugcggcacuacucccgccucgagauuugcaaccugaccccggauacacuuaccagcgacacguauaagaaauggaagcugacaaagauggacggaaauuggagacggggcucuaccgcugggggaugucgcaacuaccccaauacauucuggaugaacccucaguaccucaucaaacuggaagaggaagaugaggacgaagaggauggcgaguccgggugcaccuuccuuguuggacugauucagaagcauagacggcgccagagaaaaaugggcgaagacaugcacaccaucggcuuugggauuuaugaggugcccgaagaacucagcggacaaacaaauauccaccuguccaagaacuucuuucugacgaaccgggccagagagcgcucugauaccuucaucaaucuccgggaaguccugaacagauuuaaacuuccucccggcgaguacauucuggugccgagcacauucgaaccuaauaaggacggggauuuuuguauccgcguguucuccgagaaaaaggccgacuaucaggcugucgaugacgaaauugaggcgaaccucgaggaauuugauaucagcgaggacgacauugaugacggauuccggagacuguuugcccagcuugcuggcgaagaugccgagaucucugccuucgaacugcaaaccauccuccgccggguucuggcuaagagacaggacauuaaauccgauggguuuagcaucgagacaugcaagauuaugguggacaugcuggauucugacggcagcggaaaacucggccugaaggaguucuacauccuuuggaccaaaauucagaaguaucagaagaucuaccgcgaaauugauguggaccgguccgggacgaugaacucuuaugagaugagaaaagcccuggaagaggcgggauucaagaugcccugucaacuccaucaggucaucguggcucgcuuugccgaugaccagcugaucauugauuucgacaauuuuguucggugccuggugagacuugaaacacucuucaaaaucuuuaagcagcuggacccugagaauaccggcaccauugagcuggaucucaucagcuggcugugcuucuccguccuuuga

SEQ ID NO: 66858 - RNA, 2466 nt, Artificial Sequence
  derived and/or modified sequence opt5 from CAPN3__Homo_sapiens__NP_000061
augcccaccgugaucagcgccuccgucgcuccuagaacagccgcggagccgcggucucccggcccuguuccccacccugcucagagcaaggccacggaagccgggggaggcaaccccuccgggauuuacucugcuaucauuagccgcaauuucccuaucauuggagugaaagagaagaccuuugaacaacugcauaaaaagugccucgagaaaaaggugcuguaugucgacccggaauuucccccugaugagacaucccuguuuuacucucagaaguuccccauccaguuuguguggaaaagaccucccgagaucugugaaaacccgcgguucauuaucgacggcgccaaucgcaccgauauuugccagggggagcugggagacuguugguuucucgcugccaucgcgugccugacacuuaaccaacaccuucucuucagaguuauuccucaugaucagagcuuuaucgaaaauuaugccggcauuuuccacuuucaguucuggcgguacggcgaguggguggacgucgugaucgaugacugucugcccaccuauaacaaucagcugguuuuuacaaaguccaaccaucgcaaugaguucuggagcgcucuccuggaaaaagccuacgcuaaacuucacgggucuuaugaggcccugaagggaggcaacaccacggaagcgauggaggauuucaccgggggaguggccgaauuuuucgagaucagagacgcuccuuccgauauguacaagauuaugaagaaagccaucgagcggggcagccucauggggugcucuauugacgauggaacaaauaugaccuacggcacaucccccagcggccugaacaugggggaacuuaucgcucgcauggucagaaauauggacaacucucugcuccaagacuccgaucuggacccccggggaagcgaugagcgcccuaccagaacgauuaucccggugcaguaugaaacacggauggccuguggccuggugcgcgggcacgccuacuccgucaccggacucgacgagguucccuuuaagggcgaaaaagugaagcuggugagacuucggaauccuugggggcaggucgaguggaacggaucuuggagcgauagauggaaagacugguccuucguggauaaggacgagaaagcucgccugcagcaucaaguuacagaagauggcgaguuuuggaugagcuaugaagacuucaucuaccacuuuaccaagcucgagauuugcaaccugaccgcggaugcccuucagucugacaagcugcagacauggacgguguccgucaaugaaggccggugggugagaggguguagcgcuggaggcugccgcaacuuccccgacaccuuuuggacaaauccucaauaucggcucaaacugcuggaggaggaugacgaucccgacgauucugaaguuaucuguagcuuccucguggcccugaugcagaagaacagacgcaaagaccggaaacuuggggccucccuguuuaccauuggauucgcuaucuacgaggucccgaaggaaaugcauggcaauaagcagcaccuccagaaggauuucuuccuguauaacgccucuaaagcgagaagcaagacauacauuaauaugcgcgaggugucccaacgguucagacuuccucccagcgaguacgucaucgugccuucuaccuaugaaccccaccaggagggggaauuuauccugcgcguuuucuccgagaaacggaaccucagcgaagagguggagaauacgauuucugucgacagaccugugaagaaaaagaagacaaaacccaucauuuuuguuuccgaucgggcuaacagcaauaaggaacugggcguggaccaggaguccgaagagggaaaaggcaagaccucuccggauaaacagaagcaaagcccucagccccagcccggguccucugaccaggaaagcgaggagcaacagcaguuccgcaacaucuuuaagcagauugccggagaugacauggaaaucugcgccgacgagcugaaaaagguccucaauaccguggugaacaaacauaaggaucugaaaacacacggcuucacccuugaauccugcagaagcaugauugcucugauggacacagaugggucuggaaagcucaaucugcaagaguuucaucaccuguggaacaaaaucaaggccuggcagaagaucuucaaacauuacgacacggaucaguccggcaccauuaacagcuaugaaaugcggaaugcuguuaacgacgccggguuucaccuuaauaaccaacucuacgauaucauuacaaugagauaugcggacaagcacaugaauaucgauuucgacucuuuuauuuguugcuucguccgccuggagggcauguuucgggccuuccaugcuuucgauaaagacggagauggcaucaucaagcugaacgugcucgaguggcugcagcuuaccauguacgccuga

SEQ ID NO: 66859 - RNA, 1923 nt, Artificial Sequence
  derived and/or modified sequence opt5 from CAPN5__Homo_sapiens__NP_004046
auguucagcugcgugaagcccuacgaggaccagaacuauuccgcccugagacgggauugucgcagacggaaaguccucuuugaagacccucuguucccggcuaccgaugacucucuuuacuauaagggcacacccgggccugccguucgcuggaaaagacccaagggaaucugcgaggauccucggcuguuuguggacggcauuagcucccacgaucuccaucaaggacagguggggaauuguugguucgucgcggcuugcucuagccuggccucccgcgaaucucuuuggcagaaagugauccccgacuggaaggagcaggaaugggauccugagaagccgaacgccuacgcuggcauuuuucacuuccauuuuuggagauucggggaguggguugacguggucaucgaugaccggcugcccacggugaauaaccaacucauuuauugucacagcaauucccgcaacgaauuuuggugcgcccugguugagaaagcguacgccaagcuggcgggauguuaucaggcccucgauggcggcaauaccgcugacgcccugguggacuucacagggggagucagcgaaccuaucgaucuuaccgagggcgacuuugcuaacgaugagacaaaaagaaaucagcuguucgaacggaugcucaaggugcauucucgcgggggacugaucuccgccagcauuaaagcggugaccgccgcugacauggaggccagacuugcuugcggccuggucaaggggcacgccuacgccguuacagaugugcggaaggugcgccucggacacggccugcuggcuuucuucaaaucugaaaagcucgacaugaucagacugcggaaccccuggggcgagagagaauggaaugggccuugguccgauaccagcgaggaguggcagaaagucucuaaguccgaacgcgagaaaaugggagugacgguucaagacgauggcgaauuuuggaugaccuuugaggacgugugucgguacuucacagauauuaucaagugcagagucauuaacaccagccaucuuuccauccacaaaacaugggaagaggcgcgccugcauggggccuggacccuccacgaggacccccggcagaauagaggaggcggguguauuaaccacaaggacacguuuuuccagaauccgcaguauaucuuugaagugaagaaaccugaggaugaaguucugaucugcauucaacagcgccccaagcggucuacaagacgcgagggaaaaggcgaaaaccuugcuaucggcuucgacauuuacaagguggaggagaaccggcaguauagaaugcauagccugcaacacaaagccgccuccagcaucuacauuaauucucgcuccgucuuucuccggaccgaucagccugaagggagauaugugaucauccccacaaccuucgagcccggacauaccggcgaauuucugcugcgggucuucacagacgugccuagcaacugccgcgagcucagacuggaugagccgccccacacguguuggucuagccuuugcggguacccucagcugguuacccaggugcauguccucggagcugccggccugaaggacucccccacaggggcuaauucuuaugugauuaucaagugugaaggcgauaaaguucggagcgcugugcaaaagggaaccuccacaccugaguacaacgucaaaggcauuuucuacagaaagaaacuuagccagcccaucaccguucagguguggaaucaccgcgugcugaaggacgaauuucucgggcagguccaccugaaggccgauccggacaaccugcaagcccuccauacgcugcaccuucgggauagaaauucucgccagccuuccaaccugcccggaacaguggcugugcauauucucagcucuaccucccugauggccgucuga

SEQ ID NO: 66860 - RNA, 1926 nt, Artificial Sequence
  derived and/or modified sequence opt5 from CAPN6__Homo_sapiens__NP_055104
auggggcccccucugaagcucuuuaaaaaccagaaguaccaagagcugaaacaggaaugcaucaaggacagcagacuuuucugugauccgaccuuccugcccgagaaugacucccucuuuuauaaccggcugcuuccugggaaaguggucuggaagcgcccccaggauauuugcgacgauccucaccugaucguuggaaauauuucuaaccaucagcucacacaaggcagacuggggcacaagcccauggugagcgccuucuccugucuggcugugcaggaaucucauuggacgaaaaccaucccuaaucacaaggagcaggaaugggacccgcagaaaacagagaaguacgccggaauuuuucauuuccgguuuuggcacuucggcgaguggaccgaagucgugaucgaugaccuccugcccacaaucaacggggaucuuguuuuuagcuucuccaccucuaugaaugaguuuuggaacgcgcugcucgaaaaggcuuaugccaagcugcuuggaugcuacgaggcccuggacggccucacaauuaccgauaucauuguggacuucacgggcacccuggcugagacagucgauaugcaaaaggggcgcuauaccgaacugguggaggaaaaauacaagcucuuuggagagcuguauaaaacauucaccaagggcgggcuuaucuguugcagcauugaauccccuaaucaggaggagcaggaaguugagacggacuggggacugcucaaaggccacacauacaccaugacagacaucagaaagauucggcugggggaacgccuuguggaggucuucagcgccgaaaaaguguacauggugagacugcggaacccccucggacgccaggaguggucuggcccuugguccgagaucagcgaagaguggcaacagcugaccgcuucugauagaaagaaucugggccucgucauguccgacgauggggaauuuuggaugagccuggaggacuucugucggaacuuucauaaacuuaauguuugccgcaacgugaauaaccccaucuucggaagaaaagaacuggagucugugcucggcuguuggaccgucgaugacgauccgcugaugaaccgguccgggggaugcuauaauaaccgcgacacauuucuucagaauccucaauacauuuucacggugcccgaggauggccacaagguuaucaugagccugcagcagaaagaccucagaaccuaucggagaauggggcgcccugauaacuacauuaucggauuugaacuguucaagguggagaugaaucggaaauuuagacugcaucaccucuauauucaggaacgcgccggcacauccaccuacaucgacacacggaccgucuuccugucuaaguaucuuaagaaaggcaacuacgugcugguucccacgauguuucaacacgggagaacaagcgaguuccuccugcgcaucuuuuccgaggugcccguccagcugcgggaacuuacccucgacaugccuaagaugagcuguuggaaucuggcgagaggauacccgaaaguggucacccagauuacagugcauucugccgaggaucuggaaaagaaauaugcuaacgagaccguuaaucccuaccucgugaucaagugcggcaaggaagagguccgcuccccugugcagaaaaacacaguucacgccauuuucgacacgcaagcuaucuucuaucggagaaccacagauauucccaucaucgugcaggucuggaauagccgcaaguuuugcgaccaguuccugggccaggugacccuugaugccgacccuucugauugucgggaccugaaaagccucuaccugagaaagaaaggaggccccacagcgaaggugaagcaagggcauauuuccuuuaaaguuaucucuagcgaugaccugaccgagcuuuga

SEQ ID NO: 66861 - RNA, 2442 nt, Artificial Sequence
  derived and/or modified sequence opt5 from CAPN7__Homo_sapiens__NP_055111
auggacgccaccgcucuggagagagaugccgugcaguucgcgcggcucgcuguccaacgcgaccacgaaggcagauacagcgaggccguguuuuauuacaaggaagccgcucaggcccugaucuaugcugagauggccggguccucucuugaaaacauucaggagaaaaucacagaguaccuggaacggguucaggcgcuccauagcgccgugcaauccaagucugcugauccccugaaaagcaagcaccagcuugaccuggagcgcgcccauuuccucgucacgcaggcuuuugaugaagacgagaaagagaauguggaagaugccauugagcuguauaccgaagcgguugaccugugccucaagacauccuacgagaccgccgauaaggugcugcagaacaaacuuaagcaacuggcuagacaggcccucgaccgggcugaagcccugucugagccucuuacaaaaccggucggaaagaucagcuccaccagcgugaaacccaagccucccccuguucgcgcccacuucccccugggcgcuaauccuuuucucgagagaccgcagucuuucauuagcccccagagcugugaugcgcaagggcagcgguauacagccgaagagaucgaagugcugcgcaccacgucuaagaucaacggaauugaguacgucccuuuuaugaauguggaccugagagaacgguucgcuuaccccaugccuuuuugcgaucgcuggggcaaacucccccuguccccgaagcagaaaaccacauucagcaagugggugagaccugaggaccuuaccaacaaucccacaaugaucuauaccgucucuuccuuuagcauuaaacaaacgaucguuuccgacuguucuuucguggccagccuggccauuuccgcugccuacgagcggcgcuuuaacaagaaacucaucacagggauuaucuauccucagaauaaggauggagaacccgaguacaaccccugcggcaaguauauggugaaacugcaucuuaauggcgucccuagaaaggugaucauugacgaucagcugccgguugaccacaaaggggaacuccuguguagcuacucuaacaauaaguccgagcugugggugagccucaucgaaaaagcguauaugaaggucaugggaggcuacgauuuccccgggucuaacagcaauauugaccugcacgcucuuaccggauggaucccugagcggauugccaugcauuccgauucucagacauucagcaaggacaacuccuuuagaaugcuguaccaacgcuuccacaaaggcgaugugcucaucaccgccagcaccgggaugaugacagaggcugaaggagagaaguggggccugguucccacgcaugccuaugcugugcuugacauccgggaauuuaaaggccugagauucauucagcucaagaacccuuggucucaucugcgcuggaaagggcgguacuccgagaaugaugucaagaacuggacccccgagcugcagaaguaucucaauuuugacccgagaacagcccagaaaaucgacaacggaauuuucuggaucagcugggaugaccugugccaauacuaugaugugauuuaccuuucuuggaauccuggccuguuuaaggaauccaccuguauccacagcacaugggacgcgaaacaggggcccgucaaggaugccuauucccucgcuaacaauccucaguacaaacuggaggugcagugcccccaaggaggcgccgcuguuugggugcugcuuucucgccacaucaccgacaaggaugacuucgccaacaaucgggaauuuauuacgauggucguguacaagacagaugggaaaaagguuuauuacccugcggacccuccgccuuauaucgauggaauuagaaucaacagcccccacuaccucaccaaaauuaagcugaccacacccggcacccauacauucacgcugguggucucccaguaugagaaacagaauaccauccacuacacagugcgcguguauucugccuguagcuuuaccuucuccaagauuccuagcccguacacacucucuaaacggaucaacggcaagugguccgggcagagcgcuggaggcugcgggaauuuucaagaaacccauaagaacaaucccaucuaccaguuccacauugagaaaacgggaccucugcuuaucgagcugagaggcccccgccaguauucuguuggguucgaagucgugaccguguccacacucggcgacccuggaccccacggcuuucugcggaaguccucuggggauuacagauguggauucugcuaucuggagcuugaaaacauuccuagcggcaucuuuaacauuauccccuccaccuuccucccgaaacaagaggggcccuuuuuccuggacuuuaauagcaucauucccaucaagauuacacagcugcaguga

SEQ ID NO: 66862 - RNA, 2073 nt, Artificial Sequence
  derived and/or modified sequence opt5 from CAPN9__Homo_sapiens__NP_006606
augcccuaccuguauagagccccuggcccgcaggcucaccccgugccuaaggacgcccggaucacccauagcuccgggcaaucuuucgagcagaugcgccaggaaugccuccagagaggaacacuguuugaggaugcggacuuccccgcuagcaacuccucucuguuuuacagcgaacggccucaaauucccuucgucuggaaacgcccuggcgagaucguuaagaauccggaauuuauucuugggggagccacgagaaccgauaucugucagggcgagcucggggacugcuggcugcuugccgcuauugccucccugacacucaaccagaaagcucuggcccgggugaucccccaggaucaaucuuucggaccuggcuaugcgggcaucuuucacuuccaguuuuggcagcauagcgaguggcuggacguggucauugaugaccgccuccccaccuucagagaucggcugguguuucuucacuccgccgaccauaaugaguucuggagcgcucugcucgagaaggccuacgcuaaacugaacgggucuuaugaagcccuuaagggaggcuccgcgaucgaggccauggaggauuuuacagggggaguugcugaaaccuuccagacaaaggaggccccugaaaauuucuacgagauucuggaaaaagcucucaagcgcggcagccugcugggguguuuuaucgacaccagaucugccgccgaguccgaggcucggacgcccuucggacucauuaaaggccacgcguauagcgugaccggcaucgaucaagucucuuuucgcgggcagagaauugaacugauccggauccgcaacccguggggacagguggaguggaauggcuccuggagcgacuccucuccugaauggagaagcguugggcccgccgagcaaaagcggcuuugccacacagcucuggacgauggagaguucuggauggccuuuaaagacuucaaggcccauuuugauaagguggagauuuguaaccucaccccugacgcucuggaggaagaugccauccacaaaugggaggucacagugcaucagggcuccugggugagagggagcaccgcgggaggcugccgcaauuuccuugacacguuuuggacaaacccccagauuaagcugucucucaccgaaaaagaugagggccaggaagaguguuccuuccuggucgcucugaugcaaaaggaccggagaaaacucaagcgcuuuggggccaauguucugacaaucggauacgccauuuacgagugccccgauaaagacgaacaccuuaacaaggauuucuuucgguaucacgcuagcagagcccgcucuaagaccuucaucaaucugcgggaggugagcgacagauucaaacucccuccgggcgaauacauccugauucccuccaccuuugagccucaucaggaggcugacuucugucuucgcaucuuuucugaaaagaaagccauuacacgggauauggacgggaacguggauaucgaccugcccgagccucccaagccgacgccucccgaucaggaaaccgaggaagaacagagauuccgcgcgcucuuugagcaagucgccggagaagacauggaggugacagcugaagaacuggaauauguucugaaugccgugcuccagaaaaagaaggauauuaaauucaagaaacugagccuuaucuccugcaagaacaucauuagccugauggacaccucuggcaacgggaaacucgaguuugaugaguucaaggucuuuugggacaagcugaaacaguggaucaaucuguuccuucgguuugaugcugacaaguccggcacaaugagcaccuacgaacucagaacggcccugaaagcggccggauuccagcugucuucccaccuccugcaacuuauugugcugcgguaugcugaugaggaacuccagcuggacuuugacgauuuccugaacugucuuguucgccucgagaaugccagcagaguguuccaggcucuguccacaaagaacaaagaauuuauccaucugaauauuaacgaguucauccaccucaccaugaauauuuga

SEQ ID NO: 66863 - RNA, 807 nt, Artificial Sequence
  derived and/or modified sequence opt5 from CAPNS1__Homo_sapiens__NP_001289561
auguuccuggugaacagcuuucucaagggcgggggaggcgggggaggcgggggaggcggccuugggggaggccuggggaauguccugggaggccucaucuccggggccggaggcggcgggggaggcgggggaggcgggggaggcggcgggggaggcgggggaggcgggaccgcuaugcggauucugggcggaguuaucucugccauuagcgaggcggcugcccaguacaaccccgaaccuccgcccccuagaacacacuauuccaauaucgaggccaacgaaucugaggaagugcgccaauucagacggcuuuuugcucagcuggccggcgacgauauggaggugagcgcuacggagcucaugaauauucugaacaaagucgugacccgccaucccgaccugaagacagauggguucggaaucgauaccugcagauccaugguugccgugauggacucugacacaaccggcaaacucggguuugaagaguucaaguaccuguggaauaacaucaaacgguggcaggcgauuuauaagcaguuugauacagaccgcagcggaaccaucuguuccagcgaacuuccuggcgccuucgaggcugccggguuucaccugaaugagcaucucuacaacaugauuaucagacgguauucugaugaauccggcaauauggacuucgauaacuuuauuagcugccugguccgccuugacgcuauguucagagccuuuaagucucuggauaaagacggaacgggccaaauccaggugaauauucaggaguggcuccagcugaccauguacuccuga

SEQ ID NO: 66864 - RNA, 2130 nt, Artificial Sequence
  derived and/or modified sequence opt5 from CAPRIN1__Homo_sapiens__NP_005889
augcccagcgccaccucccacucuggcagcggguccaagucuagcggaccuccgcccccuuccggcucuagcggguccgaggcugccgcgggagcuggcgccgccgcucccgccagccagcauccugcuacagggacgggagccgugcagaccgaagcgaugaaacagauccugggcgucauugacaagaaacucagaaaccuggagaagaaaaagggcaaacuugaugacuaccaggaacggaugaauaagggggagcgccugaaccaggaucaacucgacgccguuucuaaguaucaggaagugacaaauaaccuggaguucgcuaaagagcuucagagauccuuuauggcccugagccaggauauccaaaagaccauuaaaaagacagcucggcgcgaacagcucaugagagaggaagccgagcagaagcggcugaaaaccgugcuggagcuccaguacguccuggacaaacuuggagaugacgaagugcgcacagaucugaagcaaggccucaaugggguucccauccugucugaggaagaacuuucccugcucgacgaguucuauaagcugguggauccugagagagacaugagccugcggcucaacgagcaguacgaacacgcgucuauucaucugugggaucuucuggagggaaaagaaaagccggucugcggcaccacguauaaagugcucaaggagaucguugaacgcguguuucaguccaauuacuucgacagcacccacaaccaucaaaaugggcugugcgaggaggaagaggccgcuuccgcccccgcugucgaagaccaggugccugaggccgaacccgagccugccgaggaauauacagagcagucugaaguggagagcaccgaguacgucaacagacaguuuauggcugaaacacaauucaccuccggagagaaggaacagguugaugaguggacgguggaaacaguggaggucgugaauagccuucagcagcaaccccaggcggccucuccguccguuccugagccccacagccugaccccuguggcucaggccgacccccucguccggcgccagagagugcaagaucugauggcccagaugcagggccccuacaacuuuauccaggacucuaugcuggauuucgaaaaucaaacacucgacccugcuauuguuagcgcccagccgaugaaccccacccagaauauggauaugccucaacuggugugucccccuguccacuccgagucucggcuugcgcagcccaaccaggugccgguccagccugaagcuacccaagugccccugguuagcuccacaagcgagggcuauacggccucucagccucucuaccagcccucccaugccaccgaacagcgcccucaaaaagagcccaucgaccagauucaggcuacaaucagccugaacaccgaucagacaaccgccucuuccagccuuccggcugccucccaaccucagguguuucaggcggggacgucuaagccccugcacagcuccggaauuaaugucaacgccgcucccuuccaaucuaugcagacaguguuuaauaugaacgccccuguuccgcccgugaaugagccugaaacccucaaacagcagaaccaauaucaggcuagcuacaaucaguccuucagcucucagccccaucaagucgagcagaccgaacugcagcaggagcaacugcagacaguggugggcaccuaucacggguccccugaccagagccaccagguuacaggaaaccaucaacagcccccucagcaaaauacgggcuuucccagaucuaaccagccguacuauaauuccagaggggucagccggggaggcucucgcggcgcccgggggcucaugaacggauacagaggcccugcgaauggguuccgcggaggcuacgauggguaucggcccagcuucuccaacaccccuaauagcggcuacacacagucucaguuuuccgcccccagagacuauagcggauaccaacgcgacggcuaucagcagaacuucaagcggggguccggacagucuggcccgagaggggcuccucgcggacggggcgggcccccuagacccaaccgcggcaugccccaaaugaauacccaacaggugaacuga

SEQ ID NO: 66865 - RNA, 3384 nt, Artificial Sequence
  derived and/or modified sequence opt5 from CAPRIN2__Homo_sapiens__NP_001002259
auggaggugcaggucagccaagccucccugggcuucgaacucaccucuguugaaaagagccugagagaauggucccggcuuucucgcgaggugaucgcuuggcugugccccagcuccccuaacuuuauucucaauuucccgcccccucccucugccagcuccgugagcaugguccagcuguuuucuuccccuuucggguaccagagccccucuggacacuccgaagaggagagagaaggcaacaugaaaagcgcgaagccucaggugaaucauucucaacacggggagucccagcgggcucuuagcccgcugcaguccacacucucuagcgccgccucccccagccaggcuuaugaaacguacaucgagaacggacugauuugucugaaacauaagauccgcaauauugagaaaaagaagcucaaacuggaagacuauaaggauagacuuaaaucuggcgagcaccugaacccugaccaacucgaagccguugagaaguacgaagaggugcugcauaaucuugaguuugcuaaagaacugcagaagaccuucuccgggcucagccuggaucugcucaaggcccagaaaaaggcgcagcggcgcgagcacaugcugaaacuugaagccgagaagaaaaagcugagaacaauccuccaaguccaguaugugcugcagaaccuuacccaagaacacguucagaaagacuuuaagggaggccugaauggcgcuguguaccuccccucuaaggagcuggauuaucugaucaaauucagcaagcucacaugcccugagcggaacgaaucccugucugucgaggaccagauggaacagagcucccuuuacuuuugggaucugcucgaggggagcgaaaaagccguggugggaaccacauacaagcaucugaaagaccuucugucuaagcuccucaauuccggcuauuucgagagcauucccgucccgaagaacgcuaaagagaaggaaguuccucuggaggaagagaugcugauccaaucugagaaaaagacccagcuguccaaaacggaaagcgugaaggaguccgaaucucuuauggaguuugcccagcccgaaauucagccucaagaguuccugaaucgcagauacaugaccgagguggauuauagcaacaagcagggggaggagcagcccugggaagcggacuacgcccggaaacccaaucucccuaagcgcugggauaugcugacagagccggacggacaggaaaagaagcaagaguccuuuaaaucuugggaggcuagcggcaagcaccaggaagucuccaagcccgccgugagccuggagcagagaaaacaggauaccucuaaacuucgguccacacucccugaggaacaaaagaagcaggaaaucagcaaaucuaagcccuccccuagccaguggaaacaagacacccccaagucuaaggcuggguauguucaggaggagcagaaaaagcaggaaacgccgaaacuguggccugugcaacugcagaaggagcaggaccccaaaaagcagacaccuaagagcuggacccccuccaugcaaagcgaacagaacacaaccaaaucuuggaccacaccuaugugugaggagcaggauuccaagcagcccgaaacgccgaaaagcugggagaacaaugucgaaucccaaaagcauucucucaccagccagucccagauuucuccuaaaagcuggggaguggccacagccucccugauccccaacgaccaacuucugccccgcaagcucaauaccgagccuaaggauguuccgaaacccgugcaccagccugucggcucuagcuccacacugcccaaggacccugugcugagaaaagaaaaacuucaggaucucaugacccagauucaaggcacgugcaacuucaugcaggagagcguccuggacuucgauaaacccucuuccgcuaucccuacaagccagcccccgucugcgaccccugggucccccguggccagcaaggagcagaaucugucuucccaaagcgacuuucuccaggaaccucugcaggcuaccuccagccccguuacauguucuagcaacgccugccuugugaccacagaucaggccuccucuggaagcgagacggaguucaugaccuccgaaacaccggaagcugccaucccucccggcaagcaaccuucuagccuggcgucccccaaucccccuauggcuaaagggucugagcagggauuucagagcccgcccgccuccucuagcuccgucaccauuaacacagccccuuuccaggcuaugcaaaccguguuuaauguuaacgcuccccucccuccccggaaggagcaggaaaucaaagagagcccuuacucuccgggcuauaaucaguccuucacgaccgccagcacacaaacacccccucagugucagcugcccuccauucacguggaacagaccguccauucucaagagaccgccgcgaacuaccacccugacgggacgauccaggugagcaauggaucccuggccuuuuaccccgcucagacaaacguguucccgagaccuacccagcccuuuguuaauagccgcggcucuguccggggcugcacaagagggggacgccuuauuaccaacuccuaucggagccccggcggguacaagggauucgauaccuauagaggccucccuucuaucagcaacgggaauuacucccaacugcaguuucaggcccgcgaauauucuggcgcucccuacagccagcgggacaacuuccaacaguguuauaaaagaggaggcacauccgggggaccucgcgccaauucucgggcgggcuggagcgacuccagccaggugucuuccccggagagagauaacgagacguuuaauagcggggacuccggacaaggcgauucucgcagcaugacccccguggacgucccugugacaaaccccgccgcuaccauccugccuguucauguguacccccucccgcagcagaugcgggucgccuucuccgcugccagaacaucuaaucuggccccugggacccuugaucagcccauuguguucgaccugcuccugaacaaucugggcgaaacguuugaucuucaacucggacgguucaacugcccuguuaauggcacauacguguuuaucuuccacaugcugaagcuggcugucaacgugccccucuauguuaaucugaugaaaaacgaggaagugcuugucagcgcguacgccaaugacggggcuccugaucaugagaccgccuccaaccacgccauucugcagcucuuucagggagaccagaucuggcugcgccugcacagaggcgcuauuuaugggagcucuuggaaguacuccaccuucagcggauaucuucuguaccaagauuga

SEQ ID NO: 66866 - RNA, 1428 nt, Artificial Sequence
  derived and/or modified sequence opt5 from CAPS2__Homo_sapiens__NP_001273476
augaucaacaccggcacacagauggaccuggaggugaagggggucgccgcuacgagcagaucccaaauucagcccuucuuuggacggaaaaagccucuccagcagcgcuggaccucugaaagcuggacaaaucaaaacuccugcccgcccguugugccuagacuggaucuuggcucucugguggacagcgaugacgaggaucagaauaucauucccgaaaaccucccugcccccaccgacaaauguaagcugaaauaccagcagugcaagacagagaucaaggaaggguauaaacaauacucccagcggaaugcggagaacaccaagucuaaugucacacacaaacagagcccucgcaacaagauugaugagaaaugugugcaggacgaagaggcuaauaccgaugaccuuacgacccuggauagaaaggccauccuccaacagggauaugccgacaacuccugcgauaagcagcaacgggcucgcaaacuggacgccgaaaucguugcugccgagaagaaaaagcagauuguggcggagcaggucaugaucgaccaucugagcagagccgugauuucugauccggaacagaaucucgcuaucgagcaaaaagaauccgaccacauucugcccgauagcaagaugacaccucuucgguuccgcaaaagaacccugcaugagacaaagauccggacccacucuacgcucacagaaaacguucugucccauaaacuucaguuugacggccgcauugugagcagaaccaauguccugcccuucauccagaagucuaucuacucccaccagugugggcggcgcaagggaaaacaauauagacucggcgauuuuuacgugggcgccacacugaccuuccugagcuccgaccaccucucucugccugagagcauuaaggagaacacccuucugaaacuccggaucacaaauauugaucagaucgcucuggacucccuuaagacggccagcauggaacaggaggaugacauuaucauccaggaaaccaacgauagacugguguuuaaggcgauucaagacguccucaaagagaagcugcauaaacgcgggguucggauccugacaggacucggcaaguauuuccagcagcuggacaaagaagggaacggacuucuggauaaggccgacuuuaagcaggcucucaaaguguuccaccuggaggugucugagaaggauuuugaauccgccuggcuuauucugaaugacaacggcaaugggaaagucgauuacggagaguucaagagaggcaucauuggcgaaaugaacgaguaccgcaaaagcuaugugcggaaggcuuuuaugaagcucgacuucaauaaaucugggagcguucccaucaucaacauuagaaagugcuacugugccaaaaagcauucccaagugaucucuggauga

SEQ ID NO: 66867 - RNA, 828 nt, Artificial Sequence
  derived and/or modified sequence opt5 from CAPS__Homo_sapiens__NP_004049
augcagugccacagagaccuggcccucagccaagcucuguggggcuggcagcuuuccaagcagucugggugggcccaucccagccugccucacuccccgcuccccucuaccgugcauagcuguuccugggcgccuccccaucugcagcggcaccuuccucuggcuacagucucucccggaacgacccaacucacacagggcccugccgggcgcacccugggacagacacaggccagcugcccggagcccagaccuuccauggaugcuguugacgccaccauggaaaaacugcgggcucaaugucucagccgcggcgccucugggauccagggacuggcgagauucuuucggcagcuugaucgcgacggcuccagaagccuggaugccgacgaguuccggcagggccucgcuaagcuggggcuugugcuggaucaagccgaagcugagggagugugccgcaaaugggacagaaacggcucugggacacucgaucuggaagaguuucugcgggcccucagacccccuaugucccaggcgagagaggccgucauugcugccgcuuucgccaagcuggaccggagcggagauggcgugguuaccguggacgaucuucgcggggucuacucuggacgcgcccaccccaaagugcgguccggcgaauggacggaggacgaaguucugagacgcuuucucgacaauuucgauagcuccgagaaggacggccaggugacccuggcugaguuucaagauuauuacucuggggucagcgcguccaugaacacagacgaagaguucguggccaugaugaccagcgcuuggcagcuuuga

SEQ ID NO: 66868 - RNA, 627 nt, Artificial Sequence
  derived and/or modified sequence opt5 from CAPSL__Homo_sapiens__NP_001036090
auggccggcaccgcuagacacgaccgggagauggccauccaggcgaagaaaaagcugacaacggcuaccgaucccauugaacgccucagacugcaaugccuugcccgggggagcgccggaaucaaaggccuggggcgcguguucagaauuauggacgaugacaacaaucggacacucgauuuuaaggaguucaugaaaggacugaacgacuacgcugucguuauggaaaaggaggaaguggaggagcuuuuucgcagauucgauaaggacggcaaugggaccaucgauuuuaacgaguuccugcucacacugcggccuccgaugucccgcgccagaaaagaggugauuaugcaggcuuuucggaagcuggacaaaaccggagauggcgucaucacaaucgaagaccuccgcgagguguauaaugccaagcaucaccccaaauaccagaacggcgaguggucugaagaacagguuuucagaaaguuucuggauaauuucgacagcccuuaugacaaggaugggcuugugacccccgaagaguuuaugaacuacuaugcgggagucuccgccucuauugacacggauguguacuucaucauuaugaugcggaccgcuuggaaacuguga

SEQ ID NO: 66869 - RNA, 861 nt, Artificial Sequence
  derived and/or modified sequence opt5 from CAPZA2__Homo_sapiens__NP_006127
auggccgaccuggaggaacagcucagcgaugaggaaaaggugagaaucgcugccaaauucauuauccacgcgcccccuggcgaguuuaacgaagucuucaaugacguucggcugcuucugaacaaugauaaccuccugcgcgagggggcugcccaugccuuugcucaauacaaucuugaccaguucaccccggugaagauugagggauaugaagaucaggugcugaucacagagcacggcgaccucgggaacggaaaauuucuggaucccaagaauagaauuugcuucaaauuugaccaucugcggaaggaagccacggauccucgccccugugaggucgagaacgcuguggaauccuggagaaccucuguugagacagcccuccgggcguacgugaaggaacacuauccuaauggcgucugcaccguguacgggaaaaagaucgacggacagcaaacaaucauugccuguaucgagagccaucaguuccaggcuaaaaacuuuuggaauggccgcuggagauccgaauggaaguucaccauuacacccucuaccacgcagguugugggcauccugaaaauucaaguccacuauuacgaggaugggaacgugcagcuugugagccacaaggacauccaggauucccugaccgucucuaaugagguucagacagccaaggaauuuauuaaaaucguggaggcugccgaaaacgaguaucaaaccgcgaucagcgaaaauuaccagacaauguccgacaccacguucaaggcccuccggcgccagcugccugugacaagaaccaaaauugacuggaacaagauccuuagcuacaaaauuggaaaggagaugcaaaacgcuuga

SEQ ID NO: 66870 - RNA, 900 nt, Artificial Sequence
  derived and/or modified sequence opt5 from CAPZA3__Homo_sapiens__NP_201585
augacccugagcgugcucuccagaaaggacaaagagcgggucauccgcagacugcuucugcaggcucccccuggcgaguucguuaacgccuuugaugaccucugccugcuuauucgggaugagaagcugaugcaccaucaaggggaaugugccggacaccagcauugccagaaauacucugugccgcucuguaucgacggcaaucccgugcugcugagccaccauaacgucaugggggauuaucgcuucuuugaccaccaguccaagcucucuuucaaauacgaucugcuucaaaaucagcugaaggacauucagagccacggaaucauucagaacgaggcggaauaucucagagugguucugcuuugcgcucugaagcucuacgugaaugaucauuauccuaaaggcaacuguaauaugcugcggaagacagucaaauccaaggaguaccugaucgccugcaucgaggaccacaacuaugaaacgggggaguguuggaauggacucuggaaaucuaaguggauuuuucaagugaaccccuuccugacccagguuacaggccgcaucuuugugcaggcccauuucuuuagaugcgucaaucuucacauugaaaucagcaaggaucugaaagagucccucgagauugugaaccaggcucaacuggcccuuagcuucgcucggcugguggaagaacaggaaaauaaguuucaggccgcgguccucgaggaacugcaagagcugucuaacgaggcccuccgcaaaauccugagacgggaccuuccuguuacccgcacacugauugauuggcacagaauccucuccgaccugaaucuugugauguaccccaagcugggcuacgugaucuauagccggucuguccucuguaacuggauuaucuga

SEQ ID NO: 66871 - RNA, 3099 nt, Artificial Sequence
  derived and/or modified sequence opt5 from CARD10__Homo_sapiens__NP_055365
augcccggcagagccgaggcuggggaagccgaggaagaggcgggagcuggcagcggguccgaagccgaggaggacgcccugugggaacggaucgagggagugcgccacagacucgcucgggcccugaacccugcuaaacuuaccccguaccugcgccagugcagagucauugaugaacaagacgaggaggaaguucucucuacauaucgguuccccugucgcgugaauagaacgggccggcugauggauauccuucgcugcagagggaaacggggauacgaggccuuucuggaagcgcucgaguucuauuacccugaacauuuuacccugcugacaggccaggagcccgcccagcgcuguagcaugauucucgacgaggaaggcccugaggggcugacccaguuccuuaugacagaagugagacggcugcgcgaggcuagaaagucccaacuccagcgggaacagcagcugcaagccagaggacgcguccuugaggaggaacgggcuggccuggagcagagacuccgcgaucagcagcaagcccaggaacggugccagagacugcgcgaggacugggaagcggggucucuggagcuccugcggcuuaaagaugagaacuauaugaucgccaugagacuggcucaacucagcgaagagaaaaauuccgccgugcugcgcucucgggaccuucagcuggcuguugaucagcucaagcugaaggugagcagacuggaagaggagugugcccuccugcgccgggccagaggacccccuccgggcgcugaagagaaggaaaaagagaaggaaaaagagaaggagcccgacaacgucgaucuuguguccgaacugcgggcggagaaucagcgccucaccgccagccugagagaacuucaagaggggcugcagcaggaggcuucucggccuggagcccccggcuccgaacggauucuccuggacauccuggagcacgauuggcgcgaagcccaggacagccggcaagagcucugccagaaacugcaugcuguucagggcgaacuucagugggccgaggaacugagagaccaauaccuccaggagauggaggaucugcgccugaagcacagaacacuucagaaggacugugaucucuauaaacaucggauggcgaccgugcuggcucagcuggaagagaucgaaaaggagcgcgaccaagccauucagucuagagaucggauccagcuccaauacucccagagccugauugagaaagaccaguaccgcaagcaggucagagggcuugaagccgagcgggaugaacugcucacgacccugacaucucuggagggaaccaaagcccuucucgaagugcaacugcagcgcgcucagggcgggacaugccugaaggcuugugccuccagccacucccucugcucuaaccugagcuccaccuggagccuuucugaguuuccuagcccccugggaggcccggaggcgacgggggaagccgcugugaugggaggcccugagccccacaauuccgaagaggccacagacucugaaaaagagaucaacagacucagcauucugccuuucccucccuccgcuggcucuauccugcggcgccagagagaggaagaucccgccccgcccaagcggagcuuuuccagcaugucugacauuaccggguccgucacacuuaagccuuggagccccggacucucuuccagcuccucuagcgauuccguuuggccucugggcaaacccgaggggcugcucgcgagaggauguggccuggacuuccuuaaucgcucucuggccauccgggugagcgggagauccccgccuggcggacccgaaccucaagacaagggccccgaugggcucagcuuuuauggagaccgcuggucuggcgcugugguccggagagugcuguccgggccuggaagcgcccgcauggagccccgggaacagagaguugaggcugccggccuggagggggccugccuugaagcugaggcgcagcagcgcacccuccuguggaaccaaggcucuacccugccgucccucauggauagcaaagccugccagucuuuccaugaagcucuggaggccugggccaagggaccuggcgcugagcccuuuuacauccgggccaaucuuacacugcccgaaagagcggacccucacgcucucugugugaaagcccaggagauucugcggcuggucgauagcgccuauaagcgcagacaagaaugguucugcacgcggguggacccgcuuacccugcgcgaucucgacagagggacaguucccaacuaccagcgggcucagcagcugcucgaggugcaagaaaagugucugccuuccagcagacaucgcggaccccggucuaaucuuaaaaagagagcccuggaucagcuccgccugguccggccuaaacccgugggcgcgccugcuggggacucccccgaucagcugcuucuggagccgugcgccgagccugaaagaagccuccgccccuauucccugguccggccucuccuggugucugcccuuagacccguugugcugcucccggagugucuggcuccucgccugaucagaaaccuucuggaccuccccagcucccggcuggauuuucaggucugcccugccgaaucucucagcggagaggaacugugucccuccucugcucccggcgccccuaaggcgcaaccggccacccccgggcuuggcagccgcauuagagcuauccaggaguccgugggaaagaagcacugccugcuggagcucggcgccagagggguucgcgaacuggugcagaaugagauuuacccuaucgucauccacguggaagugacagagaagaacguuagagaaguccggggacuucugggcagacccggguggcgcgacagcgagcuccugcggcaguguagaggaucugagcaagugcucuggggccugccuugcuccugggugcagguccccgcucaugaaugggggcacgccgaggaacuugccaaagugguucgcggccggauucugcaggagcaggcuagacuggugugggucgaguguggaagcucucggggcugcccuuccagcucugaagcguga

SEQ ID NO: 66872 - RNA, 3465 nt, Artificial Sequence
  derived and/or modified sequence opt5 from CARD11__Homo_sapiens__NP_115791
augcccggcgggggaccugagauggacgauuacauggaaacccugaaggacgaggaagaugcccucugggagaacguggaaugcaauagacacaugcugagccgguauaucaacccggcuaaacuuacacccuaccugcgccaguguaaggucauugacgagcaagaugaggacgaaguucucaaugccccuaugcugcccuccaaaaucaacagagcgggccggcuucuggauauucuccauacgaaggggcagcgcggauaugugguguuccuggagucucuggaauuuuacuauccugagcucuacaaacuggucaccggcaaggagcccacaagacgguucagcaccaucgugguugaagaggggcacgaaggacuuacacauuuucugaugaaugaggugauuaagcuccagcagcaaaugaaagcuaaggaccugcagcgcugcgaacuucuggccagacuccggcagcuggaggaugagaaaaagcagaugacccugacacgcgucgaacuccugaccuuccaagagagauauuacaaaaugaaggaagaacgggacuccuacaacgaugaacuugugaagguuaaagacgauaauuauaaccuggccaugcgcuacgcucagcucucugaggagaagaauauggccgugaugagaagccgggaccugcagcuugaaaucgaccagcugaaacaccgccucaacaagauggaggaagaguguaaacuggaaagaaaucaaucccugaagcucaaaaacgauaucgagaaucggccuaagaaggagcagguccuggaacuugagagagaaaacgagaugcugaaaacgaagaaucaggagcuccaaucuauuauccaggcuggcaaacgcagccugccggacuccgauaaggccauucuugacauccuggaacaugaucggaaagaggcgcucgaagacagacaggagcuggugaaccgcauuuauaaccugcaggaagaggcccggcaagcugaggaacucagagauaaguaccuggaggaaaaggaggaccuugaacugaaaugcagcacccucggcaaggauugugagauguauaaacaccgcaugaauacagugaugcugcagcuggaggaagucgagcgggaaagagaccaggccuuucacucucgcgaugaggcucagacccaauacucccagugccuuaucgaaaaggacaaauaucggaagcagauuagagagcucgaggaaaagaacgacgagaugcgcaucgaaaugguucggagagaggccuguaucgugaaucuggagagcaaacugcggcgccucucuaaggauuccaacaaucuggaccagagccuucccagaaaccugccugugacaauuaucucucaagauuucggggacgcgagcccccggaccaauggacaggaagccgaugacuccuccacgucugaggaaagcccugaggauuccaaauacuuucuccccuaccauccgccucagagacgcaugaaccugaagggcauucagcugcaacgggcuaaaagccccaucucucuuaagagaacauccgacuuccaggccaaggggcacgaagaggagggaaccgaugcuagcccuucuagcugcggcucccuccccauuacaaauucuuuuaccaaaaugcagcccccucgcagcagauccagcaucaugucuaucaccgccgaaccgcccgggaacgacuccauuguccggcgcuauaaggaggaugccccucauagaagcacaguggaagaggacaaugauucuggaggcuucgacgcucuggaccuggaugacgauucccacgaacgguacagcuuuggccccuccucuauccacagcuccucuagcucccaucaaagcgaggggcucgacgcguaugaucuggagcagguuaaccuuauguuccgcaaauuuucucuggaaagaccuuuccggcccuccgugacgagcgucggacacgugcgcggcccggggccuucuguucagcauaccacacucaauggagacucccugaccagccagcugacacuucucggcgggaacgccagaggaucuuucgugcacagcgucaagcccggcucccuggcugagaaagccggccugcgggaagggcaucaacuccugcuucuggagggauguauucgcggcgaaagacagagcgugccucucgauaccugcacgaaggaggaggcccacuggacaauccagcgguguucugggcccgucacccugcacuacaaagugaaucaugaaggauauagaaagcugguuaaggacauggaggauggccuuauuaccuccggggacagcuuuuacauccgccucaaccugaacaucuccucucagcuggaugcuugcacaaugagccucaaaugcgacgaugugguccacgugcgggacaccauguaucaagacagacaugaauggcugugugcccgcguugauccuuucacagaccacgaucuugacaugggcacgauucccuccuacucucgggcgcagcagcugcuccuggugaagcugcagagacuuaugcaccgcggaagccgggaggaggucgauggcacccaucacacacugagagcucuccgcaauacccugcaaccggaagaggcccucuccacaucugacccucgggugagccccagacugucccgggccagcuuucuuuucgggcagcugcuccaguuugugucucgcuccgaaaacaaauacaagagaaugaauagcaacgagcggguucgcaucauuucuggaagcccccugggcucccuggcuagaucuucccuugaugccaccaaacugcucacggaaaagcaagaggagcuggacccugaaagcgagcucgggaagaaucugucccuuaucccguauagccugguccgggcuuucuacugcgaaagacgccggcccgugcucuuuaccccuacagugcuggccaaaacccugguccagagacuucugaacucuggaggcgcgauggaguucacaauuuguaagagcgauaucgugacccgcgacgaauuucuccggagacagaaaacggagacaauuaucuauucccgcgagaagaaucccaacgccuucgaaugcaucgcuccugccaauauugaggcuguugccgcgaaaaacaagcauugucugcucgaagccgggaucggcugcacccgggaucugauuaagucuaauaucuaccccauugugcuuuuuaucagagucugugagaaaaacaucaagcgcuucagaaaacugcugccucggcccgaaacagaggaggaauuucuccgcgugugcagacugaaggagaaagaacuugaggcucugccgugucucuaugccaccguugagccugacauguggggaagcguggaggagcugcuccgggucgugaaggacaagauuggcgaggaacagcgcaaaaccaucuggguugaugaagaccaacuguga

SEQ ID NO: 66873 - RNA, 2223 nt, Artificial Sequence
  derived and/or modified sequence opt5 from CARD14__Homo_sapiens__NP_001244899
augggcgagcugugcagacgggacagcgcccucaccgcucuggaugaagagacacuuugggaaaugauggagucccaccgccauagaaucgugcgguguauuugccccucucgccugacgccuuaccucagacaggccaagguccugugucaacuugacgaagaggagguucugcacagcccgcggcucaccaacuccgcgaugcgcgcugggcaucugcuggaucuccugaaaacaagaggaaagaauggcgccaucgccuuccuugaaucucugaaauuucacaaccccgacguguauacccucgugacagggcugcagccugaugucgacuucagcaauuuuuccggacuuauggagaccucuaagcugacagaaugccucgcuggcgccauugggagccugcaggaggagcugaaccaggaaaaaggacaaaaggaggugcuccugcggcgcugucagcagcuucaggaacaucugggccucgcugagaccagagccgaaggccugcaccaacuugaggcggaucacucccggaugaagcgcgagguuagcgcccauuuccacgaagugcugagacucaaagacgagaugcugucucugucccuccauuacagcaaugcucugcaggaaaaggagcuugccgcuucucggugccgcucccugcaggaagaacucuaucugcuuaaacaggagcugcaaagagccaacauggucagcucuugugaacucgagcugcaggaacagucccugcggacggcgagcgaucaagaguccggggacgaggagcucaauagacugaaggaggaaaacgagaaacuucgcucucugaccuuuagccucgccgaaaaggauauccuggagcagucccuggacgaggcucggggaagcagacaggaacuuguggagcgcauucacucucuccgggaaagagccguugcugccgagcgccagcgggaacaauacugggaggagaaggaacagacacugcugcaguuccagaaauccaagauggccugccaacucuauagagagaaagugaaugcucugcaggcgcaggucugugaacuucagaaggagcgcgaucaagccuacagcgcucgggacucugcccagagagaaaucagccagucccugguggagaaagacucucuccgcagacagguguuugagcugaccgaucaagucugcgaacugcggacacagcuucggcagcuccaagccgagcccccuggcguucugaagcaggaagcucgcaccagagagcccuguccucgggaaaaacagagacuggugcgcaugcacgccaucugcccgcgggacgauagcgacugcucccucgugagcucuacggagucccagcugcuuagcgaucugucugcgacauccagcagagagcucgucgacuccuuccgcucuagcucccccgcuccucccucucaacagagccuguauaagagaguggccgaagauuuuggggaggaaccuugguccuucagcucuugucuggagauucccgagggagacccgggcgcccuuccuggggcuaaggccggagauccccaucucgacuacgaacugcuggauaccgcugaccucccucagcuggaguccagccuucagcccguuucucccggccggcuggacguguccgaaagcggcguccucaugcgcagacggccugcccgcagaauccugucucaagugacaaugcuggcguuucagggggaugcccuucucgagcagauuagcguuaucggaggcaaccugaccgggauuuucauccaccgggugaccccgggauccgcugccgaccagauggcucugcgccccggcacacaaauugucaugguggauuacgaagccagcgagccucucuuuaaagcgguccuggaggacacgacccuugaagaggccguggggcugcucagacggguugauggauucugcugucugucugugaaggucaauacagacggcuauaaacgccugcuucaggaucuggaagcuaagguggccaccuccggcgacagcuucuacaucagaguuaaccucgcuauggaggggcgggccaaaggagaacuccaggugcauugcaaugagguccugcacgugacagauaccauguuucaaggcugugggugcuggcaugcccacagagugaacuccuauacgaugaaggacacagcugcgcacggaaccauccccaauuacucucgcuga

SEQ ID NO: 66874 - RNA, 594 nt, Artificial Sequence
  derived and/or modified sequence opt5 from CARD16__Homo_sapiens__NP_001017534
auggccgacaaggugcugaaagagaagagaaaacucuucauccacagcaugggcgaagggaccauuaacggacugcuugaugagcugcuccagacacggguccugaaucaagaagagauggaaaagguuaaacgcgagaacgcuacggugauggacaagaccagagcccuuaucgauuccgugauucccaagggcgcgcaggcuugccagaucuguauuacauacaucugcgaggaagacucuuaucuggccgagacccucgggcugagcgccgcucugcaggccguccaagauaauccugcuaugccgacauguuccucucccgaaggacggaucaaacucugcuuucuggaggacgcccagcgcauuuggaagcagaaacuucagagaugucaugugcaaaacaccaucauuaaguggagcgagcgguacacauccggcucuuucgaaaugcaguggcuguuucuccgcaccaauuucaucgagagauuuuggcggaacauucugcuucugccucuccacaaagggagccuguauccccgcaucccuggacugggcaaggaacuccagacgggcacccauaagcuguccuga

SEQ ID NO: 66875 - RNA, 3114 nt, Artificial Sequence
  derived and/or modified sequence opt5 from CARD6__Homo_sapiens__NP_115976
auggccaccgagagcacacccuccgaaaucauugagagagaacggaagaaacugcucgagauccugcagcacgacccugauucuauucuugacacgcugaccagccgcagacucaucuccgaagaggaguacgaaacacuggagaacgugaccgaucuucugaagaaaucucggaagcuccugauucugguccagaaaaagggcgaagcuacaugccaacauuuccucaagugucuguuuagcaccuucccgcaguccgccgcgaucugcgggcuucgccacgagguucugaaacaugagaauacagugcccccucagucuaugggagcuagcuccaacagcgaagacgccuuuucucccggcaucaagcaaccugaggcccccgaaauuaccguguucuuuuccgagaaagaacaccucgaucuggagacgagcgaguucuuuagagacaagaaaaccucuuaucgggaaacagcucuuuccgcccgcaagaaugagaaggaauacgauaccccugaggucacacugagcuauucuguggaaaaaguugggugugaggugccggcuaccaucacguacauuaaggacggacagagauaugaggaacucgaugacucccuguaccugggcaaagaggaauaucucgggagcgucgauacacccgaggacgccgaagcgaccguggaggaggaaguuuacgaugacccugagcaugugggauacgacggcgaagaggauuucgagaacuccgaaacaaccgaguuuucuggcgaagaacccagcuaugaaggguccgagaccagccugucucuugaggaggagcaggaaaaguccaucgaggaacggaaaaaggucuucaaagacgugcugcucugccugaauauggaucgcagcagaaaggugcuuccugacuuugucaagcaguucucucuggaucggggauguaaauggacacccgagagcccgggcgaccucgccuggaacuuucugaugaagguucaagcucgcgaugugacggccagagacuccauucugucucacaaagugcucgaugaggacagcaaggaagaucugcuugcuggggucgagaaucuggaaauccgggacauucagaccaucaacccucucgacgugcugugcgccacaaugcuuuguuccgauagcucucugcagcgccagguuauguccaauauguaccaaugccaguucgcgcucccccugcugcucccugacgccgagaacaauaaaagcauccugaugcuuggagcuaugaaggauauugugaagaaacagucuacccaauucuccggcgggcccacagaagacaccgagaaguuucugacgcucaugaaaaugcccgucaucagcuucgugagacugggauauuguuccuuuucuaagagccggauucugaacacacuucucuccccugcccagcugaaacugcacaagaucuuccuccaucaggaucugccgcuucugguucuccccagacagauuucugacggccugguggagaucaccuggugcuuuccugauagcgacgaucgcaaggaaaaucccuucuuucaaaaaccugucgcucuggccaaccuucggggcaaucucgaguccuucuggacccaguuuggguuccugauggaagugagcucugccgucuuuuucuuuacagacugucugggagagaaggagugggaucuccugauguuccuuggcgaagcugcgaucgagagaugcuacuucgugcuguccagccaggcccgcgaaucugaggaagcucagauuuuucaacggauccucaaccugaaacccgcccagcugcuuuucugggagagaggggacgccggagaucgccggaagaacauggagggccuccaggcugcccugcaggaaguuauguuuuccagcugccugagaugugugucugucgaggacauggcggcucucgcccgcgaacuggggauucaaguggacgaggauuucgaaaauacccagcggauccagguuagcuccggagagaacauggccggcacagcugagggcgaagggcagcaaagacacagccagcuuaaaucuuccagcaagucccaggcccugaugccgauucaagagccuggaacgcagugcgaacucucucagaaucugcagaaccuguauggcacccccguguuucgcccuguccuugagaauagcuggcucuuucccacacggaucgggggaaacuuuaaucaugugucccugaaggcuucuugggugaugggcagaccuuucgggagcgaacaacggcccaaaugguuucacccgcugccuuuccagaacgccggcgcgcagggacgcggcaaguccuuugggauccagucuuuccacccccaaauuuucuacagcggagagagauucaugaaauucucccggguugccagaggcugucauagcaaugggaccuuuggacgccucccccggccuaucugccagcacguccaggcuuguccggagagaccccagaugaugggcacacuggaacgcucuagagccguggcuuccaagauugggcauagcuauucucuugacucccaaccugcccgggcggugggcaaacccuggccucagcaggccugcacccgcgucacggagcugaccgaagcuacaggaaagcucaucagaaccagccacauuggcaaaccccauccucaaucuuuccagcccgccgcugccacacagaagcugcggccggccucccagcaaggggugcagaugaagacccagggaggcgcuagcaacccugcgcugcagaucgggucccaccccauguguaaaagcucucaauuuaagagcgaucaguccaauccuucuacgguuaaacacagccagcccaagccguuccauuccgugccuucucagcccaaaagcucccaaacaaagucuugccagagccagccuucccagaccaagcccagccccuguaaaucuacacaaccuaagccgucccagcccuggccuccccagagcaaaccuucucaaccccgcccuccgcagcccaaguccagcuccaccaacccuucucaggccaaagcucaccauagcaaggccggacagaagagaggcgggaaacacuga

SEQ ID NO: 66876 - RNA, 1614 nt, Artificial Sequence
  derived and/or modified sequence opt5 from CARD8__Homo_sapiens__NP_001171829
auggagaagaaagaaugccccgaaaagagcuccucuagcgaagaggaacugccuagacgggacuccggcucuagccgcaacaucgaugccuccaaacucauuagacugcaggggucucggaaacuucugguggacaauagcauccgcgagcuccaauacaccaaaacaggaauuuucuuucaggcugaggccugugucacgaacgauaccguuuauagagaacugccgugcguguccgagacacuuugugacaucagccacuucuuucaggaagaugacgagaccgaggcggaaccccugcuguuccgggcugugccugagugccagcugucuggcggggauauucccuccgucagcgaggagcaagaaucuuccgagggacaggacagcggcgauaucuguucugaggaaaaucagaucguguccagcuacgccuccaagguuugcuuugagauugaagaggacuauaagaaccgccaguuccuggggccugaaggaaauguggaugucgagcucaucgacaaaucuacaaacagauacagcgugugguuucccaccgccggcugguaucugugguccgcuacaggccuuggguuccugguucgggaugaggugaccgucacgauugccuuuggaagcuggucucaacaucucgcucuggaccuucagcaccaugaacaguggcuggugggcgggccucucuucgacgugaccgccgagccggaagaggcggucgccgaaauccaccucccccauuuuauuucccugcaggcuggagagguugaugugagcugguuccucguggcccacuuuaagaaugagggcaugguccuggaacacccugcucgcguggagcccuucuacgccguucuugaaucuccuagcuucucccugauggggauccuccugagaauugcgucuggaacacggcuuagcauccccaucaccuccaacacacugauuuauuaccauccgcacccugaggacaucaaauuucaucucuaccuggugcccagcgaugcccugcucaccaaggcuauugacgaugaggaagaccgcuuccacggcgucagacugcaaacgucuccucccauggagccccuuaauuuuggcuccagcuauaucgugucuaacuccgccaaucugaaaguuaugccuaaggaacucaagcugagcuaccgguccccgggggagauucagcacuucucuaaauuuuaugcuggacagaugaaggaacccauccaacuugagaucacagagaaacgccauggcacccuggugugggauacagaagucaagccuguggaccuccagcuggucgccgccagcgcucccccucccuucuccggggcggccuuugugaaagagaaccacagacagcugcaggcucggaugggagaucucaagggcguucuggacgaucuucaagacaaugaagugcugaccgagaacgaaaaagagcucgucgagcaggaaaagaccagacagucuaagaaugaggcccugcugagcaugguggaaaagaagggggaccuugcccucgauguucuguuccgcuccauuagcgagcgggacccguaccuggugucuuaucucagacagcaaaaccuguga

SEQ ID NO: 66877 - RNA, 1611 nt, Artificial Sequence
  derived and/or modified sequence opt5 from CARD9__Homo_sapiens__NP_434700
augagcgacuacgagaacgaugacgaaugcugguccgugcuggagggcuucagagucacccucacaucuguuaucgaucccagccggauuacgccuuaucugcgccaguguaaggugcuuaauccggacgaugaggaacaagugcuguccgaccccaaccucgucaucagaaaacggaagguggggguucugcuugauauucugcagcgcaccggacacaaaggcuacguggccuuucucgaaucucuggagcuguauuacccucagcucuauaagaaagucacagggaaggagcccgcuagaguguucagcaugaucauugacgccuccggagaaucuggccugacccagcuucugaugacagagguuaugaagcuccagaaaaaggugcaagaucugaccgcgcuucugagcuccaaagacgauuuuaucaaggaacuccgggucaaagacagccugcugcgcaagcaucaggagagagugcagcggcucaaggaggaaugcgaggcugggucucgcgaacugaaaagauguaaggaggaaaauuacgaucuugccaugcggcuggcccaccaauccgaggagaaaggagcugcccucaugcgcaacagagaccugcagcuugaaaucgaccagcugaagcauagccucaugaaagcugaggaugacugcaagguggaacggaaacacacacugaagcugcgccaugccauggagcagagaccuucucaagaacuccugugggagcuucagcaggagaaggcgcugcuccaagcccggguccaggaacuggaggcuuccguucaggaaggcaaacuugauagaagcucucccuauauucaggugcuggaggaagacuggcgccaagcccuccgggaucaccaggagcaggcuaauaccaucuucucccugagaaaggaccugcgccagggcgaggcccggagacuccgcuguauggaagagaaagaaauguuugagcugcaaugccuugcgcugcggaaggauagcaaaauguacaaggacagaauugaggccauccuccugcagauggaagagguggcuauugaacgcgaucaggccaucgcuacgcgggaggaacugcacgcccagcaugccagagggcuucaagagaaggacgcucuccgcaaacagguccgggagcugggagaaaaggcggaugagcugcagcuccagguguuccaaugugaagcccagcugcuugcuguugagggcagacugcggcgccagcaacucgaaacccuggugcuguccucugaccuugaggacgggagcccuagacggucccaggagcucagccugccgcaggaucuggaagacacacagcucucugauaaaggaugccuggccggcgggggaucccccaagcaaccuuuugccgcccuucaccaggagcagguccugagaaacccccaugacgcuggccucagcucuggcgaaccucccgagaaagaacgccggagacugaaggagagcuucgagaauuaccgcagaaagcgggcgcugcgcaaaaugcagaagggguggagacaaggagaagaggaucgggaaaacaccacaggcuccgacaauaccgauacggaggggucuuga

SEQ ID NO: 66878 - RNA, 2178 nt, Artificial Sequence
  derived and/or modified sequence opt5 from CARF__Homo_sapiens__NP_001098056
auggagcagagcaacgacucccugagagugaaucacaacgauggcgaagagucuaagaccagcgcccaagucuucgaacaucucaucugcauggacucccgggauucuagcuuugggcagaaugacucccccacaguucugccuauuacgacccgcgaggcuaacaauucucuuaucagccagaacauuccgggaccccugacacagacccaaacacucuccgccgaacaguuccaccugguggaucagaauggccaggcgauccaauacgagcuucagagccugggggagucuaacgcucagaugaugauuguggccuccccuaccgaaaauggacagguccucagagugaucccgccuacacaaaccggcauggcccagguuaucauuccccaggggcaacugguggacgucaacagcccucgggaugugccggaggaaaaacccucuaaucgcaaccugccuacgguuagaguggacacccucgcugauaauacauccaacuauauccugcauccccagaccagcuuuccucuucccaagaaaucugucacaggaaugcuggaggagccgcuccugggcccucuucagccccuguccagcaauaccccuauuugggccugucggcuccgcuccugcgaaaagaucggcgacucuuacagaggguauugugugagcgagacggaacuggaguccgugcugacauuccacaaacagcaaacccagagcgucuggggaacacggcagucucccucccccgcuaagccugccacccgccucauguggaaaagccaguacguuccguaugauggcauucccuuugugaacgcggggucuagagccguggucauggaaugccaauacggaccucggcgcaagggcuuccagcugaagaaagugagcgagcaggaguccagaucuugucagcuuuauaaggcuaccugccccgcccggaucuacauuaaaaagguucaaaaguuuccugaauaccgcgugcccacagacccgaaaaucgauaagaaaaucauuagaauggagcaggaaaaggcuuucaacaugcugaaaaagaaucucgucgacgccgggggagugcugcggugguauguucagcuuccuacgcagcaagcgcaucaguaccacgagcuggaaacccccugucucacacugagcccuucccccuuuccugugagcucucuggaggaggaagagaccgccgucagagacgaaaacugcgcucuccccucccgccugcacccccagguggcccauaaaauccaagagcuugucagccagggcauugaacagguguaugcuguucggaagcagcugagaaaguucguggagcgcgagcucuuuaaaccugaugaaguccccgagcggcacaaucugucuuucuuucccacagugaacgacaucaagaaucauauucacgaaguucaaaaaucccuuagaaacggcgauaccguguacaauagcgagaucaucccugccacgcugcaguggacaaccgacuccgggaacauucucaaggagaccaugacagucaccuucgccgaaggaaauucuccgggcgagagcaucacaacgaaaguggaaaccaaccagacacgcgggucccugucucccgagccuacccaucugcucagcucccugagcucuuuccagcccaagauuuuuacacaacuucagggacugcagcuccagccucgguauaccucccccgaugaaagcccugcugugguuucugucaauaaccaacccuccagcucuccgagcggccugcuggacacgaucggguccgcggugaugaauaacaauagccuucuccugggacagucucacucccugcagagagauaccugucucacacaaaacaacagcaccgccuccacaaugggcaaucugccugagcccgaccagaaccuuguggcuauggaugagcuggucgaagugggcgacguugaggauaccgggaaucucgaaggaacggugcaccgcauucugcugggcgacguccagacaaucccuauccagauuaucgacaaccauucugcccuuauugaggaaaaucccgagagcaccaucuccgugucucaaguuaagcaggagccgaaagaaccugcccucagcauggaggcuaagaaaacaguggauuacaagaaacuguccgccaccuga

SEQ ID NO: 66879 - RNA, 1044 nt, Artificial Sequence
  derived and/or modified sequence opt5 from CARKD__Homo_sapiens__NP_001229810
auggugaccagagccggcgcugggacagccgucgcgggagcuguugugguggcccugcucagcgccgcucuggcccuuuacgggcccccucuggacgcuguccucgagcgggccuucucccugcgcaaggcgcacucuaucaaagauauggaaaacacgcuucagcuggugagaaauauuaucccgccccucagcuccaccaagcauaaagggcaagacggacggauuggcguugugggcggaugccaggaguauacaggcgccccuuacuuugcugccaucucugcucugaaggucggcgccgaucugagccacguguucugugcguccgccgcugcccccguuauuaaggcuuauucuccugaacucaucgugcaucccguccuggacagcccuaacgccgugcacgagguggaaaaauggcuuccgcgccugcaugcccucgucguugggcccggacugggcagagaugacgcgcuucugcggaaugugcaggggauccucgagguguccaaggcucgcgauauuccugucgugaucgacgccgauggacuguggcugguugcucagcaacccgcccucauucacggcuacagaaaagccgugcugaccccuaaccacgucgaguuuagccggcuuuaugacgcugugcugcgcgggcccauggauucugacgauucccauggaagcguucucagacugucucaggcccuuggcaaugugacagucgugcagaagggcgaacgggacauccuguccaacgggcagcaaguccucgugugcagccaggagggaucuucccgcagauguggcgggcagggagaccugcugagcggcucccucgggguucuggugcacugggcgcuucuggcuggaccgcagaaaaccaauggcucuagcccucuccuggucgccgccuucggcgcuugcucccuuacacggcaauguaaccaucaggccuuucagaagcacgggcgcagcaccacgaccucugauaugauugcugaagugggagccgcguucuccaaacuguuugagacauga

SEQ ID NO: 66880 - RNA, 1827 nt, Artificial Sequence
  derived and/or modified sequence opt5 from CARM1__Homo_sapiens__NP_954592
auggccgcugccgcggcugccgugggccccggggccggaggcgcugggagcgccgucccuggaggcgcugggccgugcgccaccguuuccguguuccccggagcgagacugcucacaaucggcgacgccaacggcgagauucagcggcacgcugaacaacaggcccugcgccuugaggugagagcugggccugauucugccggaaucgcgcuguacagccaugaagacgucuguguguuuaagugcuccguuucucgggagacggaauguagccgcgugggcaaacaguccuucauuaucacccucgggugcaauucuguccugauucaguuugccacacccaacgauuucuguagcuuuuauaauauccuuaagaccugcagaggacacacacuggagcgguccguguucagcgagcgcaccgaagagucuuccgcuguucaauacuuucaguucuauggcuaccucagccagcagcaaaacaugaugcaggacuaugugagaacagggaccuaccagcgggccauccugcagaaucauacggauuuuaaagacaagauuguccuggaugugggauguggcucuggcauccucuccuucuuugcugcccaagccggggcucgcaaaauuuaugcgguggaagccagcaccauggcucagcacgccgagguccugguuaagucuaacaaucuuacagacagaaucguggugauuccuggaaaggucgaggaagugucccugcccgagcagguugauaucauuaucagcgaaccuaugggcuacaugcucuuuaacgagcggaugcuggaauccuaccuucaugccaaaaaguaucugaaaccgucugggaauauguuucccaccaucggagacgugcaccucgcuccuuucacagaugagcaacuguacauggagcaguucaccaaggccaacuuuugguaucagcccagcuuccacggcgucgaccuguccgcgcuccgcggggcugccguggaugaauacuuuagacagccuguuguggacacguucgacauucggauccugauggccaaaagcgucaaguauacagugaauuuucuugaggcuaaggaaggagaucugcaucgcauugagauccccuucaaauuucacaugcuccauucuggccugguccacggccuugccuucugguuugacguggcuuucauuggguccaucaugaccguuuggcugagcacagccccgaccgaaccucucacccacugguaccaagugagaugccuguuucagucuccccuguucgcgaaggccggagauacacucagcggcacgugucugcuuaucgcuaacaaacggcaguccuaugacauuucuaucgucgcccagguggaucaaaccgggagcaaguccagcaaucugcucgaccugaaaaacccuuucuucagauacacaggaaccacacccucucccccuccgggcucccauuacaccagccccucugagaauauguggaacacgggguccacauauaaccuuagcuccggcauggcuguugccggaaugccuaccgcguacgaucugucuagcgugauugccuccggcucuagcgucgggcacaauaaccucaucccccuggcuaauaccggaauugugaaccauacacacucccgcaugggcagcaucaugucuaccgggaucgugcagggauccagcggcgcccaggggucuggcggaggcuccacaagcgcucauuaugccguuaauucucaguucacgaugggagggccugccauuagcauggcuucccccaugagcaucccgaccaacacaaugcacuacggcucuuga

SEQ ID NO: 66881 - RNA, 2496 nt, Artificial Sequence
  derived and/or modified sequence opt5 from CARS__Homo_sapiens__NP_001014437
auggccgacagcuccggccagcaagcucccgauuacagaucuauccugagcauuuccgacgaggccgcgcgggcucaggcccucaacgaacaccugucuacccgcagcuaugugcagggguacucccuuucucaggccgaugucgacgcuuucagacaacugagcgccccuccggcugauccccagcucuuucauguugcccggugguuccgccacaucgaggcgcugcuuggauccccuugcggcaaggggcagcccuguagacugcaggccagcaaaggacggcgcgugcaaccucaguggucucccccugcuggcacacagccgugcagacuccaucuguauaauucccugacgcggaacaaggaaguguuuauuccccaggacgggaaaaaggucaccugguacuguugcggaccuacaguguaugaugccagccacaugggccaugcucgcucuuacaucuccuucgacauucucagacggguucugaaagauuauuuuaaguucgacguguuuuacuguaugaauaucaccgauaucgacgauaagauuaucaaacgcgccagacaaaaccaccuuuucgagcaguaccgggaaaagcgccccgaggcggcccagcugcucgaggacguccaagcugcccugaaaccuuuuagcgugaagcucaaugaaacaaccgaccccgauaaaaagcagaugcuggagcggauucagcacgcuguucagcucgccacagaaccgcuggagaaggccgugcaaucuagacugaccggcgaggaagucaacuccugcguggaggugcuccuggaagaggcuaaagaccuucugagcgauuggcucgacuccacgcuggggugugaugucaccgacaauucuaucuucagcaaacuuccuaaguuuugggaaggagauuuccauagagacauggaggcgcugaacguucuucccccugaugugcugacacgcguguccgaguauguccccgaaauugugaauuuuguucagaagaucguggacaacggcuacggguaugucagcaauggaucuguguacuucgauaccgccaaauucgcuuccagcgagaagcacucuuauggcaaacugguucccgaagccgugggggaccagaaggcccuccaggagggagaaggcgaccugagcauuuccgcugaucggcuuucugagaagagaagcccuaacgacuuugcccuguggaaagcguccaagccgggcgagcccagcuggccuugccccugggggaaaggacgcccuggcuggcauaucgaauguucugcuauggccgggacacuccugggagccuccauggauauccacggcgggggauucgaccuucgguuuccccaccaugauaaugagcuggcucaaagcgaagccuacuucgagaacgacugcugggucagauauuuucuccacaccggccaucugacgauugcuggcuguaagaugucuaaaucccugaagaauuucaucacaauuaaggaugcccucaaaaagcacagcgcgcgccagcugcggcuugccuuucugaugcauuccuggaaagacacccucgauuacucuagcaacacaauggaauccgcucugcaguacgagaaguuccugaacgaguuuuuccuuaaugugaaagacauccucagagccccggucgauauuaccgggcaguuugaaaaguggggagaggaagaggcugagcugaacaagaauuucuaugacaaaaagaccgccauccacaaagcgcugugcgauaacguggacacacgcacgguuauggaagagaugcgggcccucgugucucaaugcaaucuguacauggcugccagaaaggcuguccgcaaacggccuaaccaggcccuucuggaaaauaucgcccucuaucugacccacaugcugaagauuuuuggcgcuguggaggaagacagcucccuuggguuccccguuggaggcccugggacaagccucucucuggaggcgaccgugaugcccuaccugcagguccucuccgaguucagagaaggcgugcggaagaucgcccgcgagcagaaagugccugaaauucugcaacuuagcgaugcucugagagacaacauccuccccgagcugggaguucgguuugaagaucaugagggccugccgacagucgugaaacuuguggacagaaauacccuccugaaggagcgcgaagagaagcggagagucgaagaggaaaaacgcaagaaaaaggaggaggccgccagacggaagcaggaacaggaggcugccaaacuggcgaagaugaaaauuccucccucugaaauguuccucuccgagacggauaaguauagcaaauuugacgagaacgggcugcccacacacgauauggaaggaaaggagcuuucuaagggccaagcuaaaaagcugaaaaagcuguucgaagcccaggagaaacucuacaaggaauaucugcagauggcccagaaugggagcuuucaauga

SEQ ID NO: 66882 - RNA, 351 nt, Artificial Sequence
  derived and/or modified sequence opt5 from CARTPT__Homo_sapiens__NP_004282
auggagagcuccagagugcggcugcucccccugcuuggcgccgcucugcuccugaugcuuccucugcucgggacccgcgcccaggaagacgcggagcugcaaccgagagcucuggauaucuacucugccgucgacgaugccagccacgaaaaggagcucauugaagcucugcaggagguucuuaaaaagcugaaauccaagcgggugcccaucuaugagaaaaaguacggacaggugccuaugugcgacgccggcgaacagugugcuguccgcaagggggccagaauuggaaaacucugcgauuguccccggggcacaucuugcaacagcuuccugcuuaagugucuguga

SEQ ID NO: 66883 - RNA, 2073 nt, Artificial Sequence
  derived and/or modified sequence opt5 from CASC1__Homo_sapiens__NP_001076441
augagacagaccggcgggggagccacaacggacagcgcuucccccgugcugaacaaugucaucaagucucaaagcuacuucaccgccaaacggguuggccucgggaacaauuccuaucugggagugggccgcccuucuagccagcaguggcuuucccugccggggcccggaggccagggcccuaaggcgaaaaagucugggagcaaaaagaagaaagugacaaaggcugagagacucaaacugcuucaagaagaggaagaacggcgccugaaggaagaggaggaagccagacucaaauacgagaaggaagagauggagcggcuggaaauucagcgcaucgagaaggaaaaauggcacagacuggaggccaaggaucucgaacggcgcaacgaggagcuggaggagcuuuaucugcucgaaagaugcuuucccgaggcugaaaaacugaagcaggagaccaaacuucugucccaguggaagcauuacauucaaugugacggaagcccugaucccucugucgcccaggagaugaauacauucaucucccucuggaaagaaaagaccaacgagacauuugaagaggugauugaaaagagcaaaguugugcugaaucugaucgagaagcucaaauucauccugcuugagaccccuccgugcgaccugcaggauaagaacauuauccaguaucaagaaucuauucuccagcugcaggagcuucugcaccucaaauuuggcgucgcuacggaaauccugcugaagcaagccuccacccucgcggaccuggauagcgggaauauggagaaggugauuaaagacgagaacguuacacuuuacgugugggccaaucugaagaaaaacccccggcaucgcucugucagauucuccgaaacccagaucggauuugagauuccucggauccucgcuacaagcgauaucgccgugcgccugcuucacacccauuaugaccacguguccgcucugcaccccgucucuacgccuagcaaggaauacacauccgccguuaccgagcucgugaaagaugacgugaagaaugucgaaaaggcgauuagcaaagagguggaggaagagucuaagcagcaggaaagaggcucccaucugauccaagaggaagagauuaaaguugaggaggaacagggggauaucgaagugaagaugagcucugccgaggaagagagcgaggcuauuaaaugugaacgggagaugaagguccuguccgaaacagugucugccgcucagcuccugcuuguugagaacagcuccgagaagcccgacuucuuugaagacaauguggucgaucugugccaguucaccacccucggaggcguguaccaccuggacauccuggagcuuccgccucaauguaaacccgucaagggcuggaugaucguggaaauucucaaagaggggcugcagaaguauacauacccucccgaaacgaccgaggaguuugaaacagagaacgccuuucccccuaucgaaguuacccuggaggugcaugaaaacgucauuuucuucgaggauccggugguugugagaugggacgccgagggaaaacacuggcgcacagauggcaucagcaaugucucuuauaagcccaaagaacggcucgugaccuucucccuggacacguuugggccugugacacuuauucaggaugcucacaucaacaugcccuaccagagcugggagcugagaccucucgacguuaauaagguccugcugaccgugaccacaguguucaccgaaauccaaauucagaucaaggagaaccuuugcaugcucucuuccauuaaacugaaggauaaaaagcauaucagcauucuggaaggaacauggaugacgcccaucccguuuauuaucgcgcucaaagaggccggccugaauaucuucccuacccgccacucccauuuuuaugucauuaucaacaauaaggugccccuuguugaggugaaggcuuaccggcagauggcccugcucucuagcgccuucgcuuuugggugguccaaauggaaccugcuguguaauucuacaaaggucguguucaaaugguga

SEQ ID NO: 66884 - RNA, 2112 nt, Artificial Sequence
  derived and/or modified sequence opt5 from CASC3__Homo_sapiens__XP_005257220
auggccgacagacggcgccagagagcuagccaagauaccgaggacgaagaguccggcgccucugggagcgauuccggaggcucuccccugcggggaggaggcagcugcuccgggucugcgggaggcggcgggagcggaucccucccuagccagcgcggcgggagaacaggagcucugcaccuucggcgcguggaaucuggcggggccaaguccgccgaggaaagcgagugugagucugaagacggaaucgagggcgaugcuguccuguccgacuacgaaagcgccgaggauucugagggcgaagagggggaauauuccgaggaagagaacagcaaaguugagcucaaguccgaagcuaaugacgccgugaacucuagcacgaaagaggaaaagggagaggaaaaaccggauaccaaguccacagugaccggcgagagacagagcggggacggacaggagucuacagaacccgucgagaauaaggugggcaaaaaggggccuaaacaucuggaugacgaugaagaccggaagaaccccgcguacauuccucgcaaaggacuuuucuuugagcacgaccugagaggccaaacccaggaagaggagguucggcccaagggccgccagagaaagcucuggaaagaugaagggcggugggagcaugacaaguuccgcgaagaugagcaggccccuaaauccagacaagagcugaucgcucuguauggauacgacauucggagcgcccacaauccggaugacaucaagcccagacgcauucggaaaccuagauauggcucucccccucagcgcgaucccaacuggaauggggaacggcucaacaagagccauagacaccagggacugggcgggacacuuccgccucgcaccuuuaucaaucggaacgcugccggcacgggaagaauguccgcgccccgcaauuacucucggagcggcggguucaaagaggggagagccggcuuucgcccuguggaagcugggggacagcacggcgggcgguccggcgagaccgucaagcaugaaaucagcuauagaucucggcgccuggagcaaacauccgugagagaccccagccccgaggccgaugcuccuguucucggaucuccggaaaaggaggaagccgccuccgagcccccugcugcggcccccgacgcugccccucccccgccugaucggcccauugagaaaaagagcuacuccagagcccgccggaccagaacaaaagugggcgacgcugucaagcuggccgaagaggugccucccccucccgaagggcuuaucccggcgccucccgugcccgagaccacgccuacaccgcccaccaaaacaggaaccugggaagcuccugucgacucuagcaccuccggccuggagcaggauguugcccagcucaacauugccgaacaaaauuggucucccgggcagccuagcuuccugcagccccgcgagcugagaggaaugccuaaccacauccauaugggcgcugggcccccgccucaguuuaaucggauggaggaaaugggcgugcaaggaggccgcgccaagagauacuccagccagcggcagcgccccgugccugagcccccggcuccucccguccacauuucuaucauggaagggcacuauuacgacccucuccaguuccaaggacccauuuauacacauggcgauucccccgccccucugccgccccaggggaugcuugugcagccuggaaugaaccugccccacccuggccuccauccccaccagacgccugcgccgcugcccaacccugggcuuuaucccccucccguuagcaugucuccgggccaaccuccuccccagcagcugcucgcccccaccuacuuuuccgcucccggagugaugaauuucggcaacccuagcuacccguaugcccccggggcucugccucccccucccccgccucaucuguaccccaauacacaggccccuucucaagucuacggaggcgugaccuauuacaaccccgcgcagcagcaaguucagccuaagcccagcccgccuagacggacaccccagcccgugaccaucaaaccuccgcccccugaggucgugucccgcgggagcucuuga

SEQ ID NO: 66885 - RNA, 1311 nt, Artificial Sequence
  derived and/or modified sequence opt5 from CASC4__Homo_sapiens__NP_612432
auggugggcuucggggccaacagacgggcuggacgccugcccagccucguccugguugugcuucugguggucaucgugguucucgccuuuaauuacugguccauuucuagcagacacgugcugcuucaggaggaagucgcggagcugcaaggccaggugcagcggaccgaaguugcucgcgggagacucgagaagcggaacuccgaccugcugcuccugguggauacacauaaaaagcagaucgaccaaaaagaagccgauuauggacgccuuucuagcagacugcaggcccgggagggccucgggaagcgcugcgaggacgauaaagucaagcugcagaauaacauuuccuaccagauggcugacauccaccaucuuaaggaacaacuggccgagcucagacaggaguuccugcggcaggaggaucagcugcaagacuaucgcaaaaauaacacguaccucgugaagagacuggaguaugaaucuuuucaguguggacagcaaaugaaagagcuucgggcucagcacgaagagaauauuaagaaacuggccgaucaguuccucgaagaacagaagcaagagacccagaagauccagagcaacgacggcaaagaacuggauaucaauaaccagguggucccuaagaauauuccgaaaguugcggagaacguggccgacaagaaugaggaacccuccagcaaccauaucccucacggcaaagaacaaauuaagcgcgggggagaugcuggcaugcccgggaucgaggagaaugaccuugccaaaguggacgaucugccucccgcucucagaaagccuccgauuucugucucccagcacgaaagccaucaggccaucucucaucugcccacaggacagccucugucccccaacaugccucccgacagccacauuaaccacaauggcaacccggggaccucuaagcaaaauccuuccagcccccuccagcggcugaucccuggauccaaccuugauucugagcccagaauccagacagacauucugaaacaggcgaccaaggaucgcgugagcgacuuucacaaacucaagcaaucccgguucuuugaugaaaaugagagccccguugacccucagcauggcucuaaacuggccgauuacaacggcgacgaugggaaugugggagaauaugaggcugacaagcaggccgagcuugcuuacaacgaagaggaagacggcgaugggggagaggaggacguccaagaugacgaagagagagaacugcagauggauccggccgacuacggcaagcagcacuucaaugaugugcucuga

SEQ ID NO: 66886 - RNA, 6951 nt, Artificial Sequence
  derived and/or modified sequence opt5 from CASC5__Homo_sapiens__NP_653091
auggacggcgugagcuccgaggcuaacgaagagaaugauaacaucgaaagacccguccggcgcagacacucuagcauucugaagccuccgcggagcccgcuccaggaccugcgcgggggaaaugagagaguucaagaaucuaacgcccuucggaauaagaagaacagccgcagaguguccuucgccgauaccaucaagguguuucagaccgagucucauaugaagauuguccgcaagagcgagauggaagagacggaaaccggcgagaaucugcuccugauccagaacaagaaacuugaggacaauuacugcgaaauuacagggaugaacacccugcucuccgcgccuauccacacacagaugcaacagaaggaguucagcaucauugaacauacccgggagagaaagcacgcuaaugaucagacagugaucuuuucugacgaaaaccagauggaucugaccuccagccauacgguuaugauuaccaaaggacugcucgacaaucccaucucugagaaguccacaaaaauugauaccacauccuuccuggccaaccuuaagcugcacaccgaggacucucggaugaagaaagaagugaauuuuuccgucgaucaaaacacgagcuccgagaacaagaucgacuucaaugauuuuauuaaacgccucaagacaggcaaauguucugccuucccugacgugcccgacaaggaaaacuuugagaucccuaucuauagcaaagaacccaauuccgcuagcucuacccaccagaugcauguuucccugaaggaggaugagaacaauagcaacauuacaagacuuuuccgggaaaaggacgaugggaugaauuuuacccagugccacaccgccaacauccagacacugauucccacgucuagcgagaccaauucccgcgaaucuaaaggaaacgacaucacaauuuacggcaaugauuucauggaccucaccuuuaaccauacacugcaaauccugccugcuaccggcaauuucagcgagaucgaaaaccagacgcagaaugccauggaugugacaaccggguauggaaccaaggcguccggcaacaaaacagucuucaagagcaaacaaaacaccgccuuucaggaccucucuauuaauuccgcugauaagauccacauuacaagaagccacaucaugggggccgagacgcauauugugucucagaccuguaaccaggacgcucggauccuggccaugacacccgaguccaucuacagcaauccuuccauucaaggaugcaagaccguguucuauucuagcuguaacgaugcgauggaaaugacaaaaugccuuuccaauaugagagaggaaaagaaccugcucaaacacgacucuaauuacgccaagauguauuguaaccccgacgcuaugagcucccugaccgagaaaacgaucuacagcggcgaggaaaauauggauauuaccaagucucauacagucgccaucgacaaccagauuuuuaagcaggaucaguccaauguucaaaucgcugccgccccgaccccugagaaagaaaugaugcuucagaaccugaugacaaccagcgaggacgggaagaugaaugugaacugcaauucugugccccacgucuccaaagaacgcauucagcagagccucucuaacccucugagcaucucccugacggaucggaagacagagcuccugagcggagagaacauggaccuuaccgaaucucauacauccaaucugggcagccaagugccccucgcugcguacaaccuggcccccgaguccaccucugaaagccacucccagucuaaaagcuccucugaugagugugaagagaucaccaagagcagaaaugagccuuuccagcgcuccgacauuaucgcuaagaacagccuuacagauacguggaauaaagacaaggauuggguucugaaaauucucccguaucuggacaaggauucuccccaguccgccgacugcaaccaagaaaucgccaccagccacaauauuguguacuguggcgggguccuggacaaacagaucacaaaccggaauaccgugucuugggagcagucccucuuuagcacaaccaagccucuguucucuuccggacaauuuagcaugaaaaaccaugauacggcuaucuccagccacacaguuaagucugugcuuggccagaauagcaagcuggccgaaccccucagaaaaucccugucuaacccuacccccgacuauugccaugauaagaugauuaucugcagcgaggaagaacaaaauauggaccugaccaaaucccacacagucgugauuggguucggaccgucugagcuucaggaacucggcaagaccaaccuggagcacacaacggggcaacugaccacaaugaaucgccagaucgcggucaaaguggaaaaguguggaaagagcccuauugagaaauccggcguucucaagucuaacugcaucauggaugugcuggaggacgaaagcguccagaaacccaaguuuccuaaagagaagcagaacgugaagaucuggggccggaaauccguugggggacccaagauugauaaaaccaucguguucagcgaagacgauaagaaugacauggauauuacaaaaucuuacaccaucgagauuaaccauagaccucuucuggaaaagcgcgacugucaccucgucccccuggcuggcacguccgagaccauccuguauacaugccggcaagaugacauggagaucaccagaagccauacaaccgcccuugaauguaagacagugucuccggacgagauuaccacgcgcccuauggauaaaacagugguuuuugucgacaaucacguggaacucgagaugaccgaaucccauaccguguucaucgauuaccaggagaaggagcggacagacagacccaacuuugaacugagccagcggaaaucccuggggacccccacggucauuugcacaccuaccgaggaaucuguguucuucccgggaaauggcgagagcgaucgccucguugccaacgacucccagcugacaccccuugaagaguggagcaauaacagagggccuguggaggucgcugauaauauggaacugucuaaguccgccaccuguaaaaacaucaaggacgugcaaagccccggcuuucucaaugagccucugucuagcaaaucccagcggagaaagucucugaaacuuaaaaacgauaagacaauuguuuucagcgaaaaucacaaaaacgacauggauaucacccaguccugcaugguggagauugacaaugagucugcucucgaagacaaggaggauuuucaccuggccggagcgagcaaaacgauccuguauuccuguggccaagacgauauggaaaucacccgcagccauacaaccgcccucgagugcaagacacugcuucccaacgaaauugcuauccggccuauggacaagaccguccuguucacggauaauuacucugaccucgaggugacagauucccacaccguuuuuauugacugucaggccacagagaaaauccuggaagagaaccccaaguucgggauuggaaaaggcaagaaccugggggugagcuuuccgaaagauaauuccugcguccaggaaaucgcugagaagcaggcccuugcggugggaaacaagaucgugcuccauaccgaacaaaaacagcagcuguucgccgcuaccaauagaacaacgaacgagauuaucaaguuucacucugccgcuauggacgagaaagucauuggcaagguuguggaucaggccugcacccuggaaaaagcccaaguggagagcugucagcucaauaaccgcgacagacggaaugucgauuucacauccucucaugcuaccgcggugugcgggagcuccgacaacuacagcugucugccuaauguuaucucuugcacagacaaccuugaaggcuccgccaugcugcucugugauaaggacgaggaaaaggcuaauuauugccccgugcagaacgaucuggccuacgccaaugacuuugcuagcgaguauuaccuggagucugaaggacagccucuuuccgcccccuguccgcugcucgagaaagaagaggucauucaaaccagcacgaagggccagcuggauugcgugaucacacuccacaaagaccaggaucugaucaaggacccucgcaaccuucuggcgaaucagacccucguuuauucucaagaucugggggagaugaccaaacugaacagcaagagaguguccuucaaacuucccaaagaccagaugaaggucuacguggaugacauuuauguuaucccucagccccacuuuucuacagaucaacccccucugccgaaaaagggacagagcuccauuaacaaagaagaggugauccucagcaaggcuggcaauaaaucccugaacauuaucgaaaauucuagcgcccccauuugugagaacaagccuaagauccucaauuccgaagagugguucgccgcugccugcaaaaaggagcugaaagaaaacauccagaccacaaauuacaacacggcgcuugacuuccauucuaauagcgacgucaccaaacaggugauucaaacacacgugaacgcuggggaggcccccgauccugucaucaccuccaauguucccuguuuucauucuauuaaaccuaaccugaauaaccucaauggaaagacaggcgaguuccuggccuuucagaccgugcaccucccgccccuuccugagcagcugcucgaacuggggaacaaggcucacaacgacaugcauaucgugcaggccacggagauucacaauaucaacaucauuagcuccaaugcuaaagauagccgggacgaggaaaacaagaaaucucauaauggcgccgagaccacaucccugcccccuaagaccgucuucaaagauaaggugcgcagaugcagccugggaaucuuucuuccccggcugccgaacaagcgcaauugcucuguuacaggcauugacgaucuggaacaaaucccugcggacaccacagauauuaaccaccucgagacgcagcccguguccagcaaagacucugggaucggauccgucgccggcaagcugaaucuuagccccucccaguacaucaacgaagagaaucugccuguguaucccgaugagauuaacagcucugacagcaucaauauugaaaccgaggaaaaagcucucaucgagacauaccagaaggagauuuccccuuaugaaaacaaaauggggaagaccuguaauucucaaaagagaaccuggguucaggaggaagaggacauccauaaagaaaagaaaauucggaagaacgagaucaaauucagcgauacaacgcaggaccgcgagaucuuugaucaccacaccgaagaggacauugauaaguccgccaacucugugcugaucaaaaaucucagcagaacaccguccucuugcagcuccagccuggacucuauuaaggcugauggaaccucccuugacuucagcacauaccggucuucccaaauggaaagccaguuucugagagauaccaucugugaggaaucccugcgcgagaagcuccaggacggccggauuacgaucagagaguucuuuauccugcuucagguccauauucugauccaaaaaccccgccagucuaaccucccugggaauuucacagugaacacacccccuacccccgaagaucugaugcucagccaguaugucuaccggccgaagauucagaucuauagagaggacugcgaagcccgccggcagaagauugaggaacugaaacuuuccgccagcaaucaggauaaacugcugguggacaucaacaagaaucucugggagaagaugagacacuguucugacaaagagcugaaggcuuucggcaucuaccuuaacaaaauuaaguccugcuuuacaaaaaugaccaagguuuucacacaucagggaaagguggcgcuguacggcaaacucguccagagcgcccaaaaugaacgcgagaagcugcagaucaaaauugaugaaauggacaagauccucaaaaagauugauaacugucugaccgagauggagacggaaacaaagaaucuugaggacgaagagaaaaacaauccuguggaagagugggauucugagaugcgggcugccgaaaaggagcuggaacagcugaaaaccgaggaagaggagcuccagagaaaccugcuugaacuggagguucaaaaggaacagacacucgcccagaucgacuuuaugcaaaaacagcggaaucgcaccgaggaacugcuggaucagcucagccuuuccgagugggacguggucgaguggucugaugaccaggcuguguucacguuuguguaugauaccauucaacugacaaucaccuucgaagagagcguugucggguuucccuuccuggacaagagauaccggaaaaucguggacgugaacuuucagucccuccuggaugaagaccaggccccucccucuagccuucugguccacaagcucauuuuccaguauguggaggagaaggaauccuggaaaaagacaugcaccacacaacaccagcugccuaaaaugcuggaggaauuuagccucguugugcaucacugucgccuucugggagaggaaaucgaguaccugaagagauggggccccaacuauaaucucaugaacauugauaucaauaacaaugagcugcggcuucuguucucuuccagcgcggcuuuugccaaauucgaaauuacccucuuccuguccgccuacuauccgucugucccucugcccagcacgauccagaaccauguggggaauacaucccaggacgauaucgcuaccauucucucuaagguuccccuugagaacaauuaccugaagaacguggucaaacaaaucuaccaggaccuguuucaggauugccacuucuaucauuga

SEQ ID NO: 66887 - RNA, 2394 nt, Artificial Sequence
  derived and/or modified sequence opt5 from CASD1__Homo_sapiens__NP_075051
auggccgcucuggccuacaaccucggcaagagagagaucaaucacuauuucagcgugcgguccgcgaaaguccuggcucuuguugccgugcugcuccuggccgcuugccaucuugccucucgcagauaccgggggaacgacagcugugaauaucugcucuccucuggacgcuuucugggcgagaagguguggcagccccacagcugcaugaugcauaaauacaagauuuccgaagcuaaaaauugucuggucgauaagcacaucgccuucauuggggacucuagaauccggcaacucuuuuauagcuucgugaagauuaucaacccucaguuuaaagaggaaggaaauaagcaugagaacaucccguucgaggauaaaaccgcguccguuaagguggacuuucuguggcaccccgaagucaauggcagcaugaaacagugcauuaagguguggacagaggauucuaucgccaagccucacguuauuguggcuggggccgcuacgugguccaucaaaauucauaacggaagcucugaagcccuuucccaguacaagaugaauaucaccagcauugcgccccugcucgagaaacuggccaagacaucugacgucuauugggugcuucaagauccuguguacgaggaccugcucuccgaaaaccgcaaaaugaucaccaaugagaagaucgaugcuuacaacgaagccgcugucagcauucucaauuccucuacaagaaacagcaaauccaauguuaagauguucagcgugucuaagcugaucgcccaggagaccauuauggaaucccuggacggccugcaccuucccgagagcucucgggagacaaccgccaugauccugaugaacguguauuguaacaaaauucucaagccugucgauggcagcugcugucagccgagacccccugugacgcugauccagaaacuugcugcgugcuuuuucacccuguccaucauuggguaccucaucuuuuauauuauccaucgcaaugcccaccggaagaacaaacccuguacagaccuggaaucuggagaggaaaagaagaauauuaucaacaccccuguuagcucccuggagauccuccugcaaucuuucugcaaacuuggccugauuauggcuuacuuuuauaugugugaucgcgccaaucucuucaugaaggaaaacaaauucuacacacacucuuccuuuuucauccccauuaucuauauucuggugcuuggggucuuuuacaaugagaacaccaaggagacgaaagugcugaauagagaacagacagacgaguggaagggauggaugcagcucguuauccugauuuaccauaucagcggcgccucuaccuuccugccgguguauaugcacauccggguccucguggcugccuaccuguuucagacaggguauggacauuucuccuacuuuuggauuaagggcgacuucggcaucuaucgcgucugccaagugcuuuuuagacugaacuuccucguugugguccugugcauugugauggaucggccuuaccaguuuuauuacuucguuccccuggugaccgucugguuuauggugaucuacgugacccuugcgcucuggccucagauuauccagaaaaaggcuaaugggaacuguuucuggcacuucggacugcugcucaaacugggcuuucuucuccuguucaucugcuuucuggccuauagccaaggggccuucgaaaagaucuuuucccuguggccccuuucuaaauguuucgagcucaagggaaauguuuacgaauggugguuuagauggcgccuggaccgguaugucguguuccauggcaugcuguuugcuuucauuuaccucgcccugcagaagagacagauucuuagcgaggggaaaggagagccccuguuuuccaacaagaucucuaauuuccuccuguuuauuagcguggucuccuuccugacauauagcaucugggcuucuuccugcaaaaacaaggccgaauguaacgagcuucacccuagcgugucuguugugcaaauccucgcguucauucugauccgcaauauuccgggcuacgcccgguccgucuauagcagcuuuuucgcuugguuuggcaaaaucagccuggaacucuucauuugccaguaccacaucuggcuggccgcugauacgagagggauccuugugcugauucccggaaacccuaugcucaauaucauuguuuccaccuuuaucuucgugugugucgcccaugagauuagccagaucacaaacgaccuggcgcagauuaucauccccaaggauaauucuucccugcuuaaacgccucgccugcauugcugccuuuuucuguggccugcugauccucagcuccauucaagacaagucuaagcacuga

SEQ ID NO: 66888 - RNA, 2697 nt, Artificial Sequence
  derived and/or modified sequence opt5 from CASK__Homo_sapiens__NP_001119526
auggccgacgaugacgugcuguucgaggaugucuacgaacucugcgagguuaucggcaaggggcccuuuagcguggugagacgguguauuaaccgcgaaaccggacagcaauucgcugucaaaaucguggacguugccaaguuuacauccucuccuggccugagcacggaggaucuuaaaagagaagcguccauuugccacaugcugaagcauccgcacaucguggagcuccuggagaccuauucuagcgacgggaugcuuuacauggucuucgaauuuauggauggagcugaccuguguuucgagauugugaaacgggccgaugccggcuuuguuuauuccgaagcuguggccucucauuacaugcgccagauccucgaggcucugagauauugccacgacaauaacaucauucaucgggaugucaagccccacugugugcugcucgccagcaaggaaaauuccgcgccugugaaacuugggggauucggcgucgccauccagcugggcgaaagcgggcugguugcuggaggccgcguggggacaccccacuuuauggccccugagguggucaagagagaacccuacggaaaaccuguggacguuuggggcugcggggugauucucuucauccugcuuucuggaugucugccguuuuauggcaccaaggagagacucuucgaaggcauuaucaaagggaaguacaagaugaacccccgccaguggucccauauuagcgagucugcuaaagaucuggucagacggaugcugaugcucgacccugccgagcgcaucacaguguacgaagcgcugaaucaccccuggcuuaaggagagagaccgguaugccuacaaaauccaucugccugaaaccguugagcaacuccgcaaguuuaacgcuagacggaaacugaagggagccgugcuugcugccgucuccagccacaaauucaauucuuucuauggcgaucccccggaggagcugccugacuuuuccgaggaucccacaagcuccgggcuccuggccgcugaaagagcggugucucagguccuggacagccucgaggaaauucacgcccugaccgauugcuccgagaaggaccuugauuuccugcauagcguguuucaggaccagcaccuccauacgcugcuugaucuguacgacaagaucaacaccaaaucuuccccucaaauucgcaauccucccagcgaugcuguucagcgggccaaggaagugcucgaggagaucucuuguuaucccgaaaacaaugacgccaaagagcugaagcggauucugacacagccgcacuucauggcucuccugcagacccaugacgucguggcccacgaaguuuacagcgaugaggcgcuucgcgugacacccccucccaccuccccuuaucugaacggagacucucccgagagcgcuaauggcgauauggacauggaaaacgucacgcgggugagacucgugcaauuucagaaaaauacagaugagccgauggggaucacccugaagaugaacgaacugaaccacugcaucguugcccgcauuaugcauggaggcaugauccaccggcagggcacacuucaugucggggacgagauuagagaaaucaauggaauuuccguggccaaccaaaccguggagcagcuccagaagaugcugcgcgagaugcggggcagcaucaccuucaaaaucgucccuucuuacagaacacaguccagcucuugugaagaucugcccuccacgacccaaccuaaggggcgccagauuuacgugcgggcucaguuugaguaugaccccgccaaagaugaccucaucccuugcaaggaagcuggaauuagauuccggguuggcgauaucauucagaucauuagcaaagacgaucacaauugguggcaagggaagcuggagaacuccaagaauggcacagccggacuuauccccucuccggaacugcaggaguggcgcguggcgugcaucgccauggagaaaaccaagcaggaacagcaagcuagcuguacaugguuuggcaaaaagaaaaagcaguacaaggacaaauaucucgccaagcacaacgcugaccuggucaccuacgaggaagugguuaaacugccugccuucaagagaaaaacgcuugugcuccugggggcgcauggagucggccggagacacauuaagaauacacugaucaccaaacaucccgaucgcuuugccuaucccauuccucacaccacacggccgcccaagaaggacgaggaaaacgggaaaaauuacuauuucgugucccaugaucagaugaugcaggacaucucuaacaaugaguaccucgaguacggaagccacgaagaugcuauguauggcaccaagcuggagacaauuagaaaaauccacgaacaagggcuuaucgccauucuggacguugagccucaggcucucaaggugcugcgcacggccgaguuugcccccuucgucguguucaucgcugcgccuaccauuacacccggccugaacgaagaugagucccuucagagacuccaaaaagaaagcgacauccugcagcggaccuacgcccauuauuuugaucugacaauuaucaauaacgagaucgacgaaaccauucgccaccucgaggaggcuguggaacuggucugcacggccccucaguggguucccgugucuuggguguacuga

SEQ ID NO: 66889 - RNA, 1368 nt, Artificial Sequence
  derived and/or modified sequence opt5 from CASP10__Homo_sapiens__NP_001193453
augaaaagccagggccaacacugguacuccucuagcgacaagaacugcaagguguccuucagagagaaacugcucaucauugauucuaaucuggggguccaggacguugaaaaccuuaaguuucuguguaucggacucgugcccaauaaaaagcuggaaaagagcuccucugccagcgauguguucgagcaucuucuggcugaggaccuccuguccgaagaggauccguuuuuccuggccgagcuccuguauauuauccggcagaaaaagcugcuucagcaccucaacugcaccaaagaagaggucgaacgccugcuuccuacaagacaacgggugagccuguuucgcaaucuccuguacgagcugucugagggcauugacuccgaaaaccucaaggauaugaucuuccugcuuaaagacagccugcccaagacggagaugaccucucucuccuuucuggcguuccuugaaaagcaggggaaaaucgaugaggacaaucugacaugucucgaagaucugugcaagaccguugugccuaaacugcucagaaacauugagaaguauaaacgggagaaggcuauccagauugucacacccccuguggacaaagaagccgagagcuaccagggagaagaggaacugguuucucaaaccgaugugaagacauuucuugaggcccugccccaggaguccuggcagaauaagcaugcuggcagcaacgaaauccucucccacgucuuccaguggcugggguuuaccgugcauauucacaauaacgugacgaaagucgagauggaaaugguucuucaaaagcagaaauguaauccugcccacgcugacggagacugcuucguguuuuguauccugacccauggccgcuucggcgccguguauucuagcgaugaggcgcucauuccgaucagagaaaucaugucccacuucacagcccugcagugcccccggcuggcugagaagccuaaacucuuuuucauucaagccugucagggggaggaaauccagcccagcgucucuauugaggcugacgcccugaacccugaacaggcgcccaccucccuucaagauagcaucccggccgaggcugacuuucugcucggacuggccacagugccuggcuacguuucuuuccgccauguggaggaagggagcugguauauucagucccugugcaaucaccuuaagaagcucguccccagacacgaggauauccugucuauccugaccgcugugaacgacgauguuagccggcgcguggacaaacagggaacgaagaaacagaugccucaacccgccuuuacacucagaaagaaacuggucuuccccgugccucuugaugcccugucccucuga

SEQ ID NO: 66890 - RNA, 729 nt, Artificial Sequence
  derived and/or modified sequence opt5 from CASP14__Homo_sapiens__NP_036246
augagcaaccccagaucccuggaggaagagaaguacgacaugucuggcgcccggcucgcucugauccuuugcgugaccaaagcccgcgaagggagcgaggaagaucuggacgcgcucgagcacauguucagacagcugcgguuugaguccacaaugaagcgcgauccuacggcugaacaauuccaggaggaacuugagaaauuucagcaggccauugacucuagagaggauccggucagcugugccuucguugugcugauggcucauggacgggaaggcuuucucaagggggaggacggagaaauggugaaacuggagaaucuguucgaagcccucaacaauaagaacugccaagcucugcgcgccaagcccaaagucuauaucauucaggcguguagaggcgagcagcgggauccuggggagaccgugggaggcgacgaaaucguuauggugauuaaggauucuccccagacaaucccuaccuacacagacgcccuucacgucuauuccaccguggagggcuacaucgcuuaucgccaugaucaaaaagggagcugcuuuauucagacacugguugacguguucaccaagagaaaaggacacauccucgaacugcuuacggaggucacccggcgcauggccgaagcugagcuggugcaggagggcaaggccagaaagacaaaucccgaaauucaguccacccuccggaaacgccuguaccugcaauga

SEQ ID NO: 66891 - RNA, 1152 nt, Artificial Sequence
  derived and/or modified sequence opt5 from CASP1__Homo_sapiens__NP_001244048
auggccgacaaggugcugaaagagaagagaaaacucuucauccggagcaugggcgaagggaccauuaacggacugcuugaugagcugcuccagacacgcguccugaauaaggaagagauggaaaaaguuaagagagagaacgcuacggugauggacaagacccgggcccuuaucgauuccgugauucccaaaggcgcgcaggcuugccaaaucuguauuacauacaucugcgaggaagacucuuaucuggccgggacccucggacugagcgccgcuccucaggccguccaggauaauccggcuaugcccacauccucuggcagcgaggggaacgugaagcuguguucccucgaagaggcccaacgcaucuggaaacagaagucugcggagauuuacccuaucauggacaaaagcuccagaacccggcuggcccuuauuaucugcaaugaagaguuugauagcauuccccgcagaacaggagcugaaguugacaucaccggcaugacgaugcugcuccagaaccugggcuauucuguggaugucaagaagaaucuuaccgccuccgacaugacaaccgagcuggaggcuuucgcccaccggccugaacauaaaacaagcgauucuaccuuucucguguucaugucccacgggauucgcgagggaaucuguggcaagaaacauagcgaacagguucccgacauccugcaacugaacgcgauuuuuaauaugcucaacacgaagaauugcccuucucugaaagauaagccgaaagugaucauuauccaggccuguagaggggacucccccggagucgugugguucaaggacagcgugggcgucuccgggaaccuuucucugccuacaaccgaggaauuugaggaugacgcuauuaagaaagcccacaucgaaaaggauuucaucgcuuuuugcagcuccacacccgacaauguuagcuggcggcauccuaccaugggaucuguguucauuggccgccucaucgagcacaugcaggaguacgccuguuccugcgauguggaagagauuuuuagaaaaguccgguucagcuuugaacagcccgacggccgcgcccaaaugccgaccacagagagagugacgcugacccgguguuucuaucuuuucccugggcacuga

SEQ ID NO: 66892 - RNA, 939 nt, Artificial Sequence
  derived and/or modified sequence opt5 from CASP2__Homo_sapiens__NP_001215
augcacccccaucaccaagagacccugaagaaaaaccgggugguccucgccaagcaacugcuucugagcgaacuccuggagcaucuucuggaaaaagacaucauuacacucgagaugcgggaacugauccaggcuaagguuggcuccuucucucagaauguggagcugcucaaccugcuuccuaaacgcgggccgcaggccuuugaugcguucugcgaggcucugagagaaacgaagcaaggacaccucgaggacaugcugcuuaccacacugagcggccuccagcaugugcugcccccucuguccugugauuacgaccucucucugcccuuuccugucugcgaaagcuguccccuuuauaagaaacugcggcucuccaccgauacaguggagcacucucuggacaauaaggaugggccuguuugccuucaggugaaaccguguacccccgaguucuaccagacacacuuucaacuggccuaucgccuccagagcagaccucggggacuggcccugguccucuccaacgugcauuucaccggcgaaaaggagcuggaauuucgcagcgggggagacguugaucacucuacgcuugugacccuguucaaacuccugggcuacgacguccaugugcuuugcgaucagacagcucaggagaugcaagaaaagcugcagaauuuugcccagcuccccgcucacagagugaccgacuccuguauugucgcccugcugagccacggcguugagggggcgaucuauggaguggauggcaagcuccugcaacuucaggagguguuccagcuguuugacaacgccaauugcccuucucuccagaacaaacccaagauguucuuuauucaggcuuguagagggggagccaucggcucccuggggcaucugcuucucuucacagcugccaccgcgagccuggcccuguga

SEQ ID NO: 66893 - RNA, 834 nt, Artificial Sequence
  derived and/or modified sequence opt5 from CASP3__Homo_sapiens__XP_011530603
auggagaacaccgaaaauagcguggacuccaagucuaucaaaaaccuggagcccaagauuauccacggcagcgaauccauggauucugggauuagccucgacaauuccuacaaaauggauuauccugagaugggacugugcaucauuaucaacaauaagaacuuccauaaaucuacaggcaugacgagcagauccgggaccgacgucgaugccgcuaaucuucgggaaacauuucgcaaccugaaguacgagguuagaaauaagaacgaccucacccgggaggaaaucguggagcugaugcgcgaugugagcaaagaagaccacucuaagagauccagcuucgucugugugcuucugucucauggagaggagggcauuaucuuugggacaaauggaccgguugaucucaaaaagauuaccaacuucuuucggggcgaccgcugcagaucccugacaggcaaacccaagcuguucaucauucaggccugucgggggaccgaacucgauugcggaaucgagacggacagcggcguggaugacgacauggcgugucacaagauuccugucgaagcugauuuucuguaugccuacucuaccgcccccggguauuacuccuggcgcaauagcaaagacggauccugguucauccaaucucuuugcgcuaugcugaagcaguaugccgauaaacucgaguuuaugcauauccugacaagagugaaccggaagguugcuaccgaauuugagagcuucuccuucgacgccacauuucacgcgaaaaagcagauuccuuguaucgugagcaugcuuaccaaagagcuguacuucuaccacuga

SEQ ID NO: 66894 - RNA, 1134 nt, Artificial Sequence
  derived and/or modified sequence opt5 from CASP4__Homo_sapiens__NP_001216
auggccgagggcaaccacagaaagaaaccccugaaggugcucgaaagccuggggaaagacuuccuuaccggaguccuggauaaucucguugagcagaacgugcugaauuggaaggaagaggagaaaaagaaguacuaugacgcuaaaacagaagauaaggugcgggucauggccgacuccaugcaagagaaacagcgcauggcgggccagaugcuucugcagacguuuuucaacaucgaucaaauuucuccuaauaagaaagcucauccgaacauggaagccgggcccccugagagcggagaauccaccgacgcccucaagcugugcccccacgaggaguuucugagacucuguaaggaacgggcugaggaaaucuacccuauuaaagagcgcaauaacagaacacggcuggcccuuaucauuugcaauaccgaguucgaucaucugcccccucgcaacggcgcugacuuugauaucacagggaugaaggaacuccuggagggacuugacuauucuguggauguugaagagaaucugaccgccagagacauggaaagcgcgcuccgggccuucgcuacacgcccggagcacaaauccucugauagcaccuuucuggugcugaugucccauggcauccucgaaggcauuugugggacgguccacgacgagaagaaacccgacgugcugcuuuacgauaccaucuuccagauuuuuaacaauagaaacugccugagccucaaggacaaaccuaagguuaucauugugcaggccugucggggagcuaaucgcggcgagcugugggucagagauucucccgccucccuugaaguggcgagcucucaguccagcgagaaccuggaagaggacgccguguauaagacacacgucgaaaaagauuucaucgcuuuuuguucuuccaccccucauaacguuagcuggcgggacuccacaauggggucuauuuucaucacccaacucaucacgugcuuucagaaguacagcuggugcugucaccuggaggagguguuccgcaaagugcagcaguccuucgaaacacccagagccaaggcucaaaugccgaccauugagcggcugagcaugacaagauauuuuuaccucuucccuggaaauuga

SEQ ID NO: 66895 - RNA, 1131 nt, Artificial Sequence
  derived and/or modified sequence opt5 from CASP5__Homo_sapiens__NP_001129581
auggccgaggacaaccacaagaaaaagaccgugaaaaugcuggaauaccucggcaaggauguccugcaugggguuuucaauuaucuugcuaaacacgacgugcugacacucaaggaggaagagaagaaaaaguacuaugauacgaaaaucgaagacaaggcccugauucuuguggauagccugcggaaaaacagagucgcgcaucagauguuuacccaaacacuccugaauauggaccagaagaucaccuccgugaagccccugcuccagauugaggcuggaccuccggagucugccgaaagcacaaacauccugaaacuuugcccccgcgaggaguuccugagacucuguaagaaaaaucacgaugaaauuuacccuaucaagaaacgggaggaccgcagacggcuggcccuuaucauuugcaacaccaaguuugaucaucugcccgcucgcaauggcgcccacuaugacaucguugggaugaaaagacuccugcagggacugggcuacacaguggucgaugaaaagaaccucaccgcucgggacauggaguccgugcugcgcgccuucgcggccagaccugaacacaagucuagcgauuccacguuucuuguucugaugucucaugggauucucgagggaaucuguggcaccgcucacaaaaagaaaaagcccgacgugcugcuuuaugacacaauuuuccaaaucuuuaauaaccggaauugccugagccucaaagauaagccuaaggucauuaucgugcaggccugucgcggcgaaaaacauggggagcugugggugagagacuccccggcuagccuggcccucaucucuucccagagcucugagaaccuggaagcggauuccgucugcaagauucacgaggaaaaagacuucaucgccuuuuguagcucuacaccccacaauguuuccuggcgggaucgcaccagaggaagcauuuucaucaccgagcuuauuacgugcuuucagaaguacuccuguugcugucaucugauggaaaucuuccggaaagugcaaaagucuuuugaggugccucaggcuaaggcccagaugcccacaaucgagagagcuacccucacacgcgacuucuaccuguucccuggcaacuga

SEQ ID NO: 66896 - RNA, 882 nt, Artificial Sequence
  derived and/or modified sequence opt5 from CASP6__Homo_sapiens__NP_001217
augagcuccgccucuggacuuagacgggggcaccccgcuggaggcgaggaaaacaugaccgagacagacgccuucuacaagcgcgaaauguuugauccugcggagaaauauaagauggaccauagacggcgcgggaucgcucucauuuucaaucacgaaagauuuuucuggcaucugacgcuuccggagcggcgcggaaccugcgccgauagagacaaccugacacggcgcuuuagcgaucucggcuucgaggugaaauguuuuaaugaccugaaggccgaggaacuucugcucaaaauccacgaagucuccaccguuucucaugcugaugccgacugcuucguguguguguuucugagccacggggagggaaaccacauuuacgcuuaugaugccaagaucgagauucagacacugaccggccucuucaagggcgacaaaugccauucccuggucgggaagcccaaaaucuuuaucauucaagcguguagaggaaaucagcacgaugugccuguuaucccccuugacguggucgauaaccagacagaaaagcuggacaccaauauuacggagguggacgccgcuucuguuuacacccucccugccggcgcugauuuccugaugugcuauagcguggccgaaggguacuauucccaucgggagacagucaacggaagcugguacauccaggaccuuugugaaaugcugggcaaauacgggucuucccucgaguuuaccgagcugcugacacucgugaaucgcaaggugagccaaagacgggucgauuucugcaaggaccccucugcgauuggcaaaaagcagguuccuuguuucgccuccaugcugaccaaaaagcugcacuuuuucccgaaaagcaacuga

SEQ ID NO: 66897 - RNA, 912 nt, Artificial Sequence
  derived and/or modified sequence opt5 from CASP7__Homo_sapiens__NP_001218
auggccgacgaucagggcugcaucgaggaacaagggguggaggacagcgcuaacgaagauuccgucgacgccaagcccgauagaucuagcuucguuccuucccuguuuucuaaaaagaaaaagaaugugaccaugcggagcauuaaaacaacgcgcgacagagugccgaccuaccaguauaacaugaauuucgagaagcucggaaaguguaucauuaucaacaauaaaaacuuugauaaggucacaggcaugggggugcggaauggaaccgacaaagaugcggaagcucuguucaagugcuuucgcucccuuggcuucgacguuauuguguacaacgauuguucuugcgccaaaaugcaggaccugcucaagaaggccagcgaggaggaucacacaaaugcugccuguuuugcuugcauccugcuuucccauggggaagagaacgucaucuauggaaaagacggcgugacccccauuaaggaccugacagcccacuucagaggcgaucgguguaaaacccuccuggaaaagccuaaacuguuuuucauccaggcgugccgcgggacggagcucgacgauggcauucaagccgacagcggacccaucaaugauaccgacgcuaacccuagauacaagauucccguugaggccgauuuucuguucgcuuauucuacagugccuggguacuauuccuggcggagcccgggacgcggcucuugguuuguccaggcccuuuguuccauccuggaggaacaugggaaagaccucgaaauuaugcagauccugaccagagugaaugaucggguggcgcgccacuucgagagccagucugacgauccccauuuccacgaaaagaagcaaaucccuugcgucguuuccaugcuuacaaaagagcuguacuuuagccaguga

SEQ ID NO: 66898 - RNA, 5949 nt, Artificial Sequence
  derived and/or modified sequence opt5 from CASP8AP2__Homo_sapiens__NP_001131140
auggccgcugacgacgacaacggcgaugggaccagccuguucgacguguuuuccgccucuccccucaagaauaacgaugagggaagccuggacaucuacgcgggccuugauuccgcugucucugacagcgccuccaaaucuugcguuccuagcagaaauugucuggaucucuaugaagagauucugacggaagaggggacggccaaggaagcuaccuacaacgaccuucagguggaguauggaaaaugccaacugcagaugaaggagcucaugaaaaaguucaaggaaauccagacacagaauuuuucccugauuaacgagaaucaaagccugaaaaagaacaucucugcccucauuaaaaccgcucggguggaaaucaaucgcaaggaugaggagaucuccaaccugcaccagagacuuagcgaguucccgcauuuucggaauaaccacaaaacagcccgcaccuucgacacagucaagaccaaggaucugaaaucuagaagcccccaccucgacgacuguagcaagacggaucaccgggcgaaaucugacguguccaaggauguucaucacagcaccucccugccuaaucuugagaaagaaggcaagccccacucugacaaacgcagcacaucccaucugccuaccagcguggagaagcacugcacaaacggggucuggucuagaucccauuaccaggugggagaaggcagcucuaaugaggauagccggcgcggcagaaaggacauucggcacucccaguuuaaccgcgggaccgagagaguucggaaagaucucucuacgggauguggcgacggggaaccccgcauccuggaggccagccaaagacugcagggacacccugaaaaguauggcaaaggggagccgaagacagaauccaaaagcucuaaguucaaguccaacagcgauucugacuacaaaggagagcggauuaauuccagcugggagaaggaaacccccggcgagagaucccauucucgcguggauagccaguccgacaaaaagcucgaacggcagucugagagaagccaaaacaucaaucgcaaagaagucaagucccaggacaaggaggagcggaaaguggaucagaagccuaaaagcguggucaaggaccaagaucacuggagacgcucugaacgggcuucccugccccauagcaaaaacgagauuacauuuucucacaauuccagcaaguaucaucuugaagagagacgcggcugggaggacugcaagcgggauaaaucuguuaacagccacuccuuccaggacgggagauguccuagcucucuguccaauagccgcacccacaagaacaucgauuccaaagaaguggacgccaugcaucagugggagaauacaccccucaaggcugaacggcacagaacagaggauaaacggaagcgcgaacaggagucuaaagaggaaaacagacauauucggaaugagaagagagugccgacggaacaucugcaaaagaccaacaaagagacaaagaaaaccacaaccgaccuuaagaaacagaaugaaccuaagacggauaagggagagguccuggacaacggcgugagcgagggggccgauaauaaagaacucgcgaugaaggccgaguccggacccaacgaaaccaagaacaaggaccugaaacugucuuuuaugaagaagcucaaucugacccuuagcccugcuaaaaagcagcccguuucccaggacaaccaacacaaaaucaccgauauccccaagucuagcggcgugugcgacuccgagagcucuaugcaggucaaaacaguggccuacguuccuuccauuagcgaacacauccugggggaggcugccgugucugagcacaccaugggagaaacaaaguccacgcuccuggagccgaaggucgcccuucuggcugugaccgaaccccgcauuggcaucagcgagacaaauaaagaggaugaaaacucucuccugguccgguccguggacaauaccaugcauugugaggaaccuauuugcggcacagagaccagcuuccccuccccuauggaaauccagcagacggagagccuguuucccucuaccgggaugaagcaaacaaucaacaauggcagagcggccgcuccgguugugauggauguccuccagaccgacgugagccagaacuucggccuggagcuugauacaaaacgcaaugacaacuccgauuacugugggauuucugaaggaauggagaugaagguugcccugagcaccacgguguccgaaacaaccgagucuauccuccagccuagcauugaagaggccgacauccugcccauuaugcuguccgaggauaauaacccuaaauucgaacccucugucaucgugacaccucuuguggagagcaaguccugccaccucgaacccugccugccgaaagagacccuggacagcucucuccaacagaccgaacugauggaucauagaauggcuacaggcgagacaaauuccguuuaucacgacgacgauaacagcguccuuucuaucgaccugaaucaccuccggccuauucccgaggccaucagcccccugaacagcccugugcgcccgguggcgaagguccugagaaacgaaagcccuccccaggugcccguuuacaauaacucucauaaggauguguuucuuccuaauagcgcucacuccaccagcaaaucucaauccgaccucaacaaggagaaucagaaacccauuuauaagagcgauaaauguacagaagccgauaccugcaagaacucuccucuggaugagcuggaggaaggggagauccggagcgacuccgaaacaucuaagccccaggagagcuucgagaagaauagcaagcgcagagucucugccgaugugcggaaaagcaagaccauuccgcgcagaggcaaauccacgguuugucucgacaaggauagccggaagacacaugugcgcauccaccagaccaacaauaaauggaacaagagaccugacaaaucuucccggagcuccaagaccgagaaaaaggacaaggucaugucuacaagcucccuggagaaaauugugcccaucaucgcuguuccuucuagcgaacaagagauuaugcauaugcuuagaaugauccgcaagcacgugcggaaaaauuacaugaaguuuaaagccaaguucucccugauucaguuucacagaaucauugaaagcgcuauccucucuuucaccucccugaucaagcaucugaaccuucacaaaauuagcaagucugucacaacgcuccagaaaaaucugugcgauaucauugaguccaagcugaaacaggugaagaaaaacggaaucguggaccgccucuuugaacaacagcugcccgauaugaagaagaaacuuuggaaguucgucgacgaucagcuggacuaucucuuugccaaacugaagaaaauucugguuugugauagcaagucuuucggccgggacagcgaugaggggaaacuugagaaaaccuccaagcagaaugcgcaauacucuaacagccagaaaagauccguggacaacagcaaucgcgaacuccugaaggagaaacuguccaagucugaagauccggugcauuauaagagccucgucggaugcaaaaaguccgaggaaaacuaccaggaccaaaauaacucuagcaucaauacagugaaacacgauaucaagaaaaacuuuaauauuuguuucgacaacaucaaaaauucccagucugaggagcggagccuggaaguucacugcccuuccacccccaagagcgagaaaaacgaaggaucuuccauugaggacgcccagacaagccagcaugcuacccuuaagccugagagaucuuuugaaauccugacggagcaacaggccuccagccucaccuucaaucuggugucugaugcucagaugggggaaauuuucaaaucccugcuucagggaagcgaccugcucgauuccagcgucaacuguacagagaagucugaaugggagcugaaaacccccgagaagcaacuccuggaaacacuuaaaugcgagagcauccccgccuguaccacagaggaacugguguccggcguugcgucuccuugcccgaagaugaucagcgacgauaauuggucccuccugucuagcgaaaaggggcccucccugucuagcggccuuucccugccugugcaccccgacguccucgaugagagcugcauguuugaggugucuaccaaccugccucucuccaaagacaauguuuguagcguggaaaagucuaaacccugcgucuccagcauucugcuugaggaucuggccgugucccucacggugccuucuccgcugaaguccgacggacaucuguccuuccuuaaacccgauauguccucuuccagcacaccugaagaggucaucucugcucacuuuagcgaagacgcccugcucgaggaggaagaugcuuccgagcaggacauucaucuggcccucgaaucugacaacagcuccucuaagagcuccuguuccucuuccuggaccagccgcuccguugcccccggcuuccaguaccacccuaaucugcccaugcacgcugugaucauggagaagucuaacgaucauuuuauugugaaaauccggagagcgaccccgagcacauccucugggcuuaagcagagcaugaugccugacgagcugcugaccucccucccccggcacggaaaagaagccgaugagggccccgaaaaggaguauauuagcugccaaaacacggucuucaaaucuguggaagaacuggaaaauuccaacaagaauguugacgggagcaagucuacacaugaagaacaauccagcaugauccagacccaggugccugauaucuacgaauuucuuaaagacgcuucugauaagaugggacacuccgacgaggucgccgaugaauguuucaaacugcaccaagugugggagacaaagguucccgagagcauugaggagcucccuucuauggaagagaucagccauuccgugggcgaacaucugccgaacaccuaugucgaccucacaaaagaucccgugaccgagacgaagaaucugggggaguuuauugaagucaccgugcuucauaucgaccagcugggcugcagcggaggcaaccugaaucaguccgcccaaauucucgacaacucucugcaggcugauacaguuggggccuucaucgaccuuacccaggaugcgagcuccgaggcuaagucugaaggaaaucacccugcccuggccguggaggaccucggcuguggggucauccagguggaugaggacaacugcaaagaagagaaggcucaaguugccaaucgcccccugaaauguauuguggaagagacauacaucgaucucaccacggaaagcccuuccucuugcgaggucaagaaagacgagcugaaguccgaacccggauccaacugugauaauagcgagcuuccgggcacacugcauaacucucacaaaaagagacggaauauuuccgaccugaaccacccucauaagaaacagcgcaaggaaaccgaucucacaaacaaagagaagaccaaaaagcccacccaggacagcugcgaaaauacagaggcgcaccagaagaaggcuucuaagaaaaaggccccucccgugacgaaagauccuuccagccugaaggccacccccgggaucaaggacucuuccgcugcccuugcuacaagcaccucucuguccgccaaaaacgugauuaagaaaaagggcgagaucaucauucucuggacaagaaaugacgaucgggaaauccugcucgagugccagaaaagaggaccgagcuuuaagaccuucgcguaucuggccgcuaaacuugacaaaaacccuaaucagguuagcgaacgcuuucagcagcugaugaagcuguucgagaaauccaagugucgguga

SEQ ID NO: 66899 - RNA, 1617 nt, Artificial Sequence
  derived and/or modified sequence opt5 from CASP8__Homo_sapiens__NP_001073594
auggagggcgggagacgggcccgcguggucaucgaaagcaagagaaacuucuuucugggagcuuuccccaccccuuuuccggccgagcacguugaacucggccggcugggggacuccgagacagcgauggugcccggaaaaggcggggcugauuacauucuucugccuuucaagaaaauggacuuuucucgcaaucucuaugauaucggagaacagcuggacagcgaggaucuugccucccugaaguuccucucucuggacuacauuccccaaagaaaacaggagccuaucaaggaugcccugaugcucuuucagcggcugcaggaaaagcgcaugcuugaggaaagcaaccuguccuuccucaaagagcugcuuuuuagaauuaaucggcuggaccuccugaucacguaucugaacacccgcaaggaggaaauggagagagaacuccaaacacccggccgggcucagaucucugccuaccgcgugaugcuguaucagauuagcgaggaagucuccagaagcgagcuucggucuuucaaauuucugcuccaggaggaaaucuccaagugcaaacuggaugacgauaugaaucuucuggacauuuucaucgagauggaaaagcgcgugauucucggcgaggggaagcuggauauccugaaaagaguuugugcucaaauuaacaagagccuccugaaaaucaucaaugacuacgaagaguuuucuaaggagcgguccagcucucuugaaggauccccugacgaguucagcaacggcgaagaacugugcggggugaugaccauuuccgauucuccgagagaacaggacagcgagucccagacacucgauaaagucuaucagaugaaaagcaagccccgcggauacugucugaucauuaauaaccauaauuucgccaaggcgcgggagaaggugccuaaacuucacucuaucagagaccgcaacggcacccaucuggaugccggggcucucacaaccacguuugaggagcugcacuucgaaauuaagccccaugacgauugcaccguugagcaaaucuacgagauccugaaaauuuaucagcucauggaccacuccaauauggauuguuuuaucugcuguauucugagccacggagacaagggcaucauuuacggcacagaugggcaggaagccccuaucuaugagcuuaccucucaauucacaggacugaaaugccccagccucgcuggcaagccgaagguguuuuucauccaggccugucagggggacaacuaccagaaaggcauuccugucgaaaccgacuccgaggaacaacccuaucuggagauggaucugucuagcccucagacgcgguacauccccgacgaggcggauuuucuucucggaauggccacagugaauaacugcguguccuauagaaaccccgcugaagggaccugguacauucagagccugugucagucucugcgcgagcggugcccuagaggagacgauauccucacaauucugaccgaagucaauuacgagguuuccaacaaggacgauaaaaagaauaugggcaaacaaaugccgcagcccaccuucacacuucgcaagaagcugguguuuccuagcgacuga

SEQ ID NO: 66900 - RNA, 1089 nt, Artificial Sequence
  derived and/or modified sequence opt5 from CASP9__Homo_sapiens__XP_011540572
auggacgaggccgauagacggcugcuccgcagaugccggcugcgccuuguggaggaacugcaggucgaccaacucugggaugcucugcuuagcagagaacuguuccggccccacaugaucgaggacauucagcgcgccggcuccgggucuagacgggaucaggcgcgccagcucaucauugaccuggaaaccagaggaagccaagcucugccucucuuuaucuccugucuggaggauacaggccaggacaugcuugccucuuuccugcggacgaaccgccaggccgcuaagcucagcaaaccgacccuggagaaucuuacacccguugugcugagaccugaaauucggaagcccgaggugcuccgcccugaaacccccagaccugucgauaucggguccggaggcuuuggggacgugggagcccuggagucucugcggggcaacgcugaucucgccuacauccugagcauggagccgugcggccauugucuuauuaucaauaacguuaauuucugcagagaauccgggcugcgcacacggaccggaagcaacauugacugugagaaacucagacgccgguuuucuucccugcacuucaugguggaagucaagggcgaucuuacagcgaaaaagauggugcuggcccuccuggagcuggcucagcaagaccauggggcccucgacugcuguguuguggucauccugagccacggaugccaggcuucucaucuucaguuucccggcgccguguaugggaccgauggauguccuguguccgucgaaaagauuguuaauaucuucaacggcacgagcugccccucucugggcgggaaaccuaagcucuuuuucauucaggcguguggaggcgggugccaagccgaccccgcuccgucccacagcagacugcgcccucccugcugugccgugucccggcacucucagaccccuggagcugauagcggcguguccaccaaaaagacaacaagaagcaaugagccccagaaccuugagaaaaauauggccgucaccgaccaacgcgggcccccucuggaagccggaggccuccgggagaagcagugggauucuuga

SEQ ID NO: 66901 - RNA, 1191 nt, Artificial Sequence
  derived and/or modified sequence opt5 from CASQ1__Homo_sapiens__NP_001222
augagcgccaccgacagaaugggcccccgggcugugccugggcugcgccucgcccugcuucugcuccugguccuuggaacaccgaaguccggcguucaggggcaagagggacuggauuuccccgaauacgacggcguggauagagugaucaacgucaaugcgaaaaacuauaagaauguguuuaaaaaguacgagguucucgcucugcuguaucacgaaccucccgaggacgauaaagccucucagcggcaguucgaaauggaggagcucauucuggaacuugccgcucaggugcuggaggacaagggggucggauuuggccucguggauagcgaaaaggacgccgcuguugccaaaaagcugggccuuacggagguggauuccauguacgucuucaaaggggacgaggugaucgaauaugauggagaguuuucugcggacaccauuguggaauuucugcucgauguccuggaggacccuguugaacugaucgagggcgagcgcgaacuccaagccuuugagaacauugaagacgagaucaagcugaucggguacuucaaaagcaaggauuccgaacauuauaaggcuuuugaggacgccgcugaggaguuccaccccuacauuccuuucuucgccacauuugauucuaaaguggcgaagaaacuuacccugaagcucaaugaaaucgacuucuacgaagccuucauggaggaaccggugacaauucccgauaaaccuaacagcgaggaggaaaucgucaauuuuguggaggaacauagacgguccacccugcgcaaacuuaagcccgagagcauguaugagacaugggaagacgauauggacggcauucacaucguugcuuucgccgaggaagcugauccugacggauuugaguuccuggaaacccucaaggccguggcccaggauaacacggagaaucccgaccugucuauuaucuggaucgacccggaugacuuuccucugcucguccccuacugggagaagaccuucgauauugaccuguccgcuccucagaucggggugguuaacgugacagaugcggacagcgucuggauggaaauggaugacgaggaagaucuucccucugccgaggaacuggaggacuggcucgaggaugugcuggaaggagagauuaauaccgaagacgaugacgacgaugacgaugacuga

SEQ ID NO: 66902 - RNA, 3267 nt, Artificial Sequence
  derived and/or modified sequence opt5 from CASR__Homo_sapiens__NP_001171536
auggccuucuacagcugcuguugggugcugcucgcucugaccuggcacacauccgccuauggccccgaccagagagcgcaaaagaaaggggauaucauucuuggaggccuguuuccuauccauuucggggucgcugccaaggaccaggaucucaaaucucggccggagagcguugaaugcauucgcuacaacuuuagaggauuccgguggcugcaggccaugaucuuugcuauugaggaaaucaauuccucucccgcccuucugccuaaccucacgcugggcuaucgcaucuucgacaccuguaauacagugagcaaggcucuggaggccacccucuccuuuguggcgcagaacaaaauugauucucugaaucuugacgaguucugcaacuguagcgaacacauccccuccacaauugccgucgugggggcuaccggaagcggcguuucuacagccguggcuaaucugcucggccuguuuuacaucccucaagucuccuaugccagcagcuccagacuucugagcaacaagaaucaguucaagucuuuucuccggaccauucccaacgaugagcaucaggcgacggccauggcugacaucauugaauacuuccgcuggaauuggguggggaccaucgccgcugaugacgauuauggaagaccuggcaucgagaaauuucgggaagaggccgaggaacgcgacauuugcaucgauuucuccgagcugauuagccaguacuccgacgaagaggaaauccaacacguuguggaggucauucagaacucuacagccaaggugaucguggucuucagcuccgggccggaccuggagccccucaucaaagaaauuguuagacggaauaucaccggaaagauuuggcuggcuagcgaggcgugggccucuuccagccuuaucgcuaugccucaguacuuucauguggugggcgggacaauuggauucgcccugaaagccggccagauccccggcuuucgcgaauuucucaagaagguccacccuagaaaaucugugcacaacggguuugcuaaggaguucugggaagagaccuuuaauugucaucugcaagagggagccaaaggcccccuuccgguugauacguuccugcgggggcacgaagagagcggagaccgcuuuuccaacucuagcacagcguucagaccucucugcaccggcgaugaaaacaucuccagcguggagacacccuauauugacuacacccaucugcggaucucuuauaaugucuaccuggcuguguauuccauugcccacgcccuccaggauaucuacaccugucugccugggagaggacuuuuuacaaacggcagcugcgcugacauuaagaaaguugaagccuggcaagugcugaagcaccuccgccaucugaauuucacgaacaauaugggcgagcaggucaccuuugaugaguguggggaccuugugggaaacuauucuaucauuaauuggcaccugucccccgaagauggcagcaucgucuucaaagaggugggguacuacaacguuuaugcuaagaagggagaaagacucuucaucaaugaggagaaaauucugugguccggcuuuucucgggaaccccugacauucgugcucagcguccuucaggugccuuuuuccaacugcucucgcgacugccuggccgggacccggaagggcaucauugagggagaaccgacauguugcuucgaguguguugaaugccccgauggcgaguacagcgacgagaccgacgcguccgccuguaauaaaugcccugaugacuuuuggagcaacgaaaaucauacgucuuguaucgcuaaggagauugaguuccuguccuggacagaacccuuugggaucgcccucacccuguucgcugugcugggaaucuuucuuaccgccuucguccucggcguguuuauuaaauucagaaacacaccuaucgugaaggcgaccaaucgcgaacugagcuaucugcuccuguuuucucuucugugcuguuucuccagcucucucuucuuuauuggggagccccaggauuggacaugccggcugagacagccggccuucggaaucagcuuuguucuguguauuuccugcauccuugucaagacgaaccgcgugcuccugguguucgaggcuaaaaucccuaccagcuuucaccggaagugguggggccugaaccuccaauuccugcuugucuuucugugcacauucaugcagauugugaucuguguuauuuggcucuacaccgcucccccuucuuccuauagaaaucaggaacuggaggacgaaaucauuuuuaucacaugccaugaggggagccugauggcccuuggcuuccucaucggauacaccugucugcuggccgccauuugcuuuuucuucgcuuuuaaaucccgcaagcuccccgaaaacuucaaugaggcgaaauuuaucacguucucuaugcugauuuucuucaucguguggauuagcuuuaucccugccuaugcuuccaccuacggcaaguucgucucugccguggagguuauugccauccuugcugccagcuuugggcugcucgcguguaucuucuuuaacaagauuuacaucauucuguucaaacccucccggaauacaaucgaagaggugagaugcucuaccgcugcccacgccuuuaaggucgcugcccgggcgacacugcgcagaagcaacgugucccggaaaagaucuucuucccuuggaggcagcaccgggucuacgccguccagcucuauuuccagcaaguccaauagcgaagauccuuucccccagcccgagcgccaaaaacagcagcagccucucgcucugacacaacaggagcagcagcaacagccgcugacccucccccagcaacagcggucucagcagcaaccuagauguaagcagaagguuaucuucggaagcggcacagugaccuuuucccugucuuucgacgaaccccagaaaaacgccauggcccaccgcaauagcacccaucagaacucccuugaggcucaaaagucuagcgauacacugacgagacaccagccucuccugccccugcagugcggggaaaccgaccuugaucugacaguccaggagaccggccuccaaggaccugugggcggggaccagcggcccgaaguggaggauccggaggaacuguccccugcccucgucguuucuagcucccagagcuuugugaucucuggaggcggguccacagugaccgagaaugucgugaacagcuga

SEQ ID NO: 66903 - RNA, 1050 nt, Artificial Sequence
  derived and/or modified sequence opt5 from CASS4__Homo_sapiens__NP_001157587
augaagggcaccgggaucauggacugcgcccccaaagcucugcucgccagagcgcuguacgauaacuguccugacugcagcgaugagcuugcuuucucccggggagacauucugacaauccucgaacagcacgugccggagucugaaggcugguggaagugucugcuucaugggcgccaaggacuggcccccgccaauagacuccagauucugacggaggucgcugccgaucggccuugucccccuuuucugcgcggccucgaagaggcucccgccagcuccgaggaaaccuaucagguuccuacacugccgagacccccuacccccgggccuguguacgagcagaugcggucuugggcggaaggaccccaaccgccuacagcccagguguaugaguuccccgacccucccaccagcgcucgcaucauuugcgagaaaacacuuuccuuucccaagcaggccauccugacccucccuagaccgguccgggcuucucugcccacgcuuccuagccagguguacgauguucccacccaacaccgcggcccugugguccugaaagaacccgagaagcagcagcucuaugacaucccggccuccccuaagaaagcgggccugcaucccccugauagccaggccucuaaccccgggccucugauuccccaaccguccagccagcagacaccugaaagaaagccccggcucucugagcacugccgccuguacuucggagcucuuuuuaaagccaucuccgcuuuccauggcagccugucuuccagccaacccgccgaaauuaucacccaguccaagcucgugauuaugguugggcagaaacugguggacacacuuuguauggagacccaggagagagauguccggaaugaaauccugcgcggaucuagccaccucugcucccugcugaaggacguggcccucgcuacgaagaacgcggugcugacauauccuagcccggccgcucuuggccaucugcaagccgaggccgaaaaacucgagcagcacaccagacaguuucgggggacacugggauga

SEQ ID NO: 66904 - RNA, 2253 nt, Artificial Sequence
  derived and/or modified sequence opt5 from CAST__Homo_sapiens__NP_001035905
augagccagcccggccaaaagccugccgcuuccccgagaccccggcgcgccgcggcugccagacggacccacgagcaugugucugaaaagacaagcgaguccccuucuaagcccggggagaaaaagggaagcgacgagaaaaaggccgcuucccugggcucuagccaguccagccgcacguacgccgggggaaccgcuucugccacaaaggucuccgcgagcucuggcgccaccuccaaaucuagcuccaugaacccuacagaaaccaaggcuguuaaaacagagcccgagaagaaaagccaguccaccaagccuaagucucucccgaaacaggccagcgauacgggguccaaugacgcucacaacaagaaagccgugagcagaucugcggaacaacagcccuccgaaaagagcaccgaaccuaaaacaaagccccaggauaugaucucugccggaggcgagagcguggcuggcaucaccgccaucuccgggaaaccuggagacaagaagaaagagaagaaaucucugacacccgcugucccgguggaaagcaagccugauaaacccuccggcaagagcgggauggacgccgcccuugaugaccugauugauacccucggaggcccugaggaaacggaggaagagaauacaaccuauacagggcccgagguuucugaccccauguccagcaccuacaucgaggaacugggaaagcgggaagugaccauuccuccgaaauaucgcgagcuucuggcuaagaaagaaggcaucacagggcccccugcggauucuuccaagcccaucggcccugacgaugccauugacgcucucagcuccgacuucacgugcggaucucccaccgccgccggcaaaaagacagagaaggaggaaagcaccgagguccugaaagcucaguccgccgggacagugagaucugcggcuccgccucaagaaaagaaacggaagguugagaaagauaccaugagcgaccaggcccuggaagcccucuccgcuagccugggaacgcgccaggccgagcccgagcuugaucugagaucuaucaaggaaguggacgaggcuaaggccaaagaagagaagcucgagaaauguggcgaagaugacgagacaauuccuuccgaauaccggcugaagcccgcgaccgauaaagacgggaagccucuucugcccgagccggaagagaaaccuaagccccgcagcgagucugaacucaucgaugagcuguccgaagacuuugauagaagcgagugcaaggaaaaacccucuaagccuaccgagaaaacagaggaaagcaaggccgcugccccggcucccgucuccgaggccgugugucggaccagcaugugcucuauucaguccgcgccucccgaaccugccacacugaaaggaacggugcccgacgacgcugucgaggcccucgcugauagccugggcaagaaggaagccgacccugaggauggcaaacccguuauggacaaggugaaagagaaggccaaagaagaggaucgcgaaaaacuuggggagaaggaggaaaccaucccgccugacuauagacuggaggaagugaaagauaaggacggaaaaccccuccugccuaaggaguccaaagaacaacuucccccgaugucugaggauuuccugcucgacgcucugagcgaggauuuuuccggcccucagaacgcgucuagccugaaguucgaagacgccaagcucgcugccgccauuuccgaggucgugucucagacacccgcuagcaccacacaagccggggcgccuccccgggauaccucccagagcgacaaagaccuggaugacgcucuugauaagcugucugacucccucggacagagacagcccgauccugacgaaaauaaaccgauggaggauaagguuaaagaaaaggccaaagccgagcaucgcgacaagcugggcgagcgggaugacacgauucccccugaauacagacaccuucuggaugacaacgggcaagauaagcccgugaaaccucccaccaagaaaagcgaggacucuaagaaaccugcugacgaucaggacccgaucgaugcccucuccggcgaccuggauagcugucccucuacaaccgaaacaucccagaauaccgcgaaggacaagugcaaaaaggcugccagcuccagcaaagccccuaagaacggaggcaaagcuaaggauucugccaagacgacagaggaaaccagcaaacccaaggacgauuga

SEQ ID NO: 66905 - RNA, 3573 nt, Artificial Sequence
  derived and/or modified sequence opt5 from CASZ1__Homo_sapiens__XP_011539937
augaagguggacuaccugagcgaguucggcuuuagacucuccgauuaugaauuugggaccaaagagaagcggauggaccugggaacagccgaaggcacgcgcugcaccgaucccccugcugggaaaccggccauggcgcccaagagaaaaggaggccuuaagcugaacgcuaucugugccaagcucucucggcaggucguuguggagaaacgcgccgacgcugggagccacacagaaggauccccuucucaacccagagaucaggagcggagcggcccugaguccggcgccgcucgcgcccccagaucugaagaggacaagcggcgcgcggugauugaaaaaugggucaauggggaguacagcgaggaaccugccccgacccccgugcugggaagaaucgcucgggagggccuugaacugccucccgaggggguuuauauggugcagccucagggaugcuccgaugaagaggaccaugccgaggaacccagcaaggauggcggggcucucgaggaaaaagacucugauggagccgcguccaaggaggacagcggcccgucuacacgccaagccuccggcgaagcuagcucucugagagauuacgccgcuuccaccaugacagaguuucuggggauguucggauaugacgaccagaacacccgggaugagcucgcccgcaagauuagcuuugaaaaacugcacgccggcuccacgccugaggcugcgaccucuagcaugcuucccacauccgaagacacccugagcaagagagcccgguucucuaaauacgaggaauauaucagaaagcucaaagcuggggagcagcuguccuggccugcccccagcacaaagaccgaggaacgcgucggaaaagaggugguuggcacgcuucccgggcugcggcucccuucuagcacagcccaucuggaaaccaaggcuacaauucugccgcuccccucccacucuagcgugcagaugcaaaaucuggucgccagagcguccaaguacgauuucuucauccagaaacuuaagaccggagagaaccugcgcccucagaauggcagcaccuacaaaaagcccucuaaauaugaccucgagaacgugaaguaccugcaucuuuuuaagccuggcgaagggucccccgauaugggaggcgcuaucgccuucaaaacagggaaggugggacggccgagcaaauaugacgucagaggcauucagaagccugggcccgccaaaguuccucccacgccuucucuggcucccgccccgcucgcuuccgugccuagcgcccccuccgcgcccggcccuggaccggagcccccugccucucugagcuuuaauacccccgaauaccugaaguccacauucucuaagaccgauagcaucacaaccggcacgguguccacagucaaaaacgggcucccuaccgacaagcccgcugugaccgaggauguuaauauuuaucaaaaauacaucgcccgcuuuagcggaucucagcacuguggccacauucauugcgcuuaucaguaccgggaacacuaccauugucuggacccugagugcaacuaucaaagauucacauccaagcaggaugugauccgccacuacaauaugcacaaaaagcgggacaacagccuucagcauggguucaugagauuuucuccccuggacgauuguuccgucuauuaccacggaugccaucucaauggcaagagcacccacuaucauuguaugcaaguggggugcaacaaaguuuacacaucuacgagcgacgugaugacccacgagaauuuccacaagaaaaacacacagcugauuaacgauggcuuucagcgcuuccgggccaccgaagacuguggaacagcggauugccaguuuuauggccagaagaccacgcauuuccacugcagacggccgggguguaccuuuacauucaaaaauaagugcgacaucgagaaacauaaguccuaccacaucaaggaugacgccuacgcuaaagauggauuuaagaaauucuauaaguacgaagaguguaaauaugaaggcugcgucuacagcaaggccaccaaccacuuucauuguauucgcgcugggugcggauucacauuuaccucuacgucccaaaugacaagccacaagagaaaacaugagcggagacacauccgcuccucuggcgcccuugggcugccucccagccuccugggcgccaaggacaccgagcaugaagaguccucuaaugaugaccugguggauuucagcgcucucuccucuaaaaacagcucccugagcgcgucuccuacaucccagcagagcucugccucccuugcugccgccaccgcugccaccgaagcgggacccagcgcuacaaagccgccuaauucuaaaauuuccggccugcucccccaggggcugccuggaagcaucccccuggcccuugcccucuccaacagcggccugcccacgccuaccccguauuuccccauucuggcugggcggggaucuacaagccucccugucggcacccccucccugcuuggggccgugucuagcggcuccgcggcuucugccacaccugacacccccacgcugguugccagcggagcuggcgacuccgccccuguggcugccgcgucugucccggcucccccugccagcaucauggagagaaucuccgccagcaaggggcucauuucucccaugauggcucgccuggccgccgcugcgcugaagccuuccgccacauuugaucccggaagcggccaacaggugaccccggcuagauucccucccgcccagguuaaacccgaaccuggggagucuaccggagcccccggcccucacgaggcuucccaggaccggagccuugaucucacagugaaggaaccguccaaugagucuaacggccacgccguccccgcgaauagcucccugcugagcucucucaugaacaaaaugucccaagggaauccuggacugggcagccuucugaacaucaaggcugaagccgaggggucucccgccgcugagccuagccccuuucucggaaaagccgugaaggcgcuggugcaggaaaagcuggcugagccguggaaaguuuaccuucgcagauucggcaccaaggacuuuugugaugggcagugcgacuuccuccauaaagcccacuuucauugugucguggaagagugcggagcccuguucuccacacuggauggcgcuauuaagcacgccaauuuucauuuccggacggaaggcggggcugccaaaggaaacaccgaggcggccuuuccugcuucugccgcugagacaaagcccccuauggcccccagcuccccucccgugccgccugucaccacagccaccgugucuagccucgaaggccccgcucccuccccugcgagcguuccgucuacgcccacccugcuugccuggaaacaacuggcuuccacaaucccucagaugccccagauuccugccagcgugccccaccucccugccuccccgcuggcuaccacaucucuggagaaugccaagccccaggucaagccuggguuccuucaauuucaggaaaaauga

SEQ ID NO: 66906 - RNA, 1584 nt, Artificial Sequence
  derived and/or modified sequence opt5 from CAT__Homo_sapiens__NP_001743
auggccgacagcagagaucccgcuuccgaccagaugcaacacuggaaggagcagcgggccgcgcagaaagcugaugugcugaccacaggcgccgggaacccugucggagacaagcucaauguuaucacggugggcccgcgcgggccccugcuugugcaggaugucguguucaccgacgaaauggcccauuuugauagagagcggauuccugaacgcguugugcacgcuaaaggagccggcgcuuucggguacuuugaggucacacaugacaucaccaaguauucuaaagccaagguguucgaacacauuggaaagaaaacacccaucgcgguuagauuuagcaccguggccggcgaguccggcucugcugauacaguccgggacccucgcggguucgccgugaaguuuuacaccgaggauggaaacugggaccuggugggcaauaacacgcccauuuucuuuaucagagauccuauccucuucccgagcuuuauucauucccaaaaacggaauccccagacccaccugaaggacccugacauggucugggauuucuggucucuucgccccgaaagccugcaccagguuuccuuucucuucagcgacagagggaucccugauggacaucggcacaugaacggcuaugggucucauacauucaaacuggugaaugcuaacggagaggccguguacugcaaguuucacuauaagaccgaccagggcauuaaaaaucuguccgucgaagaugcggcccgccucagccaagaggaccccgauuacggcaucagagaccuguucaacgcuauugccacagggaaguauccgucuuggaccuuuuacauccaggugaugacguucaaucaggcugagacauuuccuuucaaccccuuugaucuuaccaaaguuuggccucacaaggacuacccccugauucccgugggaaaacucguccugaaucggaacccugugaauuauuucgccgaaguugagcagaucgccuuugauccguccaacaugcccccuggcaucgaagcuagccccgacaagaugcuucaagggcgccuguucgcguacccugacacacauagacaccggcucggacccaacuaucugcauauuccggugaauuguccuuacagagcccgcgucgcuaacuaucagcgggauggccccaugugcaugcaggacaaucaagggggagccccuaacuacuaucccaauucuuuuggcgccccugagcagcagcccuccgcucuggaacacagcauccaguacuccggcgaggugagacgcuucaacaccgccaaugaugacaacgucacccaagugcgggcguuuuacguuaaugugcucaacgaggaacagagaaaacgccugugugagaauauugcugggcaucuuaaggaugcccagaucuucauucagaagaaagccgucaagaacuucacagaagugcacccggacuauggaucucacauccaagcucugcucgauaaauacaaugccgagaagccuaaaaacgcuauccauacguuuguucagagcggcucccaccuggccgcgcgggaaaaggccaaucuuuga

SEQ ID NO: 66907 - RNA, 2343 nt, Artificial Sequence
  derived and/or modified sequence opt5 from CATSPER1__Homo_sapiens__NP_444282
auggaccagaacagcgugcccgagaaggcccaaaaugaagcugauaccaacaaugccgacagauucuuucggucccacucuagcccuccgcaucaccgccccggccauuccagagcgcugcaccauuacgagcuccaccaccauggggucccucaccagcggggagaaucucaucaucccccugaguuccaggauuuucacgaccaggcucugagcucccacguucaccaaucucaucaccauagcgaagcccgcaaccacggcagagcccacgggcccacaggauucggccuugcuccuucccagggggccgugccgagccaucggucuuauggagaggauuaccacgacgagcugcagcgcgauggcagacggcaucacgacggcucccaguaugggggauuucaccaacagagcgauucucauuaccaccgcggcucccaucacgggagaccccaguaucucggagaaaaucugagccauuacucuuccggcgugccucaccacggggaggcuagccaucacggaggcuccuaucuuccccauggcccuaaccccuacucugagagcuuccaccauuccgaagccagccaccugucugggcuccagcacgacgagucccaacaucaccaggucccgcaucggggauggccucaccaccaucaggugcaccaucacggccgcagcagacaucacgaagcgcaccaacaugggaaaucuccccaccauggagagacgaucagcccucacuccucuguuggcagcuaccagcgggggauuuccgauuaucacagcgaauaccaucagggagaccaccaucccucugaguaucaccauggcgaucacccccaccauacccagcaccauuaccaccaaacacaccgccauagagacuaucaccagcaucaggaccaccauggcgccuaccacuccagcuaucugcacggggauuacgugcagucuaccucccaacugagcaucccucauacaucccggucucucauucacgacgcuccgggacccgccgcuagcagaaccggcgucuuuccuuaccauguggcccacccccgcggguccgcgcauucuaugacacggagcuccagcaccaucagaucucgcguuacgcagauguccaagaaagugcacacccaggauauuagcacaaagcacucugaagacuggggaaaagaggagggccaguuccaaaagcggaagaccgggagacugcagcgcacacggaaaaagggccauuccaccaaucuuuuucaguggcugugggaaaaacucacguuccugauccagggauuuagagagaugauccgcaaccuuacacaaagccuggccuucgaaaccuuuauuuucuucgucgugugccucaauacagugaugcuggucgcucagaccuuugccgagguugaaauccggggcgagugguauuucauggcucuggauucuaucuuuuucuguauuuacgugguggaggcccuccugaagauuaucgcccuugggcugagcuacuuuuucgacuuuuggaacaaucucgauuucuuuauuauggcuauggcgguccuggacuuccuucugaugcagacccacuccuuugccaucuaucaucaaagccucuucagaauccugaaaguguuuaagucucugcgcgcucuccgggccauuagaguucugcggcgccuuuccuuccugacaagcgugcaggaagucacgggaacccucggccagucccugccuucuaucgccgcuauucuuauccugauguucacaugccucuuucuguucagcgccgugcugagagcgcucuuucggaaguccgaucccaaaagauuccagaacauuuuuaccacaaucuucacccuguuuacgcuucugacacucgacgauuggucucugaucuauauggacagccgcgcucaaggggccugguacauuaucccgauucugguuaucuauauuaucauccaguacuucauuuuucuuaaucucgugaucaccguccugguggacuccuuccagaccgcccuguuuaagggacucgagaaagcuaagcaggaacgggccgcucgcauucaagagaaacugcuugaagauucucugacagagcucagagccgcggagccuaaggaagucgccagcgagggcaccaugcugaaaagacugaucgaaaagaaguucgggacaaugacggagaaacagcaggagcuucucuuucacuaccugcagcugguggcuuccguugaacaagagcagcagaaguuccggagccaagccgcugugauugacgaaaucgucgauaccacauucgaggccggcgaagaggacuuucgcaacuga

SEQ ID NO: 66908 - RNA, 1587 nt, Artificial Sequence
  derived and/or modified sequence opt5 from CATSPER2__Homo_sapiens__NP_001269238
auggccgcuuaccagcaagaggaacagaugcagcugcccagagccgacgcgauccggagccgccucauugauaccuucucccugaucgagcaccuucagggccugucucaagcugugccuagacauacaauucgggaacuccuggacccgagccgccagaagaaacuuguccugggggaucagcaccagcucguuagauuuuccaucaagccccaacggauugagcagaucucucaugcccagcgccugcugagcagacuccacgugcggugcucccagcgcccuccccugucucuuugggccggaugggugcuggaauguccucucuucaaaaacuuuaucauuuuccuggucuuucuuaauacgaucauucugaugguggagaucgagcuccuggaaagcaccaacacaaagcuguggccccucaaacugacccuugagguugcugccugguucauucugcucaucuuuauucuggaaauccuucugaaguggcucuccaauuucagcguguuuuggaagucugcuuggaacgucuucgacuuugugguuacaaugcugucccugcucccugagguggucgugcuggugggcgucaccgggcaaagcguuuggcuucagcugcucagaaucugccgggugcugcgcucucuuaaacugcucgcccaguucagacaaauucagaucauuauccuggugcugguccgggcgcucaaguccaugacauuucugcuuaugcugcuccugauuuucuucuauaucuuugccgugaccggaguuuacguguucagcgaguauacgcgcucuccgagacaggaucuggaauaccaugucuuuuucuccgaccuucccaauagccucgugaccguuuuuauccuguucacacuggaucacugguaugcucuccugcaggacguguggaaagucccugaggugucccggauuuuuagcagcaucuacuucauucuuuggcugcuccugggcuccaucauuuuuagaagcaucaucgucgccaugauggugaccaacuuccaaaauauucgcaaggaacugaacgaggaaauggcucggagagagguucagcuuaaagccgauauguuuaagcgccagaucauucagcggagaaagaauaugucucacgaggcgcucacauccagccauucuaaaaucgaagaccgcggggccagccaacagcgggagucccuggaucugucugaagugagcgaggucgaauccaacuauggagcuaccgaggaggaccucauuacgagcgccucuaagacagaagagacccuguccaaaaagagagaauaccagucuucuuccugugugagcuccacaucuagcuccuacucuagcuccagcgagucucgcuucuccgaaagcaucggccggcuugauugggagacccugguucacgagaaucuccccggccugauggaaauggaccaggacgauagaguguggccucgcgacucucuguuucgguauuucgagcuucucgaaaaacugcaauacaaccuggaggagagaaagaaacuccaggaguucgcuguccaggcccugaugaaucuugaagauaaguga

SEQ ID NO: 66909 - RNA, 444 nt, Artificial Sequence
  derived and/or modified sequence opt5 from CAV1__Homo_sapiens__NP_001166366
auggccgacgagcugagcgaaaaacagguguacgaugcucacaccaaggagaucgaccucgucaacagagaucccaagcaucugaaugacgauguugugaaaauugacuucgaagaugugaucgccgagccugaaggcacacacuccuuugacgggauuuggaaggcgucuuucacgaccuuuacagucaccaaauauugguucuaccggcuucugagcgcucucuuuggaaucccgauggcccugauuuggggcaucuauuucgccauccuuuccuuucugcauauuugggcugugguucccugcaucaagucuuuccucauugagauccaauguauuagccgcguguacuccaucuauguccacacagugugcgauccucuguuugaggccguugggaagauuuucucuaacgugagaaucaaucugcagaaagaaaucuga

SEQ ID NO: 66910 - RNA, 489 nt, Artificial Sequence
  derived and/or modified sequence opt5 from CAV2__Homo_sapiens__NP_001224
augggccuggagaccgaaaaggccgacgugcaacucuucauggaugacgauagcuacucccaccauucugggcuggaguaugcugaccccgaaaaauuugccgauagcgaccaggauagagacccucaccggcuuaacucccaucugaagcucggauucgaggaugucaucgcggaaccgguuacaacgcacucuuuugacaaaguguggauuugcagccaugcucuguucgagaucuccaaguacgugauguauaaauuucuuaccgucuuccuggccauuccccucgccuuuaucgcuggcauucuguucgccacacugucuugucuccacaucuggauccugaugccuuuugugaagaccugccuuaugguucugcccagcgugcagacaauuuggaaguccgucaccgaugugaucauugcuccucucuguacaagcguugggcgcugcuucucuuccgugagccugcagcuuucucaggacuga

SEQ ID NO: 66911 - RNA, 456 nt, Artificial Sequence
  derived and/or modified sequence opt5 from CAV3__Homo_sapiens__NP_001225
augauggccgaggaacacaccgaccuggaggcucagaucgugaaggauauucauugcaaagaaaucgaccucgucaacagagaucccaagaauauuaacgaggacaucguuaaaguggauuucgaagacgugauugccgagccugucgggacauacagcuuugaugggguguggaagguuuccuauacgaccuucacagugucuaaauacugguguuaucggcugcuuagcacccugcucggagucccgcuggcgcuucuguggggcuuucucuucgcuugcaucuccuuuugucacaucugggccgugguucccugcauuaagucuuaccugaucgagauucaauguaucagccauauuuauucccugugcauccgcacauucuguaauccucucuuugccgcucugggccaggugugcucuagcauuaaggucgugcuuagaaaagaaguguga

SEQ ID NO: 66912 - RNA, 1788 nt, Artificial Sequence
  derived and/or modified sequence opt5 from CBFA2T2__Homo_sapiens__NP_001028171
auggugggcguccccggggccgcugccuuccagcugggaccugagaagagaguuccggcgaugcccggcagcccuguggaagugaaaauccaaucccggucuucucccccuaccaugcccccucucccgcccauuaacccugggggaccccgcccugucuccuuuacacccacggcucugucuaauggcaucaaccacagcccgccuacccuuaauggggcccccuccccuccccagagauucucuaacggacccgccagcuccacaagcucugcucugaccaaucagcagcucccugccacaugcggcgcucggcaacuguccaaacuuaaacgcuuucugaccacacuccagcaguucggcaacgacauuagcccggagaucggggaaaaggugagaacccugguucuggcccucgugaauagcacggucaccauugaggaauuucauuguaaacugcaggaggcgacaaacuucccccuucggccuuuugugauccccuuccugaaggccaaucucccucugcuucaacgcgagcugcuccacugcgcuagagccgcuaagcagacccccucccaguaccuggcccagcaugaacaucugcuccugaacacaagcaucgcgucuccggccgauuccagcgagcuucugauggaaguucacggaaauggcaaacggccuucccccgagcgcagagaggaaaacucuuuugaccgggauaccauugcuccugagcccccugccaagcgcguguguacgaucagccccgcuccgagacacuccccugcccucacagucccccugaugaaucccgggggacaauuccacccuaccccgcccccucuucagcauuauacacuggaagacauugccaccagccaccucuaccgggagcccaacaaaaugcuggaacaucgcgaggugagagaucggcaccacucucugggccucaaugggggauaucaggacgagcugguggaucauagacuuaccgaacgcgagugggcugacgaauggaagcaccuggaucaugcgcucaacugcaucauggagauggucgaaaagacacggagauccauggccguucugcgccggugucaagagagcgacagagaggaacuuaacuacuggaagcgccgguauaaugagaacacggaacugagaaagaccggcacagagcucgugucucgccagcacagcccuggcuccgcugauucucugagcaaugacucccagcgggaauuuaacagcagacccgggaccggauacgugccugucgaguucuggaaaaagacagaggaagccgugaauaaaguuaagauucaggccaugucugaggugcaaaaagcugucgccgaagcggagcagaaggcuuuugaggugaucgccaccgaacgcgcccggauggagcagacgauugcugauguuaaaagacaggccgcugaagacgccuuccuggugaucaacgagcaagaagaguccacagagaauugcuggaacuguggccggaaggcgagcgaaaccugcucuggguguaauaucgcccgcuauugcggauccuucugucagcauaaggacugggagagacaccaccggcucugcggccagaaccugcaugggcagagcccccacggacaaggcagaccgcuucugccugucggccgcggguccucugcucggagcgccgauugcuccgugcccucuccugcucucgacaaaaccagcgccacaaccuccagaagcucuacacccgcguccgucacggccauugauaccaauggacuguga

SEQ ID NO: 66913 - RNA, 1962 nt, Artificial Sequence
  derived and/or modified sequence opt5 from CBFA2T3__Homo_sapiens__NP_005178
augcccgccagcagacugcgggaccgcgcugccuccucugcgagcggcucuaccugcggguccaugagccagacacacccugugcucgaguccggacugcuugcuucugccggcuguagcgccccgagagggccccggaagggaggcccugcucccgucgaucgcaaagccaaggcuuccgccaugccugacagccccgcggaaguuaaaacgcaaccuagaucuaccccgcccuccaugccucccccucccccggccgcuagccagggggccacacggccucccucuuucaccccucauacacaccgcgaggauggacccgcuacccugccccauggcagauuucacggcugccucaagugguccauggugugucugcuuaugaacgggagcucucauuccccuacagccaucaauggagcgccgugcacccccaacggcuucagcaaugggccugccacguccucuaccgcuagccuguccacacagcaccuucccccugccuguggagcucggcagcugagcaaacugaagcgcuuucucaccacacugcaacaguucggcucugacauuucccccgaaaucggggagagagugcggacccuuguccugggacucgugaacagcacgcugacaauugaagaguuucacucuaagcuccaggaggccaccaauuucccgcugcgcccuuuuguuauccccuuccucaaagccaaccugccucugcuccagagagaacugcuucauugcgcucggcuggcgaagcaaacacccgcccaguaccucgcucagcacgagcagcugcuucuggaugccagcgccuccucuccuauugacagcuccgaacuccugcuggaggugaaugagaacggcaaacgcagaacccccgaucggaccaaggaaaauggcagcgacagagauccgcuccauccugagcaccugucuaaacgccccuguacacuuaaccccgcucaacgguauuccccuagcaaugggccgccccagccuacgcccccuccccacuacagacuggaagacaucgccauggcgcaucacuuucgcgaugcuuaucggcauccugaccccagagagcuccgcgaacggcacagaccgcuggucgugccuggaucucgccaggaggagguuaucgaucauaaacuuaccgaacgggagugggccgaagaguggaagcaccugaacaaucuccugaacugcauuauggacaugguggaaaagacaagacgcucccugaccguccuccggagaugucaagaggccgaccgggaggaacugaaucacugggcucgcagauacagcgaugccgaggacacaaagaaaggccccgcuccugccgcggcccggcccagauccucuagcgcugggccggaaggaccucagcuugaugugccccgcgaguuccugccucggacccucacgggcuaugugcccgaagacaucuggagaaaggccgaggaggcugucaacgaaguuaaacgccaggccauguccgagcugcagaaggcggugucugaugccgaaagaaaagcucaugagcugauuacaaccgagcgggccaagauggaacgcgcucuugccgaggccaagagacaagcuagcgaagacgcgcucaccgugaucaaccagcaggaggauuccagcgaaucuugcuggaauugugggcggaaagccuccgagacaugcagcggaugcaacgcugcccgcuacuguggcucuuuuugccagcacagagacugggagaagcaucaccacgucuguggccaaucccugcaggggcccaccgccgugguugcugauccugugccgggacccccugaagccgcgcauagccugggccccucucucccugucggggcugccagccccuccgaggccggaagcgcuggcccuucucggccggggucccccagcccucccggcccucuggacacagugccccgcuga

SEQ ID NO: 66914 - RNA, 549 nt, Artificial Sequence
  derived and/or modified sequence opt5 from CBFB__Homo_sapiens__NP_001746
augcccagaguggucccugaccagcggagcaaguucgagaacgaagaguuuuuccgcaaacuguccagagaaugcgagaucaaguacaccggcuuucgggaucgcccgcacgaagagagacaagcccgguuccagaaugcuugucgcgacgggagaucugagauugccuuuguugcgacaggaacgaaccucagccugcaguucuuucccgcuuccuggcagggcgaacaacggcagaccccuucucgcgaguauguggaucuugaaagagaggccgggaaaguguaccugaaggcccccaugauccucaauggagucugcgugauuuggaaaggcuggaucgaccugcagcggcuugaugggaugggaugucuggaguucgacgaggaacgcgcucagcaagaagaugcccucgcucagcaggccuuugaggaagcgagacggcgcacaagagaguucgaggaccgggauagaagccaucgcgaagagauggaaguucgggugucccagcugcuggccgucaccggcaagaagacaaccagaccuuga

SEQ ID NO: 66915 - RNA, 2949 nt, Artificial Sequence
  derived and/or modified sequence opt5 from CBLB__Homo_sapiens__NP_733762
auggccaacagcaugaauggcagaaaccccgggggacggggcgggaauccucgcaagggaagaauccugggcauuaucgacgcuauucaggaugccguggggccgcccaaacaagcggcugccgaccggcgcaccgucgagaagacauggaaacucauggauaagguugugagacugugccagaacccuaaacuucagcugaaaaauucucccccuuacauccucgacauucugcccgauacguaucagcaccuucggcugauccucuccaaguacgacgauaaccaaaagcuggcccagcugagcgaaaaugaguauuucaagaucuacauugacucccucaugaaaaagucuaaacgcgcuaucagacuguuuaaggaaggaaaggagcggauguaugaggaacagagccaggaucgcagaaaccuuaccaaacugucccucauuuucucucauaugcuggccgagaucaaggcuauuuuuccuaauggccaauuccagggcgacaacuuucggaucacaaaagccgaugcggccgaauuuuggcgcaaguuuuucggggacaaaaccauugugccguggaaggucuuuagacagugucuucacgaggugcaucagaucagcuccggacuggaagcuauggcccucaaaagcacaaucgaucugaccugcaaugacuacauuucuguuuucgaguuugacaucuucacacggcuguuucaacccuggggcuccauucuccgcaacuggaauuuccuggcugugacccacccuggguauauggccuuccuuacguacgaugaggucaaggcgagacugcagaaguacagcaccaaacccggaucuuauaucuuucggcucuccuguacaagacugggccagugggccauuggguacgugaccggagacggcaacauccuucaaacaaucccucauaauaagccccuguuccaggcucucauugauggcagccgcgaaggguuuuaucuguacccggacggacggucuuauaacccugaucugaccggccucugcgagcccacgccucacgaccacaucaaaguuacacaggaacaguacgagcuguauugugaaaugggguccaccuuccaacuuugcaagauuugugccgagaacgauaaagacgugaagaucgagcccugcggacaucugauguguacaagcugccucaccgcuuggcaggaauccgauggccaggggugucccuuuugcagaugcgagauuaagggaaccgaaccuaucaucgucgacccguucgauccccgcgacgagggcucucgguguugcagcauuaucgacccuuuuggcaugcccaugcuggaucuugacgaugacgaugacagagaagagucccugaugaugaaucgccucgccaacgugcggaaauguacagauagacagaauagcccugugacgucucccggguccagcccgcuggcccaacgccggaagccucagcccgacccucugcagauuccccaccucucucugccucccgucccgccuagacuugaucugauccagaaaggaauuguucgcagccccugcggcucccccaccgggucuccuaagagcuccccguguauggugcggaaacaagacaagccccucccugcucccccucccccucugagagaucccccgccucccccucccgagcggccgccucccaucccucccgacaaccgccugagcagacauauucaccacguggaaucuguccccucccgggauccuccgaugccccuugaggcguggugcccuagagacguguucggaacaaaucagcucguuggcugucgccugcugggggaaggcagccccaagccuggaaucaccgccucuuccaacgugaauggccggcauagcagagucggguccgaccccgugcucaugcgcaaacacagacggcaugaucugccucuugagggagcuaagguuuucucuaacggccaccuggggagcgaagaguacgacgugccgccccgccucuccccucccccucccgucacaacccugcugccgucuaucaaaugcacgggaccucuugccaauagccucuccgagaagacaagagaucccguggaagaggacgaugacgaauacaaaauucccagcucucauccugucucccugaacagccagcccucucacugucacaaugugaagccuccgguucgguccugcgauaacggccauuguaugcugaaugggacccacggccccagcucugagaagaaaagcaacaucccugaccucuccauuuaucugaagggagauguguucgacagcgccucugaucccgucccucuucccccggcucgcccucccaccagagacaauccuaaacauggcuccagccugaaccggacacccuccgauuacgaccuccugaucccuccccugggggaggacgccuuugaugcgcuuccgccuucucuucccccucccccgcccccugcucgccacagccugauugaacacuccaagcccccuggaucuagcuccagacccucuagcggccaggaccuguuccuccugccuuccgauccguuuguggaccuugccagcgggcaaguuccccugccucccgcccggcgccucccuggagagaacgugaaaaccaauagaacaucucaggauuaugaccagcugcccuccugcagcgauggcucucaagcuccggcccggccucccaagcccagaccucgccggacggcucccgaaauccaucacagaaaaccucaugggccggaggccgcgcuggaaaacgucgacgccaagaucgcuaagcucaugggcgagggauacgccuucgaggaagugaaacgcgcucucgagauugcccagaauaacguggaaguugcgcgguccauccugagagaguucgccuuucccccucccgucagcccucgccugaaucucuga

SEQ ID NO: 66916 - RNA, 2721 nt, Artificial Sequence
  derived and/or modified sequence opt5 from CBL__Homo_sapiens__NP_005179
auggccggcaacgugaagaaaagcuccggggcuggaggcgggucuggaagcggcggguccggaucuggcggccugaucgggcucaugaaggacgccuuccagccccaccaucaccaucaccaucaccugagcccucacccgcccggaaccgucgauaaaaagaugguugagaaaugcuggaaacuuauggacaagguggugagacugugucaaaauccuaagcucgcgcugaagaacagcccucccuacauucuugaucugcuccccgacacauaucagcaucugcggacgauccugucucgcuacgaaggcaaaauggagacccucggggaaaaugaguauuuuagagucuucauggaaaaccugaugaagaaaacaaagcagaccauuagccuuuuuaaggagggaaaagagcggauguacgaagaaaauucccagccucgcagaaaccugacaaagcucagccugaucuucucucacaugcuugcugaacugaaaggcauuuuuccguccggacucuuccaaggggauaccuuucggaucacaaaggccgacgccgcugaguucuggcgcaaagccuuuggcgagaagaccaucgugcccuggaaauccuucagacaggcucugcaugaaguucacccuauuucuuccggccuggaggccauggcgcucaagagcacgaucgaucugaccugcaaugacuauauuucuguguuugaguucgauaucuuuacacggcuuuuccagcccugguccagccugcuccgcaacuggaauagccuggccgucacccacccuggguacauggcuuuccuuacauaugacgaggugaaggccagacugcagaaauuuauucauaagcccggaucuuacaucuuccggcucagcuguacccgccugggccaaugggcuauuggguacguuacggccgauggaaacauccugcagacaaucccgcacaauaaaccucucuuucaggcgcugauugacggcuucagagaaggguuuuaucuuuuccccgauggacggaaccagaauccugaccugaccggccucugcgagcccacaccccaagaccauaucaaggugacccaggagcaguacgaacuguauugugagaugggcuccaccuuucaacuuugcaaaauuugugccgaaaacgauaaggacgucaagaucgagccuugcgggcaccugauguguacaagcugccucacgucuuggcaggaauccgagggacagggcuguccguucugccgcugcgagauuaaagggaccgaacccaucgugguggauccuuuugaccccagaggaagcggcucucugcugcggcagggggcugagggcgccccuagccccaauuacgaugacgaugacgaugaaagagcugacgauacacucuucaugaugaaggagcuggccggagccaaagucgaacgcccgccuucccccuuuucuauggcuccucaagcgagccuucccccuguucccccgcggcuggaccuccugccucagagagugugugugcccuccagcgccucugcucugggcaccgccuccaaggccgcuagcgggucucuucauaaagacaagccccucccugucccgcccacacugcgcgaucugccucccccucccccucccgaccggccguauuccgugggagccgagagcagaccucagcgccggccccucccuugcacccccggcgauuguccguccagagacaagcugccucccguuccuucuagccgccuuggggauuccuggcugccccggcccaucccuaaagugccggucucugcgcccagcuccagcgacccuuggacgggaagagagcucacaaaccgccacucucugcccuucucccugccuagccagauggaaccccggccugaugugccgagacuuggcucuaccuuuucccucgacaccagcaugucuaugaacagcagcccccugguugggccugagugcgaucaccccaagauuaaaccuuccucuuccgcuaaugccaucuacagccuggccgcucggccccucccggugccuaagcugccucccggcgaacaaugugagggagaggaagacacagaguauaugacccccuccucucgcccccuuagaccucuggauacaagccaguccucucgggccugcgacugugaucagcagauugacagcugcacguacgaagcuauguacaacauccaaucccaggccccgucuauuaccgagagcuccacauucggcgaagggaaucucgcggccgcucaugccaacaccggacccgaggagagcgaaaaugaggacgauggcuaugacgucccuaaacccccugugcccgcuguccuggccagacgcacacugucugauaucuccaacgcguccucuuccuucggguggcuuagccucgacggagauccgaccacgaaugugaccgaaggcucucagguuccugagcggcccccuaagcccuuuccuagacgcaucaacuccgaaagaaaggccgggagcugucagcaaggcuccggacccgcugccagcgcugccacagccucuccgcagcugagcuccgagauugagaaucugaugucucagggcuacagcuaucaagacauccagaaagcucucgugauugcgcagaacaauaucgaaauggccaagaacauucugcgggaguucgucuccaucucuagcccugcucacguggccaccuga

SEQ ID NO: 66917 - RNA, 1473 nt, Artificial Sequence
  derived and/or modified sequence opt5 from CBLL1__Homo_sapiens__NP_001271220
auggaccacaccgauaacgagcugcagggcacaaauagcuccggcucucucggaggccuggacgugagacggcgcauccccauuaaacuuaucagcaagcaagccaacaaggcuaaaccugccccgagaacgcagcggaccauuaaucgcaugcccgcgaaggcuccucccggggaugaaggauucgacuacaacgaggaagagagauaugauugcaaaggcggggaacuguuugccaaucagcggcgcuucccuggacaucucuuuugggacuuccagaucaacauucugggcgagaaggaugacacacccguccacuuuugugauaagugcggccuuccuaucaaaaucuacgggagaaugauuccguguaagcauguuuucugcuaugacugugccauccugcacgagaaaaagggagauaaaaugugccccggcuguuccgacccugugcaacggauugaacagugcacccgcgggucucucuuuauguguagcaucgugcagggaugcaagagaacauaccugucccagcgggaucugcaagcucauauuaaucaccgccacaugagagccggcaagcccgucacccgggcuucucucgagaacgugcauccucccaucgccccgccucccacagaaauuccugagcgcuucaucaugccucccgacaaacaccauaugagccacaucccuccgaagcagcacauuaugaugcccccucccccucugcagcauguuccccacgagcauuauaaucagccgcacgaagacaucagagcgccucccgccgagcuuuccauggcuccucccccuccccggagcgugucucaagaaaccuuuagaauuuccacgcgcaaacauagcaaccugaucaccgucccgauucaggaugacucuaauuccggggcccgggagccuccgccucccgcucccgcccccgcgcaccaccaucccgaauaccagggacaacccgugguuagccacccucaucacaucaugcccccucagcagcacuaugcucccccgccucccccucccccgccuaucucucaucccaugccucacccuccccaggccgccggcacaccccaucucguguacucccaagcuccgcccccucccaugaccagcgccccucccccuauuacaccgcccccuggccacaucauugcccagaugcccccuuacaugaaccaucccccgccugggcccccuccuccccagcacggagggcccccggucaccgcucccccuccccaccauuauaauccuaacucccugccccaguucacggaggaucaaggcacacuuucuccgccuuuuacccagcccggaggcaugagcccugggaucuggcccgcgccuagaggacccccgccuccuccccgccugcaggggcccccgucccagacaccccucccuggcccccaccauccugaccaaacccgguacagacccuauuaccaguga

SEQ ID NO: 66918 - RNA, 582 nt, Artificial Sequence
  derived and/or modified sequence opt5 from CBLN1__Homo_sapiens__NP_004343
augcugggcgugcucgagcugcuucugcucggggccgcuuggcuggccggacccgcgagaggccagaacgaaaccgagccuaucguccuugaagggaagugccugguugugugugacagcaauccgacauccgaucccacgggaaccgcucucggcauuucugugcggagcggguccgccaaagucgccuucucugcuauccgcagcacaaaccacgagccuuccgaaaugucuaauagaaccaugauuaucuacuuugaccaagugcugguuaacauuggaaauaacuucgauagcgagcgguccacauuuaucgcuccccgcaagggcaucuauagcuucaauuuucauguggucaaaguguacaacagacagaccauucagguuucucugaugcucaauggcuggccugugaucuccgccuucgccggggaccaggaugucacacgggaggcggccagcaacggagugcugauucaaauggaaaagggcgaccgcgcuuaucuuaaacuggagagagggaaucucaugggaggcuggaaguacucuaccuuuuccggguuccugguguuuccccuuuga

SEQ ID NO: 66919 - RNA, 675 nt, Artificial Sequence
  derived and/or modified sequence opt5 from CBLN2__Homo_sapiens__XP_011524128
augcaggcccccggcagagggccucugggacuccggcugaugaugccgggccgcagaggggcccuucgggagcccggaggcugcgggagcugucugggaguggcucucgcgcugcuucugcuccugcugccugcuugcugucccguccgcgcccaaaacgacaccgaaccuaucguucucgagggcaagugccugguggugugugauuccucucccagcgccgacggcgcugucacauccucucuugggauuagcgugagauccggaucugccaaaguugcuuucagcgccacgcgguccaccaaucacgaaccuagcgagaugucuaaccgcacaaugaccaucuacuuugaucaggugcuggucaauauuggcaaccauuucgaccucgcguccagcaucuuuguggccccgagaaaggggauuuauucuuucuccuuucacguugugaaagucuacaaucggcagacaauccaggugagccugaugcaaaacggauaucccgugaucucugcuuucgccggcgaucaggacgucacccgcgaagcugccuccaaugggguucuucugcucauggagagagaggauaaggugcaucugaaacuggaacggggaaaccucaugggcggcuggaaguacagcacauuuuccggguuccugguguuuccucuuuga

SEQ ID NO: 66920 - RNA, 606 nt, Artificial Sequence
  derived and/or modified sequence opt5 from CBLN4__Homo_sapiens__NP_542184
augggcagcgggagacgggcccuguccgcugugcccgccguccuccugguucuuacccugccuggacucccggugugggcgcagaacgacacagagcccaucgugcuggaaggcaagugccuugucgugugugauucuaauccugcuacggacagcaaaggguccucuagcucuccccugggaauuuccguucgcgccgccaacagcaagguggcuuucuccgccgucagaagcaccaaucacgagccuucugaaauguccaacaaaacacggaucauuuacuuugaucaaauccucgugaauguuggcaacuucuuuacccuggagagcguguucgucgcuccccgcaaggggauuuauucuuuuuccuuccaugugaucaaaguguaccagagccagacaauccaggucaaucugaugcucaacggaaagccuguuauuucugccuuugcgggcgacaaggaugugaccagagaagccgcuacaaauggcgugcugcuuuaucuggacaaagaggauaaggucuaccucaaacuggagaaggggaaccuugugggaggcuggcaauauuccaccuucagcggguuucugguuuucccgcucuga

SEQ ID NO: 66921 - RNA, 834 nt, Artificial Sequence
  derived and/or modified sequence opt5 from CBR1__Homo_sapiens__NP_001748
augagcuccggcauccacguggcccuggucaccgggggaaacaagggcauugggcucgcuaucguuagagaccugugccggcuuuucucuggagauguggugcugacagcccgcgacgucacgagaggccaggcggcugugcaacagcuccaggccgaggggcugagcccccgguuucaucagcuugauauugacgaucugcaauccauccgcgcccucagagacuuccugcggaaagaauacggaggccuggauguucucgugaauaacgcuggcauugccuuuaaggucgcugacccuaccccguuccacauccaggccgaggugacaaugaaaaccaacuuuuucgggacacgcgauguuuguaccgaacugcuuccccugaucaagccucagggaagaguggucaaugugucuagcauuauguccgugcgggcgcucaaaucuugcagccccgagcugcagcaaaaguuucgcuccgaaacaaucaccgaggaggaacuugucggccugaugaauaaguucguugaggacacgaaaaagggggugcaucagaaagaaggauggccuagcucugccuauggcgugaccaagauuggggucacagugcucuccagaauccacgcucggaaacugagcgagcagcgcaagggagauaagauucugcucaacgccuguugccccggcuggguuagaaccgacauggcuggcccuaaagccacaaagucuccggaggaaggggcggagacccccguguaccuggcccuucugccucccgaugcugaaggaccucauggccaguuugucuccgagaaacggguggaacaaugguga

SEQ ID NO: 66922 - RNA, 834 nt, Artificial Sequence
  derived and/or modified sequence opt5 from CBR3__Homo_sapiens__NP_001227
augagcuccugcucuagaguggcccuggucaccggcgcuaaccgggggaucggacucgccauugcgcgcgagcuguguagacaguucagcggcgacguugugcuuacagcucgggauguggcccgcgggcaagccgcuguccagcagcugcaggccgaaggacucucccccagauuucaccaacuggacaucgaugaccuucagucuauucgggcucugcgcgauuuccucagaaaggaguacggcgggcugaaugugcugguuaacaaugccgcgguggccuuuaaaagcgacgauccuaugccguucgacaucaaggcugaaaugacgcucaaaaccaacuuuuucgccacacggaauaugugcaacgagcugcuucccauuaugaagccucauggacgcgucgugaauaucuccucucugcagugucucagagcuuuugaaaacugcagcgaggaucugcaggagcgguuccacuccgaaacccuuacagagggcgaccugguugaucucaugaaaaaguuuguggaagacaccaagaaugagguccaugagcgcgaaggcuggcccaacagcccuuauggggugucuaaacugggagugacaguccuguccagaauccucgcccggcgccuggaugagaagagaaaagcggaccggauucuuguuaaugccuguugccccggcccugugaagaccgacauggaugggaaagacagcaucagaacgguggaagagggagcugaaaccccggucuaccuggcccuccugcccccugaugcuacagagccccaaggccagcuugugcacgacaagguugugcagaacugguga

SEQ ID NO: 66923 - RNA, 714 nt, Artificial Sequence
  derived and/or modified sequence opt5 from CBR4__Homo_sapiens__NP_116172
auggacaaggugugcgccgucuucggcgggagcagaggaaucggccgggcuguugcccagcugauggcgcgcaaaggguacagacucgcugugauugcccggaaccuggagggagccaaggcugccgcuggcgaucuugggggagaccaccuggccuuuuccugugauguggcgaaagaacaugacguccaaaauaccuucgaggaacucgagaagcaccugggccgcgugaacuuucuuguuaaugccgcuggcaucaacagagaugggcugcucgugcggacaaaaacggaagacauggucucucagcugcauaccaaucugcucggaagcaugcugacaugcaaggccgcuaugcgcaccaugauucagcagcaaggcggguccaucgugaacguuggaucuauugugggccuuaaggggaauagcggacaguccgucuauucugccagcaaaggcggccuggugggguucuccagagcgcucgccaaggagguggcucggaaaaagauccgcgucaacguuguggcccccggauuugugcacacagauaugaccaaagaccugaaggaggaacaucuuaagaaaaauaucccucugggcagauucggggagacaauugaagucgcucacgccgugguuuuucuccuggagagcccguacaucaccggacacgugcuggucguggauggcgggcuccagcugauucuuuga

SEQ ID NO: 66924 - RNA, 1698 nt, Artificial Sequence
  derived and/or modified sequence opt5 from CBS__Homo_sapiens__XP_011528084
augcccagcgagaccccucaggccgaagugggcccgacagggugcccccacagauccggaccucauucugcuaagggcagccuggagaaagggucccccgaagacaaggaggccaaagaaccucucuggauccggcccgaugcgccuucucgcuguacguggcaacugggaagaccggcuagcgagucuccccaccaucacaccgccccugccaagucccccaaaauucuuccugacauccugaagaagauuggcgauacacccaugguccggaucaacaaaauugggaagaaauucggacucaagugcgagcugcuugcuaaaugugaauuuuucaaugccggcggcagcguuaaggaccgcaucucccugagaaugaucgaggaugcugaacgggacgggacccucaagccgggagauacaauuaucgagccuaccagcggcaacacagggauuggacuggcccuggcggccgcugugcgcggcuacagaugcaucauugugaugcccgagaaaaugucuuccgaaaaggucgacgugcuccgggcccugggggcugagaucguucgcaccccuacgaaugccagauuugauagccccgaaucucaugugggagucgcguggcggcuuaaaaacgagauucccaauucccacauccuggaccaguaucgcaacgccagcaauccucucgcucacuacgauaccacagccgacgaaauccugcagcagugugauggcaaacuugacaugcugguggcuucuguuggcaccgggggaacaauuaccggcaucgccagaaagcucaaggagaaaugcccggggugucggauuaucggaguggaccccgagggcuccauucuggccgaaccugaggaacugaaccaaacggagcagacaaccuaugaagucgaggggaucggauacgauuucauccccacagugcucgaccgcaccguggucgauaagugguuuaagagcaaugacgaggaggcuuucaccuuugcgagaaugcugauugcccaggaaggccuucugugcggcggguccgcuggaucuacaguugccguggccgugaaagcugcccaggaacuccaagagggccagcggugugucgugauccugccugauagcguuagaaacuauaugacgaaguuccuuuccgaccgcuggaugcugcagaaaggguuucucaaggaagaggaucugaccgagaaaaagcccuggugguggcaucugcgggugcaggaacucggacugagcgcgccgcuuacaguccugccuaccauuacaugcggccacaccaucgagauucucagagaaaagggguucgaccaagcucccgugguugaugaggccggcgugauccugggaauggucacgcuuggcaauaugcugucuucccuccuggccgggaaagugcagccuagcgaccaggucggaaaggugaucuacaaacaauuuaagcagauucgccugacagauacccucggccggcugucucauauccuugagauggaccacuucgcucugguugugcacgaacagauucagagccaagaccaggccugggcuggggucgugggaggccccgccgaucauuccaccgggaaaucuagccagagacagaugguuuuuggcguggucacagcgaucgaccuccugaacuucguggccgcucaagagcgcgaucagaaguga

SEQ ID NO: 66925 - RNA, 558 nt, Artificial Sequence
  derived and/or modified sequence opt5 from CBX1__Homo_sapiens__NP_006798
augggcaagaaacagaacaagaaaaagguggaggaaguccuggaggaagaggaagaggaguacguuguggaaaaagugcucgacagacgggucgugaaggggaagguugaguaucugcuuaaauggaagggauucagcgaugaagacaauaccugggagcccgaggaaaaccuggauugcccugaccucaucgccgaguuucugcaaucccagaaaacagcucacgaaacggauaagucugagggcgggaaacgcaaggccgacagcgauuccgaagacaagggagaggagucuaaaccgaagaaaaagaaagaagagagcgaaaagcccagaggcuucgcgcgggggcuugagccugaacgcauuaucggagcuaccgauuccucuggcgagcugauguuucucaugaaauggaagaauagcgacgaggccgaucuggugcccgccaaggaagcuaacgucaaauguccucaggugguuauuuccuucuacgaggaaagacugacauggcauagcuaucccucugaggacgaugacaagaaagacgauaagaauuga

SEQ ID NO: 66926 - RNA, 1599 nt, Artificial Sequence
  derived and/or modified sequence opt5 from CBX2__Homo_sapiens__NP_005180
auggaggaacugagcuccgugggcgagcaggucuucgccgcugaaugcauccucucuaagagacugcggaaagggaaacuugaguaccugguuaaauggcgcggauggagcuccaagcacaacucuugggaacccgaggagaauauucucgacccuagacugcuucuggccuuucaaaagaaggaacaugagaaggaagugcagaaccggaaacgcggcaagagaccgcgggggcgccccagaaaacucaccgcgaugagcuccuguucucggcgcagcaagcugaaagagccugaugcucccuccaagagcaagucuuccagcagcuccucuucuuccacaagcuccucuagcuccagcgacgaggaagaugacucugaucuggacgccaaaagaggaccucggggccgcgagacgcaccccgugccucagaagaaagcccagauccucgucgcuaagccggaacugaaagaucccauuagaaagaaacgggggcgcaagccucuucccccugagcaaaaggccaccagacggcccgugucccuggcuaaaguucucaagacagccagaaaagaccugggagcgccggccagcaaacuuccucccccucugucugcucccguggccggccucgcugcccugaaggcgcaugccaaggaggcuugcggcgggcccagcgccauggcuaccccugaaaaucuggccucccucaugaagggaauggccucuagcccgggccgcgggggaaucuccuggcagagcucuauuguccacuauaugaaccggaugacacagucccaggcucaagcggccagcagacuggcucuuaaagcccaggccaccaauaaguguggccuggggcucgaucugaaagugcgcacacagaagggagagcuuggcaugucucccccuggcuccaaaauccccaaggcuccuagcgggggagccguugaacagaaggugggcaacaccgggggacccccgcauacgcacggcgcgucccgggucccugcugggugccccggaccucaacccgccccuacccaggagcugucucuccaggugcuggaccugcaaagcgugaaaaauggcaugcccggcgucgggcuccuggccagacacgcuacagccaccaagggaguuccggcuacaaacccugcccccggcaaagggaccggauccggccuuaucggggcgucuggcgccacgaugcccacagauaccagcaaguccgaaaaacuggcuagccgcgccguggcuccuccgacacccgccucuaagcgggacugugugaagggauccgcgaccccuagcggccaggagucuagaaccgcccccggggaagcucgcaaagccgcuacacucccugagauguccgccggagaggaaagcucuagcuccgauagcgaccccgacucugccuccccucccagcacgggccagaauccguccgucucugugcagaccagccaagauuggaagccuacacggucccugauugagcauguuuucgugaccgacgucacagcuaaccuuaucaccgugacgguuaaagaaucucccacaagcgugggguuuuucaaucugagacacuacuga

SEQ ID NO: 66927 - RNA, 552 nt, Artificial Sequence
  derived and/or modified sequence opt5 from CBX3__Homo_sapiens__NP_009207
auggccagcaacaagaccacacugcagaaaaugggcaagaaacaaaaugggaaguccaaaaagguggaggaagcugagcccgaagaguucgucguugaaaaggugcucgacagacggguggucaacggaaaaguggaguacuuucugaaguggaaaggcuucacggaugccgacaauaccugggagccugaagagaaccuugauugcccggaacugaucgaggcguuucucaauucucagaaggcugggaaagagaaggacggaacaaagcgcaaaagccuguccgauucugaaagcgacgauuccaagucuaaaaagaaaagagacgccgccgauaagccccggggcuucgcucgcgggcuugacccugagagaauuaucggagccaccgauagcuccggcgaacugauguuucucaugaaauggaaggacagcgaugaggcugaccugguucuggccaaggaagcgaacaugaaauguccccagauugugaucgccuucuaugaggagcggcucacauggcacucuugcccugaagacgaggcucaguga

SEQ ID NO: 66928 - RNA, 1683 nt, Artificial Sequence
  derived and/or modified sequence opt5 from CBX4__Homo_sapiens__NP_003646
auggagcugcccgccgugggcgaacacgucuucgcuguugagagcaucgaaaagaaacggauuagaaaggggcgcguggaguaccucgugaaauggagaggaugguccccuaaguauaacaccugggaaccggaggagaauauccuggacccccggcuucugauugccuuucagaaccgcgaaagacaagagcagcucaugggcuaccggaaacgcgggccuaagcccaagccucuggucgugcagguucccacauucgcgagacggucuaaugugcuuacgggacugcaggauagcuccaccgacaaccgcgcuaaacucgaucugggcgcccaagggaagggacagggccaucaguaugaacucaauucuaaaaagcaccaucaguaccaaccucacagcaaagagagagccggcaagccgcccccucccgggaaguccggaaaauauuacuaucagcucaacucuaagaaacaucacccuuaccagcccgacccgaagauguacgaucugcaguaucaaggcgggcacaaagaggcuccuagccccacaugcccugaccuuggagccaagucccauccucccgauaaaugggcucagggcgccggggcgaagggauaccugggcgccgucaagccccucgcuggcgccgcuggggccccgggaaaaggcagcgaaaaggggcccccuaauggaaugaugcccgcgccuaaagaggccgugaccggcaacgggaucggaggcaagaugaaaauuguuaagaauaagaacaaaaauggccggaucgugaucgucaugucuaaguauauggaaaacgggaugcaggcugugaaaauuaaguccggagagguggccgaaggcgaggcucgcagccccucucacaaaaagagagccgccgacgagcggcauccgccugcugaucgcacauuuaagaaagcggccggggcugaagagaagaaagucgaagcucccccuaagagacgggaggaagagguuuccggagugagcgacccccaaccucaggaugccggcucuagaaaacugucccccaccaaggaggccuucggggaacagccgcuucagcugacaaccaagccugaccuccuggccugggaucccgcgcgcaauacgcaucccccuagccaccacccgcacccccauccucaccaucaccaccaucaccaucaccaccaucaccaugcugugggccugaaccucucccacguccggaaaagaugucugucugagacccauggagaacgcgagcccugcaagaaacggcuuacagccagaagcaucuccaccccuacaugucugggcgggagccccgccgcugaacgcccugccgaccugcccccggcugccgcgcugccucaacccgaggugauucuucuggacucugaucucgacgagccuaucgaucugcggugcguuaagaccagauccgaagccggagagcccccgagcucucuccaggugaaaccugaaacgcccgcuagcgccgcugucgccguggcggccgcugccgcuccuacaaccacagccgagaagccucccgccgaggcucaggacgaacccgcggagucccugucugaauuuaaaccguucuuuggcaauauuaucauuaccgauguuaccgccaacugucugacagugacguucaaggaguacgucaccguguga

SEQ ID NO: 66929 - RNA, 576 nt, Artificial Sequence
  derived and/or modified sequence opt5 from CBX5__Homo_sapiens__NP_001120793
augggcaagaaaaccaagagaacagccgacagcuccucuagcgaggaugaagaggaauacguggucgagaaaguucuggaccggcgcguggugaaggggcaggucgaauaucuccugaaauggaagggauucuccgaggagcacaacacgugggaacccgagaagaaucuugauugcccugaacugaucucugaguuuaugaaaaaguacaaaaagaugaaagagggcgaaaacaauaagccgagagaaaagagcgaauccaacaaacggaagucuaauuucagcaacuccgcugacgauauuaaaagcaagaaaaagcgcgagcaaucuaaugacaucgccagaggguuugaacggggacucgagcccgagaaaauuaucggcgcgaccgauuccuguggggaccugauguuccuuaugaaguggaaggauacagacgaagcugaucuggugcucgccaaagaggccaacguuaagugcccucagauugugaucgcuuuuuaugaggagcgccugaccuggcaugccuaccccgaagacgcugagaauaaagagaaggaaacagccaaaagcuga

SEQ ID NO: 66930 - RNA, 1185 nt, Artificial Sequence
  derived and/or modified sequence opt5 from CBX6__Homo_sapiens__NP_001290423
auggagcugagcgccgugggcgaaagagucuucgcugccgaguccaucauuaagcggcgcaucagaaaagggcggauugaauaccucguuaaguggaaaggaugggcgaucaaguauucuaccugggagcccgaagagaacauucuggacagccgccuuaucgcugccuuugagcagaaagaaagagagcgggaacuguacggcccuaagaagcgcgggccgaaacccaagacauuccuccugaaaccuuccgccucugcuagcucccccaaacuucacucuagcgccgcugugcauagacugaagaaggauauccggcgcugccacagaaugucccggcgcccucuccccagaccugacccgcaaggaggcagccccgggcugcggccucccauuucuccuuuuuccgagacggugcgcaucauuaauagaaaggucaaaccccgggagccgaagagaaaccgcaucauucugaaucucaaagugaucgauaagggagccggcggcgggggagcgggccagggggccggagcucuggcccggccuaaaguucccagcagaaaccgcgugauuggcaagucuaaaaaguucuccgaaagcguccuucggacccagaucagacauaugaaguuuggggcuuucgcccuguauaaaccuccucccgcgccccucguggccccgucucccggaaaggcugaggccuccgcuccuggccccggccugcuucuggccgccccugcugcgcccuacgacgcccgcagcuccgggucuagcggauguccguccccuacaccccagagcucugauccugacgauacacccccuaaacuccugcccgaaaccguuuccccgagcgcuccuucuuggcgggagcccgaagugcuggaccucagccugcccccugaguccgccgccaccucuaagagagcuccgcccgaggucacagccgcggcuggcccugcucccccuaccgcccccgaaccugccggggccagcuccgagcccgaagcuggagauuggcgcccggagaugagcccuugcucuaaugugguggucacggacguuaccuccaaccuucugacagugaccaucaaagaauuuuguaaucccgaggauuucgagaagguggccgcgggcgucgccggggcugccggaggcggcgggagcauuggagcuucuaaguga

SEQ ID NO: 66931 - RNA, 756 nt, Artificial Sequence
  derived and/or modified sequence opt5 from CBX7__Homo_sapiens__NP_783640
auggagcugagcgccaucggcgaacagguguucgcugucgaguccauuagaaagaaacggguucgcaaggggaaaguggaauaccucgugaaguggaaaggauggcccccuaaguauucuaccugggagccggaggaacacauccuggaccccagacuugucauggccuacgaggaaaaggaggaacgggaucgcgcgagcggcuauagaaaacgggggccuaagcccaaacgccugcuccugcaaagacuuuacuccauggaccugcggucuagccauaaggcuaaaggaaaggagaagcucugcuuuucccugacauguccucugggcucugggagccccgagggagugguuaaagccggcgccccugaacucguggauaagggcccgcugguccccacgcuuccuuucccccugcgcaaaccuagaaaggcucacaaauaucuccggcugucccgcaagaaauuucccccgagagggccuaaccuugagagccauucucaccggcgcgaacuguuccuccaggagcccccugcccccgacgugcugcaggcugccggagaaugggagcccgcggcccagccuccggaggaagaggcugaugccgaccuggcugaagggcccccucccuggaccccugcccuccccuccagcgagguuacagugaccgauauuacagccaauucuaucaccgucacauuuagagaagcgcaagcugccgagggcuucuuucgggacagauccggaaaguucuga

SEQ ID NO: 66932 - RNA, 1170 nt, Artificial Sequence
  derived and/or modified sequence opt5 from CBX8__Homo_sapiens__NP_065700
auggagcugagcgccgugggcgaaagagucuucgcugccgaggcgcuccugaagcggcgcaucagaaaagggcggauggaauaccuuguuaaguggaaaggauggucccagaaguauucuaccugggagcccgaagagaacauucuggacgcucgccuccuggccgccuuugaggaaagagagcgggaaauggagcuuuacggcccuaaaaagcgcgggccgaagcccaaaacauuccugcucaaggcucaagccaaagcuaaggccaaaacguaugaguuuagaagcgauuccgcgcggggaauccgcauuccuuaccccggcagaucuccucaggaccuggccagcaccucccgggcucgcgaagggcugagaaauaugggacucucucccccugccagcuccacaagcaccucuuccacaugccgggcugaggccccgcgcgauagagaccgggauagagaccgcgaucgggaaagagaccgcgagcgggaaagagagcgcgagcgggaaagagagcgcgaacgggagagagaacgcggcaccagccggguggaugacaagcccucuuccccuggcgauagcucuaagaaaagagggcccaagccucggaaagagcugcccgacccgucccagcgcccucuuggagagcccagcgcgggccugggggaauaucucaagggaagaaaacuggaugacacaccuuccggcgccgggaaguuccccgcuggacacucugugauccagcuugcccggagacaagacagcgaucugguccaguguggcgugaccucccccagcucugcugaggccacgggcaaacucgccguugacaccuuuccugcucgcgugauuaagcaucgggcggccuuccuggaagcuaaggggcagggagcccuggauccgaacggcacaagaguccgccacggguccggacccccuagcucuggcgggggacucuacagagacaugggcgcccagggcgggcggcccagccugaucgcucgcaucccuguggcccggauucuuggagaucccgaggaagaguccuggucuccgagccugaccaaucucgagaaaguuguggucacagacgugaccuccaacuuucugacggugacaaucaaggaaagcaauaccgaucaaggcuucuuuaaagagaagagauga

SEQ ID NO: 66933 - RNA, 510 nt, Artificial Sequence
  derived and/or modified sequence opt5 from CBY1__Homo_sapiens__NP_001002880
auggacaagugccagaaacacgauguggagugugaaaagcccgacgccaacgaggauagccugugcaauuccguccauguucaauggccuggcgaagggucuaccggauucgcuuuuaucagaccgaaaaugcccuucuuuggcaacacauucagcccuaagaaaacgcccccucggaaguccgccucucucagcaaucugcacucccuugaccgcucuaccagagagguggaacuggggcucgaguacggaagccccacaaugaaccuggcgggccagucccuuaaguuugagaaugggcaguggauugcugaaaccggagugagcggcggcgucgaucggcgcgaggugcagagacugcggcgcagaaaccaacagcucgaagaggagaauaaccugcugcggcucaaaguugacauccugcuugauaugcugucugaauccacagccgagagccaucucauggaaaaggagcuggacgaacuucgcauuucuagaaaacggaaguga

SEQ ID NO: 66934 - RNA, 2856 nt, Artificial Sequence
  derived and/or modified sequence opt5 from CC2D1A__Homo_sapiens__NP_060191
augcacaagagaaaagggcccccugggccgcccggacggggcgccgcugccgcgcgccagcuggggcuccugguggaccuuagcccugauggacugaugauccccgaggacggcgcuaacgaugaggaacucgaagccgaguuccuggcccuugucgggggacaaccucccgcucuggaaaagcucaaaggcaagggcccucugccgauggaggccauugagaaaauggcuucccugugcaugagagaccccgaugaagacgaggaagaggggaccgaugaggacgaucucgaagccgacgaugaccugcuugcggagcugaaugaaguucucggagaggaacagaaggccucugagacaccucccccuguggcucagcccaagccggaggccccucaucccggccuggaaacgacccuucaggagcggcuggcucucuaccaaacagccaucgaaagcgcgcgccaggccggggauuccgcuaaaaugagacgguaugaccgcggacugaagacccuggagaaccuccuggccucuauuagaaaaggcaaugcuaucgacgaagccgauauuccuccucccguggccaucgggaagggacccgcuagcacaccgaccuacucccccgcgccuacacagcccgccccucggaucgcuucugcccccgagccgcgcgucacccuugagggcccuagcgccacggcucccgccuccagcccuggccuggcgaaaccccagaugccucccgggccguguucuccuggaccccucgcucaacugcaguccagacagcgggacuauaaacuugccgcccugcacgcuaagcagcaaggcgauaccacagccgcugcccgccauuuuagaguggcgaagucuuucgacgccguucucgaagcucugagccggggcgagcccguggaucuguccugccucccuccgcccccugaccagcugcccccugaucccccuucucccccgagccagccucccaccccugccacagcucccuccaccacggaagucccgccucccccucgcacacuucuggaggcccucgaacaaagaauggagcgguaccagguggcggccgcucaggccaagagcaaaggagaccagagaaaggcucgcaugcacgagcggauuguuaaacaauaucaggaugccaucagagcccauaaggcuggccgcgcgguggacgucgccgaacugcccgugcccccuggguuuccgcccauucagggacuugaggcuaccaaaccuacacagcaaucccuggugggcguccucgaaaccgccaugaagcuggccaaccaggaugagggccccgaggacgaagaggacgaaguuccuaagaaacaaaauucucccguggcuccuaccgcccagccgaaggcgcccccuagccggacaccccaguccgggagcgcuccuacggccaaagcucccccgaaggccaccucuacaagagcccagcagcagcuggcguuccucgagggacgcaaaaagcaacugcuucaggcugcccugcgggccaagcagaaaaacgauguggaaggcgcuaagaugcaccucagacaagccaaagggcuggagccuaugcuggaggcuucccgcaauggacuucccgucgacaucaccaaggugcccccugcccccguuaacaaagaugacuuugcgcucgugcagcggccuggcccggggcugagccaggaagccgcuagacgcuacggcgagcugacaaagcucauucggcagcaacacgaaaugugucugaaucauucuaaccaguucacccagcuuggaaauaucacggagacaaccaaguuugaaaaacuggccgaggauugcaagagaagcauggacauucucaaacaggcuuucguccggggccugcccaccccuacagcccgcuuugagcaaagaaccuucuccgugaucaagaucuuucccgaucugucuagcaacgacaugcuucucuucauuguuaaagggaucaaucugccuacacccccgggacuguccccuggcgaucucgacguguuuguccgguucgauuuccccuauccuaacguggaagaggcccagaaggacaagacgagcgucauuaaaaauaccgauucucccgaauuuaaggagcaguucaaacuguguaucaacagaucccaccgcggguuucggagagcuauucagacaaagggaaucaaauucgaagugguucauaagggcgggcuuuuuaaaaccgaccgcgugcugggcacagcgcaacucaagcuggacgcccuggagaucgcuugcgaggucagagaaauucuugaggugcucgauggacggcgcccuaccggcgggagacuggaaguuauggugcggauccgcgagccccugacggcccagcagcucgagaccacaaccgaaagauggcuggucauugacccggugccugccgcugugcccacacaaguugccggacccaagggcaaagcgccuccgguccccgcuccugcccgggagagcgggaaccgcucugccagaccccuucacucccugagcgugcucgcuuucgaucaggaacggcuggagcgcaagauccuggcccuuagacaggcgcggagaccugugcccccugaagucgcucagcaauaccaggacauuaugcagcgcucccaguggcaacgggcccagcucgagcagggaggcguggggaucagacgcgaguacgccgcucagcuggaacggcaacugcaguuuuauaccgaggccgcuagacgccucggcaaugauggaucucgggacgccgcgaaagaagcccuguacagacgcaaccuuguugagagcgaacugcagcggcucagacgguga

SEQ ID NO: 66935 - RNA, 1806 nt, Artificial Sequence
  derived and/or modified sequence opt5 from CC2D1B__Homo_sapiens__XP_011539232
augaugcccggcccuagaccgcggaaggggccccaggcccgcggacaaggcguggcugccgcgaaacagauggggcuguucauggaguuuggaccugaagacaugcuccugggcauggaugaggcugaagacgaugaggaccuugaagccgagcugcucgcccugaccggggaggcucagacaacgggaaagaaacccgccccuaagggccaggcuccccuuccuauggcccacaucgaaaaacuggcggccgauugcaugagagacgucgaggaagaggaggaagaggaaggccucgaggaagaugcugagcugcugaccgagcuccaagaaguucuggggguggacgaggaaacagagccgcuugauggagacgaaguggccgaucccggcgggagcgaggaggaaaacggacuggaggacaccgaaccucccguccagacagcugugcucaccgccuccgcgccugccgcucaggccggcgcuucucaggggcugcaugcccuucuggaggaacggauucacaauuaccgcgaggccgcugcgagcgccaaggaggcuggagaagccgccaaggcuagacggugugagcgcggccucaaaacacuggaaucccaacuggccucuguuagacggggccgcaagaucaacgaggaugagauucccccgccuguggcgcucgggaaaagaccccuggcuccucaggaacccgccaaucggagccccgagaccgacccuccggcucccccugcucuugaauccgacaaccccucucagccugagacgagccugcccggaaucuccgcccagccggucagcgaucucgacccugauccccgcgcucugcuuucuuccagacaacgggaauauaagguggccgcgcugagcgccaaacgcgcuggcgagcucgacagagcccgggagcugaugagaauugggaagcgcuucggagcuguucuggaagcccucgagaagggccagccuguggaucugucugcgaugcccccugcccccgaagaccuuaaaccgcagcaagcuagccaggccccuaccgcucccagcgucauucccccugccguggagcgggugcagccggucauggcccccgauguuccugcuacacccguggcgccuaccgaaucucagacagugcuggacgcccuccaacagagacugaauaaguaccgcgaggcugggauccaggcccgguccggaggcgaugagagaaaagcccgcaugcaugaacggaucgcuaagcaguaucaagacgccaucagagcgcaccgcgcuggccggaaagucaacuuugccgagcuucccgugccucccggguucccgccuauucccggacuggaaagcaccaugggcguugaggaagaugccguggcugccacgcucgcggcugccgagaagcuggccuccgcugaggacucugccccugcugacaaagaugaagacgagcccccggggcaucugcagggagaaccucccgcccaggcgccugucgccaagaagcccgcuagacccacagugccuagcucccagcgccucccggagccccgggccuccucuuccaaagagagcccuucucccagcguuagagaacaacuggcccuucuggaggcccggaagcuccaguaccagcgcgccgcucugcaggcgaaaagaucccaagaucuggaacaggccaaggcuuaucuucggguggccaaauggcucgaggcccagaucauucaagcuagaucuggccgcccugucgaccugagcaaggggcccugcgaucugggccggugucucagaccuuga

SEQ ID NO: 66936 - RNA, 4863 nt, Artificial Sequence
  derived and/or modified sequence opt5 from CC2D2A__Homo_sapiens__NP_001073991
augaaccccagagaggaaaaggugaaaaucauuaccgaggaauucaucgagaaugacgaagaugccgacaugggccggcagaacaagaauagcaaaguccgcagacaaccucggaagaaacagccgcccacagcuguuccuaaggagaugguguccgagaagucucaccuggggaacccccaggaaccugugcaggaggaacccaaaacgcgccuccugagcaugaccgucagacggggaccucgcucccuuccgcccauuccuucuacaagcagaaccggcuuugccgaguucuccaugcgggggcgcaugagagagaagcugcaagcggcucggucuaaagccgaaagcgcccuccugcaggagauccccacaccucgccccagacggcuucgcuccccgagcaagaaagaacuggagaccgaauuuggaacagagccuggcaaggagguggaaagaacccagcaggagguugauucucaauccuacagccgggugaaguuccaugacucugcuagaaaaauuaagcccaaaccucaggucccccccggguuuccuuccgccgaagaggcuuauaauuucuuuacguucaacuuugauccggaacccgagggaagcgaggaaaagccuaaagcccgccaccgggcgggcaccaaucaggaggaagaggaaggcgaggaggaagagcccccugcccaggggggaggcaaggaaauggacgaggaggaacuccugaacggggaugacgcugaggauuuccugcucggacuggaccauguggccgaugacuuuguugcugugagacccgccgauuacgaaucuauccacgaccgccuucaaauggagcgggaaaugcuguucaucccguccagacagacagucccuaccuauaaaaagcuccccgagaaugugcagccucgcuuucuggaggacgaaggccuuuacacaggggugcggcccgaggucgcgagaaccaaccaaaauauuauggaaaaccgccugcucaugcaggauccugagcggagaugguucggagacgauggccgcauccuggcccugcccaauccgauuaagccuuuccccagccggcccccuguucucacgcaggaacaguccaucaaagcugagcuggagacacuuuauaagaaagccgugaaguacgugcauucuagccaacacgucauuagauccggcgacccgcccgggaacuuucagcuggauaucgacauuagcggacucaucuucacccaccauccuugcuuuucucgggaacacgugcuggcugccaaacuugcccagcuguaugaucaguaccucgcucgccaucaaagaaauaaggcgaaguuccugacagacaaacugcaggcccuccggaacgcuguucagaccggccuggaucccgagaagccucaccagucccuugacaccauccaaaaaacaauuaacgaauacaagagcgagaucagacagacgcgcaaauuucgggaugccgaacaggagaaggacagaacccugcucaagacaauuaucaaaguguggaaggagaugaaaucucugcgcgaauuccagagauuuaccaauacaccccuuaagcugguccuccggaaagagaaggccgaccaaaaggcugaugaagaggccuaugaggcggaaauucaggcugagaucagcgaacugcuggaggaacacaccgaggaguacgcccagaaaauggaagaguaucgcacgucccuccaacaguggaaggccuggagaaaagugcagcgggcuaagaaaaagaaacgcaagcaggccgcugaagagcauccuggggacgaaaucgccgagcccuacccggaggaagaucugguuaagccuucucccccugagcccacagacagagcggugauugaacaagagguccgggaacgcgccgcucagagcagacggcgcccgugggagccuacccuugugcccgagcugucccucgccggaagcgucaccccuaacgaucagugucccagagcugaagugucucggagagaggacguuaaaaagcgcuccguguaucugaaaguccuguucaauaacaaggaagugagccggacaguuucuagaccccuuggcgccgauuuucgcgugcacuucgggcagaucuuuaaucuccaaauugucaacuggccugagucccugacccugcagguguacgagacagugggacauagcuccccgacgcuccuggcggaaguuuuccuucccaucccugagaccacagucgugaccggccgggcccccacagaagagguggaauuuucuagcaaucagcacgucacccuggaccaugagggcgugggguccggaguuccuuucucuuucgaggcugauggcagcaaccagcucacgcugaugaccuccgggaaagugagccacucugucgccugggcuauuggagaaaauggcaucccccugaucccuccgcuuucccaacagaacauuggguuuagaagcgcccucaagaaggccgacgcuaucucuuccauuggcacaagcggacugaccgauaugaaaaagcuggcgaaaugggccgcugagucuaagcucgaccccaaugauccuaacaaugccccccugaugcagcuuaucagcguggccacauccggcgaaagcuauguuccugacuucuuucgccuggagcaacuccagcaggaauucaacuuugugucugaccaggagcugaaucgguccaaaagauuccgccugcuucaccuccggagccaagagguccccgaauuuagaaacuacaagcaggugccgguuuacgaucgggagauuauggaaaagguguuccaggacuaugagaaacgccugagagaucggaacgucaucgaaaccaaggagcauauugacacgcaccgcgcuaucguggccaaauaccugcagcaagugagagaguccgucaucaaucgguuucucauugcgaagcaguauuuccugcuugcugauaugaucguugaagaggaagugccuaacauuucuauccuggggcucagccuguuuaaacuggccgagcagaagagaccccuucgcccccggagaaagggacgcaaaaaggugacagcccagaaucucuccgacggcgauauuaaacugcuggucaacaucgugcgggcuuacgacaucccuguuagaaagcccgccgugucuaaauuccaacagccuagccgcuccucucggauguuuagcgagaagcaugcggcuuccccgagcaccuauucucccacacacaaugccgauuacccucucgggcagguccuggugagacccuucguugaaguguccuuccagcgcaccgucugccacaccacaacggccgagggaccuaaccccagcuggaaugaagagcuugaacugccguuuagagcuccuaacggcgacuauucuaccgccucccuccaaagcgugaaagauguuguguucauuaauaucuuugacgagguccugcaugaugugcuggaggacgaccgggaacgcgggucuggcauucacacaagaaucgagcggcauuggcuuggaugugugaagaugcccuucuccaccauuuacuuucaggcucgcaucgauggcacauucaagaucgacauuccucccguccugcucggguacagcaaagaaagaaacaugauccuggagcggggauuugauuccguuagaagccucucugaaggcagcuauauuacccuguucaucacgauugagccucagcuugugcccggggaguccauccgcgaaaaguuugagucucaagaagacgagaaacugcuccaggccacagaaaaguuccaggcggagugcgcccugaaauuuccgaaucggcagugucugaccaccgugaucgauauuagcggaaagacagucuucaucaccagauaccuuaagccucugaaccccccccaagagcuccugaauguguauccuaacaaucuccaggcuacagccgaacugguugcucgcuacgugucccuuauuccguuccugcccgacacggucucuuuuggcgggaucugcgaucucuggagcaccuccgaccaguuccuggaucugcuugccggcgacgaggaagagcacgccgugcugcucuguaacuauuuucugucucucggaaaaaaggcuuggcugcuuaugggcaacgcgauuccugaggggcccacagccuacguucugaccugggaacagggacgguaucugaucuggaauccuugcagcggccauuucuacgggcaauuugauacauucuguccccucaaaaacgugggaugccugauuggcccugacaauaucugguuuaacauccagagauacgaguccccgcuucggauuaauuucgacgucacccgccccaagcuguggaaaagcuuuuucucuagaucccucccuuaucccgggcugagcucugugcagccugaagagcucaucuaccagcgguccgauaaggcugccgccgcugaacugcaagaccgcauugagaagauccuuaaagagaagauuauggauuggagaccccggcaccugacgcgcuggaacagauauuguaccagcacacugcggcacuuucucccgcugcuugaaaaaucccagggcgaggacgucgaagaugaccaucgcgccgagcugcucaagcagcugggagauuacagauucucuggcuuuccucuccacaugcccuauagcgaagugaaaccccugaucgacgcgguuuacuccaccggggugcauaauaucgaugucccuaacguggaguucgcucuugccguuuauauucaccccuacccuaagaaugugcugagcgucuggaucuacguggccucucugauucggaacagauga

SEQ ID NO: 66937 - RNA, 3408 nt, Artificial Sequence
  derived and/or modified sequence opt5 from CCAR1__Homo_sapiens__NP_001269889
auggcccaguucggcgggcaaaagaaucccccuugggcuacccaguuuacagccacggcggugagccagccggcugcccugggaguccagcaacccucccuccugggcgccucuccuaccaucuacacacagcagaccgcucuugccgcugccgggcugacaacccagacacccgcgaacuaucaacucacccagacggccgcucugcagcagcaagccgcugccgcggccgcugcccuucagcagcugcaacagccucagcagacccuccugacacaacccgcuguugcccugccuaccagccucucccugucuacaccgcagcccaccgcccagauuacggugagcuacccuacacccagauccucucagcaacagacccagccucagaaacaacggguguucacaggagucgugaccaaacuucacgacaccuuuggcuucguugaugaggacguguuuuuccagcugagcgcugucaaagggaagacaccccaggugggagaucgcguucucguggaagcgacguauaacccgaauaugccuuuuaaauggaacgcccagagaauccaaacccugcccaaucagaaccagucccaaacacagccucuucugaagaccccucccgcuguccuccagcccauugccccgcagacaaccuucggcgugcaaacgcagccccagccucagagccugcugcaagcccagaucucugcugccuccauuacaccccuccugcagacccagccucaaccccuucugcagcagccgcaacagaaggcgggccuccugcagccucccgugcggaucgucagccagccucaacccgcucgcagacuugacccucccucucgguuuuccgggcgcaaugauagaggagaccagguuccgaaccggaaagaugaccgcagcagagagcgggaacgcgagagacggcgcucuagagaacgguccccucagagaaagcgcagccgggagagauccccucgccgggagagagaacgcucuccccggagagugcgccgggugguccccagauacaccgugcaguucagcaaauuuucccuggauugcccgagcugugacaugauggagcuccgccggagauaucaaaaucuguacauccccucugauuucuuugacgcccaguucacauggguugaugccuucccucugucccggcccuuucagcucggcaacuauugcaauuucuacgugaugcaucgcgaagucgagagccuggagaagaacauggcuauucuugacccucccgacgccgaucaccuguacucugcuaaagugaugcucauggccagcccuuccauggaagaccuguaucauaagucuugugcgcuugccgaggauccccaggaacugagagacggguuucaacacccggcucggcucguuaaguuccuggugggaaugaaaggcaaggaugaggccauggcuaucgggggacauuggagcccuucccuggacggccccgauccugaaaaagaccccagcguccucauuaagaccgccaucagaugcuguaaagcgcugacaggcauugaucuuucugugugcacgcagugguaccgcuuugccgagauccgguaucacagaccggaggaaacccacaaggggcgcacagucccugcucauguggagaccguugugcuguucuuucccgacgucuggcacugucucccuacaagauccgaaugggagacccugagccggggauacaaacagcagcugguggaaaaacuucaaggcgagcgcaaggaggccgauggggaacaggacgaggaagagaaggacgauggagaagcuaaggagauuucuacgcccacccauugguccaaacucgaccccaagacaaugaaaguuaaugaucugagaaaggagcuggaaagccgggcccucuccucuaagggccugaaaagccagcuuaucgcccgccugaccaagcaacucaaaguggaggaacagaaggaggagcagaaagaacuggagaaguccgaaaaggaggaagacgaggaugacgauagaaaaucugaggacgauaaggaagaggaggaacggaaacgccaggaagagaucgagagacaacggcgcgaaagacgguauauucugccugacgagccggcuaucauuguccaccccaacugggcggccaagagcgggaaauucgauugcuccaucaugagccuuucugugcuccuggacuacagacuggaagauaauaaggagcacuccuuugaagugagccucuucgcugagcuguuuaacgagaugcuucagcgcgacuucggaguucggauuuauaagucucugcucucccugccugaaaaagaggacaagaaagaaaaggauaaaaagagcaaaaaggacgagagaaaggauaaaaaggaggaacgcgacgaugagacagacgaacccaaaccuaagcggagaaaaucuggcgaugacaaggauaagaaagaggaccgcgaugaacggaagaaagaggacaagagaaaagaugacagcaaggacgaugacgagaccgaagaggauaacaaucaggacgaauacgaucccauggaggccgaagaggccgaggacgaagaggaugaccgcgaugaagaggaaaugacgaagcgggacgauaaaagagacaucaaccgguacuguaaggagcgcccuuccaaagacaaggagaaagaaaagacacagaugaucaccauuaauagagaucugcuuauggcuuuugucuauuucgaccaaagccauugcggcuaccuccuggagaaggaucuggaagagauccucuauacacuggggcuucaccugucucgggcccaggugaaaaagcuccugaacaaagugguccugcgcgaguccuguuucuacagaaaacuuaccgacaccagcaaggaugaagagaaucaugaagaguccgaaucucuccaggaggacaugcugggaaaccggcugcuccugccgacacccacggugaagcaggagagcaaagauguugaagagaaugugggccuuauugucuauaacggggcgaugguggacguuggaucccugcuccaaaagcuggaaaagucugagaaagugagagcugaagucgagcagaagcugcagcuucuggaggaaaagaccgaugaggacgaaaagacaauccucaaucuggagaacagcaauaaaucccucucuggcgaacugcgcgaggugaagaaggaucuuagccaacugcaggagaaccucaaaauuuccgaaaauaugaaccugcaguuugagaaucagaugaacaagaccauccggaaccugagcacaguuauggacgaaauccacaccgugcuuaaaaaggauaaugucaaaaacgaggacaaggaccaaaagucuaaagagaauggggccuccguguga

SEQ ID NO: 66938 - RNA, 2772 nt, Artificial Sequence
  derived and/or modified sequence opt5 from CCAR2__Homo_sapiens__NP_066997
augagccaguucaagagacaacggaucaacccccugccuggcgggcgcaauuuuuccggaaccgccucuacaagccuccugggcccgcccccugggcuucugacgcccccuguggcuaccgagcucucccagaacgccagacaucugcagggaggcgaaaaacagcgggucuucacagggauuguuaccucucuucacgacuacuuuggagugguggaugaggaagucuucuuucaacugagcgugguuaagggccgccucccccagcugggcgagaaagugcuggucaaggcggcuuauaauccugggcaggccgugccguggaacgccguuaaagugcagacacucuccaaucaaccccugcuuaagucuccugcucccccucugcuccacgucgccgcucugggacagaagcagggcauccuuggggcccagccccaacugauuuuccagccgcauagaaucccuccccucuuuccucagaaaccccugagccuguuccaaaccucccacacacuccaucugagccaccuuaaccgguuucccgcgcgcggaccucacggcagacuggaccaggggcggucugaugacuacgauuccaagaaacgcaagcagagagccggaggcgaaccguggggcgcuaaaaagccccggcaugaccucccucccuaucgcgugcaccugaccccuuacacgguggauagccccauuugcgacuuccuugagcugcagagacgguaucgcucucuccuggucccguccgauuuucugagcguucaucucucuuggcuguccgccuucccucuuagccaacccuuuucccugcaccacccuucuagaauccaggugagcuccgagaaggaagcugcccccgacgcgggggccgagccuaucaccgcugauagcgaccccgccuacucuuccaaagugcuccugcuuagcucuccgggacuggaagaacucuaucgguguugcaugcuguucgucgaugacauggcugagccuagagaaacacccgagcauccccugaagcagauuaaauuccuccugggccgcaaggaagaggaagccgugcuuguugggggagaguggagcccuucccuggacggccucgauccgcaggccgacccccaagugcugguccggaccgcuaucagaugugcgcaggcccagacagggauugaucugucuggaugcaccaaaugguggcgcuuugcugaguuccaguaccuucaaccuggacccccucggagacuccagacggugguuguguaccugcccgacgucuggacaaucaugccuacccuggaagagugggaagcccucugucagcagaaggccgcugaggccgcgcccccgacacaagaagcucagggcgagaccgagccuaccgaacaggcccccgaugcccuggagcaagcugccgacacaagccgccggaaugcugaaacgccugaggccaccacacagcaggaaaccgauacagaccuucccgaggcgccgccucccccucuggagcccgccgugauugcuagacccgggugcgucaaccucucccugcacggaaucguggaagaucgccggccuaaagagagaauuagcuuugaaguuauggugcuggccgagcuuuuccucgagaugcugcagcgcgacuuuggcuaucgggucuacaagaugcugcucucucugccggaaaaggugguuuccccucccgagcccgaaaaagaggaagcugccaaggaggaggcgaccaaagaagaggaagccaucaaggaggaaguggucaaagagccuaaggaugaggcucaaaaugaagggcccgccacggagagcgaagcuccucuuaaggaggacggacugcucccgaaaccccugucuuccggcggggaagaggaggaaaagccuagaggcgaggccagcgaagaccugugugagauggcccuugaucccgagcuccugcugcuccgggacgauggagaagaggaguucgcuggcgcgaaacuggaggacuccgaagugcgcucuguggccagcaaccaguccgagauggaguuuucuagccuucaggauaugccuaaggaacuggaccccuccgcuguucucccgcuggauugccugcuugccuucgucuuuuucgacgccaauugguguggguaucuccauagacgggaucuggagagaauccugcucacacugggcauucgccuuagcgcugaacaggccaaacaacuggugucucggguggucacccagaacaucugccaguacagaucccuccaguauagccgccaagagggccuggacgggggacugccugaagaggugcuuuuuggcaaucuggaucuccugcccccucccgggaagucuaccaagcccggcgcggcuccuacagagcacaaagcccucguuucccauaacggaagccugauuaaugugggcucucuucugcagagagccgaacagcaagacagcgggcggcucuaccuggagaacaagauccacacccuggaacuuaaacuggaggaaucccacaaccgcuucagcgcuacagaggucacgaauaagacccucgccgcggagaugcaggaacugagagugcggcucgcugaggccgaagagacagcccgcaccgcugagagacagaaaucucagcugcaacggcuucugcaggaacuccgcagacggcugacaccgcugcagcuugagauucagcgcguuguggaaaaggccgauuccugggucgagaaggaggaacccgcuccuagcaacuga

SEQ ID NO: 66939 - RNA, 1221 nt, Artificial Sequence
  derived and/or modified sequence opt5 from CCBE1__Homo_sapiens__NP_597716
auggugcccccuccgcccagcagaggcggggccgcucggggacagcugggccgcucccucgggccucugcuucugcuccuggcccuuggacacaccuggacauacagagaggaacccgaggacggcgaucgggaaaucugcucugagagcaagauugcgacgaccaaauauccuugucugaaguccucuggggaacucacaaccugcuaccgcaaaaaguguugcaaaggauauaaguucguccugggccaauguauccccgaggacuacgauguuugcgcugaggccccuugugaacagcagugcacagacaacuuuggcagagugcuguguaccugcuauccgggguaccgguaugaucgcgagagacaucggaagcgcgaaaaacccuacugucucgacauugaugagugcgccagcuccaauggaacacugugcgcucacaucuguauuaacacccuuggcucuuacagaugcgagugucgggaaggguauauccgcgaggacgauggaaagacgugcaccagaggcgacaaauacccuaaugauacagggcaugaaaagagcgagaacauggugaaagccggaaccuguugcgcuacauguaaggaguucuaucagaugaagcaaaccguccugcagcucaaacagaagaucgcccugcuucccaauaacgcggccgaccugggcaaauacauuacgggcgauaaggugcucgcuuccaauacauaucugccugggcccccgggacugccuggcgggcagggacccccuggcagccccgggcccaaaggaucuccuggcuuuccgggcaugcccgggccucccggacaaccuggcccccggggguccaugggaccgaugggcccuagccccgaccucucucacaucaagcaggggcgcagaggcccuguuggacccccuggcgcccccgggcgggacggauccaaaggcgaaagaggggcuccgggaccucgcggcagccccgggcccccuggcucuuucgauuuucugcuucugaugcucgccgacauucggaacgauaucaccgagcugcaggaaaagguguucggacauagaacacacuccagcgcggaggaauuuccgcuuccccaggaguucccuuccuaccccgaagccauggaccugggcucuggggaugaccacccucgccggaccgagaccagagaucuccgcgcuccccgggacuuuuauccuuga

SEQ ID NO: 66940 - RNA, 1119 nt, Artificial Sequence
  derived and/or modified sequence opt5 from CCBL1__Homo_sapiens__NP_001116144
auggccaagcagcugcaagcuagacggcucgacggcaucgauuacaaccccuggguggaguucgucaaacuggccagcgaacacgacguugugaaucuugggcagggauuuccugauuucccgcccccugacuuugcgguggaggcuuuccagcaugccgucuccggcgauuuuaugcugaaccaguauaccaagacauucgugauuaucauugaacccuuuuucgacugcuacgagccuaugacgaugauggccgggggacgccccguuuuugugucucucaaaccuggcccgauccaaaauggggaacugggaagcuccucuaacuggcagcuugaucccauggagcuggcuggcaaguucaccagcagaacaaaagcccucguccugaauaccccuaacaauccccugggcaagguguuuucccgggaggaacucgagcugguugcuucucuuugucagcagcacgacguggucugcauuacagaugaaguguaucaauggaugguguacgacgggcaucagcacaucagcaucgccucccugccuggaaugugggagcgcacccucacaauuggcagcgcggggaagaccuucucugccacgggauggaaagucggcuggguucuggggcccgaucauaucaugaagcaccuuagaaccgugcaccagaacuccguguuucauuguccgacacagagccaagcugccgucgcugagucuuucgaacgggagcagcuccuguuccgccagccuuccagcuauuuugugcaauucccccaggccaugcagagaugccgggaccacaugauucgcucucugcaguccguuggacugaaaccuaucauuccccaaggcagcuacuuucucaucaccgauauuuccgacuucaagagaaaaaugcccgaccugccuggcgcgguggaugaaccguaugaccggcgcuuugucaaguggaugaucaagaauaaagggcuuguggccauccccguuucuauuuucuacagcgugccucaucagaagcacuuugaucacuacaucagauucuguuuugucaaagacgaggcuacacugcaggccauggaugaaaagcuccggaaauggaagguggagcuguga

SEQ ID NO: 66941 - RNA, 882 nt, Artificial Sequence
  derived and/or modified sequence opt5 from CCDC101__Homo_sapiens__NP_612423
auggcccuggugagcgcugacuccagaaucgccgagcuccugaccgaacuucaccagcugauuaagcaaacacaggaggaacggucucgcagcgagcauaaccucgucaauauccagaaaacgcacgaaagaaugcagaccgagaacaagauuucccccuacuaucggacaaaacugcgcggccuuuacaccacagcgaaggcugaugccgaggccgaaugcaauauccugagaaaagcucucgacaagauugccgagaucaagucucugcuggaggaacggcgcaucgcugccaaaauugcggggcucuauaacgauagcgagccuccgagaaagaccaugcggcgcggaguucugaugacacuucugcaacaguccgccaugacccucccccuguggaucggcaaaccuggggacaagcccccuccccuuuguggagcuauuccugccucuggcgauuacguggcuagaccgggggacaaaguggccgcgcgggucaaggccguggauggagacgaacaguggauccuggcugagguugugagcuauucccaugccacgaauaaguacgaagucgaugacauugaugaggaaggcaaagagcgccacacccucagcagacggcgcgugaucccccugccucaguggaaggcuaaccccgagacagacccugaagcccuguuccaaaaagagcagcucguucuggcccuuuauccccagaccacaugcuuuuacagagcucugauucaugcgccgccucagcggccccaagaugacuacucuguccucuucgaagacaccuccuaugccgauggcuacagcccuccccugaauguggcucagagauaugugguggccuguaaggagcccaaaaagaaauga

SEQ ID NO: 66942 - RNA, 1542 nt, Artificial Sequence
  derived and/or modified sequence opt5 from CCDC102B__Homo_sapiens__NP_001087198
augaaccuggacagcauccacagacucauugaggaaacccagaucuuccaaaugcagcaguccucuauuaagagccggggcgauaugguggcccccgcuuccccuccgcgcgacacaugcaauacguguuuuccccugcaugggcuucagucucacgccgcgcauaacuucugcgcucacagcuacaauaccaacaaaugggauaucugugaggaacugagacuccgggagcuggaagaggucaaggcccgcgccgcucaaauggagaaaacaaugagauggugguccgacugcaccgccaauuggcgggaaaaguggucuaaaguucgcgcugagagaaacagcgcccgggaagagggacgccagcuuagaauuaagcuggagauggcgaugaaggaacucuccacacugaaaaagaaacagagccugccuccccagaaggaggcccucgaagcuaaugugacccaagaucugaaacuuccuggcuuuguggaggaaucuugugagcauacagaccaguuccagcuguccagccagaugcacgagucuauccgggaauaucucgucaagcgccaauuuuccaccaaggaggauacgaacaauaaagaacagggggugguuaucgacagccugaagcugucugaggaaaugaaacccaaccuggauggaguggaccucuucaauaacggcggguccggaaauggcgagaccaagacaggccugagacugaaagccauuaaccucccucuggagaaugaagucaccgagaucagcgcccuucaggugcaccuggaugaauuucaaaagauucucuggaaagagcgggaaaugcgcacagcucuggagaaggagaucgaaagacuugaguccgcgcugucucucuggaaguggaaauacgaagaacugaaggagagcaaaccgaagaacguuaaagaguucgacauucugcucgggcagcauaacgaugagaugcaggaacuguccggaaauaucaaggaggaaagcaagucucagaacuccaaagaccgggugauuugcgagcuuagagccgagcuggaacgccuccaagcugagaauaccagcgaaugggacaagcgggagauccuggaaagagagaaacagggccuugagcgcgaaaaccggagacugaagauccaggucaaagagauggaagaacuccuggauaagaagaaucgccugucugccaacagccagucccccgacuuuaaaaugucucaaauugaucuccaggaaaagaaucaggagcugcuuaaccugcagcacgcuuauuacaaacucaaucggcaauaucaggccaacaucgccgagcugacgcaugcuaauaacagaguggaccagaaugaagcggaggugaagaaacugcgccuucgggucgaggagcucaagcaggggcugaaccaaaaggaggaugaacuggacgauagccucaaucagauuagaaaacugcagcgcucccuugacgaggaaaaggagcggaacgaaaaccuggagacagagcucagacaccuucaaaauugguga

SEQ ID NO: 66943 - RNA, 297 nt, Artificial Sequence
  derived and/or modified sequence opt5 from CCDC103__Homo_sapiens__NP_001245326
auggagagaaacgacaucauuaauuucaaggcccuggaaaaagagcuccaggcugcccugaccgcggaugaaaaguacaaacgggagaacgcugccaaacuucgcgccguggaacaaagagucgcuagcuaugaggaguuucggggcaucguucuggccucccaccucaagccccuggaacgcaaggacaagaugggagggaaaagaacagugccuuggaauugccauacgauucagggccggaccuuccaggauguggcuacagagaucucuccgaacagcuggaaguccucuuga

SEQ ID NO: 66944 - RNA, 1500 nt, Artificial Sequence
  derived and/or modified sequence opt5 from CCDC105__Homo_sapiens__NP_775753
augagagugcugguucccccugccgagcggagccaggacacccgcgucggcgcuccggccuggagagaagcggcucaagccauggcccggacagcucacauccucacggaucgcugcgggcaggaggccgugaccauguggcagcccaaggacuccgugcuggauccuaacgucgcucaucaccuuggacgggccgcguacauucagcccuggcgguuccgcguggaaaugaucaaaggcgggggaacacuggagaagccucccccuggcgaagggguuacccucuggaaaggaaagaugaaaccgcccgccugguaugcuagacugccucuuccccugcaucggaaggcccgcgcucuccaaacaaccgaggugguccacgcccaugcgagaggcgcccggcugacagcugcccgccugggcagagcucagcaccagauuaaugggcgggugcgccagcuccugagacaacgggagguuaccgaccacagacuuucugaagugcgcaagggacugcucaucaaccagcagagcgucaaacugcggggcuacagaccuaaguccgagaaagugcccgauaaggccgacucuaugcuuacgugggaaaaagaggagcucaagagcaugaagcgcaaaauggaacgggauauggagaaguccgaagugcugcugaaaacccuggccucuuguagagacacacucaauuuuugcuucaaggagcgccugcaggcugucgaucuuaugaaccaaccgcuggacaaaguucucgaacaggcgcggagacauagcugggugaaucugucccgcgccccuacccccagaacacaggggcaaaagaccccuccucccgaucccgugggaacguauaacccggcuugugcccuugcccugaaugaggcuaaaagacuccuggucgagagcaaggacacacugguggaaauggccaagaacgagguugaugugcgcgaacagcagcuccagauuucugaccgggucugcgcgucccuggcucaaaaagccagcgagacccuugaacugaaggagagacucaauaugacacugggccuuaugcgggggaccauccugcgcuguaccaaauacaaccaggagcucuauacaacgcacggacugaucaagggcccccugucuaaagugcaucucgaaaccgccgagaagcuggacagaccucuuguucggauguaccagagacacgugggcacacagcugcccgaagcugcccgccucgcucaagggaccgauaagcugcagugccacauuacauaucuggagaaaaaucuugacgaacuccuggccacccauaagaaccuguccuggggacucaauuguaaaaacaucggccacgaggucgaugggaaugugguccggcugagacuucgccagagacagccucaugugugcuacgagcaagcgcagcggcugguuaaggacugggauccccgcacgccgccucccagaagcaaaucuuccgccgacccuuga

SEQ ID NO: 66945 - RNA, 2355 nt, Artificial Sequence
  derived and/or modified sequence opt5 from CCDC108__Homo_sapiens__NP_001265224
auggagaccgccaucuggagacggagcuacauuucccugaucucuagcgaacgccccgugcacaacuggagaggcaaguccguccagaaaaagcaagcugagucuaaaagccagauuaagcuccauacacaguccgccccuuucgggcugugcccgaaagacaugaugcuuacgcaggcgcccucuagcguugugcggucccgcaauagcagaaaccacaccgucaauucuggaggcuccugucugagcgcuucuacagucgccaucccugccauuaacgauuccagcgcugccaugucugcuugcuccaccaucagcgcccaacccgcguccucuauggacacacagaugcauagcccuaagaagcaggaacgggugaauaaacgcguuaucugggggauugagguggccgaagaacuccacuggaagggaugggagcugggcaaagaaaccacaagaaaccuuguccugaagaaucggucccucaaacugcagaagaugaaguauagacccccuaaaaccaaguuuuucuuuacggugaucccgcaacccauuuuccugagcccugggaucacccucacacugcccauuguuuuucgcccucuugaggcuaaagaauacauggaucagcugugguucgagaaggccgagggaauguuuugugugggccuccgggcuacccugcccugccaucgccuuaucuguagaccgccuucucugcagcuccccaugugcgccgucggcgacacaaccgaagcguucuuuugucuggauaacgugggggaccugccuacguucuuuacaugggaguucuccagccccuuucagaugcuccccgccaccggacugcuugaaccuggccaggcuucucaaauuaaagugacauuccagccgcugaccgccgucaucuaugagguucaagcuaccugcugguacggggccggaagccggcagcgcuccucuauccagcuccaggccguggcuaagugugcgcaacugcuugugagcauuaaacacaagugccccgaagaucaggacgccgagggcuuccagaagcugcucuauuuuggguccgucgcugugggauguacaagcgagagacagauccggcugcacaauccuucugccguuaacgcccccuucagaauugaaaucuccccugaugagcuggcugaagaccaagccuuuagcugccccacggcgcauggcauugugcucccgggcgagaaaaagugcgucucuguguucuuucacccuaaaacccuggauacacgcaccguugacuacuguuccaucaugcccagcgggugcgcuuccaagacacuucugaaaguggucggauucugucggggcccugccgugucucuccagcauuauugcgucaauuuuagcugggugaaccugggggaaagauccgagcagccccuuuggaucgagaaucagucugauuguaccgcccacuuccaauuugcuauugacugccuggaaagcguuuucacgauccgcccugccuuuggaacacucgugggcaaggcucggaugacccugcacugugccuuccagcccacccauccgauuaucugcuuuagacgcgucgcgugucugauucaccaucaggacccucucuuccuggaucuuauggggacaugccacuccgacagcaccaagcccgccauccugaaaccccagcaucucacaugguaccggacgcaccuggcuagaggacugacccuuuacccuccggauauccucgacgccaugcugaaggagaaaaagcuggcucaagaucagaacggcgcccucaugauucccauccaggaccuggaagauaugccugcgccccaauauccuuacauucccccuaugacagaguucuuuuucgacggcaccucugauaucacaauuuuucccccgccuaucuccguggaacccguugagguggacuucggggccuguccuggacccgaggcuccgaauccugucccccuuugccugaugaaccacaccaaaggcaagauuauggugguguggacgcgccggagcgauugcccuuuuuggguuacccccgaaucuugugacgugcccccucucaaguccauggccaugagacugcauuuccagccgccccacccuaacugccuguauacaguggagcuugaggcuuuugccaucuacaaagugugugcccgcaaugagcgggaggaaugcggggucagcgcuagaucucucagcggacuggugggcuggcaggagguuaccgaaggguccuuccggcugcauccccuccgcgcgagacugagccuuggcuggacagugaccccuaugucucuguccccucccaagcuccuggccuga

SEQ ID NO: 66946 - RNA, 2013 nt, Artificial Sequence
  derived and/or modified sequence opt5 from CCDC114__Homo_sapiens__NP_653178
auggagggcgaaagacgggccuacagcaaggaggugcaccagcgcaucaacaaacaacuggaagagauuagacggcucgaagagguccgcggggaccugcagguucagaucuccgcugcccagaaucaagugaagagacuucgggauucucagcgccuggagaacauggacagacuccugaaaggacgggcccaggugcaggcugaaauugaggaacuucaagagcagacccgcgcccuggauaagcagauccaggagugggaaacaagaauuuucacgcauagcaaaaauguccggucccccggcuuuauccucgaccaaaaggugaagauccgcagacggauucgcauccuggagaaccagcuggauagaguuaccugccacuucgacaaucagcucgugcggaacgccgcucugagagaagaacuugaucugcuccgcauugaccggaauagauaucugaacgucgaucgcaaacuuaagaaagaaauccaucaucugcaccaccucgugucuacacugauucugagcuccaccucugccuacgcuguucgggaggaggccaaggcgaaaauggggcuccugagagaacgcgccgagaaggaagaggcucaaagcgaaauggaggcccaggugcuucagcggcagauccugcaccucgagcaacugcaucacuuucuuaagcugaaaaauaacgacagacagccugauccggacguccucgaaaagcgcgagaaacaggcuggagaaguggccgagggcguguggaagacaucccaggaacggcugguccuguguuaugaggaugcgcucaauaaacugagccaacuuaugggggagucugaccccgaccugcucguucagaaguaccuggaaauugaggaaagaaacuucgccgaguuuaauuucaucaacgagcagaaucuugaacuggagcaugugcaggaagagaucaaagaaaugcaagaggcucucguguccgcccgcgcuagcaaggaugaccagcaucugcugcaggagcagcaacagaagguccuccagcaacggauggauaaagugcacucugaagccgagagacuggaagcccgguuucaggacguucgcggacagcuugagaagcugaaagcugauauucagcuccuguucaccaaggcgcacugcgacuccagcaugaucgaugaccugcuuggcgugaaaacaucuaugggcgauagagacauggggcucuuucugucccugauugaaaagcggcucgucgagcugcuuaccgugcaagccuuccugcacgcucagagcuuuacgucccucgccgaugccgcucugcugguucuuggacagucucucgaggaccugccuaagaaaauggcgccccugcagccucccgacacccucgaagauccuccgggcuucgaggcgagcgacgauuaucccauguccagagaggagcugcuuagccaaguggaaaagcuggucgagcuccaggagcaggcugaagcccagcgccaaaaagaccuggccgcugccgcugccaagcuggaugggacacuuucuguggaccucgcguccacccagcgggccggaagcucuacaguccuggugccuaccagacauccccacgcuaucccuggcagcauucugucccauaaaacgucucgcgauagagggagccucggacacguuacauuuggcggccuguccagcucuaccgggcaccuucccucccauaucacacacggagacccgaacaccggccaugugaccuucgggagcacaucugccuccagcggaggccacgucacguuccggccuguguccgcuucuagcuaccugggguccaccggauauguuggcucuagccgcggcggggagaacacagaaggaggcguggaguccgggggaaccgccagcgauucuuccggcgggcucggcagcucuagagaccacgucuccagcacaggacccgcgucuagcaccggcccuggguccagcacgucuaaggauucccggggauga

SEQ ID NO: 66947 - RNA, 543 nt, Artificial Sequence
  derived and/or modified sequence opt5 from CCDC115__Homo_sapiens__NP_115733
auggccgcucuggaccucagagccgagcuggauagccuugugcugcagcuccugggcgaccuugaggaacuggaagggaagcggaccguccucaacgcgcgcguugaggaaggauggcugucccuggcuaaagccagauacgccaugggcgcuaagucuguggggccccuccaauaugccagccacauggagccucaggugugccugcaugcuuccgaggcccaggaaggacuucagaaauucaaggucgugcgggcgggcguucacgccccggaggaaguggggccccgcgaggcuggacugagacggcgcaaaggcccuacaaagacgcccgagccugaaucuagcgaggcuccccaagauccucucaauugguuuggcauccuggucccgcauucccuuagacaggcccaggccucuuuccgggacgggcugcagcucgcggccgauauugcuagccugcaaaaccgcaucgacuggggaagaucccagcugcggggccuccaggaaaagcugaaacagcuugagcccggggccgcuuga

SEQ ID NO: 66948 - RNA, 1323 nt, Artificial Sequence
  derived and/or modified sequence opt5 from CCDC121__Homo_sapiens__NP_001136155
augggcagcagagggcagggaucccacucuaagaaaacccggagcaugcccgugauccuguccccucaacgcacaggcucuggggccacgggaggcccggcugccagagcguacagcgucgcugaggccguuaagcaguuccgggccgggcccgcuggaaccggcgccggcugcucccuccagggguguugggcugccccucgccccuuugaacauagaacaaacaaacugcgggagcuuucuacccuggcgcacugcagccgcgaacuccagacacaagugccugacgccuccgcucauagccuggccgugacccuuucugagcugcacuccuguagagaucuccaggacgaaugccuggauagccgguucgcugagggaccccgcagacugcucccuccguaucauucucugauuaauaacuuugucaagcccgagaaacuuacaaagguggaaacccggcugaaggagaaaaucguugccgaaaugacggaccucaauaagcacauuaaacaggcgcagacccaacgcaagcagcugcuugaggaguccagagaacugcaccgggagaaacuccuggugcaggccgaaaaccgcuucuuucuggaguaccucacaaauaagaccgaagaguauacagagcagccugaaaaggucuggaacagcuaccugcaaaaaucuggcgagaucgaaagacggagacaggaguccgcuagccgcuaugccgaacagauuuccgugcuuaagaccgcucugcuccaaaaagagaauauccagucuagccugaagcggaaacuucaggccaugagagauaucgccauucugaaggagaaacaggaaaaggagauccaaacgcuccaggaagagacaaagaaaguucaggcugaaaccgcguccaagacacgcgaggugcaggcccaacugcugcaggagaaacggcuccuggaaaagcagcuuagcgagcccgacagacgccugcucgggaaacggaagagacgcgaacugaacaugaaggcucaggcccuuaaacuggccgcuaagcgguucauuuuugaguacucuuguggaaucaauagagagaaccaacaguucaaaaaggaacuccugcagcugauugagcaggcccaaaaacucaccgcgacccagucccaucuggaaaaucgcaagcagcaacuucagcaggagcagugguaucuggaaagccucauccaagcucggcagagacugcagggcucucacaaccagugccugaaucggcaagaugucccuaagacaacgcccagccuuccgcaggggaccaaaucccgcauuaacccuaaguga

SEQ ID NO: 66949 - RNA, 822 nt, Artificial Sequence
  derived and/or modified sequence opt5 from CCDC122__Homo_sapiens__NP_659411
augagcgacaacaaggagagaaaaucccagggcuuccccaaggaagauaaucaagacaccucuagccuggccgaugcuguggagaaagucgccaagcagcagcagucccaagcgucugaaaucgagaaaaacaagaagguucucuuuaaucugaaaaacgaacuucacgagcuggagaaggaaauugcugccaucagcgccgagacaaaagaaacggagcggcagauuuaccagcaggacuccgcuaucgagaauaccaagcuccauugcgauucucuggaaacacaaauuaaaagccuucacuccgagaacgugaagcugaaguucgacaucgaaaccgcccaggaggauuuugaagaacauaugaucaaauauaaugcuuacuaugccaagauuaaagcgcacaagaacagccucggggagguggaaucuaaaugguccuucaugacagagcugcaugaaaagcgcgacuuugucaaaaagcugaagaccaugaaagaggaacucaugcaggaucugcagaauccuggaggcaacagaaucacacaagugcaggaggacauuaccaaucuuaaggauaaaaucauuacgguuaaggagagcaucauugagaaaaccuguuuccuggaggaagagaagaagacacacgaaaaacuccggaaggagaucgaggugcagcacaaacgcuacgacgccauccugaagagacuucauugccaagucaacaaacugcagucuaaucggcgccaguggcaguggaacauucaacagcucgaaaagaccgcugccgagcugagaaaguguaucgggaugcaggaauga

SEQ ID NO: 66950 - RNA, 3165 nt, Artificial Sequence
  derived and/or modified sequence opt5 from CCDC129__Homo_sapiens__NP_001244896
augagcgugucccugcagaacuacucucccaugauggcccaaaagagccagggcuccgacaaucuccaggaggggcaggaaaaaucuaagagagagauccugaaaugcaccaagagcgcuugggccccucuugaugaauggcugccgcccgacccugaggaagagucccaaucucucaccauucccaugcuggaggauagcaaacaggaauccauccagcaguggcuugacagcggauucuuugucucugcgaacgagaauuuccaacagguuauugaucggacggugucccuguaugaacagggcauggugcagaugaccgucaaggacuacaugcgcagccuccaccaauuuucugagacaccuauccuguccagagggaccagcuucaacucuuguuauuccacagcuagcgugccccaguccauuccugaguggcuggaauuuugggagaucgauccgguugaaauccuccuggaccuuggauucggcgccgaugagcccgacauuugcaugcagaucccugcccgguuucugggguguggaucugcugcccgcggcauuaauaucagaguguuccucgaagcucaaaagcagcggauggauauugagaaccccaaucuguacggccgcuuuagacagcuugagauccuggaccaugucaccaacgccuucagcucccuccugagcgaugugucuauucugccuaaucgggcggaagagaaagccgggggagaauccguucagcgcacaagcgugucugcugccaaggagcacagacggcgcaugggcaaacuccugagacgggcuagcaagcaaaacauccgcagagacugcaaucccgaagucuccgagucuuuuaaagugaaggacgagguguucgucccguuuaccaagccuugggauuguggggccgaacuugcggccacgagcaucaaccauaaacagaaucaccugucccucagcguugagcaucagucucugcaggcuugcgacgaucuucugcccuauccuccccacggacuccuguccaagcaauggcccuguagcucuaugccugccaaacaggcuccgcccuccugcgugagcgaaggcuccgugaaggggcggacccagaaagagaaccuguuccagacaaauaagcucaaaucucugagccaccuugccggaaagggcccugacuccuucgaaauggaggagguccaaucuuuugaagaggaaaccggcaacccccuggauaugacaagcgggaccgugggagccagaguugaccgcgcuaacuccugucagagcgauucuuccggcuuccucgaggagccucuggaaccccuuccgcugcagaugccuagccuccccaauucucaguccccugcggagaacgggggacggaagcccagagaccaaagccauucucuggugagcucccaggauugccagcuggaaagcgacggcccugauucuaaaucccgcgccagcauguccuuuucuagccaagaggcuaaugcccucgaacagcgggccuccgucucugugauggaggaggaguuccugcuugaagcuauggaagggcccccggagcuguacauuccugacauggccugugcgaagacgacaaccagaggagaaugcccccgcaaagacagccaccucuggcagcugcugcccaugccucaugcugaguaugagguuacacggccgaccgccaccuccaaguacgaucacccccuuggcuuuauggugacacacgucacggaaaugcaggacucuuucgugagaccugagggcgccgggaaaguccaaagccaucacaacgaaucccagcgcagccccggaaaugaucauacccaggacaaguuucuccacguggauucugaggcuccucgggaagaggaguccagcggcuucugcccccauacaaaccacucucugcugguuccugaauccagcucucaguguauccccaagcacuccgagauuaccccguacgccacagaccucgcucaaaccagcgaaaaacugaucccucaucuucacaagcugcccggggauccugcccaggugaaauccagaagcggaacgcucggccagauucugcccgggacagaggcggagauggaaaaucugccgcuuaacaccggcucuagccgcuccgucaugacccagaugucuagcucccucgugucugccgcucaacgggccguugcucugggaacaggcccuagagggaccagccuggagugcacagugugugaccccgucacggccaccgaaacacggcucggaaccaaggcgcgccagcugaaugaugccuccauccagacaucugcucuuagcaacaaaacccugacgcauggcccucaaccccucaccaaguccgugagccuggacucuggguuuuccagcaucugccccaugggaacaugucacgccauuccugcucacugcuguaucugcugucaucaccauccgcacugccauggcgagagacagucucccgggccugaacccuccgugugucggcacugccugugcagccuuaccggccaccaggaggcccaguucaugacaacccucaaggcccugcaagauacgacaguuagagagcuguguuccugcaccguccaugaaauggaggcuaugaaaacaauuugucagucuuuucgcgaauaucucgaggaaaucgagcagcaccugaugggacagcaagcgcuuuucagccgggacauguccgaggaagagagagaagaggccgaacagcugcagacccuccgcgaggcucugagacagcaaguggccgagcuggaauuucagcuuggcgaucgggcccagcagauucgcgaggggauccuccugcaacuggaagugcucaccgcugagccucccgagcauuacagcaaucugcaccaguauaacuggaucgaagagucuaauggacagacauccugcagcaagauucauccuggcauggccccgagaacggucuuucccccugacgacgggcaagaagcgcccuguucuggaggcacccagcuugcugccuucacaccucccacccuggagaacagcacacggauguccccgucuagcuccgccugggcuaaacucgggccuacaccccugucuaauugccccgugggcgaaaaggaugccgacguuuuccuguga

SEQ ID NO: 66951 - RNA, 1191 nt, Artificial Sequence
  derived and/or modified sequence opt5 from CCDC130__Homo_sapiens__NP_110445
augggcgagagaaagggggugaacaaauacuaucccccugacuucaauccggaaaagcacggaagccugaaccgguaccauaauucccacccccuccgcgagagagcccggaaacugucucagggcauccuuauuauccgcuuugaaaugccuuauaacauuuggugcgauggguguaagaaucauaucggaaugggcgucagauacaacgcugagaaaaagaagguugggaauuauuacaccacacccauuuaucgguuccgcaugaaaugccaccugugugugaacuacaucgaaaugcaaacggacccugccaauugcgauuacgugaucgucagcggagcgcagagaaaggaggagcggugggacauggcugauaacgaacaggugcucaccacagagcaugagaaaaagcagaaacuggaaaccgacgccauguuucgccuugagcacggcgaagccgauagauccacacugaagaaggcucuccccacccugucucacauucaagaggcccagagcgcuuggaaagacgauuucgcccucaauuccaugcugcggcgcagauuucgggaaaagaaaaaggcgauccaggaggaagaggagcgcgaccaggcccugcaagcuaaagccucucuuacaauuccucugguuccggaaaccgaggaugacagaaagcucgcugcccugcuuaaauuccauacgcuggauagcuaugaagacaagcagaagcucaaacggaccgagaucauuuccagaagcugguuucccucugcgccuggcuccgccuccucuuccaaggugagcgggguccugaaaaagcuggcucagucucgccggacagcccucgcuaccucccccaucacagugggagaccugggcauuguuagacgccggagcagagaugugccugaaagcccccagcacgccgccgacaccccgaaaucuggggagccucgcguccccgaggaagcugcgcaagaucggccuaugagccccggagacugucccccugagacgacagaaaccccgaagugcuccagccccagaggccaggaggggucucgccaggauaagccucuuucccccgccggaagcucucaagaagcugccgacacaccugauacccggcaucccuguagccugggcuccucucucguggccgacuacagcgauuccgagagcgaguga

SEQ ID NO: 66952 - RNA, 351 nt, Artificial Sequence
  derived and/or modified sequence opt5 from CCDC134__Homo_sapiens__NP_001291726
auggaccugcuccaguuccuggccuuucuuuucgugcugcuccugagcggcaugggggcuaccggaacacuuagaacgucccuggaucccucucucgagaucuacaagaaaauguuugaagucaagcggcgcgagcaacugcuggcccucaaaaaccuggcgcagcuuaaugacauucaccagcaguauaagauccuggauguuaugcucaaaggccuguucaaguuuauuccuagcaccgacccguuccaaaaggcucuuagagaagaggaaaaacggcgcaagaaagaggagaagagaaaagaaauccggaaggggccccgcauuuccagaucucagagcgagcuguga

SEQ ID NO: 66953 - RNA, 1305 nt, Artificial Sequence
  derived and/or modified sequence opt5 from CCDC136__Homo_sapiens__NP_001188301
auggaggccggcgcuggggccggagcgggcgcugccggguggagcugccccggaccuggcccgaccgugacaacgcugggguccuacgaagccucugagggaugugaaagaaagaaaggccagcgguggggcagccucgagcgcagagggaugcaagcuauggaaggagagguccugcuucccgcccuguaugaggaagaggaagaggaggaagaggaagaggaagagguugaggaagaggaagaacaggugcagaagggcggguccgugggaucucucagcgucaacaaacaccggggccugucccuuaccgaaacagagcuggaggaacuccgcgcucaggugcugcaacugguugccgagcucgaagagaccagagaacuggcggggcagcaugaggacgauucucuugagcugcagggacuccuggaagacgagcggcuugccagcgcucagcaagccgaaguguucacaaagcagauccagcagcugcaaggcgagcuccgcucccugagagaggaaauuagccugcucgagcacgaaaaagagucugaacugaaggagaucgagcaggaacuucaucuggcucaggccgagauucaaucccuccggcaggcggccgaagauagcgcuaccgagcacgaaucugacaucgccucccugcaggaggaucuuugccgcaugcagaaugagcuggaagacauggagcggauuagaggcgauuacgaaauggagaucgcuagccuccgcgccgaaauggagaugaagucuuccgagccuagcgaagaacugcaagaacugagagagcgguaucauuuucucaacgaggaauaccgcgcccugcaggaguccaauucuagccuuacagggcagcuggcugaccucgaauccgagagaacccagcgggcgacggaaagauggcugcaaagccagacccuuucuaugacauccgccgagagccagaccucugagauggauuuccuggaacccgacccugagaugcagcuccugcgccaacagcugcgggaugcugaggagcagaugcacggaaugaaaaacaagugucaggaacucugcugugagcuggaggaacuucaacaccauagacaggucagcgaggaggagcagcgccggcugcaaagagaacucaaaugcgcccagaaugaggugcugcgcuuucagacaucccacucuguuacccagagcucccccacgccuaacccgcccaucuucagccugccucuugugggccucgucgugauuucugcccugcugugguguuggugggcugagacauccagcuga

SEQ ID NO: 66954 - RNA, 492 nt, Artificial Sequence
  derived and/or modified sequence opt5 from CCDC140__Homo_sapiens__NP_694583
augggcgacgagugcagcaaccccgaucugcucgccgaaccuggguccucuccgcccugggaccacggaaaucagagacaagaggcugccaacgaaagcaauacccgggugccucgcguccugaaggcgcaucuuggccccgagacagcucagccuacgaaaagauccaagcggaaccgcuggagacggcagucuugucaggggcccagcccugcccgcuccggacaauuccugggcucugccgaucucgggcugcagagaggaguucuuaaaagcgcugcccggaccugccuguccgaaaucagcaauucuacacgcgcuuccccggagagcgcccagucuaccgaccccggcagagcggcccggccucgcacaagaacccuccccacaccucacuccuuuaagauuggcgaggaagcugaggaaaugaaaaagaagaaagagcggaagcgcagaaaagagcggaagaaagaaagaaacuucaagaaguga

SEQ ID NO: 66955 - RNA, 4593 nt, Artificial Sequence
  derived and/or modified sequence opt5 from CCDC141__Homo_sapiens__NP_775919
augagcucccagggcucucccagcguggcccuguccaccacaacggucucuagcguugcugugcaagccggggacuccaagaucgugauugcggucaucaaaugcggaaagugggugcagcuccagcuggcugagucucagccuaaccuucuggaaauuggcagcucccaagaugagaccaaaaagcuccugcacgaccaugaacuucugcucgccaaacugaaggcccuggaggauagaguuugggaacuccugcaggaggcugacaagacagccgaggaaaauaaagaucagagccagguguacgacgcuauggccgagacccuuggggaagcgugggccgcucuggucucuaugcucgagcggcgcacagagcugcuuagacugaccuccgaguucuuugaaaacgcccucgaguucgcuaucaagauugaucaagccgaagacuuucugcagaauacacacgaguucgaaagcgcggagucucugaaaucccuccugcagcuucaugaacaccauaccaaggagcugcucgaacggagccuggcccuucugaacaaaucucagcaacucacggauuuuaucgagaaguucaagugugaaggaccgaaugugaaccccgagcugacccagggcgcucacuccagcugccugaaaguugaccgccuccuggagcuucugcaggauagacggcgccaacucgacaaguaucugaaacagcaguggcaggaacuuucccaagugcugcagaucugucagugggaucagcaagagaaucaggucacaugcugguuucagaagaccauuagaaaccuccaggaacaaucucuggggagcucccugagcgacaaugaggaccggauccacaaacaggaggaacucauuaucaaggccaaagaguggaacucugcuguggaaaagcugaaguccgaggcccuucgcauucugcucagcaaagauuacguggaaaaggagcaucugcagcugucucaccagaaacuuagccaacuccaggaggaguucggacagcugauggucgaaagaaauacauggcugaagaaagccaacgaauuuuucaauuccgcuaacaaggcguuugacguucucggccggguggaggccuaucugaaacuucugaaaucugaaggccucagccuggcugugcuggccguccgccaugaggagcuucacagaaagaucaaagauuguaccacggacgcccuccaaaaggggcagacacugauuucccagguggauagcuguucuucccagguuagcggaauccacgaaaugaugggcugcaucaaacggcgcguggaccaucugaccgagcaaugcucugcucacaaggaauacgcccucaagaaacagcagcugacagcguccgucgagggguaucuuagaaagguggaaaugagcauucagaaaaucuccccuguucugucuaaugcuauggaugugggaagcacccgguccgagucugagaagauucucaacaaauaccuggaacuggacauccaagccaaggagaccagccaugaacuugaggccgcugccaagacaaugauggaaaagaacgaguucgucuccgaugagauggugagccucucuuccaaggcuagauggcuggccgaggaacugaaucucuuuggccagagcauugacuaucgcucucagguccugcagacguacguggcguuccuuaaauccagcgaagagguugagaugcaauuccagucucugaaggaauuuuacgagaccgaaaucccccagaaagagcaagaugacgccaaggcuaaacacuguagcgacuccgccgaaaagcaguggcaacucuuccugaagaaaucuuuuaucacacaggaucuggggcuugaguuccucaaccugauuaauauggcuaaggagaacgaaauccuggacgugaaaaaugaggucuaucucaugaagaacaccauggaaaaucagaaagccgagcgggaggaacugagccuucugagacucgcguggcagcugaaggccacagaguccaagccuggaaaacagcagugggcugccuuuaaggaacaacugaaaaagaccagccauaaccuuaaacugcuccaggaggcucugaugcccguguccgcccucgaucugggcggcucucuucaguucauucuggaccuccgccagaaguggaaugauaugaagccucaauuucagcagcugaacgacgaaguucaguacaucaugaaagagagcgaggaacugacggggcggggagccccggugaaggagaaaucccaacagcuuaaggaucugauucacuuccaccagaaacaaaaggaaagaauccaggacuaugaggauauccucuacaaggucgugcaguuucaucaggugaaagaggaacugggccgccucauuaagucucgggagcuggaguucguugaacaacccaaagaacuuggggacgcucacgauguccagauccaucugagaugcagccaggagaagcaggcgcgcguggaccaccuccaccggcuggcccugucccuuggaguggauauuaucucuagcguccaaagaccucauuguuccaaugugagcgcuaaaaaccugcagcagcagcucgaacugcucgaggaggacucuaugaaguggcgcgccaaagccgaagaguauggccggacacuguccagaagcguugaauacugcgcuaugcgggacgagauuaaugaacuuaaggauucuuuuaaggacaucaaaaagaaauucaacaaucugaaguuuaacuauaccaaaaagaacgagaagucccgcaaucugaaagcccucaaguaccaaauucaacagguggauauguacgcggagaaaaugcaggcucugaagagaaaaauggaaaaggucagcaacaagaccucugacuccuuccuuaauuaucccagcgauaaagugaacguucugcucgaggugaugaaggaccugcagaaacacgucgaugacuucgauaaggugguuacagacuacaaaaagaaucucgaucugaccgaacauuuucaggaggugaucgaagagugccacuucugguaugaggacgccuccgccacagucgugcggguggggaaguacagcacggaauguaaaaccaaggaggcugucaaaauccuucaucagcaauuuaacaaguucauugccccuucuguuccccagcaggaagagagaauccaggaggcgacagaucuggcucaacaccuguauggacucgaagagggccagaaauacauugaaaagaucgugaccaagcacaaagaggugcuggaaagcgucacagagcuuugcgagucccugaccgaacucgaggaaaagcugaaacagggcgacgugcucaagaugaauccgaaccuggaggacuuucauuaugauuacauugaccuucugaaagaaccugccaagaauaaacagacgaucuucaacgaggagcgcaauaaggggcaaguucagguggccgaucugcucggaaucaacggcaccggggaggaacggcugccccaggaccuuaaggucucuacagauaaagaaggaggcgugcaggaccugcuccugccugaggauaugcucagcggggaagaguacgaguguguuucccccgacgauauuucucugcccccucuuccgggcagccccgaauccccucuggcucccucugacauggagguggaggaaccugucagcuccagccugucucuccacaucuccagcuauggagugcaagccggcaccucuucccccggggaugcucaggagagcguucugccgccucccguggccuuugcggacgccugcaaugacaagagagaaacauucuccucucauuuugagcgcccuuaccuucaguucaaagcugaacccccucugaccagcagaggauuugucgagaaguccacggcccuccaccggauuagcgcugaacaucccgagucuaugauguccgaggugcacgaacgcgcccugcaacagcacccgcaggcccagggcgggcugcucgagacaagagagaaaaugcaugcugauaacaauuucaccaagacacaagaccggcuucacgcgagcucugaugccuuuagcggacugcgcuuccaguccggcaccucuagaggguaucagcggcagauggugccucgcgaagaaaucaagagcaccuccgcuaaaucuagcgucguuucccuggccgaccaagcccccaacuucagcagacuccugucuaacgugacagugauggagggcucccccgucacgcuugagguggaaguuaccggauuuccugagccgacacugaccugguacaagaaaggccagaagcucagcgcugaugggcaucuccaggugcugcacaaagaaacacggcacuccgucuucauucccaagguguguaaggccgacgcgggacuguauguugcucgcgcccaaaauucuagcggcgcccuuuccucuaacgugauccugcaugucaccgggaauugcagacugccuaucacgcgggugaacuggauuacacucugugucguguacguuagcgugucccugauguauuggcuucugacccaguga

SEQ ID NO: 66956 - RNA, 1338 nt, Artificial Sequence
  derived and/or modified sequence opt5 from CCDC148__Homo_sapiens__NP_001288613
augaagagaacccuggagaugaacguguucgucacacuccagauccugguugacuuugugaaaaagcaacuuaaaacgguguucgaacggcugcgccucgagcagcagagaauugaaaaugaucugagcgacugguccaucaagauucuugaucacucucuggaggagaaaaccaacccccucagcgagcugccuaucgagcuggaaucccucgagugcccguaccccgaccugaagucuagcauucuuuccgaauuuuauaaguucacacagaaauaccaaaagaaacugcaggauuuuaaucuccagcuggaggacaucuaucggaacugucagcuuucugaggaagaucauuggaucuaccaagccauucuggaccaguauccuggcgaucucuucgggcgcagaacccuguaccuggacaugcuccagcgguauuuuccccacaagagccgccaugaucuggucgagcacgaaaaauacugcgaccaguacagauucgcuaucgagcaacagaauauucuuaucuccaacuggaauaagaacaagaaagauuuuauucagaaggccgugcugacacucaccgaagcgugugcuacacaugagauggagagcaugcuggccaaagacaagaaaaagcaacaggaacuuugcgccgaccugaaagcuaagguucggcaguggcgcgcccaccaggaggaaguggcuagacucgagauggaaaucucugcccggcgcagagagaaggaggaagagaaagaaaagcuguggaaaaagaaagagcugcuccaacgggcggaaaagaagaaaaagauuaaaaaguauugggccaaaaagaagcagaaauggcaggagauggagaugcgcgaucugcagagacuugaagaacugaagaaacucaucgcugaacaaucccugaaggaccgggagagagucaaauaccgccaggagcuucuggaacggagacucauggagaagaaggaaguggcccugcaggaggcucacgaagauaaagagcgcgcccggagacuggaggcgcuccgcaagcagguugccguggucgcucaauucgacccugugcggaugaugagcgauaccauggccucuaaagcuagaaugggaaucgaaauugaggaagaguuuauccugcagaagccccuuuucacgcugaauaccuauaacgaacagcagauuaucuccgacccucgccuccgguuugagcuggcccugagagaggccggccuucaucgcacacucuacgcuaaagaaauucugccgaagaucagcccccaaaaaccuccccggaaggauauggagucuaccguguucaagaucuga

SEQ ID NO: 66957 - RNA, 1626 nt, Artificial Sequence
  derived and/or modified sequence opt5 from CCDC151__Homo_sapiens__NP_001289382
augcaucccccuguggccccgugcaagaaacugagaugucccccuacccggagcuucacacccacgcgcggcagauccaaggagggggaccggaaagccuuuuucgaaucuagccaguggaacaucaagaaaaaucaagagaccauuucccagcuccgcaaggaaacaaaggcucuggagcuuaaacugcucgaucugcuuaagggagacgaaaaagucguucaggcggugaucagagaguggaagugggagaaaccuuaccugaagaaccggaccggccaggcucucgaacaccuggaucaccgccugagagagaaggugaaacaacagaaugcccuccggcaucaggucgugcugcgccagagacggcuugaggaacugcaacuccagcacucucugcgccuucuggagauggccgaagcucagaacagacauacagagguugccaagaccaugcggaaucucgaaaaccgccuggagaaagcucagaugaaggcccaagaagcggagcacauuacaagcguguaucugcagcucaaagccuaccugauggacgagucccuuaaucuggaaaacagacucgauucuauggaggcugaagucgugcggaccaagcacgagcuggaagcccuucauguugugaaucaggaggcucugaacgccagagacaucgcgaaaaaucaacuccaguaucuggaggaaacgcugguccgcgagcggaagaagagagaacgcuacauuagcgagugcaaaaagcgggccgaagagaaaaagcucgagaacgaaagaauggagcgcaaaacccaccgggaacaucugcuucugcaguccgaugacacaauccaggauagccuccacgcuaaggaggaggaacugagacaacgcuggucuauguaucagauggaggugaucuuugggaaggugaaagacgccaccggaacagaugaaacccacucccuuguccggagauuccuggcucagggcgacacguuugcccagcucgagacacuuaagagcgaaaaugagcaaacccugguucgccucaaacaggagaagcagcagcugcaacgggaacuugaggaucugaaauacucuggggaagccacacucgugucccagcagaagcugcaggcugaggcgcaagaaagacugaagaaagaggagcggcgccaugccgaagcuaaggaccagcuugagagagcccuccgggccaugcaaguggcuaaagacagccuggaacaccuggccucuaagcucauucauaucaccgucgaggauggaagauucgcgggcaaagaacuggacccccaggcugauaacuaugugccuaaucuucugggccucguugaggagaagcugcugaagcugcaggcccagcuccaggggcacgacgugcaagaaaugcugugucauauugccaaccgcgaguuucuggcuucccucgaaggacggcugccggaguacaacaccagaaucgcccuuccccuggcuacaagcaaagauaaguucuuugacgaggaauccgaggaagaggauaaugaagucgugacgcgcgccucucucaaaauuagaagccagaagcugaucgagucccacaaaaagcaccggcgcagcagacggucuuga

SEQ ID NO: 66958 - RNA, 294 nt, Artificial Sequence
  derived and/or modified sequence opt5 from CCDC167__Homo_sapiens__NP_612502
augaccaagaaaaagagagagaaccugggcguggcccucgaaaucgacgggcuggaggaaaaacuuagccagugccggcgcgaucuggaggcugucaauuccagacuccacucucgggaacugagccccgaggcccgcagaucccuugagaaggagaaaaacucucugaugaauaaggcgagcaacuacgaaaaggaacucaaauuccugcggcaagagaaucgcaagaacaugcugcucuccguugcuauuuuuauccugcuuacacugguguaugccuacuggacgauguga

SEQ ID NO: 66959 - RNA, 1509 nt, Artificial Sequence
  derived and/or modified sequence opt5 from CCDC169-SOHLH2__Homo_sapiens__NP_001185839
auggagacccugcaggaaagccucaacacacugcuuaagcaacuggaggaagagaaaaagacgcucgaaucccaggugaaauacuaugcccugaaacuugagcaggagucuaaggcuuaccagaagaucaauaacgaaagacggaccuaucuggccgagaugagccaaggcuccgggcuccaccaggucucuaagcgccagcagguugaccaacugcccagaaugcaggaaaaucuggugaaaacacuccugcuuaaggaggagcuggauccucucaaagcgaagauugacauccugcuugugggagaugucaccgugggcuaccuggcugacacaguucagaaacucuucgccaacauugccgaagugaccaucacaauuagcgauaccaaggaggcugccgcucugcuggacgauugcaucuuuaauaugguccuccugaaggugccguccucucuuagcgccgaagaacuggaagcgaucaaacucauucgguucgggaagaaaaagaacacgcauucccuguuuguuuucaucauucccgagaauuuuaaaggauguaucagcggccacgggauggacauugcccuuaccgagccucugacaauggaaaagaugucuaacguggucaaauauuggaccacaugccccuccaauaccgugaagacggagaacgcuacaggaccugaggagcucggccugccccugcagcgcagcuacucugaacaucucggcuauuucccuaccgaucuguuugccuguuccgagagccuuagaaaugggaacggacuggagcucaaugcuucucuguccgaguucgaaaagaacaaaaagaucagccuucugcacuccucuaaagaaaagcuccggcgcgagagaauuaaauacugcugugaacaacugcggacacugcucccguacgugaagggccgcaagaaugacgccgcgagcguccuggaggccaccguugauuaugugaaauacaucagagagaagaucucccccgcugugauggcccagauuaccgaagcccuucagagcaacaugcgguuuugcaaaaagcaacagacaccuaucgagcugucucuccccgggacggucauggcucagcgcgaaaacuccgugaugagcaccuauucuccugagagaggacugcaguuccugacaaauaccuguuggaacggcugcagcacacccgacgccgaguccucucuugaugaagcuguucgggugccgagcuccagcgcgucugagaaugccauuggggacccuuacaaaacccauaucuccagcgcugcccucucucugaacucccugcacacgguccgcuauuacagcaaggugacacccuccuaugacgccaccgcuguuaccaaucaaaacauuucuauccaccucccuagcgccaugccucccguguccaagcugcuucccagacauuguacaucuggacugggccagaccugcacaacgcacccgaauugucuccagcaguuuugggcguacuga

SEQ ID NO: 66960 - RNA, 2148 nt, Artificial Sequence
  derived and/or modified sequence opt5 from CCDC170__Homo_sapiens__NP_079335
augagccuggacugcaccucccacaucgcccucggcgcugccucucccgcgccugaggaaacauacgaucaucugagcgaggugccggucacgagagaacagcuuaaccacuaucggaauguugcucaaaacgcccgcuccgagcuggccgcuacccucgugaaguucgaaugugcccagucugagcugcaggaccuuagaagcaaaaugcuguccaaggaggugucuugccaggaacucaaagcugagauggaaagcuacaaggagaauaacgcccggaaauccagccugcugacaucucuccgcgauagaguccaagagcuggaagaggaauccgcggcccuuagcaccucuaagauucggacagagaucaccgcucaugccgcuauuaaggaaaaucaggagcugaaaaagaaagugguugagcucaacgaaaagcugcagaaauguuccaaggagaaugaagagaacaagaaacaggugagcaagaauugccgcaaacacgaagaguuucuuacacaacugagagacugucucgaucccgacgagcggaacgauaaggccucugacgaagaucugauccugaaacuccgcgaccugagaaaggagaaugaguucgucaaagggcagauugugauccuugaggaaaccaucaacguucaugagauggaggcgaaggccucccgggaaacgauuaugcgccuggcuagcgaggugaauagagaacagaagaaagccgcuuccugcaccgaggagaaggaaaaacucaaccaggaucugcuuucugccgucgaggccaaggaagcucuggagcgggaagugaaaaucuuucaagagcgccuccuggcgggacaacaggugugggacgccagcaagcaagaggucucccugcucaagaaaucuucuuccgaacuggaaaagagccuuaaagcuagccaggaugccguuacaaccagccagucccaguauuucucuuuuagagaaaagauugccgcucugcuccggggcagacugagcaugacaggguccaccgaggacacgauccuugagaaaauucgcgaaauggacagccgggaggaaucuagagaucgcauggugucccaacuggaggcccagaucagcgaacucguggagcagcugggaaaggaaucuggcuuccaccagaaggcgcugcaacgggcucagaaagccgagaauaugcucgagacacugcaggggcagcuuacccaccuggaagccgagcucgucuccggaggcgugcugagagacaaccugaacuuugaaaagcaaaaauaccuuaaguuccucgaucagcugagccagaaaaugaagcuggaccagauggcugccgagcucggcuuugauaugcgccuggacguugugcuugcucggacagagcaacuggucagacucgaauccaaugccgugauugagaacaagaccaucgcgcauaaucugcagcgcaaacugaagacccagaaagaacggcuugagucuaaggaacuccacaugagccugcugagacagaaaaucgcccagcucgaggaggaaaagcaggcucgcacagcccugguuguggagcgggauaacgcucaucuuacgauuagaaaucugcagaaaaaggucgaacggcuccaaaaggagcugaacaccugucgcgaccugcacacagaacuuaaagccaagcucgcggauaccaaugagcugaaaaucaagacacuggagcagaccaaagccauugaagaccucaacaaguccagagaucagcuggagaagaugaaagaaaaggcugagaaaaagcugaugucugugaaaagcgaacuggacacgacagagcacgaggccaaggaaaauaaggagcgggcuagaaacaugaucgaagucgugaccuccgagaugaaaacccucaagaaaagccuggaggaagccgagaagcgcgaaaaacagcuggccgacuuccgggagguugugucucaaaugcuugggcucaaugucacaucccuggcucugccugauuaugaaauuaucaagugccucgagagacuggugcauagccaccagcaucacuuuguuaccugugcgugccuuaaggacgugacaacgggacaggagcgccauccccagggccaccuucaacuccugcacuga

SEQ ID NO: 66961 - RNA, 3981 nt, Artificial Sequence
  derived and/or modified sequence opt5 from CCDC171__Homo_sapiens__NP_775821
augaaccugaauaccagcuccaacacaggcgacacgcagagacucaagaucgccucucuggaugugaaacaaauucuuaagaaugagaccgaacuggacaucacagauaaccuccggaaaaagcugcacugggcuaaaaaggagaaacuugaaauuaccacaaaacauaaugccgagcuggcgagcuacgaaucccagaucgcuaagcuccgcucugaggucgagaaaggggaagcccugagacagagccuggaguaugaccucgccguugcucggaaggaagccggacugggccgcagagcugccgaggagcggcuugcggaagcccaccgcauucaggagaaacugugcgcucaaaacuccgaacuccaggccaagaccaaugagacagaaaaggcuuuccagaccucucagcaaaaauggaaggaggaguguagacgguuugaacaugaucuggaggaacgcgacaacaugauccagaauugcaacagagaguacgaucuucugaugaaagaaaagagccggcucgagaaaacgcugcaggaggcccuggaaaagcaccagcgcgagaaaaaugaaauggagucccauaucagagaaaccgcgcucgaggaguuccggcugcaagaggagcagugggaagccgagcgcagagagcuucaguuuauugugcaagaacaggacacagcugugcagaacaugcacaagaaggucgagaaacuggaaaccgagcacauggauuguagcgaccuccugcggagacagacaucugaacuugaguucuccacccaacgcgaggaacggcugagaaaggaguuugaagccacgacacuccgcgugcggaaacuggaggaaaauaucgaggcugagagagccgcccaucuggaaagcaaguucaacucugagauuauccagcuccgcauucgggaucuggaaggggcccuucagguugagaaagcgucccaggccgaagcuguggccgaccuggagaucauuaagaaugaguuuaaggaagucgagagcgccuaugaaagagagaaacacaacgcucaagagucuuucgccaagcucaaccugcuugaaaaagaguacuuuuccaagaauaaaaagcugaacgaagauaucgaggaacagaagaaagugaucauugaccucagcaagcgccugcaguauaaugagaaauccugcucugagcugcaggaggagcucguuauggcgaagaaacaucaggcuuuccugguggaaaccugugagaacaaugucaaggaacuugagagcauccuggacuccuuuacagugagcggacaauggaccucuggcauucacaaggauaaagacaagcccccuuccuucagcgugguccucgagcggcugagacgcacccugacagauuaccagaacaaacuugaagacgccucuaaugaggaaaaggccugcaacgagcucgauagcacgaaacagaagaucgacucccacaccaaaaauauuaaggaacugcaagauaagcuggcugacguuaacaaagagcucucucaucugcacacaaagugugccgaucgggaggcucuuaucagcacccugaaaguggaacuccagaaugugcugcauugcugggagaaggaaaaagcccaggcggcccaauccgagagcgagcugcagaaacuuucucaggcuuuucacaaggacgccgaagagaagcucacauuccugcauacccuguaucagcaccucgucgcugggugugugcugaucaagcaaccggaaggaaugcuugauaaauucuccuggagcgagcugugcgccguucuccaggaaaacguggacgcgcugauugccgaccugaauagagcuaacgagaagauccggcaccuugaguacauuuguaaaaauaagucugauacgaugcgcgaacuccagcagacacaagaggacaccuuuaccaaggucgccgaacagaucaaagcucaggaguccugcuggcauagacagaagaaagaacuggagcugcaauacagcgaacucuuccuggaagugcagaagcgggcccagaaauuucaagagauugccgaaaagaacauggagaaacuuaaccacaucgaaaagucccaugagcagcugguucucgaaaauucucacuucaagaaacugcugagccagacacagagagaacaaaugucccuucucgcugcgugcgcccugauggcuggcgcccuguauccccucuacucucgcagcugugcccuguccacccagcgggauuuucuucaggaacaggugaacacauucgaacuguuuaagcucgagaucagaacgcuggcucaagcccugagcaccgucgaggaaaagaagcaggaggaagcgaaaaugaagaagaaaacauucaagggccuuauucgcaucuuuagaaaaggggugauugcuguccuggccgccaaucggcucaagauccugggacagucuugcgcuucccucuucaccuggauggagagcuuuaaagaaggcauugggaugcugguguguacaggagagccucaggacaagcacaaguuccccaaacaucaaaaggagcagcuucgcugccugcaggcccucucuuggcugaccuccagcgaucugcuugcggcuaucauuucuagcauggccgaacugcaggacguuaucggcaaagccgauccuaacuccagaaucugugggcaccuccugauuggagcugccaagaauagcuuugcuaaacucauggacaagaucucucuggugauggagugcauuccccuucauuccagccgguccaucacguaugucgaaaaggauucucuggugcaacgccucgcccacggccugcauaaaguuaacacccuggcgcuuaaguacggccugagagggcacgugccuauuacaaaaagcaccgccucccuccagaagcagauccugggauucacacaacggcuccacgcugccgaggucgaacgcagaucucugcggcuugaggugaccgaguucaaacgcagcgugaaugaaaugaagaaggagcuggacaaagcucagggccugcagaugcagcucaacgaauuuaagcaauccaaacugaucacgcaugagaaguucgaaucugccugugaggagcuuaauaacgcccugcucagagaggagcaggcucagaugcugcucaaugaacaggcgcaacagcugcaggagcuuaacuauaaacuggagcugcacagcuccgaagaggccgauaagaaucagacacucggggaagcuguuaagagccugucugaggccaaaauggaacuucggagaaaggaccaaucccugcgccagcucaaccggcaucugacccagcucgagcaagauaaaagacgccuggaggaaaauauucacgacgccgagagcgcccuucggauggcugcgaaggacaaagaaugcgucgcuaaccauaugagagccguggagaacacacugcacaaggugcgcgaucagaucucucuguccuggagcgccgcuucucggaaugacuuuacccuccagcugccgaaacuucaccuggaaaccuucgccauggagggacucaagggcgggcccgaggucguggcgugucaggcuaugauuaaguccuuuauggauguuuaccaacuggccagcacaagaaucaugacgcucgaaaaagagaugaccucccaucgcagccacauugccgcucugaagucugaacuucauacagccugccugcgggagaacgcuagccugcaguccaucggaucuagagaccacagcaaucucuccaucccuucucgggcuccccugccugcggauaccacaggcauuggcgacuuccuuccccugaaagccgaacucgauaccacguauacauuucugaaggagaccuucaucaacaccgugccgcacgcucugacaagcucccauucuagcccugucaccauguccgccaaugcuaaccgccccacacagauugggcucuga

SEQ ID NO: 66962 - RNA, 2382 nt, Artificial Sequence
  derived and/or modified sequence opt5 from CCDC175__Homo_sapiens__NP_001157871
auggcccugagccccuggaccccuggccucggggcuggagagaagcuggugcaggccgcggcugucuccacaggcccgucucuugaacugugcacgcuccccagcacccugggguccucuguugccguggaggcccuugaacaacuguucguggucgagcagagccuccaguccgacuacuuuaaauguaacgaagaggcuaagaucuuccugaaagauauugccguggcuguuaagaaacuggaggaaaugagaaaggccacaaucgaccuccuggagauugaaucuauggagcuuaauaagcuguauuaccuccuggagacccuuccuaacagcaucaaacgggaacuggaggaaugcgugcgcgaugcgagacggcucaaucuguuugagauuaacacaaucaagaugcgcaucaccagaacagaaaaugagauugagcugcucaaaaagaaaaucaccgaccugacgaaguauaacgaagcccuuggagagaagcaggaagaacuggcucggaaacacgcccgcuucguccucucccugaaucaaaccauggaaaagaaagcuacaaccacaguguacauuaacgagaccuauacgaagaucaaucuuaaaagagaggauauugcccugcagaagaaauguauccaggaagcggaggaacucauggagaaggaacgggccgaguaccugauucgcaagcaggagcugacagcucaaaucaacgaauuugagaauaccagagaaguuaaacggauggagacauaucagaagaaaaaggagcucgacaaacugcagaccaagaugagcaagaucaaagaaaccgugacagucucugccgcugugcuuuccgaucauaaccuggagauugcccgccuccacgaaagcaucagauacugggagcaggaagugucugagcugaagaaagaccuugccauucuggaggcuaagcucugcuucuuuacggauaauaaagaaaagcuggacgauaucuccaacgacgagaagaaugaguuccugaacaaaauuaagcaacucgucgagacccugcaugcggcccggauggaauacaaagaucuucgcgagaagaugaaaacacuggcuagacaguauaagaucguucucagcgaggaagagaaggccuuucugcagaaacaaaagauccacgacgaaaaccagaaacagcugaccuucauuucucagaaggaguacuuucuuucccaaaaacggguggacaucaagaauauggaagagggccucauuacacugcaggagcugcagcaggccaccaaaacgguguaucaacagcagaucaagauucucagcgcuaaccuggaaagagagucccagcgcugugucaucacacaauggaagauggccugccuucggaaaaagcaugcgagauggaccgcuaaaaucaaggccgaaauucaggccaucaccgagaaaauucagaaugcugaggugcgccggaucgaacugcucaacgagacaucuuucagacagcaagaaauuagcggguuuguugcccagaucgagaagcugaccacagaacugaaggaggaggaaaaggcuuucgugaauaaggagaaaaugcuuaugaaggaacucuccaaauacgaggaaauuuucgucaaggagacgcagaucaacaaggagaaagaagaggaacugguggaguaucugccccaacuccagguugccgaacaggaguacaaggagaaacgccggaagcuggaagaacuuagcaauaucauuaccgcgcagagacaagaagaggaucugcucaacaaucacaucuuucuguucacacgcgacuuuucucgguauauuuccaacauggaggaugugaaacaggaacugcagcagcuuagagaccaagagagcaagaagaauaaagaucacuucgaaacccucaagaaccuggagaauggauuuuacaucaacgaccagaaagccgaucugcuccugcuugaaaauaagaaacugaaggaguacauucucuaucugaaaaacaacaucgagaaguaccgcgaaggccaggaggcucugaugcauacaucuagcgaccuuucccggcagcucaucgcccaagaagcucaguauaaggaucugugggccgaguuccagaccacggucaaaauucugguggacaauggcgaagagacccuccaagauaucaacaaucugacagacaaacuuagagagcgggacgagaaaaugcagcacgucucuaccuggcugcgcgggagccucgagggacugagacugcuuguggaacaggaguccccuauggaucugcucaagaaaaagaagcauauucggacaagaguucacuuucccguggucaaauguaccgaaaagaacacgcugacaaaauga

SEQ ID NO: 66963 - RNA, 1590 nt, Artificial Sequence
  derived and/or modified sequence opt5 from CCDC176__Homo_sapiens__NP_079333
augcccagcaagggcaaagacaagaaaaaggggaaauccaagggaaaggauaccaaaaagcugaucaaaacagacgagucuguggucgauagagccaaggcuaacgccagccucugggaagcgcggcuggagguuacggaacuuucccgcauuaaauacagagacaccucucggauccuggcuaagagcaaugaggaucucaagaaaaagcagugcaaaauggaaaaggacauuauguccgugcugucuuaucuuaaaaagcaagaucaggagaaagacaacaugaucgagaagcugaagcagcagcucaaugaaacaaaagagaaggcccaagaagagaaagauaagcuggagcagaaauacacccgccagauuaacgaacuggagggccaguuccaccaaaaggccaaggaaaucgggaugauccauacagagcucaaagcugugagacaguuucagaagcggaaaauucaggucgaacgcgagcuggacgaucuuaaggagaaucugagaaacaccgaacggauccaccaagagacacuccgcagacuggaaagccgguucuuugaggaaaaacaucgccuugagcaggaggccgaaaagaagauuaucaugcuggcugagagagcccaccaugaagcgauugugcagcucaaugacgccggacggaacguuuucaaagagaaugauuaucugcaaaaggcucuggccuaccaccucaaagaaaccgacgcucugcagaagaacucccagaaacuucaggagagccacacgcugcuccugcaucaaaaggagaucaaugaccuucuggugaaggaaaagauuaugcagcucguccagcagcgcucucaaauccagacccugcagaagaaagugguuaaccuggagacagcccucuccuauaugaccaaggaauuugagagcgaggugcugaaacuucagcaacacgcgaugaucgaaaaucaggccggccaggucgagauugauaagcugcagcaucuccugcaaaugaaagacagagaaaugaaccgggugaagaaacuugcuaaaaauauccuggaugagagaacagaaguggagcgcuucuuucucgacgcccugcaccaggucaagcagcaaauucugaucucucggaaacacuacaagcagauugcucaggccgccuucaaccucaaaaugagagcugcguguaccgggcgcacggaguauccuaagauccggacauuugauggaagagaacauuccaccaacagcguuaaucaggaccugcuugaggccgaaaaguggacacacaucgagggcaacguggauauuggcgaccugaccugggaacaaaaagagaaggugcuccgccugcuguucgcuaaaaugaaugggugcccgucucggaaguacaaccaguccagcagacccccuguccccgauuacgugguuuccgacucuggagagaccaaagaauuuggcgaugagagcaaacuucaggacaagaucuucauuacacagcaaaucgccauuuccgacagcucuggggaagugguccucccuacgauccccaaggagccucaggaauccgauaccggaacauuuuga

SEQ ID NO: 66964 - RNA, 2604 nt, Artificial Sequence
  derived and/or modified sequence opt5 from CCDC178__Homo_sapiens__NP_001098998
augaccgagaacaagacagugagcuccucuagcacgagagacgaucagaccaauaucggccugacaugccaagaagucaaagcccuccgggagaaggcuuggucccgcaccaacgaagggaaugccaugucucagagccugguucuuuacggagcguccaaagagaacucugaaggcuuccacgagagcaagaugacaaauaccgagggggugaacaaaggaauuuauuuuuccuaccccuguagacggcauagcugcgcuguggucaauaucccugccccgugugugaacaagaugauuucucacauccaggacguugaauccaagauucaggagcaucugaaacgcuucgaaacaucuuuugaggaguggucuagaaccuccagcacgaaggaucucaaagaagacuggucugugaccacacccgucaaggaggugaaaccuggcgaaaagcgggaugagaagugccccgaacugaaacaagagauggagacccuucuguccgaagccauccgccucaucaagagccuggagacagacagagcugaugccgaagaggcucugaaacagcagcggucccgcaagaauaugauuaacaugaaaaucgacucuuggagcguuuggaagcuccaggaacugccucuugccgugcaaaaagagcacgaggcguaucuguccgaugucauugaacuccaguggcaucuggaggacaaggccaaucagcuucagcacuucgaaaagcaaaagaccgagcuggaagaggcuaacgccaagauccaggcugauauugacuacaugaaugagcacgggccccuccuggauagcaaacagaaccaagaacugcaggaccucaagaaucauuauaaaaagaagauggaggugauggaccugcacagaaaagugaacgaagaacuugaggaagcccuggaggcgugugaaaacgcccggcucaaggcucagcagaucaaagaggaaauugauaaggacaucuaccaagaugagaaaacgaucgaggccuauaagcgcgaaauuuaccagcugaauagccuuuuugaccauuacuccagcucugucaucaacguuaauacaaacauugaggaaaaggaggaagaggugaccgaggcuaucagagaaacaaaaagcuccaagaaugagcugcacucucucagcaaaaugcuggaagaucugcggcgcguguaugaccagcucaccuggaagcagaaaucccacgagaaccaauaccuggaagccgucaaugauuucuaugccgcuaagaagaccugggacauugagcuuagcgauguggcgaaagacuuuucugccaucucccuggcuugcacaaagcucacggaggauaacaaaaagcuggaaaucgacauuaauaaaaucaccguuaagacaaacgagagcauucggaaaaagucuaaguacgaauccgagaucaaauaucuuaccauuaugaagcugaaaaaugacaagcaucucaaaaacaucuacaaggaggccuauagaaucggaacacuguuccaccugaccaagcauaaaacggaugaaauggaggacaagauugccgaagugagacgcaaauuuaagggccgggaggaguuccucaaaaagcugacacagggcgaggucgcugccgggauggugcuucagaagaaacuguacagcaucuacgagguucaggcgcucgaaagaaaggagcugauuaaaaaucgcgcuaucugugccaugucccuggccgaacuucaagagccucuccugcagcuggaagaugaggcugagcggauuagaucucucgacaaggaacacagcgugaugcugaacaauaucauugaucagaaagaccuuauccgccggaaggucggaaaggugaaaaagaaacugagaaagaaaggcaagaaaacccucgaugcccugaucgagaccgaauccaagcgcucugcuauuuuuaaggaccuggaggccacaaaaagcaagaccaugaucuucuaugcgaaaauuaacgaacuuaacgaggagcucaaggccaaagaagaggaaaagaaguccuuugaucagacacuggagauccugaaaaauaaguucauuacgaugcgguucaaaagagagcaugcucaaaccgucuuugaccacuacaugcaggaaaagaaagauugcgaggaacgcaucuucgaggaagaccagcgguuuagagugcuccuggccguucggcaaaagacacuucaggauacccagaagaucauugcugacagccuggaggagaaccuccgccuggcccaggaauaucaacagcugcagaucacauuccuuaaagagaaggacaauuacuuuaacauuuaugauaaacagcucucucuggacaccuccaucagagauaagaaacaacugugucagcuccagcggagaaugcacacgcuguggcaggaacauuucaaacuugugguccuguuuagccaaaugcgccucgcgaauuuccagaccgacucucaggaguccauucaaaagauccuggccgugcaggaagagagcucuaaccugaugcagcacauccuuggguuuuuccagacacucaccgauggaacaugcgagaaugacggcuga

SEQ ID NO: 66965 - RNA, 5106 nt, Artificial Sequence
  derived and/or modified sequence opt5 from CCDC180__Homo_sapiens__NP_065944
augagaggcggggagaaccggccgccugcucgcgugcagagcuccucugaggaacuggaacugagacaccaaagccuggacgcuuucccgggacggcgccuucccggcagagggauccagccugccgcgaagauguccucugucggaaaaguuacccaggugcccaauggcaaggcuuaccagcaaauuuuucaggccgaggugcagcugguccauagccucgccgcuacgcggaaacgcgccgcugaaagauccgugacgcugaagucugggcggaucccuaugaugaaaaagguugagacccccgagggagaagugaugagcccucgccagcaaaaguggaugcacucccuuccgaacgauuggauuauggagaaucccguccugcauagagaaaaagagcgggccaagcgcgagaaagcgagagaaagcgagaacacaaucgccgcucgggaagugcgcggccucauggacaccauuguuccugagaagaucucuacauccaccuuccagagacaggccgaacacaaacggaaaagcuaugagucugcucuggccuccuuucaggaggaaaucgcgcaagugggcaaggagauggaaccccugauugucgauacagggggacucuuccugaagaaacuuaccgagagcgacgaagagaugaauagacuguuucucaaaguggagaacgauacgaaucuggaagacuacaccauccaggcccuucuggagcucugggauaaaguggcuggccgccugcugcuccggaaacaggaaauuaaggagcuggacgaagcccuucauucucuggaguucuccagaacagauaaacucaagagcguccugaagaaauaugcugagguuaucgaaaagaccuccuaccuuaugcgcccugagguguaucggcugauuaacgaagaggccauggugaugaauuacgcccuccuggggaacagaaaagcucuggcgcaacucuuugucaaucugauggagucuacacuucagcaggaacuggacagccgccaccgguggcagggacucguggauaccuggaaggcccugaaaaaggaggcccuucugcaauccuucagcgaauuuauggccucugaguccauccacacgcccccggccguuacaaaggaacucgaggugaugcugaaaacccagaacguccugcagcagagacgccucaagcaucugugcacaauuugugaccuucugccucccagcuauucuaaaacccaacucaccgaguggcacagcucccucaauucucugaacaaggaacuugauacauaccauguggacugcaugaugcggaucagacuccuguacgagaaaacguggcaggaaugucugaugcacguucagaauugcaagaagcagcuccuggacuggaaggcuuucaccgaggaagaggccgagacacuugugaaccaauuuuucuuucagauggucggcgcgcugcaggggaagguggaagaggaucucgaacugcuggacaagagcuucgagacccuugcugaucagacagaauggcaauccagccaccucuucaaguauuuucaggaggucgugcagcugugggaggcccaucaaucugaacugcucguucaggagcuggaacuugagaaacgcauggagcagcaccggcagaagcauucccuggaaagccaagugcaggaggcccaccucgacagacugcuggaucagcuucggcagcaaucugacaaggaaacccucgcuuuccaucuggagaaagucaaggauuaccugaaaaacaugaagucccgcuaugaauguuuucacacgcuccugacaaaagaggugauggaguacccugccaucaugcuuaaggaacugaauagcuauuccucugcucucagccaguacuucuuuguuagagagauuuucgaacagaaccuggccggagaggugaucuuuaaauuccggcagcccgaagcgcacgagaagcccucccaaaagagagucaaaaagcugcgcaaaaagcagggcucuaaagaggacaugacccggagcgaagaguccauuagcucuggcaccuccacagccagaagcguggaagagguggaagaggagaaugaucaggaaauggagucuuuuaucaccgaagagguucuugggcaacagaagaaguccccucuccaugcuaaaauggacgagagcaaggaaggaucuauucagggccuggaggaaaugcaggucgagcgcgaagggagccugaacccgucccucaaugaggagaacgugaaaggacaaggcgaaaagaaagaggaaagcgaggaagaggaugagaaggaagaggaagaggaagaggagaagcuggaagaggaaaaagaggagaaggaagcccaggaggaacaggagucucuuuccgugggggaagaggaggacaaagaagagggacuggaagagaucuauuacgaagacauggagagcuucacaaucuccucuggcaauacguacuuugucuucgugccccucgaggaggaacacugcagaaagagccauuccaccuuuucugcuauguucauuaacgauacaagcuccgccaaauucaucgaacagguuaccauuccuucucggcugauccuggagauuaagaagcaacuucgcgcgggcuuuuucgaacaccuggagaaaugguuugaccaguguagccucaauacaagagugaccgucgccacgaagaucaacgagcuggauuccgaacucgagcugcaccuucaucugcaccagccccgggcucagcaaaucgaaaaagacauucauaaugugcgcgccgcugagcuccugcugcaccaggagcagcuugauagccauugcgccgggguuaccgaaacacugaagaaaaagagacucauguucugucaguuucaagaggaacagaacgugcggucuaaaaauuuccgccugaagaucuaugacauggagcacauuuuucucaacgccaccagaucccagaagcuggucacacuuagcaauacccugcaccaagaacuccugucuuacguggauguuacacaggugucccugcggagcuuccgccaguaucuugaggagucucugggaaaacucagauacuccaacaucgaauuuauuaagcauugccggcuguucagcgagggcgggaacuuuuccccuaaagaaaucaauagccucuguucuagacuggagaaggaagcugcgcgcauugagcuugucgagagcgugaucaugcugaacauggaaaaacuggagaaugaauaucucgaccaggccaacgaugugaucaauaaguucgaguccaaguuucacaaccugucugucgaccuuauuuucaucgagaaaauucaacggcugcucacaaaucugcagguuaagaucaaaugccagguggcuaagagcaacucccagaccaauggacucaacuucucucugcaacagcuucagaauaaaauuaagacaugccaggagagcagaggcgagaagaccaccgugacaacggaggaacugcuguccuuuguccaaaccuggaaagaaaagcucucucagcgcauccaguaccugaacuguagccuugaucggguguccaugacagagcugguuuucaccaauacaauccucaaagaccaagaggaagauagcgacauucugaccucuuccgaggcccucgaagaggaagccaagcuggacguggucacgcccgagagcuuuacacagcuuucuagaguggggaaaccgcugaucgaggauccugcuguugacgugauucgcaagcugcuccagcugcccaacaccaaguggccuacccaucacugcgauaaagaccccucccagacaggccggggagccugggcguguggcagcagaggguccucugaagcuggagccggcggggccgucugcagcccucccgugcuuuguuccugcccgggaccuagcucucccaagggcuucaaacgccaucggugucaacccgaaaauuccgggaagaaagcuguuccuagcgccucugcgaccagcgcuggcuccuuuacaccgcaccccaagccuaacaagauggaaagaaaauaucgggugcugggagauaagcccccucccgccgccgaggacuucaaaggcaucauucucacgcugcucugggaaucuagcgagaaccugcuuaccgucgcugaggaauuuuaccgcaaggagaaaagaccugugacacggcccgauugcaugugugacaccuucgaucagugcgccgaaaauaucuccaagaaaauccuggaguaccagucucaggcuaacaaguaucacaauagcugucugauugaacuccgcauccaaauuagacgguuugaggagcugcuuccccaggugugcuggcuggucauggaaaacuucaaggagcaucacuggaaaaaguuuuucacauccguuaaagaaaucagagggcaguucgaggagcagcaaaagcgccucgaaaaacggaaggacaagaaugcccagaaacugcaucugaaccucggacacccugugcacuuucaggagauggaaagccuucaucugucugaggaagagagacaggaggaacuggauuccaugauucgcaugaauaaggagaaacucgaagagugcacccggagaaacggccaaguguucaucacgaaucuggcgaccuuuacagaaaaguuccuucugcagcucgacgaggucgugaccaucgaugacguucagguggcccgcauggagcccccuaaacaaaagcugagcaugcugauucggagaaagcucgcugggcuuucccugaaagaagagucugaaaagccccugaucgagcgcggaagcagaaaauggccgggcauuaagccuacagaagucaccauccagaacaaaauucuccugcagcccacauccucuaucagcaccacgaagacaacccuugggcaccuggccgcuguggaggcccgggacgccguuuaccucaaguaucuggcuuccuuugaggaggaacugaaacgcauucaggaugacuguaccagccaaaucaaggaagcgcagagauggaaagauucuuggaagcagucccuccauacaauccagggccuuuacguguga

SEQ ID NO: 66966 - RNA, 1527 nt, Artificial Sequence
  derived and/or modified sequence opt5 from CCDC181__Homo_sapiens__NP_067002
augaacgagaauaaggacaccgauagcaaaaaguccgaagaguacgaagacgauuucgagaaagaccuggaauggcucaucaacgagaaugagaagucugaugccagcauuaucgaaauggcuugcgagaaagaagagaacauuaaucaggaccugaaggagaacgaaacagugauggagcacacgaagagacauuccgaucccgacaaaucucuucaagaugaagucagcccucggcgcaaugacaucauuuccguuccgggcauccagccccuggauccuaucucugacagcgauuccgagaacagcuuucaggaaucuaagcucgagucccagaaagaccuggaggaagaggaagacgaggaagugagacgguauauuauggagaagaucgugcaagccaauaaacuucugcagaaccaggagcccgucaaugauaagcgcgaaagaaagcucaaauucaaggaccagcugguggaucuggagguuccuccccucgaagacaccacaaccuuuaaaaacuacuucgagaaugaacggaacauguuugggaagcugagccaacuuuguauuucuaaugauuucggacaggaggacgugcugcucucccugacaaacggcagcugcgaggaaaacaaagaucgcaccauccuugucgagagagacgggaaguuugaacugcucaaucugcaggauauugcgucucagggauuccugccuccgaucaacaaugcuaacuccacagagaaugacccccaacagcuccugccucggagcuccaacucuagcguguccggcaccaaaaaggaggauagcacggccaagauucacgccguuacccauucuuccacaggggaaccccuugcuuauaucgcccagccuccccugaaucgcaaaaccuguccgagcucugcugugaacagcgacagauccaagggaaauggcaaaucuaaccaccggacacaaagcgcccauaucuccccugucaccagcacguacugccucucuccccgccagaaggagcugcagaaacagcuugaagagaagagagaaaagcugaaacgggaggaggaacgcagaaagauugaggaagagaaagaaaagaaacgggagaaugacaucguguuuaaggcguggcuccaaaagaaaagagagcaagugcuggaaaugcgccggauucagagagccaaggagaucgaagauaugaacucccgcgagaaucgggacccucagcaggcuuucagacuguggcucaaaaagaaacacgaagaacagaugaaggagcgccagacagaggagcugcggaagcaggaagagugucuguuuuuccuuaaaggcaccgaggggagagaacgcgccuuuaagcaauggcuccggagaaaacgcauggagaagauggcugaacagcaggccguccgggagagaacacggcagcugcgccuugaagcgaaaagaagcaagcaacugcagcaccaucucuauaugucugaggccaaacccuuccgguucaccgaucacuacaacuga

SEQ ID NO: 66967 - RNA, 1872 nt, Artificial Sequence
  derived and/or modified sequence opt5 from CCDC185__Homo_sapiens__NP_689823
auggccggcuucagccacuuuucccagcccccuuacagagaccugugggagccgccccggccugggggagaacgcgagucuacccaaagacucggcgggcagcggagcggagcugauuccacagccugcucucgcgcgggcacgcccggggcugaaagcgaggccggagccuguuggcugcauccucacugcuccuucacccccagaccucggcgcagaggcuguucugacagccuucggggcucccgcagccugucugauguggcuagacggccgcucgaacgcuccagaaagcaucggccccgcagcagacggcuggaggacgccuggggagagacagggaccaaaccuagacccgcuuggcagccucagacacaacuucccccgcagcgcccucagcccugcccucacuauccccuggcccagggcgauucucccccuccgugucccgggggagcgggcaccccucucuccgggacauuucgggucgaaaaggcccaaggaggcgaccagugggcuguuccccugggcagacaucuggggcgcuggagcccuucuuccgugcccagcgagcgguccucugugccgagccagaaauucaagagacacuccgccugcgucugugcucagaaacgcgauagcucugaccaaguggaaucccucgccagccgggauucucagccucuggcgagcuccaaggagaugagaucuccccacacccagguucuuaagagcaaacuggaggaaguggucguguccagccaagaccagcagaucguugcccucgugcugacgcgccuuaagaaagcucagcggauuagagagcugcaacagcaggccgcuaaggccugggaagaacucaaacgcucugaucagaagguccaaaugacccuggaacgggagagacggcugcuccugcgccagucccaggagcaguggcaagaaaaggagcagagaaaaacacuucagagcccugaacagcggggacugagacgcgacucucaacggaagaacgugcccccuggcgaguccagauggaaagaacagcccgaggaucaggagagcccgcgccaagaaaagcucgagaaagccagagcucaggcggaacaucggaagcagugccaggugcgcagacugcgggagcaagagaaaaugcuucgcaaucugagagagcagcacucccuccagcugcagcggcgccuggucgaggccuguagaaagcggcaucuccacgcuguugaagggcaaaagaaagugcaggacaccaaccugucuagccuuaucaauuaccaggcccgcaaggugcugauggacugccaggccaaagcugaggaacuccugagacaacuuucccuggagcagucuuuucagcggagccaagagauucaccagggacucagaaaggaacgccagcgggagcugagagaaaaagcccagaaggaggaagaacaacugcagcaggcgcgcuggcgggcuggcgaguccgaggagcagagaaagaugcgcaaacggauccucgucgaacuggccgaugagaagauuagacaagcccgcagccaugugcacaaaacaacccgggacaagguucagcaucuuagagaacugaaccaccuccgggagaaaaaucaucacauccugaagcugaaggcugagaaagaagagaagugucacaucgaagggauuaaagaggccaucaagaaaaaggaacagcgcgugcagcauauuucucaaggaaaggauccuaacuuccaggaguuucagaaacuuccccaggcuuccagacgggaggaacgcgcgcccccuaauagcucucucgaccaaaugguccuggaggcccagcugagagccugccagcaaaaccggggcuauuga

SEQ ID NO: 66968 - RNA, 1884 nt, Artificial Sequence
  derived and/or modified sequence opt5 from CCDC22__Homo_sapiens__NP_054727
auggaggaagccgacagaauccugauucacagccuccggcaggcuggcaccgccgugcccccugauguccaaacacugcgcgcguucacgaccgagcuuguuguggaagcuguggucagaugccugcgggugaucaacccggccguuggguccggacucucuccccugcuuccucuggccaugagcgcucgcuuuagacucgccaugucccuggcucaggccuguauggaccugggcuacccccucgagcugggguaucagaauuuccuuuacccuucugaacccgaucugcgggaccuccugcuuuuucuggcggagcgccucccuacagaugccagcgaggacgcugaucagccggccggagacuccgcuauucugcugagagccaucggcucucaaauucgggaucagcucgcgcugcccugggugccuccccaucuucgcaccccuaagcugcagcaccuccaggggagcgcccugcaaaaacccuuccaugcuuccagacuugucgugccggaacugagcucucggggagagccucgcgaauuucaggccagcccccuccugcugccuguucccacacaggugccccagccugucggcagaguggcuucccuccuggagcaccaugcccuucaacugugccagcagaccggccgggaccgcccgggggaugaggacugggugcacagaacaucucggcuucccccucaagaagauaccagagcccagcgccagcggcugcagaagcaacuuacggagcaccugagacaguccuggggacuccugggcgcucccauccaggcgcgcgaccugggggaacuccugcaggccuggggagcuggcgccaaaaccggggccccuaagggaagccgguucacacauucugagaaauuuaccuuccaccuugaaccccaagcucaggccacacaggucuccgacguuccggcgaccagcagacgcccugaacaggugacgugggcugcccaagagcaggagcuggagucccuccgggaacagcuggagggcgugaacagaucuaucgaagaggucgaggccgauaugaagacacugggcgugagcuuuguucaggcugaauccgagugucgccauagcaagcucucuaccgccgaacgggagcaagcucucagacugaaaucccgcgccguggaacugcuccccgacgggacagcgaaucuggccaaacuucagcuggucguggagaacagcgcucagcggguuauucaccucgccggacaaugggagaagcacagagugccucugcuggcugaauaucggcaucuucgcaagcuccaggauugcagagagcuggaaucuagccggagacuggccgagauccaggagcuccaccaguccguccgcgcggccgcugaagaggcccggagaaaagaagagguguacaagcaacugaugucugaacuugagacccugccccgcgacgucagcagacucgcuuauacccagcggauucuggagaucgugggcaauauucgcaagcagaaagaagagaucacaaagauucuguccgauacgaaagaacuucagaaggagaucaacagccucucugggaaacuggacagaaccuucgccguuacagaugaacugguguuuaaggacgccaaaaaggaugacgcuguccggaaggcguacaaauaucucgccgcucugcaugagaauuguucccaacuuauccagaccauugaggauacaggaaccaucaugcgcgaagugagagaccuggaggaacagauugagacggaacucggcaagaaaacacugagcaaccuggagaagauccgggaggacuaccgcgcccuuagacaggaaaaugccgggcuccugggacggguucgcgaggcuuga

SEQ ID NO: 66969 - RNA, 825 nt, Artificial Sequence
  derived and/or modified sequence opt5 from CCDC28A__Homo_sapiens__NP_056254
augcccagagccgagccucgggcuacccugggcgaacaggagaaggccgggcucccgcugggagcguggcgccuuuaccugcucagacacuuccggaaacaaacagaacugcgcagaagcggcucccgggacgugacgggggcccuucuggucgcugccgcuguugccucugaggcugugggaagccuccgcguggccgaaggcgggcccaacacccugcugcuccagguccugagauccuggccuuggugcaauaaggagcuuaaaacaauggaggaacggaaggugaaacgcagaucucccaagagcuuuuccgcgcauuguacccagguugugaacgccaagaaaaaugcuaucccugucucuaagagcacaggauucuccaaccccgccagccagucuaccucccaacggccuaaacugaagcgcgugaugaaagagaagacaaagccgcagggcggcgaagggaaaggagcucagagcacccccauucagcacucuuuucucacggauguuuccgacgugcaagagauggagagaggccugcuuagccugcucaaugauuuccauucugggaagcugcaggccuuuggaaacgaaugcuccaucgagcagauggaacacguccggggcaugcaggagaaacuggcgcgccucaaucuggaacuuuauggggagcuggaggaacucccugaggacaagagaaaaaccgccagcgauuccaaccuggaccggcuucugucugaucucgaggaacugaauagcuccauucaaaagcugcaucucgcugacgcccaggaugugcccaacacaagcgcuucuuga

SEQ ID NO: 66970 - RNA, 2826 nt, Artificial Sequence
  derived and/or modified sequence opt5 from CCDC39__Homo_sapiens__NP_852091
augagcuccgaguuccuggccgaacuccacugggaggacggcuuugcuauccccguggccaacgaagagaauaagcugcuugaagaucagcugucuaaacucaaggacgagagagcgagccugcaagaugagcuucgggaauacgaggaacgcauuaacuccaugaccucucauuucaaaaaugugaagcaggagcugagcaucacacagucccucugcaaagcuagagagcgggaaacggagucugaagaacacuuuaaggccauugcccagcgcgaacuggggagaguuaaggacgagauccaacggcuggagaacgaaauggcuagcauucucgagaaaaaguccgauaaagaaaauggaaucuucaaggccacccagaaacuggacggccuuaagugucagaugaacugggaucagcaagcucuggaggccuggcucgaagagagcgcgcauaaggacucugaugcccugacacuucagaaauaugcucagcaggacgauaauaagauccgcgcccugacccuccaacuggagagacugacacucgaaugcaaccagaaacggaagauucuggacaaugagcuuaccgaaacaaucuccgcucagcuggagcucgauaaagccgcgcaagacuuucgcaagauucacaacgaaagacaggagcugaucaaacagugggagaauaccauugaacagaugcaaaagcgggacggggauaucgacaacugugcccuugagcuggcucgcauuaagcaggaaacgagagagaaagagaaucucgugaaggaaaagaucaaguuccuggagagcgaaaucggaaacaauaccgaguuugaaaaacggauuucuguggccgaucgcaagcugcucaagugcagaacagcuuaccaggaccaugagaccucccggauccagcugaaaggcgagcuugauagccugaaggccacagucaacagaaccucuuccgaccucgaagcccugcgcaaaaacauuagcaagaucaaaaaggauauucacgaggaaacggcucggcuucaaaagacaaagaaucacaacgagaucauccagaccaagcugaaagaaauuacagagaagaccauguccguggaggaaaaagcgaccaaucucgaggacaugcugaaggaagaggaaaaggauguuaaagagguggacguccagcugaaccucaucaagggggugcuguucaaaaaggcccaggagcuucaaacagaaacgaugaaagagaaggcuguucugucugaaauugagggaaccagaagcucccucaaacaucugaaucaccagcugcagaaacuugauuuugagacacucaagcagcaagaaaucauguauagccaggacuuccauauucagcaaguggagcgccggaugucuagacugaaaggcgaaaucaacuccgaggaaaagcaggcccuggaggccaaaaucgucgagcuccgcaagagccuggaagagaaaaagucuaccuguggccuucuggaaacacagauuaagaaacuccacaaugaccuguacuuuaucaagaaagcucacagcaagaacuccgaugagaaacagucucugaugaccaagauuaaugaacuuaaccucuucaucgaccggagcgagaaggagcuggauaaagccaagggguuuaaacaagaccugaugauugaagauaaucuccugaaacuugaggugaaaagaacgcgcgaaaugcugcauuccaaggcggaggaagugcucagccuggagaagcggaaacagcagcuguauacagcuauggaggaaagaaccgaggaaaucaagguccacaaaaccaugcuugccucucagauucgcuacguugaccaagagcgggagaacaucuccacagaguucagagagcggcucagcaagaucgaaaaacugaagaaucgcuaugagauucugaccguggugaugcucccuccggaaggagaggaggaaaagacacaggccuacuacgucaucaaggcugcccaggagaaggaggaacugcagagagaaggcgauugccuugacgcuaaaauuaacaaggccgagaaagagaucuaugcgcuggaaaauacgcuccaagugcugaacucuuguaacaauaacuacaagcaguccuucaaaaagguuacccccagcuccgaugaguaugaacugaagauucagcuugaggaacaaaaacgggccguggacgagaaguacagauauaaacagcgccagauccgggagcuccaggaagauauccaaucuauggagaauacacuggacgucauugaacaucuggcuaacaaugugaaggagaaacucagcgagaagcaggccuacuccuuucagcugucuaaggaaaccgaggaacagaaaccuaaacuugagagaguuacaaaacaaugcgcuaagcugaccaaagaaauccgccuccugaaggauacgaaggacgagaccauggaggaacaggacauuaaacugagagagaugaagcaguuccacaaagugaucgaugaaaugcuugucgacauuaucgaggaaaacacagagauccggauuauccugcagaccuauuuucaacagagcgggcucgagcugcccacagccuccaccaagggaagccgccagucuuccagaagcccuucucauacgucccucagcgcgcggucuagccgcuccacaagcaccucuacaucccagagcuccauuaaagugcuggaacuuaaguuccccgccucuagcucccuggucggcucuccuagcagaccguccucugcuagcuccucuagcuccaaugucaagagcaaaaagucuuccaaauga

SEQ ID NO: 66971 - RNA, 438 nt, Artificial Sequence
  derived and/or modified sequence opt5 from CCDC3__Homo_sapiens__NP_001269587
auggacgagaacuacaaucugcucccccacggcgugaacuuccaggaugccaucuuuccugacacccaagaaaauagacggauguucagcucccuguuucaguucucuaacugcagccaggggcagcaacuugcuacauuuuccucugauugggagauucaggaagacagccgccugauguguuccucuguccagaaggcccucuucgaggaagaggaucauguuaaaaagcugcagcaaaaaguggcgacgcuugagaagagaaaucggcagcugcgcgaaagagugaaaaaggucaagcggagccuccgccaggcucggaaaaagggaagacaccuggagcuggccaaccagaaacucuccgaaaagcuggccgcuggcgcccuuccgcauaucaaugcucgcgggcccgugagaccucccuaucugcggggauga

SEQ ID NO: 66972 - RNA, 3093 nt, Artificial Sequence
  derived and/or modified sequence opt5 from CCDC40__Homo_sapiens__NP_001230271
auggccgagcccggcggggcugccggaagaagccacccugaagacggcuccgcgucugagggggaaaaggagggaaacaaugaaagccauaugguguccccgcccgagaaagaugacggccagaagggggaggaagcugucggaucuaccgagcacccugaagagguuacaacgcaagccgaggccgcuaucgaagagggcgaaguggagaccgaaggcgaggccgcuguggagggggaagaggaagccgucagcuacggagaugcggaguccgaagaggaguauuacuauacagaaaccucuagccccgagggccagauuuccgccgcugacacaaccuacccuuauuucucucccccucaggaacugccgggggaggaagccuacgauagcguguccggagaggcuggccuccagggguuucaacaggaggccacaggacccccugaaagccgggagcgcagaguuaccucucccgaaccuucccauggcgugcugggccccagcgagcagauggggcaggucacgucuggaccggcggugggccggcuuaccggguccacagaggaaccucaaggacagguucugcccaugggcgugcagcaccgcuucagacucagccauggguccgacaucgagucuagcgaucuggaagaguuugucucccaggaaccugugauuccucccggagugcccgacgcccacccgcgggagggcgaucuucccgucuuccaagaccagauccagcaaccuagcaccgaggaaggcgcuauggccgagcgcguugaaucugagggguccgaugaagaggcugaggacgaaggaagccagcugguggugcucgaucccgaccacccucugauggucagauuucaggccgcccugaaaaacuaucucaaucggcagauugagaagcugaaacuugaccugcaagaacucgugguugcuacaaagcagucucgcgcgcagagacaggagcugggcgugaaccuuuacgaaguccaacagcaucuggugcaccuccagaagcugcuggagaaaagccaugaucggcacgccauggcuuccucugagcgcagacagaaggaagaggaacuccaagccgcccgggcucuguacaccaaaacgugcgccgcggcuaaugaggagcgcaagaaacuugccgcccugcagacagaaauggagaaccucgcucugcaccuuuucuauaugcagaauaucgaccaggauaugagagacgauauccggguuaugacccaaguggucaagaaggccgaaacagagcgcauuagagcugaaaucgagaaaaagaaacaggaccuguacguggaucagcucaccacccgggcccaacagcuggaggaagacauugcgcuguuugaggcccaguaucucgcucaggccgaagauacaagaauccugcgcaaggcugucagcgaggccuguacggaaauugacgcgaucuccguggagaaacggagaauuaugcaacagugggccagcucucuuguugggaugaagcaucgcgaugaggcucaccgggccgugcuggaagcucucagaggaugccagcaucaggccaaauccaccgacggcgagaucgaagccuacaaaaagagcaucaugaaagaggaagagaagaacgagaaacuggcuucuauucuuaaucgcacagaaaccgaggcgacacugcuccaaaagcugaccacgcagugucugacaaaacaggucgcccuccagucccaauucaacaccuaucggcugacccuucaggacacagaagaugcucugagccaggaccaacucgagcagaugauccugaccgaggaacugcaggccauuagacaggccauccaaggggagcuugaacuccgccggaagacagaugcugccauuagagagaagcugcaggaacacaugacguccaauaaaaccacaaaguacuuuaaccagcugauccuccggcugcagaaagagaagaccaauaugaugacacaucuuucuaaaaucaacggcgacauugcgcaaaccacgcuggauaucacccacacaagcucccgccucgacgcucaccagaagacccugguggagcuggaucaggacguuaagaaagugaaugaacuuauuacaaacucucagagcgagaucuccagacggaccauucucaucgaaagaaagcaaggacugaucaacuuccugaauaaacagcucgagcgcauggucagcgaacugggcggggaggaggugggaccccuugaacuggagauuaagcggcucucuaaacugaucgaugaacaugacggcaaggccgugcaggcccagguuacguggcugagacuucaacaggagauggucaaggugacacaggaacaagaggagcagcucgcuucccuggaugccagcaaaaaggaacugcacauuauggagcagaaaaagcuccgcguggaaucuaaaaucgagcaggagaagaaagaacaaaaggagauugaacaucacaugaaggaccuggauaacgaccuuaaaaagcugaauaugcucaugaacaaaaauagaugcuccagcgaggaacuggagcagaacaaucgggucaccgagaacgaauuugugcgcucucugaaggcgagcgagagagaaacaaucaaaaugcaggacaaacuuaaucagcucuccgaggaaaaggcuacccugcugaaccaacucguugaggccgagcaccagauuaugcugugggaaaagaagauccagcuugccaaggagaugcggagcucuguggauuccgaaaucgggcagaccgagauucgcgcuaugaagggagaaauccauagaaugaaaaaguauugucggacaacgcaagacgcccaccgccauguccacgagcagcauggcacccacgcugggacaugcaccaagaauacaggcagagcccaggcgcgggcccgcaccacgagagaugcucggggacacgugcaugagcaacacggcacaagagccgggaccuguaccaacaauacaggacgcgcucaggcccgggccagaacccgcgacgcucggagacauguucacgaacaucgcacacacacggcgcgggccuga

SEQ ID NO: 66973 - RNA, 927 nt, Artificial Sequence
  derived and/or modified sequence opt5 from CCDC42B__Homo_sapiens__NP_001138344
auggccgugcccugggaggaauacuucagacuggcucuccaggagaagcugagcaccaaacuuccugaacaagccgaggaccacgucccgcccguucugcggcuccuggaaaagcgccaggagcuuguggaugcggaccaggcucugcaggcccaaaaagagguguuuagaacaaagacggccgcucucaaacagcggugggaacagcuggagcagaaggaacgcgagcugaagggcuccuucaucagauuugauaaauuccuccaagacucugaggcccggcgcaacagagcucugcggcgcgccgcggaagagagacaucaggccgggcggcgcgaagucgaggcucuuagacuguggacccagcuccaggaacugcggcgcgagcacgccagacuucaacggagacugaagcgccucgagccuugcgcucggcugcuggaacaggcccucgagcugcuucccggauuucaggaagugccugagcugguugcgagauucgauggccucgccgaaacacaagcugcccugcgccuucgggagagagagcagcuggcugaacucgaggccgcccgcgcucggcugcagcagcugagagacgcguggcccgaugaagugcucgcccaagggcagcgccgggcucagcugcaggagagacuugaagccgcccgcgagcggacccugcaaugggagagcaaauggauucagauccagaauacagcugccgaaaagacccuccugcuuggaagaucccggauggcgguccugaaccucuuucagcuggugugucaacaucagggccagccuccgacacuggacauugaggauaccgaagggcagcucgagcacguuaaacuguucaugcaagaccuuucugcuaugcuggccggacucggccaggccgagcccgcugccccugcuagcuga

SEQ ID NO: 66974 - RNA, 729 nt, Artificial Sequence
  derived and/or modified sequence opt5 from CCDC42__Homo_sapiens__NP_001151733
augagccugggcaucauggaggaagaggaccucgccgaauacuucagacugcaguauggggagcggcuucugcaaaugcuccagaagcugcccaacguggaaggagcuuccgagucuccuagcauuuggcuucuggagaaaaagaaagaaaccgagaucaugcaccagacaaugguccagaagaaaaagauguuucaacgcagaauggaaacgcucaaucugcggugggaggagcugggcguuaaggaagcccagcucaaagcgcauauucagaaguccgagcaguucauccaagaaaacgaucagaaacgcauuagagcuaugaagaaagccaauaaggagcgggaacugaagugccagcacaugcaggagcuuaccaaacgcaagcaagagaugguggcccugagacucgaacaucagcggcugucugcuaaacuuaaggacuacuauaucuuuaacaaauaccuggagaagguggucgaaaauagcgaggaaucccgcugggcccacauccagaacacagcugccaaaaagacccuccugcuggggacaauuaagauggcgacccucaaucuguuccaaaucgugucuaaacaucuuaaggagguuacagagguggcccuggaagauacccacaaacagcucgacaugauucagcaguuuauccaagauagaagcgacauuugggcugaggucaagaaaaaggaacagcagcgggugcgcaucuga

SEQ ID NO: 66975 - RNA, 921 nt, Artificial Sequence
  derived and/or modified sequence opt5 from CCDC50__Homo_sapiens__NP_777568
auggccgaggugagcaucgaccaguccaagcugcccggcgucaaagaaguuugcagagauuucgcugugcucgaggaccacacccuggcccauucucuucaagaacaggagauugaacaccaucuggcgagcaacgugcagcggaaucgccucguccagcacgaucugcaaguggcuaagcagcuucaggaggaggaccugaaagcccaggcccaacuccagaagagauacaaagaucuggaacagcaggacugugagaucgcucaagaaauucaggagaagcuggccaucgaggcugaacggcgccggauucaggagaagaaagaugaagacaucgccagacuccugcaagagaaggaacuucaggaggagaaaaagcgcaaaaagcauuuuccugaguucccggcgacaagagccuaugcugauuccuacuauuacgaagacgggggaaugaagccccggguuaugaaagaagccgugucuacgccuagccgcauggcucacagagaucaggagugguaugacgccgaaaucgcgcggaagcugcaggaggaggaacuccuggccacccaagucgauaugcgcgcugcccagguggcucaggacgaggaaauugccagacuucugauggccgaggagaaaaaggcuuacaaaaaggcgaaagaacgggagaaguccucucucgacaagcgcaaacaggaucccgaauggaagccuaaaacagccaaggcugccaacagcaaauccaaggagagcgacgaaccccaccauucuaagaaugagagaccugcccggccgcccccucccaucaugaccgauggcgaggacgcugauuauacacacuuuaccaaccaacaguccagcacaagacauuucucuaaauccgaaagcucucacaagggguuucacuacaaacauuga

SEQ ID NO: 66976 - RNA, 987 nt, Artificial Sequence
  derived and/or modified sequence opt5 from CCDC54__Homo_sapiens__NP_115989
auguacacccugcacacaaagagagugaaagccgcugcccggcagauguggacgagcaaccucuccaagguccgccaaucucugaaaaauguuuaucauaagugcaaaaucagacaccaggacagcaccggcuaccccacagugaccuccgaugacuguaaccaggaugacgauucuuaugacgggaagaugaaucuuccugugguccugcaggaugugaagacagcgcaaguugaacucuucagccagaugaccgacauugugcauaugaucccgaaaguccaggaaaagacagaucuguaccagaaacaaauggaggugcuugaaacccggaugaacguuaaugaggacaagcagugcacgaccacaaaagauauucuguccaugaaggaagacaucaaggcucucaaaaagaaagugaccgagcuggagauucagaacucuuguagcacaauccacugccuggaaauccucgagggagaacgcggcaaggagauuaccgagcugcuuuauaaacugauccagcccgccacgcucaagaauacacuggccuccaccgauauggaaauuagcucugcugagccugaaaaaguccccuccuacccuaagagcacagaccaucuugagaagaaaaccaucucuccccaaaugaagacccugaaaaagagaaaccaccagaaugccucccggagcuuugaaaaagcuaagccuaacauuuauaucuacccggacuucucuacauggauuaagcucacguuugugcacgggggaaaauggaccuucuuucuguccgccacaaagcuggaggaguucauccaguggcuccugagccgccccaccauccuuccugaggagccccaagugauuacacagagauacuguccuuuuaccggccccauccugucccucacgacaauuugccugucuaucuucaauaacauuuauggguuuaucuguagccuuaaagaagaggucacccggcuguga

SEQ ID NO: 66977 - RNA, 1653 nt, Artificial Sequence
  derived and/or modified sequence opt5 from CCDC60__Homo_sapiens__NP_848594
augaccaaggugcccgccacaaagaagcugcagagcuccccuaacucuggcgcugucagaccguucuacgccagcgagaaucuccggcaaguucccgacaaaccuaugaaguccaucaaauauauggauaaggaaauuaucaaccugaagaaagaccuuauucgcucuagauuucugauccagagcgugaagauugggcggggauacuucgcgauccuccgcgaggaaacggcuaaaaagaaaaagcagcagcaacugcagaaacuuaaagaggaagagagaaauaaguuucagcccgccgagaaaaucuccgaaauucacuauggcgauacccugcucucuacauacgacgaugagaagcugaaaacccugggggcccgggugacacgcagaccuuucacccccauccauagcugcauuaucuccccuagccucacagaagcucacgucgagccgcuguuucggcagcuuugugcccugcauuggcuccuggaggcucuuaccauugaccacacgcaucacaccaugaagcccgugaucacaugcuggaacccuaaagaucccggaggcucuaaguccaccauuaagaaaaucaauaaggacaaaagcauggggcaaaagugggaacacuucaucacagccccuaaaaccaagaaguuuaaaauucccacgaugcgcguuacaaacagaaagccgucucggcgcggauccacccugagccucucuagagcguccggcggcagcuccccucagucuagcaugaucuccgugaaucccgggagcgaugagccucccucugucaacacacaggugaccuccagcaaagacauugaagauaaugagucuagcuccaccaagcccgacgaagaaccucuguauaugaaccugcagaaacuccuggagaugguucgggaagaugcccgcagaacagugacgaucgagaauggaaugcaacggaaggcuccgucuauucuuagcguccugaagcagaacaaauccaauagcgccuacaaggaaaugcagaccacacucaaaucuuccgagagaucuagcuccaccagcgcugaaucccauauccaacccgugcagaagaaaucuaagaaccgcacaaauugugacaucaacauucacuauaagagcggcgugugcaacaccaugcgggccaaauucuacuccgucgcgcaggaggccggguuuugucugcaggacaagauggagauccuuaugaaaagacaagaggagcgcggcauucagaaguuccgggcuuuuguucuggugucuaauuuccagaaagauaucgccaagaugagacaucacauuagcguggucaaaggagacgcugaagagaucgccgaucacugguacuuugaccuccuguccaagcugccugaagaucucaagaacuuccgccccgccaaaaagauccuggugaaacuucagaaguucggggagaaucuggaccuccggauuagaccucauguucugcuuaaagugcugcaagaucuccgcaucugggagcugugcagccccgacauugcugucgcgaucgaauuugugcgggagcacauuauccauaugccgcaggaagauuauauuucuuggcugcaguccagaaucaacaucccuauuggacccuacagcgcccuccgcuga

SEQ ID NO: 66978 - RNA, 2055 nt, Artificial Sequence
  derived and/or modified sequence opt5 from CCDC62__Homo_sapiens__NP_958843
augaaucccccugccgcuuuccuggccggcagacagaacaucgggagcgagguggaaauuuccaccaucgagaagcaacggaaagaacuccagcugcuuauuggagagcugaaggaccgcgauaaagaacucaacgacauggucgcgguucaccagcagcaacugcuuucuugggaggaggauagacagaaggugcugacacucgaagaacggugcagcaaacuggaaggcgagcugcauaagcgcacggagaucauuagaucccucaccaagaaagugaaggcucuggaaucuaaucagauggagugucagacagcccuucagaaaacccaacugcagcuccaggaaauggcccaaaaggcuacacacagcucccugcuuucugaggaccuggaagcccggaacgagacccucagcaauacacuggucgagcuguccgcucagguggggcagcuccaagcccgcgaacaggcgcugaccacgaugaucaaacuuaaggauaaggacaucauugaggccguuaaccauaucgcugauugcagcggaaaauuuaagaugcuggaacacgcccucagagacgcuaaaauggccgagaccuguauugugaaggaaaaacaggauuacaagcagaaacugaaggcgcuuaagaucgaggucaauaaacugaaggaggaccucaacgagaaaacaaccgagaauaacgaacaacgggaggaaauuauccgccugaagcaggagaaaucuugccugcaugaugagcuccuguucacaguggaaagagagaagcggaaggacgaacuucugaauauugccaaauccaagcaggagcgcaccaacagcgagcuccacaaucugagacagaucuauguuaaacaacagucugaucuucaguuucugaacuucaauguggaaaacucccaggagcucauccaaauguacgacagcaagauggaagagucuaaagcucuggacuccagccgggauaugugucuguccgaccucgaaaacaaucacccgaaggucgauauuaagcgcgagaaaaaccagaagucucuguuuaaagaccagaaguucgaggccaugcuugugcagcaaaauagaagcgauaaauccagcugcgacgaauguaaggagaagaaacagcagaucgauacgguguuuggcgaaaagucugucauuacacuguccagcaucuucaccaaagaccucguugagaagcauaaccugcccuggucucuugggggaaaaacacaaauugaaccugagaauaagaucacccugugcaaaauccacaccaagagccccaagugucauggcacaggcgugcagaacgaggggaaacagccuuccgaaacgcccacccucucugaugagaagcaguggcacgacgugagcgucuaucugggacugacaaauugcccuuccagcaaacacccggaaaagcucgauguggagugucaagaccagauggaacggucugagauuuccugcugccagaaaaacgaggcuugucugggcgaaagcgggaugugcgacucuaaguguugccaucccuccaauuuuaucauugaggccccuggacacaugagcgauguugaauggauguccaucuucaagcccucuaaaaugcagagaauugugcgccuuaagagcggcuguaccugcuccgagucuaucugugggacacaacaugacagcccugccuccgagcugaucgcuauucaggauagccacucucucggauccagcaaaucugcgcugcgggaagacgagaccgaauccagcucuaacaagaaaaauagccccacgucccugcuuaucuacaaggaugccccggcuuuuaacgagaaggccagcauuguccucccuucucaggacgauuucucccccacaagcaaacugcagagacugcucgccgaaucccgccaaauggugaccgaccuggagcuuucuacccugcucccuaucagccaugagaaucugacaggcuccgcuaccaacaagucugaaguucccgaggaaagcgcccagaaaaauacauuuguguccuauuga

SEQ ID NO: 66979 - RNA, 1692 nt, Artificial Sequence
  derived and/or modified sequence opt5 from CCDC63__Homo_sapiens__XP_011536303
augagcgugcugaagaaaaacagacggaaggacuccgauacaccccaggagccuucugaaaaagccaaggagcaacaggcugaagccgagcuccgcaaacugagacagcaguuccggaagauggucgaaagccgcaaguccuuuaaauucagaaaucaacagaagaucgcgucucaguacaaagagauuaagacccuuaaaacggagcaggacgaaaucacccugcuccugagccuuaugaaguccucucggaacaugaaucgcagcgagaagaacuauauggaacugagacuccugcugcaaacaaaagaggauuacgaggcucucauuaagucccugaaaguucuucuggccgaacucgacgagaagauccugcagauggaaaagaagauugccaaucagaaacagaucuuugcuaagaugcaagaggccaacaauccgcggaaacuucagaaacagauccacauucuggaaacccgccucaaccuggugacagugcauuucgauaagaugcugaccacaaaugcuaaacucagaaaggagaucgaggaccugcgguuugaaaaagccgcguaugauaacgucuaccaacagcuucagcacugccugcucauggagaagaagaccaugaaucuggccauugaacagagcucucaggcuuaugagcaacgcguggaagccauggcuagaauggccgcgaugaaagaccggcagaagaaagauacgucccaguacaaccuugagauccgcgagcuggaaagacucuaugcccaugagagcaagcugaaaucuuuccugcucguuaagcugaaugaccggaacgaauuugaggaacaagcuaagagagaggaggcccuuaaagcuaagaaacacgugaagaaaaaucgcggcgaauccuucgagagcuacgaagucgcccaucugcggcuccugaaacuugccgagucugggaaccugaaccagcucauugaggauuuucuggcuaaggaagagaagaauuucgcgagauuuaccuacgugacagaacugaacaaugacauggagaugaugcacaagcgcacccagcggauccaggaugaaauuauccuccugagaucccaacagaaacuuagccacgacgacaaccauuccguucugcgccagcucgaggauaagcugcggaaaacaaccgaggaagccgacauguaugagucuaaguacggagaagugagcaaaacgcuggaucuucucaaaaauuccgucgagaagcuguucaagaagaucaacugugacgcuacaaaaauucuggugcagcucggcgaaaccgggaaggugacagauaucaaucugccccaauauuuugccauuaucgagaaaaagaccaacgaccuucugcuccuggagaccuacagacgcauucuggaagucgagggagccgaagcugagaucccucccccuuucaucaaucccuucuggggcgggagcgcccuucucaagccuccggaacccauuaaaguuaucccucccgugcugggagcggauccuuuuucugaccggcuggaugacguggagcagccccucgaucacuccagccugagacagcuuguccuggacaacuauauucucaaggagaaucgcucuaaagaagugcggggcgacagccugccggagaagguugaugacuucagaucccggaaaaaggugacaauguga

SEQ ID NO: 66980 - RNA, 1455 nt, Artificial Sequence
  derived and/or modified sequence opt5 from CCDC65__Homo_sapiens__NP_149115
augcccaagaaagagaagauggccaaaaccccucugagcgacgaaaagcagcuccugcuuuuccaacagaaacugcucgcugaggaagagauggccaagaagaaagaaagacugcuuucccaguuucugaaggauaaacucgcgaaggaggagcacaacucugcucugaaucugaacaaaaucaauacacaguggcggacggugcuccgcgaagucaagaccagagagcugcauaaggacauugaaauccuuagccaaacauucgagcggguuguggauugcaaagacaacgugauuaagucccuggccaaagaucucucugaggccgaagaacaguacgcucacgcccugcgcagccaucuucacaaugucgaccagcugcucgcucugcagagacaucggcugucccuccuggaagagucuuauaacauggaacuugaggcccugaccaaggaguuugaaacagagcgcaaaaccaucauugaucaacacgaaaaggagauccacuaccuccaggacaucuucauggcgauggaacagaauuauauugauagcgaguacgaguccaaacuggaauuucagagcauguggaacgaccuuaagaauaugaaccuggaggaaaagcauuuccucagacugcaccuggagaaucggguggaagaucucuggcgcaaauuucaagacguucugaagaacuauacagaugccaccgaggacagaaaagcugccuucgagacgcuucaggugaaggacgaaaaaucuuccaaggagaucgaaguccagaugaagaaaauucaaaagcugcaggaugcuaucaccauuagcaaaggcaagaucaugauucauucucgggaguccgaggacgaaaaucgcuacaucagaaacgauaaagagcucgugcugguucagcuucggaagcugaaggcccagcgcacacaagcgagagccgcuagccagaaaaaucucgugcggcugacccuggaaucuaacgccacacucaaggcucugagaaaaaucgucgacaagggggagaaaauucuuaagcuggccgaaaucugucgcaaguuugagaccgaggaagagaaagugcucccguucuauuccagcgugcugacgcccaaggaacaggagggcauucagaaaaacaaucuggaggagcuuacagaggaacucaccaaggucaugguugauuacaucggaauggagaacuuuuggaaacgguacaauaaggugaaacuggaacaacugucccuccagcacagacgcgcccagcugcuugacauuaacgggaagcugcgggagaugcucaagcaguaucuggauggaaucucugugagcgacgaaguccugucccaacuuaauccucucuucaucgugaacuaccagagcaaucugcugcagccccucucuauuagaaucgcucacccuggcgauaaacagcaucccacaaccuga

SEQ ID NO: 66981 - RNA, 2745 nt, Artificial Sequence
  derived and/or modified sequence opt5 from CCDC66__Homo_sapiens__NP_001012524
augggcaacaaggccaaaaucgcuaagugcccccugagaaccaaaacagggcacauucucaagagcacgcaggacaccuguaucggauccgagaaacugcuucaaaagaagccugugggcucugaaacaagccaggccaaaggggagaagaauggaaugaccuucuccucuacaaaagaucugugcaagcaguguauugacaaagauugccuccauauccagaaggaaauuagcccggcgacccccaacaugcaaaagacacggaauaccgucaacacgucccugguuggcaaacagaagccucacaaaaagcauaucaccgcugagaauaugaaaucuagccuugugugucugacacaggaccagcuccaacagauccugaugaccgugaaccaggggaaucgcucccugagccucacagaaaacggaaaggaggccaaaucucaguacucccuguaucuuaauagcauuucuaaccaacccaaggaugagaauaucaugggccuguuuaagaaaaccgaaauggucuccagcgugccugccgagaacaagucuguucucaaugaacaccaggagacguccaaacagugcgagcaaaagauugcuaucgaaaacgaguggaaacccgccgacauuuucagcacacugggcgaaagagagugugaucgguccucucuugaagcuaagaaggcccaguggcgcaaagagcuggacgaacagguggcgcucaagaaaaaggaaaaagaggucagcgaaaaguggaaugauccuuggaagaaauccgagagcgacaagaucauuugggaaaaacaucagauccuggaucaaucuagagagaccgugcugcucgagcacccguuuuccgccguuaagcaggaacugcagcggaaauggaucgaggaacuuaacaagcagauugaggacgaucgccaaagaaagaucgaagagaaaauuaucuacagcaagggggaggaacacgaccggugggcuaugcauuucgacucucugaaaagcuaucccggaucccagucucagcucuuuagccaguccacacacaagcaaccugaguacuucugcgugagccccgauacccaggaacuggccgacgucucuuccguguguaccccuacaacgggcagccagguggagcccucugaggaggagcauauugcuaaaccgaucaaggaugucguuauggccaacuccaaaaagaccaauuuucuucgcagcaugacagcgcugcucgacccugcccagaucgaagagagagaucggcgcagacaaaagcagcuggaacaccagaaagcuauuaccgcccaaguggaggagaagcggcgcaaaaagcagcuggaagaggaacagcggaaaaaggaggaacaggaggaggaacucagacuggcucaagagagagaagagaugcagaagcaguaugaagaggacauccuuaaacagaagcaaaaagaggaaauuaugacacugaagaccaacgaacucuuccagacgaugcagcgcgcccaggaacuggcccaacggcuuaaacaggagcagagaauccgcgagcuggcucaaaaggggcacgauacaucccggcucauuaagaaucugggaguggacaccauccagauggaauacaacgcgucuaauaucagcaacuccagacaugauucugacgagauuagcggcaaaaugaauaccuauaugaacuccacaaccagcaagaaagauacagggguccagacggacgaccugaauaucggaauuuuuaccaacgccgaaucucacugcggcucccucauggagcgcgauaucacaaauuguagcucucccgaaauuuccgcugagcugaucggccaguucagcaccaagaaaaacaagcaagagcuuacacaggacaagggggccucucuggaaaaagagaauaaccggugcaaugaucagugcaaccaguuuaccagaauugaaaagcaaacgaaacauaugaagaaauacccuaagcgccccgacuggaacaucaauaaacccccuaagcgguacaucccggccagcgagaaguaucccaaacagcuccagaagcagagagaagagaaaaaggugcgccggcaaauggagcugcugcaccuuguugagaaaaacaauccuggacaucucucccagaacagaggcauuagccccgagaucuuccacucuucccaccaggaaaccgagagcaagcugcgguggcaucuggugaagaaagaagaggagccucucaauauucacuccuuuucuaaggaacgcagccccuccucuccggucccugugguuaaaaacagaacacagcaaacccagaauacacugcaucuuccccugaagaacagcuccuacgagcgggaaaaucucaucucugggagcaaccagaccgagcuguccagcggaauuucugaguccagccacuucaucccuuaugugagaacgaaugaaaucuacuaucuggaucccgacgcuccucuuucuggccccuccacacaagauccgcaguaccagaacagccaggacugugggcaaaaacgccaacucuucgauucugacugcguccgggauccucugcugaaucccaacauggugaagaauagagaccgccagcaggccauucucaagggacuguccgagcuuagacagggccugcuccagaaacagaaggaacuggagagcucccugcuuccccucgcggaaaaccaggaggagagcuuuggcucuagcuucuga

SEQ ID NO: 66982 - RNA, 1815 nt, Artificial Sequence
  derived and/or modified sequence opt5 from CCDC67__Homo_sapiens__NP_857596
auggagaaccaggcccacaauaccaugggcacaagccccugcgaagcugagcugcaagaacucauggagcagaucgacauuaugguguccaacaagaaaauggauugggaaagaaagaugcgggcccuggagacgcgccuugaccugagagaucaggagcucgcgaaugcucagaccugucuggaccaaaaagggcaggaagucggacuucugcggcagaagcucgauucucuggagaaaugcaaccuggccaugacacagaauuacgaaggccaacuccagagccugaaggcccaguucuccaaacuuaccaacaauuuugagaaacugcgccuccaucagaugaagcaaaacaaaguuccuagaaaggagcugccgcaccuuaaagaagagauccccuucgaacugucuaaucucaaccagaagcuggaggaauuucgggcuaagagccgcgagugggacaaacaggagauucuguaucaaacacaucucaucucccuggaugcccagcagaaacuucugucugaaaaguguaaucaguuccaaaagcaggcucagagcuaccagacccaacucaacgggaaaaagcagugccuggaggacuccagcucugaaauuccuagacuuaucugugaucccgacccuaauugcgagaucaacgaacgggaugaguuuauuaucgagaaacugaaguccgccgugaaugaaauugcgcucagccgcaacaagcugcaggacgagaaccagaaacugcuccaagaacugaagauguaucagagacagugucaggccauggaggcuggacuuucugaagugaaauccgagcugcaaagccgggaugaccuccugcgcaucauugagauggaaagacuucagcugcaccgggagcuccugaagaucggcgaaugccagaaugcccaagggaacaaaacacgccuggagucuuccuaccuccccagcauuaaggagccugaaagaaagaucaaagagcuguucuccgucaugcaggaccagccgaaucaugaaaaggagcuuaacaaaauccggucucagcugcaacagguggaagaguaucacaauagcgagcaggaaagaaugcgcaacgagauuuccgaucucaccgaggaacugcaccagaaggaaaucacgauugcuaccguuacaaagaaggccgcgcugcuugagaagcaacucaaaauggagcuggaaaucaaggagaaaaugcuggccaagcagaaagugagcgacaugaaguacaaggcuguccggaccgaaaauacacaucucaaaggaaugaugggcgaucuggaccccggcgaguauaugucuauggauuuuaccaacagagaacagucccgccacacgagcauuaauaaacuucaguacgagaacgagcggcugagaaaugaccucgccaagcugcaugugaacgggaagucuacauggaccaaucaaaacacauacgaagagaccggacgcuaugcuuaccagagccagaucaaaguugaacaaaaugaggagcggcugucccacgauugugaaccuaacagaucuaccaugcccccucuucccccgagcacauuccaggccaaggagaugacguccccucucgugagcgacgaugacgucuuuccccugucuccucccgauauguccuuccccgccagccuggcugcgcagcacuuucuccuggaagaggaaaaacgcgccaaggagcuugagaagcugcucaacacccauaucgacgaacugcagcggcacacagaguucacccugaauaaauauucuaaacuuaagcaaaacagacauauuuga

SEQ ID NO: 66983 - RNA, 1008 nt, Artificial Sequence
  derived and/or modified sequence opt5 from CCDC68__Homo_sapiens__NP_001137301
augaccacagugacggucaccacagagauucccccuagagacaagauggaagauaacagcgcccuguacgaguccaccucugcucacaucaucgaagagacagaauauguuaaaaagauucggaccacacuccagaaaauccgcacccaaauguucaaggacgagauuagacaugauagcacgaaucacaaacuggacgccaagcauugcggcaaccuucagcagggguccgauucugagauggacccgagcuguugcucccuggaucuccugaugaagaaaaucaagggaaaagaccuucagcugcucgaaaugaauaaggagaacgaagugcugaaaaucaagcugcaagcgucucgggaggcuggcgccgccgcucuccgcaauguggcccagagacuguuugagaacuaccagacccagagcgaagagguccggaagaaacaagaagauuccaagcagcuucuccaggugaauaaacuggagaaggaacagaaacugaagcaacacguugagaaccuuaaucagguggcugagaaacuggaagagaagcauagccagauuacagaacucgagaaccugguccaacgcauggaaaaggagaaaagaacccugcucgagcggaagcugucucuugaaaauaaacugcuccagcugaaguccagcgccacauaugggaaaucuugucaggaccuucagcgcgagaucuccauucugcaagaacagaucagccaccuccaguucgugauucacucucagcaucaaaaccugagauccguuauccaggagauggaaggacugaagaauaaccucaaggagcaggauaaacggauugagaaucugcgcgaaaaggugaacauccuugaggcgcagaacaaagaacugaagacccaagucgcccucagcuccgagacgcccagaacaaaagugucuaaggcugugagcaccuccgagcugaagacagaaggcgucagcccuuaccuuaugcugauccggcuccgcaaauga

SEQ ID NO: 66984 - RNA, 1425 nt, Artificial Sequence
  derived and/or modified sequence opt5 from CCDC6__Homo_sapiens__NP_005427
auggccgacagcgcuuccgagucugauaccgacggcgccgggggaaacagcuccucuagcgcggcuaugcaguccucuugcagcuccacaagcggcgggggaggcgggggaggcggcgggggaggcgggggaaagucuggcgggaucgugauuucccccuucagacuggaagaacucacgaaucggcuggccagccuucaacaggaaaacaaaguccugaagaucgagcucgaaaccuacaaacugaaguguaaagcccuucaggaggagaaucgcgaucugagaaaggcuucuguuacaauucaggcccgggcugaacaagaggaagaguuuaucuccaacacccucuucaagaaaauucaggcccugcagaaggagaaagaaacacuggcggugaauuaugagaaggaagaggaauuucucaccaacgagcugagccgcaaacuuaugcagcugcaacacgagaaggccgaacucgagcagcaucuggaacaggagcaggaguuccaagugaauaaacuuaugaaaaagaucaaaaagcuggagaacgacacaaucucuaaacagcucacccuggagcagcugagacgggaaaagauugaucucgagaauacgcuggaacaagagcaggaagcucuugucaaccgccuguggaaaagaauggacaagcucgaggccgagaagcggauccugcaggaaaaacuugaucagccuguguccgcuccgcccagcccucgcgacauuuccauggagaucgauucucccgaaaauaugaugagacacauucgguuucugaagaacgagguugagcgccucaaaaagcaacugagagccgcgcagcugcagcauagcgaaaagauggcccaguaccucgaggaggaacggcacaugcgcgaagagaaucugagacuucaacggaagcugcagagagagauggaacgccgggaggcucucugcagacagcuguccgaaagcgagucuucccuugaaauggacgaugagcgcuauuucaacgagaugagcgcccagggacugcggccuagaaccgugucuagccccaucccuuacacaccgucccccucuagcucccgcccuauuagccccggccucucuuaugcuucccauaccgucggcuuuacaccucccaccagccugacgcgggccgggaugucuuacuauaauuccccgggacugcacgugcaacacaugggcacaagccaugggaucaccagaccuucuccccgccgguccaacagcccugacaaguucaaaagacccacacccccuccgucccccaacacccagaccccuguucagcccccucccccgccucccccucccccuaugcagcccacagugccgucugccgcuacgagccaaccuacccccucccagcacagcgcgcaucccucuucccagccuuga

SEQ ID NO: 66985 - RNA, 1317 nt, Artificial Sequence
  derived and/or modified sequence opt5 from CCDC78__Homo_sapiens__NP_001026907
auggagcacgccgcuaccacaggccccagaccugggccgcccagccggcgcguggaaaacgucguucugagagccaaggacuggcucccuggagcgcccggcgggacggcugugugggccaccucccuggaggccgaagugccucccgaucuugcucugaauaaagagcagcaacuccagaucucuaaggaacuggucgacauucagaucacaacccaucaccuucaugagcagcacgaggccgaaauuuuccaacugaaaagcgagauccuccggcuggaaucccgcgugcuggagcucgagcugagaggagauggcacaucucaggggugcgcuguuccuguggaaagcgacccgcggcauccccgcgccgcggcccaggagcuuagacacaaggcucaggucccuggacacuccgaugaccaucgguuucaagugcagcccaaaaacaccaugaauccugaaaacgagcagcaccgccugggcucuggccuccagggggaaguuaagugggcccuggagcaucaagaggcuagacagcaggcccuugugacacgggucgcgacccugggacgccaacuccagggcgccagagaagaggcucgggccgcugggcagcgccuggccacgcaggccguggugcuguguagcugccaaggacagcucagacaggcugaagcggagaaugcccggcugcagcuucaacugaagaaacucaaggaugaauacguccugagacuucagcacugugcuuggcaggccguugagcacgccgacggcgcugggcaggcccccgcgaccacagcucugcgcaccuuccucgaggccacacuggaagauauucgggccgcucauagaucccgcgagcaacagcuggcccgggcugccagaagcuaucacaaacgccucguggaccugucucggagacaugaggaacuucugguggcguaccgcgccccgggaaacccucaggcuaucuuugauaucgccucccucgaccuggaaccccuuccugucccccuggugaccgauuucagccaccgggaggaccagcauggcggccccggggcucuccugucuuccccuaagaaaagaccgggaggcgccagccaagggggaacgucugagccccagggccuggacgcggccuccugggcucagauucaccaaaagcuccgcgauuuuagccgguccacacagucuuggaaugggagcggacacuccugcuggagcggcccuagauggcugaagucuaacuuccuuuccuaucggagcaccuggacaucuaccugggccggcaccagcacaaaauccuga

SEQ ID NO: 66986 - RNA, 2853 nt, Artificial Sequence
  derived and/or modified sequence opt5 from CCDC80__Homo_sapiens__NP_955805
augaccuggagaaugggcccccgguucacaaugcugcucgccauguggcuggugugcgggagcgagccucacccgcaugcuacgauccgcggaucccacggcgggagaaaggucccccuuguuucuccugacagcucccggcccgcccgcuuucugagacauaccggacggucucgcggcauugaaagaagcacacucgaggaaccuaaccugcagccccuucaacggcgcagauccgugccugugcugcggcucgcgcgcccgaccgagcccccugcuagaucugauaucaauggggccgccguccggcccgaacagcgcccugcugccagaggaagcccccgggagaugauuagagacgagggcuccagcgcucgcucucggaugcugagauucccguccggcucuagcuccccuaacauccuggccagcuuugcggggaaaaaucgcguguggguuauuucugcuccccacgccuccgaaggauacuaucggcucaugaugagccugcuuaaggaugacguguacugugagcuggccgaaagacauauccagcagaucguccucuuccaccaagcuggcgaggaagggggaaaagugcgccggauuacauccgaaggccagauccuggagcagccucuugaucccucucugauucccaagcucaugagcuuucugaaacuggaaaaggggaaguucggaaugguucuccugaaaaagacccuucagguggaggaaagauauccuuacccgguccgccuggaggccauguaugaggugaucgaccaaggccccauucggagaaucgaaaagauucgccagaagggcuuugugcagaaaugcaaggcguccggggucgagggacagguuguggccgaaggcaacgaugggggaggcggggcuggacggccuagccucggcucugagaagaaaaaggaagaccccagacgggcccaagugccucccacacgcgaguccagagucaaagugcugcggaaacuugcugccaccgccccggcucugccucagcccccuagcacgcccagagcgaccacacucccucccgccccggcuaccacaguuacccgcucuacgagccgggccgugacagucgccgcuagaccuaugaccacaaccgccuuccccaccacacagcgccccuggacgccuuccccgucucacagacccccuaccacaaccgaggugaucacagcgcggcgccccagcguuuccgaaaaucuguacccucccagcagaaaagaucaacaucgggagcgcccucagaccacgagacggcccucuaaggcuacaucccuggagagcuuuaccaacgccccgccuaccacaaucucugagcccuccacccgcgccgcuggcccugggagauuccgggacaaucgcauggauagacgggaacacggacauagagaccccaacguggucccgggcccucccaaaccugccaaggagaagccucccaaaaagaaagcucaggauaagauucucagcaaugaguaugaagagaaauacgaccugucccgccccacagccucucagcuugaagacgagcugcaaguggggaacgucccgcucaagaaggcgaaagagagcaagaaacacgaaaagcuggagaaacccgaaaaggagaagaaaaagaaaaugaagaaugaaaacgccgauaaacuucugaaguccgagaagcagaugaaaaagucugagaaaaagagcaaacaggaaaaggagaaauccaagaagaaaaagggaggcaaaacggaacaggacggguaccaaaagccuaccaauaaacacuuuacacagagccccaagaagucuguggcugaucuccugggcuccuucgagggaaaacggagacugcuccugaucaccgccccuaaggcugaaaacaauauguauguucagcagcgcgacgaguaccuugagagcuuuuguaaaauggccacacggaagauuucugugaucaccauuuucggccccgucaacaacuccacgaugaaaaucgaucauuuccaacuggacaaugaaaagccuaugagagugguugaugacgaggaucucguggaccagcgccugaucagcgaacugcggaaggaguaugggaugaccuacaacgacuuuuucaugguccuuacagauguggaccucagagugaaacaguauuacgaaguuccgauuaccaugaagucugucuuugaucugaucgacacauuccagagccgcauuaaagauauggagaagcagaaaaaggagggaaucgugugcaaggaagacaaaaagcaaucccuggagaauuuucucagccgguucagauggcggcgcagacugcuugugauuucugcgcccaacgaugaagacugggccuauucccagcaacugagcgcucucuccggccaggccuguaauuuugggcugcggcacaucaccauccugaaacuucucggagucggcgaggagguugggggcgugcuggaacuguucccuauuaacggaucuagcguggucgagcgcgaagaugugcccgcucaucucguuaaggacaucagaaauuacuuucagguguccccugaguacuucucuaugcugcuugucggcaaagaugggaacguuaagagcugguaucccuccccgauguggucuauggugauuguguacgaccugaucgauagcaugcagcuccggagacaagaaauggccauucagcagucccugggaaugcgcugcccugaggacgaguaugccggcuacggguaucacagcuaccaucagggauaucaagauggcuaccaggacgacuaccggcaccacgaaucuuaucaucacggguaccccuauuga

SEQ ID NO: 66987 - RNA, 1242 nt, Artificial Sequence
  derived and/or modified sequence opt5 from CCDC83__Homo_sapiens__NP_001273088
auggagaacagcggcaaggccaauaaaaaggacacccacgaugggcccccuaaagaaaucaagcugccgacaagcgaggcucuccuggacuaccagugccaaauuaaagaagaugccguggagcaguucauguuucagaucaagacgcuuagaaagaaaaaccagaaguaucaugaacggaauagccgccugaaagaggagcaaauuuggcacaucagacaucuccugaaggaacuuagcgaggaaaaagcggagggacugcccgucguuacccgggaggacguggaagaggcuaugaaggaaaaguggaaauucgagcgcgaucaggaaaagaaccucagagacaugcggaugcagauuuccaaugccgagaaacuguuucuggagaagcucucugaaaaagaguacugggaagaguauaagaacgugggcagcgaacgccacgccaaacugaucacaucccuucagaaugauaucaacaccgucaaggagaaugcugagaagaugucugaacauuacaaaauuacacuggaggacaccagaaagaaaaucauuaaggaaacacuccugcaacuugaucagaaaaaggagugggccacccagaacgcugugaagcugaucgacaaagggagcuaucucgaaauuugggagaaugauuggcugaagaaagagguugccauccaccggaaggaaguggaggaacugaaaaacgcgauucacgagcucgaggccgaaaaucugguccuuaucgaccagcuguccaacugucgccucguggaucugaagaucccuagacggcuuuaccugacgcaagcugccggacucgagguucccccugaagagaugagccuggaacugcccgagacccauauugaggaaaagucugagcuccagccuacagaaguggagucccgcgaccugaugucuucuuccgacgaaagcaccauccuucaccugucucaugaaaauuccauugaggaucuccaguaugucaaaaucgacaaggaagagaacagcggcacagaguucggggauaccgacaugaaauaccugcuuuacgaggaugaaaaggacuuuaaagauuaugugaaccugggaccgcucggcgugaagcugauguccgucgagucuaagaaaaugcccauucacuuccaagagaaggaaaucccuguuaaacuguacaaggacgugagaagccccgagucccacaucacguauaaaaugaugaaguccuuucucuga

SEQ ID NO: 66988 - RNA, 1662 nt, Artificial Sequence
  derived and/or modified sequence opt5 from CCDC85A__Homo_sapiens__NP_001073902
augagcaaggccgcuggcggggccgcggcugccgccgcugccgcugaguccugcucucccgccccugcgggaagcuccgccgcuccgcccgccccuguggaagaccugucuaaagucagcgaugaggaacuccugcagugguccaaggaggaacuuaucagaucucugcggcgcgcugaggccgagaaaguuagcgcgaugcucgaccacuccaaccugauuagagaagugaaucggcgccuucaacugcaucucggcgagaucagagggcugaaggauauuaaccagaaacugcaggaagacaaucaggagcuccgggaucuguguugcuuccuugacgaugaccgccaaaagggaaagagagugagccgggaguggcagcgccugggcagauacaccgccggggucaugcacaaagaaguggcucucuaucugcagaagcugaaagaucuggagguuaagcaggaagagguggucaaagaaaacauggagcucaaggagcugugugugcugcucgacgaagagaagggagccggcugcgcuggcucucgguguuccaucgauagccaagccucucugugccagcuuacagccuccacggcucccuacguucgcgacgugggggauggaagcucuaccuccagcacaggcuccaccgacucuccugaccaucacaaacaucacgcgagcuccgggagccccgaacaucugcagaagccuagaucugagggauccccggaacacagcaaacaccggucugccagccccgagcauccucagaagccccgcgcuuguggcacaccugauagacccaaagcccucaaggggccguccccugagcaccacaaaccccugugcaagggaucuccugaacaacagcggcauccccaccccggcagcuccccugagacccuuccgaagcauguccugagcggcucucccgaacacuuucagaaacauagauccgggagcucuccugagcacgcccgccacuccggaggcagccccgaacaucuccaaaagcacgcucuugggggaucccuggagcaucucccucgggccagaggcacaucucccgagcaccugaaacagcacuaugggggaagcccggaccauaagcacggcggcggguccggaggcucugggggaagcggcgggggcucccgcgaaggaacccuucggagacaggcgcaggaggauggcagcccucaucaccgcaauguguacucugggaugaacgaauccacgcugagcuaugugcggcaacucgaggcuagaguccgccagcuggaggaagagaaucggaugcuuccccaggccucucagaacagacgccaaccucccaccagaaauuccagcaacauggaaaaaggauggggcucucgggcccggcgcguucugcagugguggcagggguguagaggaauuggccggugccucccuacacugcccgggagcuucagacuguccagcggcgcugacggaucuaauuccagcccgaacuccgccgcuucuuuuagcggccaugccaccccuucccagcaacccgagcccguggugcacucucucaaggucguguggcgcaagcugggggaugcggccggaagcuguccuggcauccggcagcaccuuuccgggaaucaguacaaaggaccgauguga

SEQ ID NO: 66989 - RNA, 1083 nt, Artificial Sequence
  derived and/or modified sequence opt5 from CCDC86__Homo_sapiens__NP_077003
auggacacaccccugagacggagccgcagacucggcgggcugcggccugaguccccggaaucucuuaccagcgugucccgcacgagacgggcccuggucgaguucgaaucuaaccccgaggaaacccgcgagccuggaagcccucccuccguucagagagcuggccucgggucucccgagcggccuccgaagacaagccccggauccccucgccugcaacagggcgccgggcuugaaagcccccagggacagccugagcccggcgcggcuucuccgcaaagacagcaggaucugcaccucgaauccccucagcggcaacccgaguacagcccugagucuccccgcugccagcccaaaccuuccgaagaggccccgaaguguagccaggaccagggcgugcuggccucugaacuggcucaaaauaaagaggaacucacccccggggccccucagcaucagcugcccccugugcccggauccccggagccuuaucccggccaacaggcuccugggcccgagccuagccagccccuucuggaacucacaccgagagccccuggaucuccccggggccagcacgagcccuccaagccuccgcccgcgggggaaaccgucacaggaggcuuuggcgccaaaaagcgcaaggggagcuccagccaagcuccugccucuaaaaagcugaacaaagaggaacuucccgugaucccuaagggaaaacccaaguccggcagaguuuggaaggaucggagcaaaaagagauucucucagaugcugcaggacaaaccucuccgcaccagcuggcagcggaagaugaaagagagacaagagcgcaagcuggcuaaagauuuugcccggcaucuggaagaggaaaaggagagacgccggcaggaaaagaaacagagacgcgcggagaaucucaagcggagacuggagaacgaacgcaaagccgaggugguccaggugauucggaaucccgcuaaacuuaagagagccaagaagaaacaacugcgguccaucgaaaagcgcgacacgcucgcucugcuucagaaacagccgccucagcaacccgccgccaagauuuga

SEQ ID NO: 66990 - RNA, 5613 nt, Artificial Sequence
  derived and/or modified sequence opt5 from CCDC88A__Homo_sapiens__NP_001129069
auggagaacgaaaucuucacaccccugcucgagcaguuuaugacaagcccucuggugacgugggucaagaccuucggcccgcuugccgcugggaauggaaccaaccuggacgaauacguugcccucguggauggcguguuucugaaucaagucaugcuucagauuaaccccaaacuggagucccagagagugaauaagaaaguuaacaaugacgcgucucuccggaugcacaaccuguccauccuggugcgccagauuaaguucuauuaccaagaaacccuccagcagcugaucaugaugucccuuccuaauguccugauuaucgggaaaaaccccuuuucugagcagggaacagaggaagugaagaagcuccugcuucugcuccugggcugcgcuguucaaugucagaaaaaggaggaguucaucgagcgcauucaggggcuggauuuugacaccaaagccgccguggcugcccacauccaggaggucacacacaaucaagaaaacguguucgaucuccaguggauggaggugaccgacaugagccaggaagauauugagccucugcuuaagaauauggcucugcaucucaaacggcugaucgacgaacgcgaugagcacuccgagacgauuaucgaacuuucugaggaaagagacggacugcauuuucucccccacgccagcuccagcgcgcaaucuccuugcggcuccccgggcaugaagcggaccgagagccgccagcaccugucugucgaacuggccgaugcuaaggccaaaauuagacggcuccgccaggagcuggaggaaaagacagagcagcuucuggacuguaaacaagaacucgagcagauggaaaucgagcugaagagacuucagcaggagaacaugaaucugcucuccgaugcucggagcgcccgcauguauagagacgaacuggacgcgcugcgggagaaagccguucgcguggauaagcucgaaucugagguguccagauacaaagagcggcugcaugacaucgaguucuauaaggcuagagucgaggaacuuaaggaggauaaccaagugcugcucgaaaccaaaacaaugcuggaggaccagcuggaggggacccgcgcccggagcgauaaacuucacgaacucgagaaagaaaaccugcagcugaaggcuaaacuccaugacauggagauggaaagagauauggaccgcaagaagauugaggagcugauggaagagaauaugacgcuugaaauggcccagaaacaauccauggaugagucucugcaccucggaugggaacuggagcagaucagccggacauccgagcugagcgaagcuccccaaaagucucuuggccacgagguuaacgaacucaccuccagcagacugcugaaacucgagauggagaaucagucucugacaaagaccguggaagaacuucgcaccacagucgacagcguggaagggaacgccuccaaaauucugaagauggagaaggaaaaucaacggcucucuaaaaagguugagauccuggagaacgaaauugugcaggagaaacagagccugcaaaauugccagaaccuuuccaaggaucucaugaaagaaaaggcgcagcuggagaagacgaucgaaacccugagagagaauagcgagcgccagaucaaaauucucgaacaagagaacgaacaucugaaucagacagucucuucccuucggcagagaagccagaucucugccgaggcucgcgugaaggacauugaaaaagagaacaagauccugcacgaguccauuaaagaaaccagcuccaagcucucuaaaaucgaguuugaaaagcggcaaaucaagaaagagcuggagcauuacaaggaaaaaggagagagagccgaagaacuggaaaaugagcuucaccaucucgagaaggaaaacgagcugcugcagaaaaagauuacaaaucucaagaucaccugugagaagauugaggcccuggaacaggagaacagcgagcuugaacgggagaaccgcaagcugaaaaagacgcucgacuccuucaaaaaucugacauuucagcuggaaucucuugagaaggaaaacagccaacuggaugaggagaaucucgaacugagacggaacgucgagucccucaagugcgcuagcaugaaaauggcccagcugcagcuugaaaauaaggagcuggagucugaaaaagagcaacucaagaaaggccuggaacugcuuaaggcguccuucaagaaaaccgagagacuggaagugagcuaucaggggcucgacaucgagaaccagcgccugcagaagacccucgaaaauucuaacaaaaagauucaacagcuggaauccgagcuucaggaucuggaaauggagaaucagacacuccagaagaaccuggaagaacugaagaucagcucuaaacggcuugagcagcuggaaaaggagaauaagagccucgaacaggagaccucccagcuggaaaaagacaagaaacaacucgagaaggagaacaaaagacugcgccagcaggcugaaauuaaggauacaacgcuugaggaaaauaacguuaagaucggaaaucuggagaaagagaacaagacccugagcaaagaaaucggcauuuacaaggagucuugugugagacucaaagaacuggagaaggaaaacaaggagcuugucaaacgggccacaaucgacauuaagacccuggugacacuccgcgaggaucugguuuccgaaaaacucaagacccagcaaaugaauaacgaccuggagaaacuuacgcacgaacuggagaagaucggccugaauaaggaaagacuccugcacgaugagcagagcaccgacgaucgguacaaacuucuggaguccaagcucgaaucuacacugaaaaagagccucgagauuaaagaagagaagaucgccgcucuggaagcccgccuugaggaguccaccaacuauaaucagcaacugagacaggaacugaagacagugaaaaagaacuacgaggcucucaaacagcggcaggacgaagagagaaugguccaaucuagcccucccaucuccggggaggauaauaagugggaaagagagucucaggaaaccacgcgggagcugcuuaaagugaaggaccgccugauugaaguggagagaaacaaugccacacuccaggcggagaaacaggcccugaagacccaacucaagcagcuggaaacacagaacaauaaccuucaggcucaaauccuggcccugcagcggcagaccguuagccuccaagagcagaauaccacacugcagacgcagaacgcuaaacuucaagucgaaaauuccacccugaacagccagucuacaucccucaugaaccagaaugcccagcugcugauucaacagagcucucucgagaacgaaaaugaguccgugaucaaggagagagaagaccuuaaaagccuguaugauucucugauuaaggaccaugagaaacucgaacugcuucacgagcgccaggcguccgaauacgagagccugaucuccaagcauggaacccucaagagcgcccacaaaaaccuggagguggaacaccgggaucuggaggacagauauaaucagcuccuuaagcaaaaaggccagcuggaagaucuggagaagaugcucaaagucgagcaggaaaagaugcugcuugagaacaagaaucaugaaacaguggcugccgaguacaaaaagcugugcggggaaaacgaccgccucaaucacaccuauucucagcugcugaaagagacggagguucuccaaacagaucauaagaaccuuaaaagccugcugaauaacuccaagcucgaacagacccggcuggaggcugaguucucuaaacuuaaagagcaguaccaacagcuggacaucaccagcacaaagcucaauaaccagugugaacugcugucccagcucaaaggaaaucuugaggaggaaaacagacaucugcuggaucaaauucagacccucaugcugcagaaucgcacacuucuggagcagaacauggaaucuaaggaccucuuucauguggagcaacggcaguacaucgauaaacugaacgaacugagacgccagaaggagaaacucgaggaaaagauuauggaccaguauaaguucuacgauccuuccccuccccggagacggggcaauuggaucacgcuuaaaaugcgcaagcugauuaaauccaagaaagacaucaacagagagcggcaaaagucucugacccucacacccacccgcagcgacuccagcgaaggguuucugcagcuuccccaccaggauucucaagacuccagcucugucggauccaauagccuggaggauggccagacacucggcaccaagaaauccucuaugguggcccugaagagacugccuuuccuccggaacagacccaaagacaaggauaaaaugaaggccugcuaucgccggagcauguccaugaaugaccuuguucagagcauggugcuggcugggcaguggacgggaucuaccgagaaccuggaaguccccgaugacaucuccacaggcaagagacgcaaagagcucggggcgauggccuuuagcaccacagcuauuaauuucucuaccgugaacagcuccgccggauuucggucuaagcaacugguuaauaacaaagauacaaccagcuucgaagacaucuccccucagggcgugucugaugacagcuccacggggagcagaguccacgccucucgcccggcuucccuugacagcggccggacauccaccucuaauagcaacaauaacgccucccugcaugaggugaaggcgggagcugugaauaaccagucuagaccccagagccacuccagcggcgaauuuucucuccugcaugaucacgaggccugguccagcucuggguccagcccuauucaauaccugaaacgccagaccagaucuagccccguccuccagcauaagaucuccgagacacuugaaucucggcaccacaagauuaaaaccggaagcccuggcuccgagguugugacgcugcagcaauuccuggaagagagcaacaagcucacauccgugcagaucaaaucuagcucccaggaaaaucugcuugacgaggucaugaagucucugagcguguccucugauuuucucgggaaagacaagcccguuagcuguggacuggcccgcuccgugagcggcaaaaccccgggggauuucuaugacagacggacaaccaagccugaguuucugcgccccggcccuagaaagacagaagauaccuacuucauuucuuccgcuggaaaacccacgccuggcacccaagggaagaucaaacucgucaaggagagcucucuuucccggcagagcaaagacucuaaccccuaugccacacugccgagagcguccagcgugaucuccaccgcugaaggaacaacccgccggacgagcauucaugauuuccugacaaaggacucuagacucccuaucagcguugauagcccgcccgccgccgcugacucuaauaccacagccgcuagcaacguggauaagguccaggagucccgcaauucuaaaagccgguccagagaacagcaaucuagcuga

SEQ ID NO: 66991 - RNA, 6087 nt, Artificial Sequence
  derived and/or modified sequence opt5 from CCDC88C__Homo_sapiens__NP_001073883
auggacgugaccgucuccgagcugcucgaacuguuccuucagagcccccugguuacaugggugaagacguuuggcccuuucgggucuggaagccaagacaaccucaccauguacauggaccugguggauggcaucuuucuuaaucagauuaugcugcagaucgaccccagacccacaaaccagcggauuaauaaacacgucaacaaugaugugaaccuccgcauccaaaaucugaccauucugguuagaaacaucaagacauauuaccaggaggugcuccagcagcugaucgucaugaaucuuccuaacgugcugaugauugggcgggacccccucuccggaaaaucuauggaagagaucaagaaaguucugcuucuggugcucggcugcgccguccaaugugaacgcaaggaggaguucauugaaagaaucaagcagcuggauauugagacccaggcugggaucguggcccauauucaggaagugacacacaaucaagagaacgucuuugaccugcaguggcucgagcugccugauguugcgcccgaagaacuugaagcucugagccgguccauggugcuccaucugcgcagacuuaucgaccagcgggaugagugcaccgaacugaucguggaccucacgcaagagcgcgauuaucugcaggcccagcacccuccgucucccauuaaaagcuccagcgccgacucuaccccuucccccacaagcucucuguccagcgaggacaagcagcaucucgcugucgaacuggccgauaccaaagcuagacuucggcgcgugagacaagagcuggaagacaagacagagcagcucguugauacccggcacgaaguggaccagcugguccuugagcugcagaaagugaagcaagagaauauccagcucgccgccgaugcccgcucugcuagagccuaccgggacgaacuggauucccugagagagaaggcuaaccgcguugaacggcucgagcuggaacuuacgagauguaaagagaagcugcacgacguggauuucuauaaagcccgcauggaggaacuccgggaggacaauauuauccugauugaaacaaaggcgaugcuggaggagcagcuuaccgccgcuagagcccgcggagauaaaguccaugaacucgagaaggaaaaccugcagcugaaaagcaagcuccacgaccuggagcuugaccgggauacagacaagaaaagaaucgaggaacugcucgaggaaaacauggugcuggagaucgcucaaaagcaguccaugaaugaaucugcccaucugggcugggagcuugaacagcucagcaaaaacgccgaucuguccgacgcuagccgcaagucuuuugucuucgagcugaaugagugcgcguccagccggauucucaaacuggaaaaggagaaccagucucuucaaagcaccauccagggccugagagaugccucccucgugcuggaagagucugggcugaaguguggagaacuugagaaagagaaucaccagcucagcaagaaaauugaaaagcugcaaacccagcuggagcgcgaaaaacaguccaaccaggaccucgagacacugagcgaggaacuuauccgggagaaggaacaacugcagucugauauggagacgcucaaggcugacaaagccagacagauuaaggaucuggaacaggagaaagaccaccugaaucgggccauguggucccuucgcgagagaagccaaguuucuuccgaagcucggaugaaggauguggagaaagaaaacaaggcccuccaucagaccgucacagaggcgaauggcaagcugagccagcuggaauuugagaaaagacagcuccaccgcgaccuggagcaagcuaaggaaaaaggggagcgggccgaaaaacuugagagagaacugcagcgccuccaggaggagaacggaagacuggcccggaaagugaccucccuggaaacagcuaccgagaagguugaagcccuugagcaugagucucaaggccugcagcucgaaaaucgcacgcugagaaaaagccucgauacacugcagaacgugucccuucagcuggaggggcucgaacgggacaauaagcaacuggacgcugagaaccuggaacuucgcagacuggucgagaccaugcgguucaccucuacaaagcucgcccagauggagcgcgaaaaucagcagcuggagagagaaaaagaggaacuccggaagaacguggaucugcuuaaagcgcugggaaagaaaagcgagcgccucgagcuguccuaccaaagcgugucugccgaaaaccugagacuucagcagucccuggaguccucuucccacaagacccagacacucgaaagcgagcugggcgaacucgaggcugagcggcaagcccugagacgcgaccuugaagcucugcggcuggccaaugcgcagcucgagggcgccgaaaaggauagaaaagcucuggagcaggagguugcccagcuugaaaaggacaaaaagcugcucgagaaagaagcuaagcgccuguggcaacaggucgagcucaaggaugccgugcuggacgauucuacggccaaacuuagcgcuguggaaaaggagucccgggcgcuggacaaagagcuggccagaugccgcgaugcugccgggaagcucaaagaacuggagaaggacaaccgggaucuuaccaagcaggucacagugcaugccagaacccugacaacccuccgcgaagaccugguucucgagaaacugaaaucccaacagcuuucuuccgaacuggauaaacugagccaggagcucgagaaggugggacugaaucgggaacuucugcuccaggaggacgacuccggcucugauacgaaauauaagauccuggaagggagaaacgagagcgcucucaaaaccacacuggccaugaaggaagagaagaucguccuucuggaggcgcaaauggaagagaaggcuucccugaaucggcagcucgaaucugagcugcagaugcuuaagaaagagugugaaacccugcgccagaaccaaggagagggccagcaccuccagaauagcuuuaagcacccugccgggaaaacagccgcuucccaucagggaaaggaagccuggggccccggccacaaggaggcgaccauggaacugcugagagugaaagaccgggcuauugagcucgagcgcaacaaugccgcccuucaagcugaaaagcagcugcugaaagagcagcuccaacaucuggaaacgcagaacguuacauucucuagccagauccuuacccugcagaagcaauccgccuuucuccaggagcacaauacaacccugcagacccagacagcuaaacugcaaguggaaaacagcacgcucucuucccagagcgccgcgcuuaccgcccaguacacacugcugcagaaucaccauaccgcuaaggagacagagaacgaaucucuccaaagacagcaggagcagcugaccgccgcuuacgaagcccuucugcaagaucacgagcaucucgggacgcugcacgaacggcaguccgccgaguaugaggcucugauuagacagcauagcugccucaagacacuucaccgcaaucuggaacuggagcacaaagaacucggagagcggcauggcgacaugcugaagagaaaagcggagcuugaggaacgcgaaaagguccugaccaccgagcgggaagcccuccaacaggagcagagaacaaacgcucuggccaugggggagaaccagcgccugcggggagaacucgauagagugaauuuccuucaccaucaacugaaaggcgaguacgaggaacugcacgcccauaccaaggaacucaagacaucucugaacaaugcucagcuugagcugaaccgcuggcaggccagauucgacgagcucaaagaacagcaccaaacgauggauaucucccugaccaagcuggacaaucacugugagcuccuuagccggcugaaagggaaccuggaagaggaaaaucaucaccuccugucccagauucagcuucugagccagcaaaaccagaugcuccuggagcagaauauggagaacaaggaacaauaucaugaggaacagaaacaguacaucgauaagcugaaugcgcuccgcagacacaaggagaaacuugaggaaaagauuauggaccaguauaaauuuuacgauccgccucccaagaaaaagaaccacuggaucggcgcuaaagcccugguuaagcugaucaagccuaaaaaggagggaucucgggaacgccucaaaagcacaguggacagcccgcccuggcaacuggagucuagcgacccugccuccccggcugccucucagccccuuagaagccaggcggaaaauccugauacccccgcucugggcuccaacugcgccgaggagcgggacgcccauaaugggucugucggaaagggcccuggggaucucaaacccaagagaggaagcccgcaccgcggcucccuggaccggacagaugcuagcaccgaccuggccaugagaucuuggccuuccgaacucgggagccgcacguguucuaccuccgcuacaaccacagcccccagcaacuccaccccuauugcgcggcaucccggcagaacaaagggauauaacucugaugacaaucuuugcgagccuagccuggaguucgaggugcccaaccaccggcaguacgugucccgcccgagcucucuggaauccagcagaaauaccucuagcaacuccucuccucucaaucugaaaggcagcuccgagcaacuucaugggcggucugagagcuuuuccagcgaagaucugauccccucucgcgaccucgccacgcugcccagagaggcuuccacaccuggacggaacgcccugggccgccacgaauacccgcuccccagaaaugggccucuuccccaggagggagcucagaagcggggcaccgccccucccuaugucgggguucgcccuugcagcgccucccccucuagcgaaauggugacccuggaggaguuccuggaagaguccaacagaucuagcccgacacacgauaccccuuccugucgggacgaucuccugagcgacuacuuuagaaaggcuucugaucccccugcgauuggcggacagcccggcccgccugccaagaaagaaggggcuaagaugcccacgaauuucguggccccuacagucaagauggccgcucccaccuccgagggacgcccccuuaaaccuggccaauaugugaagccgaacuuucggcugacagaggccgaagcgcccccuagcguugcucccagacaggcccagccuccccaaucucucucccuggggcgcccucggcaggccccggugcccccugcuagccaugcccccgcgucuagaagcgccucccugucucgcgcuuucagccucgccuccgcugaucuucugcgggccagcggaccugaggcuugcaaacaggaaagcccccagaagcugggcgccccggaggcgcucgggggcagagaaaccggaucucacacacugcaaagcccugcgccgcccuccucucauagccuugcucgcgagcggaccccucuggucggcaaagccggguccucuugucagggacccggcccuagaagccgcccgcucgacacgcggagauuuucccuggcucccccuaaggaggaacgccuggcuccccuccaccagagcgccaccgccccugcgaucgccacagcuggggccggagccgcugccgcgggcucuggcuccaauagccagcugcuucacuucucucccgccgcugccccggcugccagaaccaagccuaaagcgcccccucgguccggggagguggccacaauuacccccguucgcgcuggacugagccucucugaaggcgauggggugccuggacaaggcugcuccgaggggcugcccgccaagagcccgggaagauccccugaccuugcuccccaucugggccgggcccucgaagauuguagcagaggcucugucagcaaauccucucccgcuagcccugagcccgggggagacccccagacggugugguacgaguauggcugcguuuga

SEQ ID NO: 66992 - RNA, 1617 nt, Artificial Sequence
  derived and/or modified sequence opt5 from CCDC8__Homo_sapiens__NP_114429
augcugcagaucggcgaggacguggauuaccuccugauucccagagaaguccggcuugccgggggaguuuggcgcgugaucagcaagccugcuaccaaagaggccgaguucagagagcggcugacacaauuucucgaagaggagggccgcacgcuggaagacguggcgagaauuauggagaaguccaccccgcaucccccucagcccccuaaaaagcccaaagaaccucggguccgcagacgggugcagcagaugguuacaccgcccccucgccuuguggucgggaccuaugauucuagcaacgcuuccgacucugaguucagcgauuuugagacauccagagacaagucucggcaaggaccccgcagaggcaagaaagugcggaagaugccuguuagcuaccugggguccaaauuccucggaagcgaucuggaaucugaggacgaugaagaacugguggaagccuuucuccgcagacaggagaagcagcccuccgccccgccugcucggagacgcgucaaucugcccgugccuauguucgaggacaaccuuggcccccagcugagcaaagccgaucgguggagagaauaugugucucaagucuccuggggcaagcucaagcgccggguuaaagggugggcucccagagccggaccuggcgugggggaggcgcgccuggccagcaccgcuguggaaucugccggagucuccagcgcuccggagggcacaucccccggggaccggcuuggaaaugccggcgaugugugcguuccucaggcgucucccagacgcuggcggccuaagaucaacugggccagcuuuagacgccggagaaaagaacagaccgcucccacgggccagggggccgacauugaggcugaccaaggaggcgaggccgccgauucccagcgggaagaggcuaucgcggaccagcgcgaaggggccgcuggaaaucaaagagccggcgccccggcugaucagggggccgaggcggcugacaaccagcgggaagaggccgccgauaaucagagagcuggagccccugcugaggaaggcgccgaggcggccgacaaccaacgcgaagaggcugccgauaaucagcgggcugaggcccccgcggaccagagaagccagggcaccgauaaccaccgcgaagaggccgcugacaaucaaagagccgaagcuccugccgaucaggggucugaggugacagacaaccagcgggaagaggccguccacgaccagcgcgagagagcucccgcggugcaaggagccgauaaucagcgggcucaggcccgcgccggccagagagcugaagccgcgcauaaccaacgggcuggggccccuggaauccaggaggccgaaguuuccgcugcccagggcaccacagggaccgcgcccggcgcucgcgccagaaagcaagugaaaacgguccgguuccagacaccgggacgcuuuagcugguucuguaagagacggagagccuuuuggcacaccccucgccugcccacacuccccaaacgggugccuagagcuggcgaggcccgcaaucugcggguccugagagcugaagcccgcgcggaggccgagcagggggaacaggaggaccaacucuga

SEQ ID NO: 66993 - RNA, 1326 nt, Artificial Sequence
  derived and/or modified sequence opt5 from CCDC91__Homo_sapiens__NP_060788
auggacgaugacgauuucggcggguuugaggccgcugaaaccuucgacggaggcagcggggagacacagacgaccucccccgccaucccuugggcggcuuuuccggccgugucuggaguccaccugagccccuccucuccugaaauuguucucgauagagaccauagcuccucuaucggcugccugagcuccgaugccauuaucagcucucccgagaacacacacgcugccaauuccauugugagccaaaccaucccuaaggcucagauccagcagucuacacauacccaccuugacauuucccuguucccccucgggcugacagaugagaaaagcaacggaaccaucgcccuuguggacgauucugaggacccuggcgcgaaugucuccaacauucaacugcagcagaagaucagcucccucgagauuaaacugaaggugucugaagaggaaaaacagcggaucaagcaagauguugagagccugauggagaagcauaaugugcucgaaaaaggcuuucugaaggagaaagaacaggaggccauuuccuuccaggaccgcuacaaggaacuucaggagaaacacaagcaagagcuggaagacaugagaaaggcugggcacgaggcccucagcaucaucgucgaugaauauaaagcucugcuucagucuuccgugaagcagcaaguugaggccauugaaaaacaguacaucagcgcgauugagaagcaggcccauaaaugugaggaacugcucaacgcucagcaccaacggcugcuggagaugcucgacacggaaaaggagcugcuuaaagaaaagaucaaggaggcccugauucagcagucucaggagcaaaaagaaauccucgagaagugccuggaagaggagcgccagagaaauaaagaagcucuugugagcgccgccaagcuggagaaagaagcugucaaggaugcggugcucaagguggucgaggaagaacggaaaaaccuggagaaggcccaugcugaggaacgcgaacuguggaaaaccgagcacgccaaggaccaggaaaaaguuucccaggagauccaaaaggccauucaggagcagagaaagaucucucaggaaacagugaaagcugccauuaucgaggaacaaaagcggagcgagaaagcgguggaagaggcugucaagcgcaccagagaugagcucauugaauauaucaaagagcagaagcggcuggaccaggugauccgccaaagaucccuuagcucucuggaacucuuucuguccugugcccagaagcagcuuagcgcccugauugcuacagagccgguugauaucgaguga

SEQ ID NO: 66994 - RNA, 972 nt, Artificial Sequence
  derived and/or modified sequence opt5 from CCDC94__Homo_sapiens__NP_060544
augagcgagagaaaggugcugaacaaauacuaucccccugacuucgauccguccaagauccccaaacucaagcugccuaaagaccggcaguacgucguucgccuuauggcccccuuuaauaugagaugcaagaccuguggcgaauauauuuacaaggggaaaaaguucaacgcucggaaagagacagugcaaaaugaaguguaucugggacucccuaucuuucgcuucuacauuaagugcacgagaugucuggccgagaucaccuuuaaaacagaucccgaaaacaccgacuauacaauggagcacggcgcgacccggaauuuccaggcugagaaacuucuggaagaggaagagaagcgcguccagaaggagagagaagaugaggaacucaacaauccuaugaaggugcuggagaaccggacaaaagacucuaagcuggaaauggagguucucgagaaucugcaggaacuuaaagaucugaaccaacgccaggcccauguggacuuugaggccaugcucagacagcaccggcugagcgaagaggaacgcagacggcagcaacaggaggaggaugaacaggagaccgcugcccuucuggaagaggcucgcaagagacggcuccuggaagacuccgauucugaggacgaggccgcgccgagcccccugcagccugcccucagacccaauccuacggcuauucuggaugaagcccccaaaccgaagcgcaaggucgaggugugggaacaauccguugggucucuuggaagccggccuccccuguccagacucguggucgugaaaaaggcuaaagccgacccugacugcagcaacggccagccccaggcggcccccaccccuggggcuccgcaaaaucgcaaggaggccaaccccacaccucugacccccggagcuucuucccuuagccagcugggcgccuaccucgauucugacgauuccaauggcagcaacuga

SEQ ID NO: 66995 - RNA, 1032 nt, Artificial Sequence
  derived and/or modified sequence opt5 from CCDC97__Homo_sapiens__NP_443080
auggaggccguggcuaccgccacagcggcuaaggaacccgacaaaggcugcaucgagccugggccgggacacuggggcgaacugagcagaacgcccgucccuuccaagccccaggauaaaguugaggccgccgaagcuaccccuguggcccucgacucugauacaagcggggcugagaacgccgcgguguccgccaugcugcaugcugucgccgcuucucggcuucccguguguagccaacagcagggagagccugaccugaccgaacacgagaagguugccauucucgcgcagcuguaccaugaaaaaccgcuuguguuccuggagcgcuuuagaacaggccuccgggaggaacaccuggccugcuucgggcauguccgcggagaucacagagcugacuuuuauugugccgagguggcucggcaaggcaccgcccgccccagaacacugcggacccgccucagaaaucggcgcuacgccgcucugagagaacuuauccagggcggggaguauuucuccgaugaacagaugcgguuucgcgcgccucugcucuacgagcaguauauuggacaauaccugacgcaggaggaacuuucugccagaacccccacacaccagccucccaagccgggcagcccugggcggcccgcuugcccucuguccaaccuccugcugcagagcuaugaggaaagagagcuccaacagcgccugcuucagcaacaggaagaggaggaagccugucuggaggaagaggaagaggaggaagacucugaugaggaagaccagcgguccggaaaggauagcgaggccuggguucccgacucugaggaaagacucauccugcgcgaggaguucaccucccggaugcaucagagauuucuugauggcaaagacggggacuucgauuacagcacaguggacgauaaucccgacuuugauaaccuggacauugucgcucgcgaugaggaagaacgguacuucgacgaggaggaaccugaagaugccccgucucccgagcucgacggagauuga

SEQ ID NO: 66996 - RNA, 2508 nt, Artificial Sequence
  derived and/or modified sequence opt5 from CCHCR1__Homo_sapiens__NP_001099033
auguggccccacagcgccggcgcuagaccuugggccuccacccugacagggaaggacccgcgggugauggcgugcuggugucucgauggacugcccucuggccuugcugagccuuggcgcgaacuguggagauggcggagccgcccccuccauugcgucccucccuucuccccucuggccagaucuagccgggaccaccgcaaccuuagacggcgcgggaauaucgauggauggagacagaaccuggagccguccaauaacguugaaauguuucccccuucuggccaucaagacgugagcgagcggcgccucgauacgcagagaccccaggugaccaugugggaacgggacgucuccagcgaucgccaggagccugggagacggggaagaucuuggggccuggagggcucccaagcccugagccagcaggcugaagugauuguucgccagcuccaagagcugcggagacuugaagaggaggugcgccugcuccgggaaacaucucugcagcagaaaaugagacuugaggcccaggcuauggaacuggaggcccucgcgcgcgccgaaaaggcugggcgggccgaggcugagggacugagagccgcgcuggccggcgcugaagucgugcgcaaaaaucucgaggaagggucccaacgggagcuggaagagguucagagacuucaccaggagcaacugagcucucucacccaggcccaugaagaggcucuguccagccuuacauccaaggccgaaggacuggagaaaucucucagcucccuggaaacccgccgggccggcgaggcuaaggagcuggcggaagcccagagagaggcugaacuccugcggaagcagcuuagcaaaacacaagaggaccuggaggcccaggugacccucgucgaaaaccugcgcaaguacgugggggaacaggugcccucugaaguccacucccagacgugggagcuugaaagacaaaaacugcucgagaccaugcagcaucugcaggaggaucgggacagccugcacgccacagcugaacuccugcagguuagagugcaaucucuuacccacauccuggcccuccaggaggaggagcugacacgcaaggugcagccgagcgauucccuggaaccugaguucacccggaaaugucagucucuucucaauagauggcgcgagaaggucuuugcgcugauggugcaacugaaggcucaggaacucgagcauagcgacuccguuaaacagcugaagggacaaguggccagccuucaggaaaaagucacgucucagucccaggagcaagccauucugcagagaagccuccaggauaaggcugccgaaguggagguugagcggaugggcgcuaaaggccugcagcuggaacuuucucgcgcccaagaggcgagacggcgcuggcagcagcagacagccuccgcugaggaacaacucagacugguggucaacgccgugagcuccucucagaucuggcuggagaccacaauggcuaaggucgaaggggccgcggcccagcuccccagccugaauaaccggcuuuccuaugcugugcgcaaaguucacaccauuagaggacugaucgcccggaagcucgcucuggcccaacugcgccaggagucuugcccucuucccccucccgugaccgacgucagccucgaacugcagcagcugagagaggaacggaauagacucgacgccgagcugcaacuuuccgcucgccugauccagcaggaggugggccgggcgagagaacagggggaggccgaacgccaacagcucagcaagguugcucagcagcuggagcaagaacugcagcagacacaggagucucuugccucccucggacugcaacuggagguggcccggcagggccagcaagaaagcacggaggaagcugccucucucagacaggagcugacccagcagcaagaacuuuacgggcaggcgcugcaggagaaagucgcugagguggaaacacgccuccgggagcagcuguccgauaccgaaagacgccugaacgaggcccggagagagcacgccaaggcugugguuagccuucggcaaauucagcgcagagccgcgcaggaaaaagagcggucucaggaacugcgcagacuccaagaggaagcucggaaggaggagggacagagacuggcccgccggcuccaggaacuggagagagacaaaaaucuuaugcuggccacacuccaacaggaaggccugcugagccgcuauaagcagcagcggcuucugaccguccucccgucccugcucgauaagaaaaagagcguggugucuucccccagaccucccgaguguagcgcuuccgccccugucgcugccgcggugcccacgcgcgaaucuaucaaaggcagccuguccguucuucuggacgaucuccaagaccugucugaggccauuagcaaggaggaagcugugugccagggggauaaccuggaccgguguuccucuagcaauccgcagauguccagcuga

SEQ ID NO: 66997 - RNA, 1287 nt, Artificial Sequence
  derived and/or modified sequence opt5 from CCKAR__Homo_sapiens__NP_000721
auggacguggucgauagccugcucguuaacggcuccaauaucacacccccuugcgagcuggggcuugaaaacgagacccuguucugucucgaccagccgagacccucuaaggaauggcaaccugccgugcagauucugcuuuacagccugaucuuucuccuguccgugcugggaaauacgcucgucauuaccgugcugauccggaacaaacgcaugagaacaguuaccaauauuuuccuucugucucucgcugugagcgaucugaugcuuugccuguuuuguaugcccuucaaccucaucccuaaucugcugaaggacuuuaucuucggcuccgccgucugcaaaacaaccacauauuuuauggggaccucugugagcguuuccacguucaaccucguggcgauuagccuggagcgguacggagcuaucuguaagccccuucagucucgcgucuggcagaccaaaucccacgcccugaaggugauugccgcuacauggugccucagcuuuaccaucaugacaccuuauccgauuuacucuaaucuggugcccuucaccaagaacaauaaccaaacggccaauauguguagauuucuucugccuaacgaugucaugcagcaguccuggcauacauuccuccugcugauccucuuucugauucccggcaucguuaugaugguggcuuaugggcuuaucagccuggaacucuaccagggaauuaaauucgaggccucucaaaagaaauccgcgaaggagcggaaaccuagcaccacauccucuggcaaguaugaagacagcgauggcugcuaccugcagaagaccagacccccgcgcaaacuugagcugcggcagcucuccaccgggucuagcucccgcgccaauagaauccggagcaacucuagcgcugccaaccugauggcuaagaaacgcgugauuagaaugcugaucgucauugugguucucuucuuucuguguuggaugccuaucuucuccgccaaugcguggcgggccuacgacacagcuucugccgaacgcagacuuagcggaacgcccaucuccuuuauucugcuccugagcuauaccucuuccugcgugaacccuaucauuuacuguuucaugaauaagcgguuuagacugggcuucauggcuacauuucccugcugccccaacccugggccgcccggagcccgcggcgaggucggggaggaagaggaaggaggcaccacaggcgccagccuuucucgguucuccuauagccacauguccgcuucugugccuccccaguga

SEQ ID NO: 66998 - RNA, 1344 nt, Artificial Sequence
  derived and/or modified sequence opt5 from CCKBR__Homo_sapiens__NP_795344
auggagcugcucaagcugaacagaagcgugcagggcaccgggcccggaccuggcgccucccuuugccggccgggggcuccccugcucaauucuagcuccgucggaaaccugucuugugaaccuccccgcaucagaggcgccgggacacgggagcuugaacuggcgauucgcaucacgcucuacgcuguuauuuuccugaugagcgugggaggcaauaugcugaucauugugguccucggccuguccagacggcuucgcaccgugacaaacgccuuucugcucucucuggccguuagcgaccuucugcucgcuguggccugcaugccuuucacccugcugcccaaucucauggggacauuuaucuucggaaccgucaucuguaaagcuguguccuaucugaugggcguuagcgugucugucuccacacuuagccugguggccauugcgcucgagagauacucugccaucugccggccucugcaagcucgcguguggcagaccagaucccacgccgcucgggucauuguugccacguggcuucugagcgggcuccugauggugccguaucccguguacaccgucgugcagccuguuggaccccgcgugcugcaguguguccauagauggccuucugcgcgggugcgccaaacaugguccguucuccugcuucugcuccuguuuuucauccccggcguggucauggccguggcuuaugggcuuauuagcagagaacuguaccucggacugcgguuugauggcgacuccgauucugacagccaguccagaguccgcaaccagggcgggcugccgggagccgugcaccagaauggccggugcagaccugagaccggggcuguuggagaggauagcgacggcuguuaugugcaacucccccgcucucggccugcccuggaacuuacagcccugaccgcucccgggcccggauccggcagcagaccuacgcaggcgaagcuccuggccaaaaagcgcgucgugcggaugcugcuuguuaucgugguccucuucuuucugugcuggcugccgguguacucugcuaacacauggagagccuucgauggccccggggcccaucgcgcucucagcggagccccuauuuccuuuauccaucugcuuucuuacgcgagcgcuugugugaauccccugguuuauugcuucaugcaccggagauuucgccaggccugucucgagaccugcgcccggugcuguccuagacccccgcgggcucgcccuagagcccugcccgacgaagauccucccacaccuuccaucgcuagccugucucggcuuuccuacaccaccauuagcacacucggccccggguga

SEQ ID NO: 66999 - RNA, 348 nt, Artificial Sequence
  derived and/or modified sequence opt5 from CCK__Homo_sapiens__NP_000720
augaacagcggcgugugccuguguguccucauggccguucuggcugccggggcgcuuacccagcccgugccuccggcugaccccgccggauccggccugcaaagagccgaggaagcuccucggcgccagcucagagugucucagcggacagauggggagagccgcgcccaccugggagcccuucuggcuagauacauccagcaagcgcggaaggcccccuccggccgcaugucuauugucaaaaaucuccagaaccuggacccuagccauagaaucuccgaucgggacuauaugggguggauggauuucggacgcagaucugcugaagaguacgaauaucccagcuga

SEQ ID NO: 67000 - RNA, 294 nt, Artificial Sequence
  derived and/or modified sequence opt5 from CCL11__Homo_sapiens__NP_002977
augaaggugagcgccgcucugcucuggcugcuucugaucgccgcggcuuucagcccccagggccucgccgggccugccucugucccgaccacaugcuguuuuaaccuggcuaauagaaaaauuccccuucaacggcuggagagcuaccgcagaaucacguccggaaagugcccucagaaagccguuauuuucaagaccaaacucgcuaaggacaucugugccgaucccaagaaaaagugggugcaggacucuaugaaauaucuggaucagaaguccccuacacccaaaccuuga

SEQ ID NO: 67001 - RNA, 297 nt, Artificial Sequence
  derived and/or modified sequence opt5 from CCL13__Homo_sapiens__NP_005399
augaaggugagcgccguccugcucugccugcuucugaugaccgcugccuucaacccccagggccucgcgcaaccugacgcucugaauguuccguccacauguugcuuuacguucucuagcaaaaagaucucccuucagagacugaaaucuuacgugauuaccacaagccgguguccccagaaggccgugaucuuucgcaccaaacucgggaaggagauuugcgccgauccuaaggaaaaauggguccagaacuauaugaagcaccugggaagaaaagcucauacacugaagaccuga

SEQ ID NO: 67002 - RNA, 330 nt, Artificial Sequence
  derived and/or modified sequence opt5 from CCL14__Homo_sapiens__NP_116738
augaagaucagcguggccgcuauucccuucuuucugcucaucaccauugcccugggcacaaaaacggaguccucuagccagaccgggggaaagccuaaagucguuaagauccaacuuaaacuggugggcgggccguaccaccccuccgaaugcuguuucacauauaccacauacaagauuccuagacagcggaucauggacuauuacgagaccaacucucagugcagcaagcccggaaucguguuuauuacaaaacgcggccauuccgucuguaccaauccuucugauaagugggugcaggacuauaucaaagauaugaaggaaaacuga

SEQ ID NO: 67003 - RNA, 342 nt, Artificial Sequence
  derived and/or modified sequence opt5 from CCL15__Homo_sapiens__NP_116741
augaaggugagcgucgccgcucuguccugccucaugcugguugccgugcuuggcucucaggcgcaauucaccaacgacgcugagacagaacugaugaugagcaaacucccccuggagaauccugugguccuuaacuccuuucacuucgccgccgauuguugcacgucuuacaucagccaguccauuccguguucucugaugaaaagcuauuuugaaaccuccagcgagugcucuaagcccggggugaucuuccucacaaagaaaggaagacagguuugugcuaagccuuccggccccggggugcaggacugcaugaagaaacugaagccuuacagcauuuga

SEQ ID NO: 67004 - RNA, 363 nt, Artificial Sequence
  derived and/or modified sequence opt5 from CCL16__Homo_sapiens__XP_005258077
augaaggugagcgaggccgcucugucccuccugguccuuauccugauuaucaccucugccagcagaucccagcccaaaguuccugaaugggugaacacaccgucuacgugcugucucaaguacuaugagaaagugcugccccggcgccuugucgugggcuacagaaaggcgcugaauugccaccucccugcuauuaucuucguuaccaaacggaaccgcgaaguguguacaaaucccaacgacgauuggguccaagaguauauuaaggacccuaaucugccccugcucccuaccagaaaccugagcacagugaagaucaucaccgccaaaaaugggcagccgcagcuucugaacucccaguga

SEQ ID NO: 67005 - RNA, 285 nt, Artificial Sequence
  derived and/or modified sequence opt5 from CCL17__Homo_sapiens__NP_002978
auggcuccccugaagaugcucgcccuggugacccuucugcucggcgccagccugcagcacauccaugcggcuagagggacaaacgucggacgggagugcugucuugaauacuucaaaggcgccauuccucugcgcaagcucaaaacgugguaucaaaccuccgaggacugcucuagagaugccaucguuuuugugacagugcaggggcgggcuauuuguagcgacccgaauaacaagcgcgucaaaaaugccgugaaguaccugcagucccuggaaagaucuuga

SEQ ID NO: 67006 - RNA, 270 nt, Artificial Sequence
  derived and/or modified sequence opt5 from CCL18__Homo_sapiens__NP_002979
augaagggccuggccgcugcccuccuggugcuugucugcaccauggcgcuguguagcugcgcucagguugggacaaacaaagagcucuguugccugguguacacguccuggcaaaucccccagaaguucauuguggacuauucugaaaccagcccucaguguccgaaacccggagucauccuucugacaaagagaggccggcagauuugcgccgauccuaauaaaaagugggugcaaaaguacaucuccgaccucaaacugaacgccuga

SEQ ID NO: 67007 - RNA, 297 nt, Artificial Sequence
  derived and/or modified sequence opt5 from CCL19__Homo_sapiens__NP_006265
auggcccugcuccuggcccuuagccugcucgugcuguggaccucccccgccccuacacuuucuggcacgaacgacgcggaggauugcugucugagcgucacccagaagccgauccccggguacauuguuagaaauuuccacuaucuccugaucaaagacggaugccgggugccugcuguggucuuuacaacccugcgcggcagacaacucugugcucccccugaucagcccuggguggaacggauuauccagcgccugcagagaacauccgccaagaugaaacggcgcucuagcuga

SEQ ID NO: 67008 - RNA, 291 nt, Artificial Sequence
  derived and/or modified sequence opt5 from CCL1__Homo_sapiens__NP_002972
augcagaucauuaccacagcccuggugugccuccugcuugcuggcauguggcccgaggacgucgauagcaaguccaugcaaguuccuuucucuagauguugcuuuagcuucgccgaacaggagaucccgcugcgggcgauucucuguuaccgcaacacguccucuaucugcagcaaugaagggcugauuuuuaaacuuaagagaggaaaagaggcuugugcccuggacaccgugggcugggugcagcggcaccgcaagaugcucagacauugccccuccaaacggaaguga

SEQ ID NO: 67009 - RNA, 288 nt, Artificial Sequence
  derived and/or modified sequence opt5 from CCL20__Homo_sapiens__NP_001123518
augugcuguaccaagagccugcuccuggccgcucuuauguccgugcugcuccugcaccuuugcggcgagucugaagccagcaacuucgacuguugccugggguacacagauagaauccuccaucccaaauuuauugucggauucacgcggcagcuggcgaaugagggcugugacaucaacgcuauuaucuuucacaccaagaaaaagcuguccguuugcgccaauccuaaacaaacaugggugaaguauauugugcgccuccugucuaagaaagucaagaacauguga

SEQ ID NO: 67010 - RNA, 405 nt, Artificial Sequence
  derived and/or modified sequence opt5 from CCL21__Homo_sapiens__NP_002980
auggcccagagccuggcucucucccugcuuauccuggugcucgccuucggcauucccagaacccaagggucugacggaggcgcgcaggauugcugucugaaguacagccagcggaaaaucccugcuaaggucguucgcuccuauagaaaacaggagccgucucuugggugcagcauucccgccauccuguuucucccucggaagcgcucccaagccgaacugugugcugaccccaaagagcugugggugcagcagcucaugcagcaccuggauaagacaccuucuccccaaaagccugcccagggaugcagaaaagaccggggcgcuagcaagacggggaaaaagggaaaaggcuccaagggcuguaagcgcaccgaaagaagccagacaccgaaagggcccuga

SEQ ID NO: 67011 - RNA, 282 nt, Artificial Sequence
  derived and/or modified sequence opt5 from CCL22__Homo_sapiens__NP_002981
auggacagacugcagaccgcccuccuggugguccuuguucugcucgcuguggcccugcaagcgacagaggcuggccccuacggggccaacauggaagauagcgugugcugucgggacuauguccgcuacagacuuccucugcgggugguuaagcacuucuauuggacguccgauucuugcccgcgccccggagugguccuccugaccuuuagagacaaagagaucugugccgauccucgggugcccuggguuaagaugauucugaauaaacucagccaguga

SEQ ID NO: 67012 - RNA, 414 nt, Artificial Sequence
  derived and/or modified sequence opt5 from CCL23__Homo_sapiens__NP_005055
augaaggugagcgucgccgcucuguccugccucaugcugguuaccgcccuuggcucucaggcgagagugacaaaagacgcugagacggaguucaugaugagcaagcugccccucgaaaacccugugcugcuugauaugcuguggcggcgcaaaaucgggccgcagaugacccucucccacgccgccggauuucaugcuacaucugccgacuguugcauuagcuacacccccagauccaucccuuguucucugcuggaaagcuauuucgagacaaauuccgaaugcagcaagcccggcgucauuuuucucaccaaaaaggggcggcgcuucugugcuaacccuucugauaagcaagugcagguuugcaugagaaugcugaaacuugacacacggaucaagacccgcaaaaauuga

SEQ ID NO: 67013 - RNA, 360 nt, Artificial Sequence
  derived and/or modified sequence opt5 from CCL24__Homo_sapiens__XP_011514762
auggccggccugaugaccaucgugacaagccuccuguuccuuggggucugcgcucaccauauuauccccacgggauccguugugauuccuucuccguguugcauguuuuucgugagcaagagaauccccgagaaccgggucguguccuaccagcugucuagccgcuccaccugucucaaagccggcguuauuuuuacaaccaagaaagggcaacaguucugcggagacccuaagcaggaaugggugcagagauauaugaaaaaucuggaugcgaagcaaaagaaggcuucuccccgggcccgcgccgucgcugugaaaggcccuguucagagauaccccgggaaccagacaaccuguuga

SEQ ID NO: 67014 - RNA, 450 nt, Artificial Sequence
  derived and/or modified sequence opt5 from CCL25__Homo_sapiens__NP_001188288
augaaccuguggcuccuggccugccuuguggcuggcuuccugggggccugggcgcccgcuguccacacccagggaguuuuugaggacuguugccucgccuaccauuauccuaucggcugggccgugcugagacgggcuuggacauaccgcauucaagaagugagcggguccuguaaucuuccggccgcuaucuucuaucugcccaagagacaccggaaagucugcggaaacccuaagucucgcgaggugcagagagccaugaaacuccuggaugcgcggaauaagguuuuugccaaacugcaucacaacacgcagaccuuccagggcccccaugcugugaagaagcucagcuccggaaauucuaaacugagcuccucuaaguuuagcaacccuauuuccagcucuaaacgcaaugucucccuucugaucagcgccaacucugggcucuga

SEQ ID NO: 67015 - RNA, 285 nt, Artificial Sequence
  derived and/or modified sequence opt5 from CCL26__Homo_sapiens__NP_006063
augaugggccugagccucgccuccgcugugcugcuugccucucugcucagccugcaccuugggaccgcgacaagaggauccgacaucucuaagacgugcuguuuccaguacagccauaaaccccugccuuggaccuggguccgguccuaugaguuuacaucuaacagcugcucccaacgcgcuguuauuuucaccacaaagagaggcaaaaagguguguacccacccgcggaaaaagugggugcagaaguacaucagccuccugaaaacacccaagcagcuguga

SEQ ID NO: 67016 - RNA, 339 nt, Artificial Sequence
  derived and/or modified sequence opt5 from CCL27__Homo_sapiens__NP_006655
augaaggggcccccuaccuucugcagccugcuccugcuuucccugcuccugucuccggaccccacagccgcuuuucuucugccucccagcacggccuguugcacccagcucuacagaaaaccucuguccgauaagcugcuccggaaagugauccaagucgagcugcaggaagcggacggcgauugucaccuucaggcuuucguucugcaucucgcccagcgcucuauuugcauccacccccaaaacccuagccugucccagugguuugagcaucaggaaagaaaacuucacggaacacugccgaagcucaauuucggcaugcugcggaagaugggguga

SEQ ID NO: 67017 - RNA, 384 nt, Artificial Sequence
  derived and/or modified sequence opt5 from CCL28__Homo_sapiens__NP_001288802
augcagcaaagaggccuggccaucguggcucucgccgucugcgcggcucugcacgccagcgaggccauucuucccaucgcuuccucuuguugcaccgaaguuagccaucacauuucccggcgccugcucgagagagugaacaugugucggauccagcgcgccgacggggauugcgaccuggcugccgugauucuucaugucaagagacggcgcaucugugugucuccucacaaucauacaguuaaacaguggaugaaggugcaggcggccaaaaagaacggaaaaggcaaugucugccacagaaagaagcaccaugggaaacggaacagcaaucgcgcucaccaaggaaagcaugaaacguacggccacaaaaccccguauuga

SEQ ID NO: 67018 - RNA, 300 nt, Artificial Sequence
  derived and/or modified sequence opt5 from CCL2__Homo_sapiens__NP_002973
augaaggugagcgccgcucugcucugccugcuucugaucgccgcgaccuucauuccccagggccucgcucaaccugacgccaucaacgccccggucacauguugcuacaauuuuacgaacagaaaaauuuccguucagcggcuggcuucuuaucgcagaaucaccagcuccaagugucccaaagaggccgugauuuucaagacaaucguggcuaaagaaaucugcgccgauccuaagcagaaguggguccaggacucuauggaucaccuugacaaacaaacccagacacccaagaccuga

SEQ ID NO: 67019 - RNA, 279 nt, Artificial Sequence
  derived and/or modified sequence opt5 from CCL3__Homo_sapiens__NP_002974
augcaagugagcaccgccgcucuggccguccuccugugcacaauggcgcuuuguaaccaguucuccgcuucucuggccgccgacacgcccaccgcuugcuguuuuagcuacacauccagacagaucccucagaauuucauugccgauuauuuugagaccucuagccagugcuccaagccgggcguuaucuuccucacaaaacggucucgccaagugugugcugaccccagcgaagagugggugcagaaguacgucuccgaucuggaacuuagcgccuga

SEQ ID NO: 67020 - RNA, 282 nt, Artificial Sequence
  derived and/or modified sequence opt5 from CCL3L3__Homo_sapiens__NP_001001437
augcaagugagcaccgccgcucuggccguccuccugugcacaauggcgcuuuguaaccagguucuguccgcuccccucgccgccgacacgccuaccgcuugcuguuucucuuacacaagcagacagaucccgcagaauuuuauugccgauuauuucgagaccuccucucagugcagcaagcccuccgugaucuuucugacaaaacggggccgccaagugugugcugacccuucugaagaguggguccagaaguacgugagcgaucuugaacuguccgccuga

SEQ ID NO: 67021 - RNA, 279 nt, Artificial Sequence
  derived and/or modified sequence opt5 from CCL4__Homo_sapiens__NP_002975
augaagcugugcgugaccguccucagccugcuuaugcugguugccgcuuucuguucccccgcccucucugcgccuaugggcagcgacccgcccacagcuugcuguuuuuccuacacggccagaaaacugccucggaacuucgugguggauuauuacgagaccucuagccuuugcucccagcccgccgucguguuucaaacaaagcgcucuaaacagguuugugcugacccuagcgaauccugggugcaggaguaugucuacgaucuggaacucaauuga

SEQ ID NO: 67022 - RNA, 279 nt, Artificial Sequence
  derived and/or modified sequence opt5 from CCL4L1__Homo_sapiens__NP_996890
augaagcugugcgugaccguccucagccugcuuguucugguggccgcuuucuguucccucgcccugucugcgcccaugggcagcgacccuccgacagcuugcuguuuuuccuacacggccagaaaacuuccccggaacuucguggucgauuauuacgagaccucuagccugugcucccagccugccgugguuuuucaaacaaagcgcgggaaacaggugugugcugaccccucugaaagcuggguccaggaguauguguacgaucucgaacugaauuga

SEQ ID NO: 67023 - RNA, 264 nt, Artificial Sequence
  derived and/or modified sequence opt5 from CCL4L2__Homo_sapiens__NP_001278397
augaagcugugcgugaccguccucagccugcuuguucugguggccgcuuucuguucccucgcccugucugcgcccaugggcagcgacccuccgacagcuugcuguuuuuccuacacggccagaaaacuuccccggaacuucguggucgauuauuacgagaccucuagccugugcucccagccugccgugguugggaagcaagugugugcugaccccucugaaagcuggguccaggaguauguguacgaucucgaacugaauuga

SEQ ID NO: 67024 - RNA, 465 nt, Artificial Sequence
  derived and/or modified sequence opt5 from CCL5__Homo_sapiens__NP_001265665
augaaggugagcgccgcugcccuggcggucauccucauugcuaccgcccugugcgcccccgcuuccgccucuccuuacagcuccgacaccacgccguguugcuucgcuuauaucgccagaccccuuccucgggcgcacauuaaagaguacuuuuauaccucuggcaaguguagcaaccccgccguugugcaucgcuccagaaugccuaaacgggaagggcagcaaguguggcaggauuuccuguacgacucucgccucaauaagggaaaacugugccaccccaaggagccuccgagcgucugucagcccagagaagagaugggcuccggggugcaucagcuuuuuggagaugaacugggcuggcggguucucgagccugagcugacacaaaucugccuguuccuccuggcucuugugcuggccugggaagcuagcccccacuauccuacacccccggccccuuga

SEQ ID NO: 67025 - RNA, 300 nt, Artificial Sequence
  derived and/or modified sequence opt5 from CCL7__Homo_sapiens__NP_006264
augaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucuga

SEQ ID NO: 67026 - RNA, 300 nt, Artificial Sequence
  derived and/or modified sequence opt5 from CCL8__Homo_sapiens__NP_005614
augaaggugagcgccgcucugcucugccugcuucugauggccgcgaccuucucuccccagggccucgcucaaccugacuccgucagcaucccgauuacauguugcuuuaacguuaucaauagaaaaauucccauccagcggcuggaguccuacacgcgcauuaccaacauccaguguccuaaggaagccgugaucuucaaaacaaagagagggaaagaggugugcgccgaucccaaggaacgguggguccgcgacucuaugaagcaccuugaucagauuuuucaaaaucugaaaccuuga

SEQ ID NO: 67027 - RNA, 1398 nt, Artificial Sequence
  derived and/or modified sequence opt5 from CCM2__Homo_sapiens__NP_001025006
augcacagcuccugcagacagcggcgcaaccaaaaucugucuaaggagaucccccagaccgaguuccauacaggcuacagcauggaaaacgaaccugggauuguguccccguuuaaaagagucuuccucaagggagagaaaucucgggacaagaaagcccacgaaaagguuacggagcgcagaccccugcauaccguggugcuuagccugccugagcgggucgaacccgaucgccuccuguccgacuauaucgagaaggaagugaaauaccuuggccagcugacaucuauuccuggguaucucaaucccagcuccagaaccgagauccugcacuuuauugauaacgcuaagcgggcccaucagcugccuggacaccucacacaagagcacgacgcgguucugagccuuucugcuuacaaugugaaacuggccuggcgcgauggcgaagacaucauccucagagucccgauucaugauaucgccgcuguguccuauguucgggacgaugccgcucaccuggugguccuuaagaccgcccaggaccccgggauuagcccuucucagucccugugugcggagagcucucgcggacucuccgccggcagccuguccgaaucugcugugggccccguggaggccugcugucuggucauccucgcugccgaaagcaaaguugcggccgaggagcugugcugucuucugggacagguguuccaaguggucuacacagaauccaccauugauuuucucgacagagcuaucuucgauggggccagcacgccuacccaucaccugucucuucacuccgacgacagcucuacaaagguggauauuaaggagaccuaugaaguugaggcuagcacauuuugcuuccccgaauccguggacgucggcggggccucuccgcauagcaaaaccaucuccgagagcgagcugucugccuccgcuacggaacuccugcaggauuacaugcugacacuccggaccaagcugagcucucaggagauccagcaauuugcggcccuucugcacgaauaccgcaacggagcuuccauucaugaguucuguaucaaucucagacagcuguauggcgacagccggaaauuucuucugcucgggcugagaccuuucauucccgaaaaggauucccagcacuuugagaacuuccuggagacaaucggagugaaagacggccgcggcauuaucaccgauucuuucgggcggcauagacgcgcccucagcaccacauccucuagcacgaccaauggaaaccgggccacaggcuccagcgacgauagaucugcuccuuccgaaggggacgagugggaucgcaugaucagcgacauuucuuccgacaucgaagcccugggaugcagcauggaucaagacucugcguga

SEQ ID NO: 67028 - RNA, 1395 nt, Artificial Sequence
  derived and/or modified sequence opt5 from CCNA1__Homo_sapiens__NP_001104515
auggagaccggcuuccccgccaucauguacccugggagcuuuauuggaggcuggggagaagaguaucuguccugggaaggaccgggccuccccgacuucguguuucagcaaccugucgagucugaagcuaugcacugcagcaaccccaaguccgggguugugcuggccacaguggcgagaggaccugaugcuugucagauccuuacgcgggcuccccugggccaggacccuccgcagcgcaccguccucggccugcuuacagccaaugggcaauacagacggaccugcggacagggcauuacacgcaucagauguuauucugggagcgagaacgcuuuucccccugccgggaaaaaggcucugcccgauugcggcgugcaggagccucccaaacagggguucgacauuuacauggaugaacucgagcaaggagaccgggauuccuguucuguucgcgaaggcauggccuucgaggacguguaugaggucgauaccggcacacucaagagcgaccugcauuuucugcuggauuucaauaccguguccccgaugcuuguugacagcucucugcucucccagagcgaagauaucucuucccuggggacggacgugaucaacgucaccgaguacgcggaagagauuuaucaguaccuuagagaagccgagauccggcaccgcccuaaagcucauuacaugaagaagcagcccgacauuacagagggaaugagaaccauccugguggauuggcucguggaagucggcgaggaauauaaacugcgggccgagacacuguaccucgcuguuaauuuucuggaccgcuuccuuagcugcaugucugugcugagagggaagcuccaacuggugggaaccgccgcgaugcuucuggccuccaaauaugaagagauuuacccucccgaggucgaugaauuuguguauaucacggacgauacauacaccaagcggcagcuccugaaaauggagcaucugcuccugaagguucuugcuuucgaccugacagugcccaccaccaaccaguuucuccugcaauaucuucgcagacagggcgucugugugcggacagaaaaucuggccaaguacguugcugagcucagccugcuggaagccgauccuuuccucaaauaccugccgucccuuauugccgcugcggccuucugccuggcuaacuauacggugaauaagcacuuuuggcccgagacccucgccgccuucacaggguacucucugagcgagaucgucccuugucuguccgaacuucacaaagccuaucucgacaucccccacagaccucagcaggccauucgcgagaaguacaaagcgagcaaguaucugugcgugucucugauggaacccccggcuguccuccugcuucaauga

SEQ ID NO: 67029 - RNA, 1299 nt, Artificial Sequence
  derived and/or modified sequence opt5 from CCNA2__Homo_sapiens__NP_001228
augcugggcaacagcgcccccgggccugcuaccagagaggccggauccgcgcuccuggcccuucagcaaacagcccugcaggaagaccaggagaauaucaacccggaaaaggccgcucccgugcagcaaccucggacgcgcgccgcucucgccguccugaaaucuggcaaucccagagggcuugcgcagcagcagcggccuaagacccgcagaguugcuccccugaaagaucucccugugaacgacgagcacgugacagucccgcccuggaaggcuaauagcaaacaaccugccuucaccauucauguggaugaagcugagaaggaggcccagaagaaacccgcggaaucccagaagaucgagcgggaagacgcccuggcuuuuaacucugccauuagccugccuggaccccgcaaaccgcucguuccucuggauuaccccauggacggcuccuucgagucuccucacacaauggauaugagcaucgugcuugaggacgaaaagcccgucuccgugaaugagguucccgauuaucaugaagacauucacaccuaccugagagagauggaagugaaaugcaagccuaaggucggguauaugaaaaagcagccggauaucacaaacagcaugcgggcuauccucguggacuggcugguggaggucggagaggaauacaaacuucaaaaugagacccugcaucucgccguuaacuauauugaucgcuuucugucuuccaugagcgugcugagaggcaagcuccagcuggugggcacggccgcuaugcuucuggcgucuaaauucgaagagaucuaucccccugaagucgccgaguuuguguacauuaccgacgacacauacaccaagaaacagguucuccggauggagcaccuggugcuuaagguccugacauucgaucucgcugcccccaccgugaaucaauuucugacgcaguacuuccugcaccagcagccugccaacuguaagguugaaucccucgcuauguuucugggggagcuuagccugaucgacgccgaucccuaucucaaauaccugccgucugugauugcgggagcugccuuccaucuugcccuguauacagucaccggccaauccuggccugaaagccucauccgcaagacaggguacacccuggagucccugaaacccugccucauggaccugcaccagaccuaucuuaaggcuccucagcaugcccagcaaucuauuagagaaaaauacaagaauagcaaguaucacggagugucccugcucaaucccccugagacacugaaccuguga

SEQ ID NO: 67030 - RNA, 1302 nt, Artificial Sequence
  derived and/or modified sequence opt5 from CCNB1__Homo_sapiens__NP_114172
auggcccugagagugacccggaacagcaagaucaaugcugagaacaaagccaagauuaauauggcgggcgcuaaacgcguccccacagccccugccgcuacguccaagccggggcucagaccccggaccgcccugggagacaucggcaacaaaguuucugaacagcuucaagcuaagaugccuaugaagaaagaggccaagcccagcgcgacagggaaagugauugauaagaaacugccuaagccccucgaaaaggugccuaugcuggucccggugcccguuuccgagccugugcccgaaccugagcccgagccggaaccugagcccgucaaagaagagaaacuuucuccugagcccauccugguggacaccgccagccccuccccuauggaaacaucuggaugcgcuccggccgaggaagaucucugucaggcuuucagcgacguuauucuggccgugaaugaugucgacgcggaggauggcgccgaccccaaccugugcuccgaauacgugaaggauaucuaugcuuaccuccgccagcuggaggaggaacaggccgugagaccuaaguaucuucuggggcgggaggucaccggaaauaugcgcgcuauccucauugacuggcugguucaagugcagaugaaauuuagacuucugcaggaaacaauguacaugaccgugagcaucauugaucgguucaugcagaacaauuguguccccaagaaaaugcuccaacuggugggcguuacggccauguuuaucgccucuaaguaugaggaaauguacccucccgagauuggcgacuucgcuuuugugaccgauaacacauauaccaagcaccagauccgccagauggagaugaaaauucugagagcgcucaauuucgggcugggacggccgcuuccucugcauuuucuccgcagagccuccaagaucggcgaagucgacguggagcagcacacacuggcuaaauaccuuauggaacugaccaugcucgacuacgauaugguucauuuucccccuagccaaaucgccgccggggcuuucugccuggcccugaagauucucgacaacggagaguggacgcccacacugcagcacuaucuuucuuacaccgaagagucccugcucccugugaugcagcaucuggcgaaaaaugucgugauggucaaccaaggccuuacaaagcacaugaccgugaagaauaaauaugcuaccagcaagcacgccaaaaucucuacacugccccagcucaacuccgcccugguucaggaucuggcuaaggccguggcuaaagucuga

SEQ ID NO: 67031 - RNA, 1197 nt, Artificial Sequence
  derived and/or modified sequence opt5 from CCNB2__Homo_sapiens__NP_004692
auggcccugcucagacggcccaccgugagcuccgaccuggagaacaucgauacaggcgucaauucuaagguuaaaagccacgugacgauucgcagaaccgugcuugaagagaucgggaaccgggucacaacccgcgcugcccagguggcgaagaaagcucaaaauacaaagguuccugugcagccgaccaaaacaaccaacgucaauaagcagcugaagcccacggccuccgugaaaccuguucagauggaaaagcucgcccccaaaggaccuucucccaccccugaggacgugagcaugaaggaagagaaccugugccaggcuuucuccgaugcccuucuguguaaaauugaggacaucgauaaugaagacugggagaacccgcagcucugcucugauuacgucaaggacauuuaucaguaccugagacagcuggaagugcuccaaagcaucaauccccauuuucuggauggccgggacaucaacgggcgcaugagagcuauucuuguggauuggcugguccagguucacuccaaguuccggcuccugcaggagacacuuuauaugugugugggaaucauggaccgcuuucugcaagugcaaccugucagccggaaaaagcuccagcuggugggcauuaccgcccugcuccuggcgucuaaauacgaggaaauguucucccccaauaucgaggauuuuguuuauauuacagacaacgccuacaccagcucucagaucagagaaauggagacgcuuauucugaaggaacucaaauucgagcuggggcgcccucuuccccugcauuuucucagacgggcuuccaaggccggagagguggacgucgaacaacacacacuggcuaaauaucugauggagcucacccugaucgauuacgacauggugcauuaccacccgagcaagguugccgcggccgcuucuugccuuucccagaaggugcugggccagggcaaauggaaucucaagcagcaauauuacacaggguauaccgaaaacgagguccuggaagugaugcagcacauggccaaaaaugucgugaagguuaacgagaaccuuaccaaauucaucgcuauuaagaauaaguacgccagcuccaaacugcucaagaucucuaugauuccucagcugaacagcaaagccgugaaggaucuggcuagcccccucaucggacgcuccuga

SEQ ID NO: 67032 - RNA, 876 nt, Artificial Sequence
  derived and/or modified sequence opt5 from CCNB3__Homo_sapiens__NP_391990
augcugcucccccugccuccgcagagcuccaagcccgugccuaaaaagucucaaagcuccaaaaucguccccucucaccaugacccuagcgagaagaccggcgaaaacugccagacaaaaauuucccccucuagccuucaggaguccccuagcucucugcagggggcccucaagaagagauccgcuuucgaagaucugacgaauguuagcuuugagaugacccacgaaacacuuuaccuggccgugaaacucguggaccuguaucugaugaaggcggucuguaaaaaggauaaacuccaacugcuuggagcuaccgccuucaugaucgccgcuaaguuugaggagcauaacucuccgcggguggacgauuucguuuacauuugcgacgauaauuaucagcgcuccgaagugcugagcauggagaucaacauucucaauguccugaagugugacaucaacauccccauugccuaccacuuucuuagacgguaugcucgcugcauccauacaaauaugaaaacccugacacucucuagauacauuugugaaaugacccugcaggaguaucacuacgugcaggagaaggccuccaaacuggcggccgcuagccuccugcuugcccuguacaugaagaaacucggcuauuggguuccuuuccuggaacacuacuccggguauucuaucagcgagcuucauccccuggugcggcaacucaacaagcugcugacguuuuccagcuacgauucucucaaagcugucuauuacaaguauucccacccuguguucuuugaaguggccaagauucccgcgcuggacaugcuuaaacuggaggaaauccucaauugcgauugugaggcccagggacugguccuuuga

SEQ ID NO: 67033 - RNA, 597 nt, Artificial Sequence
  derived and/or modified sequence opt5 from CCNC__Homo_sapiens__NP_001013417
auggccccuaccugcguguuccuggcuagcaaggucgaggaauuuggcguuguguccaacacaagacucaucgccgcggcuacgucugugcugaaaacccgguucagcuacgccuuucccaaggaguucccguaucgcaugaaucacauucuugaaugugaguuuuaccugcucgaacugauggacugcugucuuaucgucuaucaucccuacagaccucugcuccaguaugugcaagauauggggcaggaggacaugcugcugccccucgccuggcggauuguuaacgauacauaccgcaccgaccugugccuucuguauccucccuucaugaucgcucucgccugucugcacguggcuugcgucgugcagcagaaagaugccagacaaugguuugcggagcuuuccguugacauggaaaagauucuggagaucauccgggugauucucaaacuguacgaacaguggaagaauuucgaugagcgcaaggagauggccacaauccugucuaaaaugccuaagccgaaacccccucccaacagcgaaggagagcagggcccuaaugggucccagaacucuagcuacucccaaagcuga

SEQ ID NO: 67034 - RNA, 888 nt, Artificial Sequence
  derived and/or modified sequence opt5 from CCND1__Homo_sapiens__NP_444284
auggagcaccagcugcucugcugugaaguggagaccaucagacgggccuaccccgacgcuaaccugcuuaaugaucgcguccugagagccaugcucaaggcggaagagacaugcgcuccuagcguuuccuauuucaaaugugugcaaaaggaagugcugccgucuaugcggaaaauugucgccacguggaugcuugaggugugcgaggaacagaagugugaggaagagguuuuuccccuggccaugaacuaccucgaccgcuuccugagccuggagccugugaaaaaguccagacuccagcugcuuggcgcuaccugcauguuugucgccucuaagaugaaagaaacaaucccccugaccgcugagaagcucuguauuuauacagauaauagcauccggccugaggaacugcuucagauggaacugcuccuggugaacaaacugaaguggaaucucgccgcgaugacaccccaugacuucauugagcacuuucuguccaaaaugccugaggccgaagagaacaagcaaaucauccgcaagcaugcucagaccuucguugcccuuugcgcuaccgaugugaaauuuauuucuaauccgcccagcauggucgccgcgggguccgugguggccgcuguccagggacugaaccucagaagcccuaauaacuuccugucuuacuaucggcuuacgcgcuuucuguccagaguuaucaagugugaccccgauugccuccgggccugucaggaacaaauugaggcucugcuggaaagcucucuccgccaggcccagcagaauauggacccuaaagccgcugaggaggaagaggaagaggaagaggagguggaucuggcgugcacccccacagacgugagagaugucgacaucuga

SEQ ID NO: 67035 - RNA, 870 nt, Artificial Sequence
  derived and/or modified sequence opt5 from CCND2__Homo_sapiens__NP_001750
auggagcugcucugccacgaaguggaccccgucagacgggccguucgcgauagaaaccugcuucgggacgaucgcgugcugcagaaucuccugaccaucgaggaaagauaccuuccucaauguagcuauuucaagugcgugcagaaagacauucagccguacaugcggcgcauggucgcuacauggaugcuggaggugugugaggaacagaagugcgaggaagagguuuuuccccucgccaugaacuaucuggauagauuccuggcgggcgugccuacgcccaaaucccaucuccaacugcuuggggcugucuguauguuucuggccucuaagcucaaagaaaccagcccucugacagccgagaaacuuugcaucuacaccgacaauuccauuaagccccaggagcugcucgaaugggagcuggugguucugggaaagcucaaguggaaccuggcugccgugacaccucacgauuucaucgaacauauucuucggaaacugccgcagcagcgcgagaagcucucucugaucagaaaacacgcucaaaccuuuaucgcccuuugugcgacagacuucaaguuugccauguaucccccuagcaugauugcuaccggcuccgucggggccgcuaucugcggacugcagcaggaugaagaggugucuagccucacgugugacgcccugaccgagcugcucgcgaagauuacaaauaccgauguggacugccugaaagccugucaggaacaaaucgaggcuguccuucugaacucccuccagcaguaccggcaagaucagcgcgacggcagcaagucugaagacgagcuggaucaggccuccacacccaccgacguuagagauauugaccuuuga

SEQ ID NO: 67036 - RNA, 636 nt, Artificial Sequence
  derived and/or modified sequence opt5 from CCND3__Homo_sapiens__NP_001129489
augaacuaccuggacagauaucucagcugcgugcccacccggaaggcccagcugcaacuucugggcgcugucuguaugcuccuggccuccaaacuucgcgagacaacgccucugaccaucgaaaagcucugcauuuacacagaucacgcgguuucuccgagacagcugcgggacugggaggugcuggugcucgggaaacugaagugggaucuugcugccgucaucgcccaugacuuccuggcuuuuauucuccaccgccugagccuucccagagaucggcaggcccuggugaaaaagcaugcucagaccuuccucgcccugugugcgacagacuauaccuuugccauguacccucccuccaugaucgcuacaggaucuauuggcgccgcuguucaagggcugggagccugcagcauguccggcgaugaacucaccgagcugcuugcggggaucacgggaaccgaaguggacugucugcgcgccugccaggagcagaucgaggcugcccucagagaaucucugcgggaggcuagccagacauccagcucuccugcccccaaggccccucgcggcuccagcucucaaggcccgucccagaccagcacacccaccgaugucacggcuauucaccuuuga

SEQ ID NO: 67037 - RNA, 1083 nt, Artificial Sequence
  derived and/or modified sequence opt5 from CCNDBP1__Homo_sapiens__NP_036274
auggccagcgcuaccgcccccgcggcugccgugccuacacuggccuccccgcucgagcagcugagacaccuugcugaggaacugcggcuccugcuuccccgcgucagaguuggcgaagcccaagagacgaccgaagaguucaaccgggagauguuuuggcgcagacugaaugaagcugccgugacagugucucgggaggcgaccacacucaccaucgucuucagccagcugccucugcccuccccucaggaaacacagaaguuuugcgagcaagugcaugccgcuauuaaagccuucaucgcuguuuacuaucuccugcccaaggaccaggggauuacccuucgcaaacuggugagaggagccacgcucgauaucgucgacggcauggcgcagcugauggaggugcuuucuguuaccccuacacagagcccggaaaacaaugaucugauuuccuacaacucugugugggucgccugucaacagaugccccagaucccucgggacaauaaggcugccgcucuccugaugcugaccaaaaacguggauuuugugaaggacgcccacgaggaaauggagcaggccgucgaagagugcgaucccuauagcgggcuccugaaugacacagaggaaaacaauuccgauaaccauaaucacgaggacgauguucuuggauucccuagcaaccaagaccuguacuggucugaagaugaccaggagcucaucauucccugucuggcucuugugcgcgcguccaaggccugccugaaaaagaucagaaugcucguggcugaaaauggcaaaaaggaccaggucgcccaacuggaugacauuguggauaucagcgacgagauuucuccguccguugaugaccuggcccucagcaucuauccucccaugugucaucugaccgugcggauuaacucugcuaaacuugucuccgugcugaagaaggcccucgagaucacgaaagcgagccacguuacaccucagcccgaagauuccuggaucccccugcuuauuaaugcuaucgaccacugcaugaaccgcauuaaggagcugacccagucugaacucgagcuguga

SEQ ID NO: 67038 - RNA, 1233 nt, Artificial Sequence
  derived and/or modified sequence opt5 from CCNE1__Homo_sapiens__NP_001229
augcccagagagcggcgcgaaagagacgccaaggagcgggauaccaugaaagaagacggcggggcugaguucagcgcccgcuccagaaagcggaaagcgaacgugacagucuuucugcaggauccugacgaagagauggcuaagaucgaucgcacggccagagaccaaugcggaucucagccgugggauaauaacgccguuugugcugaccccugcagccucauuccuacccccgauaaagaggacgaugaccggguguacccuaauuccacauguaagccccgcaucauugccccuucuagaggcagcccgcugcccgugcuuuccugggcuaaccgggaagaggucuggaagaucaugcugaauaaagaaaagaccuaucuccgcgaucagcacuuccuggagcagcauccucuucugcaacccaaaaugagagccauucuccuggacuggcugauggaggugugcgaaguuuacaagcuccaccgggagacauuuuaucuggcgcaggacuucuuugaucgcuacauggccacccaggaaaacguggucaaaacacuucugcagcucaucgggaucucuagccuguucauugcugccaaacuugaggaaaucuauccucccaagcugcaucaauuugcuuacgugaccgacggagccuguuccggcgaugagauucucacgauggagcugaugaucaugaaagcgcugaaguggagacucagcccgcugaccauuguuucuuggcuuaauguguauaugcaggucgccuaccugaacgaccuccacgaagugcugcuuccucaguacccccagcaaaucuucauucagaucgcugagcugcucgaucugugcgugcuggacgucgauugucucgaauuuccuuaugggauccuggccgcuuccgcccuuuaccauuucucuucuuccgagcugaugcagaaaguuagcggauaucaauggugcgacauugaaaauugugugaaguggauggugcccuuugccauggucauccgggagacaggcagcuccaaacucaagcacuucagaggcguggcugaugaggacgcgcacaacauucagacccaucgcgauagccuggaccuucuggacaaagcccgggcuaagaaggccaugcucuccgaacagaauagagccucuccccugccuagcgggcugcucacaccgccccaguccggaaagaagcaaagcucuggcccugagauggcuuga

SEQ ID NO: 67039 - RNA, 1215 nt, Artificial Sequence
  derived and/or modified sequence opt5 from CCNE2__Homo_sapiens__NP_477097
augagcagacgguccucucgccugcaggccaagcaacagccccagccuagccagaccgaguccccgcaagaagcucagaucauucaggccaaaaagagaaaaacaacgcaggacgugaagaaacggcgcgaggaagucaccaagaagcaccaauacgagaucagaaacugcuggcccccuguucucucuggcgggauuagccccuguaucauuaucgaaacaccucauaaagagaucggaaccuccgauuucucucgguuuacaaauuaucgcuucaagaaccuguuuauuaaucccagcccucuuccggaccuguccuggggcugcagcaaagagguguggcucaacaugcugaagaaagaaucuagauacgugcacgauaagcauuucgagguccuucacuccgaccuggaaccccagaugcggagcauccuccuggauuggcugcucgaggugugugagguuuauacccugcaucgcgaaacauuuuaccuugcgcaggacuucuuugauagauucaugcugacccagaaggacauuaauaaaaacaugcuccaacugaucgggauuacgucucuuuuuaucgcuuccaagcuggaggaaauuuaugccccuaaacuccaggaguucgccuacgugaccgauggagcuugcagcgaagaggacauccugcggauggagcugaucauucucaaggcccugaaaugggaacuuugucccgucacaaucauuucuuggcugaaucucuuucuucagguggaugcucuuaaggacgccccuaaaguucugcucccccaauauucccaggagaccuucauccagauugcgcagcugcuggaucucugcauccuggccaucgacagccuugaauuucaauaccgcauucugacagcugccgcucucugucacuucaccuccaucgagguggucaagaaggccucuggccuggaaugggacagcauuuccgagugcguggauuggauggugccguucgucaacguugugaaaagcacgucuccugugaagcugaaaacauuuaagaaaauccccauggaggacagacacaauauucagacccauacaaacuaccuggcgaugcucgaagaggucaauuauaucaacaccuuccggaaagggggacagcuguccccuguguguaauggcggcaucaugaccccucccaagagcacagaaaagcccccggggaagcacuga

SEQ ID NO: 67040 - RNA, 2361 nt, Artificial Sequence
  derived and/or modified sequence opt5 from CCNF__Homo_sapiens__NP_001752
augggcagcgggggagugguccacugcagaugugccaagugcuucuguuaccccaccaaacggcgcaucagacggcgcccuagaaaccugacaauucucucccugccggaggacguucuuuuucauauccugaaguggcucucuguggaagauauucuggcugugcgggccguccacagccagcuuaaagaccugguggauaaucaugcguccguuugggcuugcgccucuuuccaagagcucuggcccagcccuggcaaccugaagcuguuugaacgcgccgcugagaaagggaauuucgaagccgcugugaagcucggaaucgccuaucuguacaacgagggccuuuccgucucugacgaggcgagagccgaagugaaugggcugaaggcuagccgguuuuucucccucgccgagcgccugaacguuggagcugcccccuuuauuuggcuuuucaucagaccucccuggagcgugucuggcuccuguugcaaagcggucgugcacgaaagccugcgggccgagugucagcuccagcgcacgcauaaggcuucuauccugcacugccugggcagagugcucucccuguuugaggaugaagagaaacagcaacaggcccacgaccuuuucgaagaggcugcccaucaggggugucugaccagcucuuaucuccugugggaauccgaucggcgcacagacgucagcgauccuggaagaugccuucacuccuuucggaagcugagagacuacgccgcuaaaggcuguugggaggcgcagcucucucuggccaaggcuugcgccaaugccaaccaacuggggcucgagguucgcgcuagcuccgaaauugugugccagcuguuccaggccagccaggcggugucuaagcaacaggucuuuuccgugcagaaaggacuuaaugauaccaugcgguauauccugauugacuggcucguugagguggcuacaaugaaggauuucaccagccugugucuucaucugacagucgaaugcguggacagauaccuccgccggagacugguuccgcgcuaucggcugcaacuccugggcaucgccuguauggugauuugcaccagauucaucucuaaagagauucuuacgauccgcgaagccgucuggcugaccgacaacacauacaaguacgaggaucucgugcggaugaugggggagaucgucagcgcucuggaaggaaaaauuagagugcccaccguuguggacuauaaggagguccugcuuacacucgugccuguugaacugcgcacccagcaccuguguuccuuucucugcgagcugucucuucugcacacgagccucuccgccuacgcucccgcccggcuggcggccgcugcccugcuucucgcuagacugacacauggccagacccagccuuggacaacccaacugugggaucucaccggcuucagcuaugaagaccugauccccugugugcuuucucugcacaaaaagugcuuucaugaugacgccccgaaggauuaccggcaggucucccucacagcggugaaacagcgcuucgaggacaagagauauggggagauuagccaggaagaggugcugucuuacucccaacugugugccgcucuuggaguuacgcaggauagcccugaucccccuaccuuucucuccacaggcgaaauccacgccuuccugucuagccccuccgggcggagaaccaaacgcaagcgggagaauagccugcaggaggacagaggaucuuuugucacaacccccacggcugaacucuccagccaggaggaaacacugcuuggcucuuuccuggacuggucccucgacugcuguagcggguaugagggagaucaagaaucugagggcgagaaagaaggcgacgugaccgccccuuccgggauucuggaugugaccgucguguaccugaacccggagcagcauugcugccaggaaagcucugacgaggaagccugucccgaggauaagggaccucaggacccccaagcucuugcgcucgauacacagaucccugccacccccggcccgaagccucugguucgcacaagcagagagcccgggaaagacgugacgaccuccggauacagcucugucuccacagcuagcccuaccuccucuguggauggcgggcugggcgcccucccccagccuacaagcguucugucccuugacucugauagccacacccaacccugccaccaucaggcccggaaguccugucugcagugccgcccgccuucuccucccgaaagcuccgugccccagcaacaggucaaaagaaucaaucucuguauucacagcgaggaagaggacaugaaccugggacuggugcggcuuuga

SEQ ID NO: 67041 - RNA, 888 nt, Artificial Sequence
  derived and/or modified sequence opt5 from CCNG1__Homo_sapiens__NP_954854
augaucgaggugcugaccacaacggacagccagaagcuccugcaccaacuuaacgcccugcucgaacaggaguccagaugccagcccaaagucuguggccugcggcuuauugaaucugcucaugauaaugggcugcgcaugaccgccagacuccgggacuucgagguuaaggaucugcugagccucacacaguuuuucggauuugacaccgaaacauucucccuggcggugaaccuucuggaucgcuuucucucuaaaaugaaggugcaaccuaaacaccugggcugcgucgggcuuagcuguuucuaccuggcugugaaguccaucgaggaggaaagaaauguuccgcucgccaccgaccugauucggaucucucaguaucgcuuuacagugagcgaucugaugagaauggagaagauuguccucgaaaaagugugcuggaagguuaaagccaccacggcuuuccaguuucugcagcuuuacuauucccugcuccaagagaaccugccccuugagcggcgcaauagcaucaacuucgaaagacuggaggcccagcucaaggcuugucauugccggaucaucuuuucuaaagccaagccuuccgugcuggcgcugagcauuauugcccucgaaauccaggcucagaagugugucgagcugaccgaaggaauugagugccuucaaaaacacucuaagaucaauggccgcgaccugacauucuggcaggagcucguguccaaaugucugaccgaauacagcucuaacaagugcuccaaacccaaugugcagaaacuuaaguggauugucagcgggagaacagcccggcaacugaagcauuccuauuaccgcaucacccaccucccuacgauccccgagaugguuccuuga

SEQ ID NO: 67042 - RNA, 1035 nt, Artificial Sequence
  derived and/or modified sequence opt5 from CCNG2__Homo_sapiens__XP_011530701
augaaggaccugggcgccgagcaccucgcugggcaugaaggagugcagcugcuuggccugcucaacgucuaccuggagcaagaagagagauuccagccccgggaaaaagggcuuagccugaucgaggccaccccugagaaugauaacacacucugcccgggacugcgcaaugcgaagguugaagaccugagaucccucgcuaacuuuuucggcucuuguacggagaccuuugugcuggccgugaauauucuugaucgguuccuggcccucaugaaagucaagcccaaacaccugagcugcaucgggguguguuccuuucuucuggcugcccgcauuguugaagaggacugcaacaucccuucuacacaugaugugauuagaaucagccaguguaagugcaccgcuuccgacaucaagcggauggagaaaauuaucucugaaaagcuccacuaugagcuggaagccacaaccgcgcugaauuuccuccaucuguaccacacaauuauccuuugucacaccagcgagcgcaaagaaauucugucccucgauaagcuggaggcccagcuuaaggcuugcaacuguagacugaucuuuagcaaagccaagcccucuguccucgcucugugccugcucaaucuggagguggaaacgcuuaaauccguugagcugcucgaaauucugcuucuggugaagaaacauagcaagaucaacgacaccgaguucuuuuauuggcgggaacucgucucuaaaugucuggccgaguacuccagcccugagugcugcaagcccgaucugaaaaagcucguguggaucgugucucgcagaacagcgcaaaaucugcacaacuccuauuacagcgucccugaacuuccgaccauucccgagggaggcuguuucgacgaauccgagucugaagauagcugcgaggacauguccuguggcgaggaaagccugucuuccagcccucccucugaucaggagugcacauuuuucuuuaauuucaagguugcccagacccucuguuucccuagcuga

SEQ ID NO: 67043 - RNA, 813 nt, Artificial Sequence
  derived and/or modified sequence opt5 from CCNH__Homo_sapiens__NP_001186118
augacccugugcaaguacuaugagaaaagacuccuggaguucuguagcguguuuaagcccgccaugccucgguccgucguuggcacagcuugcauguacuucaaacgcuuuuaucuuaacaauucugugauggaauaccacccgagaaucauuaugcugacgugugccuuccucgcgugcaagguggacgaauuuaacgucagcagcccccaguucguggggaaucugcgggagucuccucuuggacaagaaaaagcucuggagcagauccucgaguaugaacugcugcucauucagcagcugaacuuucaucuuaucguucacaaucccuaccgcccuuucgagggcuuucugauugaucucaagaccagauaucccauccuggaaaacccugagauccuucggaagacagccgacgauuuccugaaucgcauugcccucaccgacgcuuaccugcuguacacaccgagccaaaucgcccucaccgcuauucuguccucugccagcagagcggggaucacaauggaguccuaucuuagcgaaucucugaugcucaaagagaaccggaccugucugucccagcuucuggauauuaugaaguccaugcgcaaucucgugaaaaaguacgaacccccuagaucugaggaagucgccgugcugaaacagaagcuggagcggugccauuccgcugagcucgcccugaacguuaucacgaagaaacgcaagggauaugaagacgaugacuacgugagcaaaaagucuaaacacgaggaagaggaauggaccgaugacgaucuugucgagucccuguga

SEQ ID NO: 67044 - RNA, 1134 nt, Artificial Sequence
  derived and/or modified sequence opt5 from CCNI__Homo_sapiens__NP_006826
augaaguuccccggcccucuggagaaccagagacucagcuuucugcuugaaaaagccaucacccgggaggcucaaauguggaaggugaauguccgcaaaaugccguccaaccagaauguuucucccagccagagagacgaagugauucaguggcuggccaagcucaaauaccaauucaaccuguauccugagacauuugcgcuugcuuccucucugcucgaucgguuccuggccacggugaaggcccaccccaaguaccugagcugcaucgcuauuuccugcuuuuuccucgccgcuaaaaccgucgaagaggacgagcgcaucccugugcugaagguucuugccagagauucuuuuuguggguguagcuccagcgaaauucugcggauggagcgcaucauccucgacaaacugaauugggaucuucauacagcgacaccccuggacuuccuccacauuuuucaugccaucgcugugucuaccagaccucagcugcuguucucccucccgaagcugagccccucucagcaccuugccguccugaccaaacagcuccugcauugcauggcuuguaaccaacuucugcaguuucggggauccaugcucgcccuggcgauggugagccuggaaauggagaagcucauuccugauuggcugucucuuacaaucgagcugcuccagaaggcccagauggacuccagccaacugauucacugccgcgaacuuguugcucaccaucuguccacccuccagucuagccugccccucaauuccguguaugucuacagaccucugaaacacacgcuggugaccugugauaagggcguguuccggcuucaucccagcucugucccggggccugacuuuuccaaagauaacagcaagcccgagguuccugugcgcggaacagccgcuuucuaucaccaucugcccgccgccucuggcugcaaacagaccagcacaaagagaaaaguggaagagauggaagucgacgauuucuacgacgggaucaagcggcucuauaaugaggacaacguguccgagaauguuggaucuguguguggcaccgaucugagccgccaagaaggccacgcuucccccugcccuccgcugcagcccgucagcgugauguga

SEQ ID NO: 67045 - RNA, 1152 nt, Artificial Sequence
  derived and/or modified sequence opt5 from CCNJ__Homo_sapiens__NP_001127847
auggagcuggaaggccagugguggagagggcaacucgccgcugacauccaccaggcccugcgguacaaggagcuuaaacugcccagcuauaagggacaguccccucagcucucucugcgcagauacuucgcggaucuuauugcuaucgugagcaaccgguuuacccugugcccguccgcccgccaucucgccgucuaucugcuggaccucuucauggauagauacgacauuucuauccaacagcugcaccuuguugcucugagcugucuccugcuugccuccaaauuugaagagaaggaagauucugugcccaaacuggagcagcucaauagccugggcugcaugacaaacaugaaucuggugcucacgaagcagaaccugcuucauauggagcugcuccugcuugaaaccuuccaauggaaucugugucucccuacagcugcccacuuuauugaguauuaccuguccgaagcgguccaugagaccgaccugcacgauggguggcccaugaucugccucgagaagacaaaacuguauauggccaaguacgcugacuacuuccuugaagugagccugcaggauuaugccuuucucaacuacgcuccuucucugguugccgcggccuguguggcuuccagccggaucauucuucgccugucucccaccuggccuacaagacuccaccggcugaccgccuauuccugggacuuccugguccagugcaucgagcgccuccugauugcucaugauaaugacgugaaagaagccaacaagcagagaggacaagccggcccgcagagcgcucagcuuucuguuuuucaaacggcgucccagcccagccggccugugcacuuccagcagccccaauaccugcaucagacccaccagacaucccuccaguaucgccacccuaccucugagcaacccagcugucagcagaucgucuccacaacccauacgagcucuuacacacugcagaccugcccggccggguuucaaacauccgugcagggacugggccacaugcagaccggcguggggaugagccuugcuauuccugucgaaguuaaacccugucucucugugagcuauaauagauccuaccagaucaacgagcauuacccuugcauuacccccuguuucgagcgguga

SEQ ID NO: 67046 - RNA, 1308 nt, Artificial Sequence
  derived and/or modified sequence opt5 from CCNJL__Homo_sapiens__NP_078841
augauggacgagcccuggugggaaggcagaguggccagcgauguccacugcacccugcgggagaaggaacucaaacugccuacauuccgcgcucauuccccgcuucugaagucuagacgguuuuucguugacauccucacgcugcuuagcucccacugucagcugugccccgccgcgcgccaucucgcuguguaccugcuggaucacuuuauggacagauauaacgugaccacaucuaaacaacucuacaccgucgccgugagcugucugcuucuggccaaugggguuucccuccugucuccucggcuuaagugcagcggaaugauuuccgcucauuguaaccugcaccuccccggcagcucuaauuccccugccagcgcuccccacccuccgcccacaccuccccagguggccgagaccacagggaaauucgaagaucgcgaggaccaugucccuaagcuggagcagaucaacucuacccggauucuguccagccagaauuuuacgcucaccaagaaagaacugcuuucuacagagcugcuccugcuugaagcguucuccuggaaccugugccuccccaccccggcccacuuucuggauuauuaccugcucgcuagcgugucccaaaaggaccaucacugucacacauggccuaccacgugccccagaaaaacaaaggagugucugaaagaguaugcccauuacuuccuugaaguuacccugcaggaucacaucuuuuauaaguuccagccuucuguggucgcugccgcgugcgugggagccagccgcauuugucuccagcugucccccuacuggacaagagaccuucaacggaucagcucuuacucccuggagcaucucagcacgugcaucgaaauucugcugguggucuaugauaauguucucaaggacgcuguggccgugaaaucucaggcucuggccaugguccccggcaccccuccgacacccacccaggugcuuuuucagccucccgccuacccugcucuggggcaacccgcgaccacacucgcccaguuccagaccccgguucaagaucugugccuggcuuaucgcgacagccuucaggcccacagauccggaucucuccugagcggcuccacaggcagcucucugcauaccccuuaccagccccuccagccucuggacaugugucccgugccuguccccgccucccuuagcaugcacauggcuaucgccgcggagccgcggcacugccuggcuacgacauaugggucuuccuacuuuagcggaucccauauguucccuaccggcuguuucgaucgcuga

SEQ ID NO: 67047 - RNA, 1743 nt, Artificial Sequence
  derived and/or modified sequence opt5 from CCNK__Homo_sapiens__XP_011535577
augaaggagaacaaagaaaauagcucccccucugugaccagcgccaaccuggaccacacaaagccuugcugguacugggauaaaaaggaccucgcucacacgccgucccagcuggagggccuugaucccgccaccgaagcgagauaccggcgcgagggggcuagauucaucuuugacgucggaacacggcugggccuccacuacgauacccuggccacagggauuaucuacuuccaucgcuuuuacauguuccacucuuuuaaacaauucccuagauauguuaccggagccuguugccuuuuucuggcuggcaagguggaagagacacccaagaaauguaaggacauuaucaaaaccgcccggagccuccugaaugaugugcaguucgggcaguuuggagacgauccuaaggaggaagucauggugcuggagcgcauucuccugcagacgaucaaauucgaccuucaaguugaacaucccuaccaguuucugcucaaguaugcuaagcagcugaaaggcgauaagaacaaaauccagaaacuugugcaaauggccuggaccuucgucaaugacucccugugcacaacccucucucugcagugggagccugagauuaucgcgguggccguuauguaccuggcuggcagacucuguaaguuugaaauucaggaguggacaagcaagccgauguaccggcgcuggugggaacaguucgugcaagauguccccguggacgugcuggaggacaucugccaccagauucuugaucuguauucccaggggaaacaacagaugccucaccauacgccccaccagcuccagcaaccucccagccugcagccgaccccucaggucccccagguucaacagucucagccuucccagagcucugaacccucccaaccccagcagaaggacccucagcaaccggcccagcagcaacagcccgcucagcagccuaagaaacccagcccucaacccucuuccccgagacaggugaagcgggccguggucgugagcccuaaagaggagaacaaggcggccgaacccccucccccuaaaauccccaagauugagacaacccauccgccucuuccucccgcucaucccccgcccgaucgcaagccuccccuggccgcugcccucggagaagccgagccucccggcccuguugacgcuacagaucugcccaaagugcagaucccgccucccgcgcacccugcccccguccaccagccgccuccccugccucacagacccccucccccgcccccuuccucuuacaugaccgggaugagcaccacauccagcuauaugucuggagaaggcuaccaaucccuccagagcaugaugaagacggaggggcccucuuauggagcucugccucccgccuacggcccuccggcccaucuucccuaucacccucauguguaucccccuaaucccccgccuccucccguucccccucccccggcuagcuuucccccucccgccaucccucccccgaccccuggcuaucccccucccccucccacauacaacccgaauuucccucccccucccccgcggcugcccccuacccacgcggugcccccucaucccccuccggggcucggacugcccccugcuuccuaucccccucccgccgucccgccuggcgggcagccucccgugcccccucccauuccgcccccuggaaugcccccugucggcgggcuuggacgcgccgcuuggaugagauga

SEQ ID NO: 67048 - RNA, 1581 nt, Artificial Sequence
  derived and/or modified sequence opt5 from CCNL1__Homo_sapiens__NP_064703
auggccagcggcccccacuccaccgcuacagccgcggcugccgccucuagcgcugccccuuccgcugggggaucuagcuccggcacgaccacaaccacaaccacaaccaccgggggaauccugauuggcgacagacucuacucugaggugagccugacgaucgaucauucccuuauuccggaggaacggcugagccccacaccuucuaugcaggacgggcucgaucugcccuccgaaaccgaccuucgcauccugggaugcgagcucauucaagccgcgggcauccugcugagacucccucaggucgccauggcuacaggccagguucuguuccaccgguuuuucuauagcaagucuuuugugaaacauuccuucgaaaucguggccauggcuuguauuaaccuugccagcaagaucgaggaggcgccccgccggauucgggaugucaucaauguguuucaccaucugcgccagcucagagggaaacggaccccuucuccgcugauucuugaccaaaacuacaucaauacgaagaaccagguuauuaaagccgaacgcagagugcugaaggagcucggauucugcguccacgugaagcacccccauaaaaucaucguuauguaucuccaggugcuggaaugugagcggaaucagacacugguccaaaccgcuuggaacuacaugaaugauucccugcgcacaaacguguuugugagauuccagccugagaccauugccugcgcuuguaucuaucuugccgcccgggcucugcagauuccccucccuacccgcccccacugguuucugcuuuucggcacaacggaagaggaaauccaggagauuugcaucgaaacccugagacucuacacacggaagaaaccgaauuaugagcugcuggagaaggaagucgagaaaagaaagguugcgcuccaagaagccaagcugaaagcuaaggggcuuaacccugacggaacccccgcccugagcacacucggcggguuuuccccugccucuaaacccagcagcccccgcgaggugaaggcugaagagaaauccccuaucucuauuaaugugaagaccgucaaaaaggagccggaagaucggcagcaggccuccaagagccccuacaacggagugagaaaagacucuaagcgcagcagaaauuccagaucugcgagccgcucccggagcagaacgcgcucucgguccagaagccauacaccucgccggcacuacaacaauagacggucucgcuccggcaccuauagcuccagaucucggagcagaucccgcucucacagcgagagcccccggagacaucacaaccauggcuccccucaccugaaagcuaagcauacccgcgaugaccuuaaaucuuccaacagacacgggcacaagcggaagaaaagccgcucuagaucccaaagcaagucucgggaucauagcgacgccgccaaaaagcaccgccaugaaagaggacaccaccgggaccgcagagagcggucccgcagcuucgaaagaucucauaaauccaagcaccauggcgggagccgguccggacacggcagacaucgccgguga

SEQ ID NO: 67049 - RNA, 1170 nt, Artificial Sequence
  derived and/or modified sequence opt5 from CCNL2__Homo_sapiens__XP_011540521
augggccagcuggccgcugcccucaugagccccagacgggggcugccucuuggagcggaguccccgucugcucgcugcagccacgccuccaaccugcaucccagaggcuucucucucuuucaaguggacagcuucaaggaagccgcugcccgguccgcugagaaagggccugccgcgucugcccuggaagaggaagaggaggaacccaagcgcauggcuugucuuccugccgcuacccccgcccugugcagcgcguccagcuuugagaauuacaugaacgauucucucagaacagacgucuucguucgguuucagccugaauccaucgccugugcuugcauuuaucuggccgcucgcacgcuggagaucccgcuccccaauagaccucacugguuccugcuuuuuggagccaccgaggaagagauucaggaaaucugucugaaaauucuccagcuguacgcccggaagaaaguggaucuuacacaucuggagggcgaaguggagaagcgcaagcacgcuaucgaggaagcgaaagcccaagcuagagggcuccugcccggaggcacccagguccuggacggcacaagcggguucucuccugcccccaagcucguggaguccccgaaagaaggaaagggcagcaaaccuucuccccuguccguuaagaacaccaagcggcgccuugagggggccaaaaaggcuaaagccgauagcccugugaauggacugcccaagggcagagaaucccggucucgcagcagaucccgggagcagagcuauucuagaucccccagccgcucugcgagcccuaaacggagaaaguccgacucugggagcacauccggaggcagcaaaucucagucccgcagccggucuagauccgauagcccgccccgccaagcuccucgguccgcccccuacaagggcucugagaucagagggagccgcaaguccaaagacugcaaguauccucagaaaccccauaagucucggagcagauccagcucucgcucccggagcagaucucgggaacgcgccgauaacccgggaaaauacaagaagaaaucccacuauuacagagaccagcggagagagcgcagccggucuuacgaaagaaccggccgcagauaugagcgggaucacccugggcauagccgccacagacgguga

SEQ ID NO: 67050 - RNA, 1053 nt, Artificial Sequence
  derived and/or modified sequence opt5 from CCNO__Homo_sapiens__NP_066970
auggugacccccugcccuacaagcccguccucucccgccgcuagagccggccggcgcgacaacgaucagaaucugagagcgccugucaagaaaagccggcgccccagacuccggcgcaagcaaccucugcacccccuuaacccuuguccgcugcccggggacuccggaaucugcgaucucuucgagucuccuagcuccggcucugacggggcugaaagccccuccgccgccagaggaggcagcccucugcccgggccggcucagccuguugcccagcuugaucugcagacguuucgggacuacggacaaucuuguuaugcuuuccgcaaagcccaggagucccauuuucaccccagagaagcgcucgcccggcagccucaggugaccgcugagagccgcugcaagcugcugucuuggcucauucccgugcauagacaauucggccuguccuuugaaagccuuugucugacagucaauacccucgaucgguuccugacaaccacacccguggccgcugacugcuuucagcuucugggcguuaccucucuccugaucgccuguaaacagguggagguccacccuccgcgcgugaagcagcugcucgcgcugugcuguggggccuucuccagacaacagcuuugcaaccuggaguguauuguucuccauaagcugcacuuuacgcuuggagcucccaccaucagcuucuuucuggaacacuucacacaugcccggguggaggcuggccaggccgaagccuccgaggcucucgaggcgcaagcccuggcuagaggggucgccgaacugucucucgccgauuacgcuuuuaccagcuauuccccuagccugcuugccauuugcugccuggcgcucgcugaccgcaugcugcgggugucuagacccguggaucuucgccugggagaccacccugaggccgcccucgaagauuguaugggcaaacugcagcugcucgucgcuaucaauuccacaagccugacccauaugcuucccguucagaucugcgagaaguguucucugccgccuagcuccaaauga

SEQ ID NO: 67051 - RNA, 2181 nt, Artificial Sequence
  derived and/or modified sequence opt5 from CCNT1__Homo_sapiens__NP_001231
auggagggcgaaagaaagaacaauaacaaacggugguacuucacccgcgagcagcuggaaaauagccccuccagacgguuugggguggacccugauaaggagcucucuuaucgccaacaggccgcuaaccugcuucaggacaugggacagagacugaaugucagccaacucacaaucaacacggccauuguuuacaugcaccgguucuauaugauccaguccuuuacccaguucccgggcaauucuguggcgcccgcugcccuguuucuugccgcuaaaguggaagaacagccuaagaaacuggagcaugucauuaagguggcccacacaugccuccauccccaagaaagccugccugauacccgcuccgaggcuuaccugcagcagguucaggaccucgugauccuggaaucuauuauccuucaaacacugggguucgagcucaccaucgaucacccccauacacacgucgugaaguguacccagcugguuagagccagcaaagaccuugcgcagacguccuauuuuauggccaccaacagccugcaccucacaaccuucucucugcaauacacaccuccgguggucgcuugcguguguauucaucuggccugcaagugguccaauugggagauccccgugagcaccgauggaaaacacuggugggaauaugucgacgcuacgguuacacucgagcugcuugaugaacugacccaugaguuucuccagauucuggaaaagacaccuaaccggcuuaaacgcaucuggaauuggagagccugugaggcggccaagaagaccaaagcugacgaucggggcaccgacgagaagacaucugaacagacgauucugaacaugaucucccagucuagcuccgauaccacaauugccgggcucaugagcauguccaccucuacaaccagcgcugugcccucccugccugugagcgaggaaucuuccagcaaucugacgucugucgagaugcuccccggaaaacgcuggcugagcucccaaccgucuuucaaacuugaaccuacacagggccacagaaccagcgagaaccuggcccucaccggcguggaccacucccugccccaggacgggagcaaugccuuuaucucucagaagcaaaacuccaagagcguuccuucugcuaaagugucccuuaaggaguaccgggcgaagcaugccgaggagcuggcugcccagaaacgccagcucgaaaacauggaggccaaugucaagagccaguacgcuuaugccgcgcaaaaccugcugucccaccaugauucucacagcuccgugauccucaaaaugcccauugaaggaucugagaaucccgagagaccuuuccuggaaaaggcugacaaaacagcccuuaagaugcggaucccgguugccggcggggauaaggcugccagcuccaaacccgaggaaauuaagaugagaaucaaagugcaugcugccgcggacaagcacaacagcgucgaggauucugugaccaaaucccgcgagcacaaggaaaagcauaaaacacacccuagcaaucaucaccaccaucacaaccaucacucucauaagcacucccacagccagcugcccgucggaacgggcaauaaacggccuggggaccccaagcauucuagccagaccuccaaccucgcccacaaaacauacagccugucuuccagcuuuuccucuagcuccucuaccagaaagcgcggaccgagcgaggaaacaggcggcgcuguguucgaucauccugccaagauugcuaaauccaccaagucuagcucccugaauuucagcuuucccucucuuccuacgauggggcagaugcccggacacuccagcgacaccucuggccucuccuucagccaaccuucuugcaaaacacggguuccccauuccaagcuggauaaagggccgaccggagccaacggccacaauacaacccagacgaucgacuaucaggauacagugaacaugcugcacagccuccuguccgcgcaagggguccagccuacccagcccacagccuuugaguucgugagacccuacagcgacuaucuuaauccucgcucuggaggcaucagcucccggucuggcaacaccgacaagccgagacccccuccccugccuagcgaacccccucccccgcucccuccccugccuaaauga

SEQ ID NO: 67052 - RNA, 951 nt, Artificial Sequence
  derived and/or modified sequence opt5 from CCNY__Homo_sapiens__NP_001269781
augggcaacaccacaagcugcuguguguccucuagccccaagcugagacggaaugcccacucccgccucgagucuuacagaccugacacggaucugagccgggaagacaccgggugcaaccuucagcauaucuccgaucgcgagaauauugacgucagagaaaaacggaagucucuguucaucaaccaccauccgcccggacaaauugcucgcaaauauagcuccuguagcacaaucuuucucgaugacucuaccguuucccagccuaaucugaaguacacaauuaaaugcguggcccuugcgaucuauuaccacaucaagaacagagaucccgacggccggaugcugcucgauauuuucgacgagaaucugcauccucugagcaagucugaagugcccccugauuaugacaaacacaacccggagcagaagcagaucuaccgcuuugucagaacccucuucuccgcugcccaacugacagccgagugugcuauugugacccuuguuuaucuggaacggcuccugacguacgccgagaucgauauuugccccgcuaauuggaaacgcaucgugcuuggggccauucugcucgcgagcaaggucugggacgaccaggccguguggaacguugauuacugucagauccugaaagacaucaccguggaagauaugaaugagcuggagagacaguuucucgaacugcuucaauucaacauuaaugucccuucuuccguguaugcuaaguacuauuuugaccugcggagccucgccgaggcuaacaaucuguccuucccccuugaaccucugucucgcgagagagcccacaagcucgaagcgaucagccggcugugcgaggauaaauacaaggaccugagacgcuccgcccggaaaagaagcgcuucugccgauaaccucacacugccccgcugguccccggcuauuaucagcuga

SEQ ID NO: 67053 - RNA, 2976 nt, Artificial Sequence
  derived and/or modified sequence opt5 from CCP110__Homo_sapiens__NP_055526
auggaggaauacgagaaguucugcgaaaaaucucuggccagaauccaggaggcuucccucucuaccgaaucuuuucugcccgcccaauccgagucuauuagccuuauccgguuccacggcguggcgauucuguccccucuccugaacaucgagaagcgcaaagaaaugcagcaggagaagcagaaagcucuugacgucgaagccagaaagcaaguuaaucggaagaaagcccugcucacacgcgugcaggagauucuggauaacgugcaggucagaaaggcuccgaaugccucugacuuugaucagugggagauggaaacgguguauagcaacuccgagguucggaaucugaacgugcccgcuaccuucccuaauagcuuucccucucauacagaacacuccaccgccgcgaaacucgacaagaucgccgggauccugccucuugauaacgaggaccaauguaaaacagauggaauugaccuggcucgcgauagcgaaggcuucaauucucccaagcagugcgacuccagcaacaucucucaugucgagaaugaggccuuuccuaagaccuccagcgcuacaccgcaggaaacccucauuuccgaugggcccuucucugugaacgagcagcaagaccugccucuucuggccgaaguuauccccgauccuuacgugaugagccuccagaaucugaugaaaaaguccaaagaguauauugaaagagagcagagccggcgcucucugagaggauccaugaaccggaucgucaaugagagccaccucgacaaggaacaugacgcgguggagguggccgauugugucaaagaaaagggccaacugacggggaaacacugcguuucugugauucccgacaagccgagccuuaacaaguccaacgugcugcuccagggagcuucuacccaggccagcuccaugagcaugccuguccuggcuucuuuuuccaaaguggauauccccauccgcacaggccacccuaccguucuugagagcaauucugacuucaaggugauucccacauuugucaccgaaaacaaugugaucaaaucccugacgggcagcuacgccaagcuccccuccccugagccgucuaugagccccaaaaugcauagacggcgcuccagaacaucuagcgccugucacauucugaucaacaauccuauuaacgcuugcgagcugucccccaaggggaaggaacaggcgauggaucucaucauccaagacaccgaugagaauacaaacguuccugaaauuaugcccaaacugccgaccgaccuugccggaguguguagcucuaaggucuaugugggcaaaaauaccuccgaggucaaggaggaugugguucuggggaaaagcaaccaggugugccagucuuccggaaaucaucucgaaaacaaggucacacacggccuggugacgguugaggggcagcuuaccagcgacgaacggggagcucacaucaugaauagcacaugugccgccaugccuaagcugcaugagcccuacgcuagcucccaaugcauugccagcccuaacuucggcaccgugucuggccucaaacccgcguccaugcuggaaaagaauuguagccugcagacagagcucaacaaauccuaugaugucaagaacccuucuccccugcuuaugcagaaucagaacaccagacaacagauggacacgccgauggugagcugcgggaaugagcaguuucuggacaacuccuucgaaaaagugaagcgccggcucgaucuggacaucgauggacugcagaaggagaauugcccuuacguuauuacaucuggcaucaccgaacaagagagacagcaccuucccgaaaaacgcuaccccaaggggagcggauucgucaacaaaaauaagaugcucggcaccuccucuaaagagagcgaggaacugcugaaguccaaaaugcucgcuuuugaggaaaugcggaagagacuggaggaacagcaugcccaacagcuuagccugcucaucgccgagcaggagcgcgaacaggagcggcugcaaaaggaaauugaggagcaggaaaagaugcugaaagagaaaaaggcuaugacagccgaagcuagcgagcuugacaucaacaaugccguggaacucgaguggagaaaaauuuccgauagcucucugcuggagaccaugcucucccaggcggacagccugcacacaucuaacuccaauagcuccggguucacgaacagcgccaugcaguauucuuuugugagcgcuaaugaagccccuuucuaccuuuggggauccucuaccagcggccugacaaagcucuccgucacccgcccguuuggccgggcuaagacaagauggucucaaguguucagccuggagauccaggccaaauuuaacaagauuaccgcgguugccaaaggguuccugacgcgccggcuuaugcagaccgauaagcucaaacagcugagacaaacagugaaggacaccauggaauuuauccgguccuuccagucugaggcuccccugaagcgcggaauugucagcgcccaggaugcuucccuccaagaaagagugcuggcccagcuucgggccgcucuguauggcauccaugacaucuuuuucguuauggaugcggccgagagaaugagcauucuccaccacgaccgcgaggugcggaaagaaaagaugcugagacagauggauaaaaugaagucuccucgcgucgcucuguccgccgccacacagaaaagccuugacagaaagaaguacaugaaagcugccgagauggggaugcccaauaagaaauuucucgugaagcaaaacccuucugaaacccggguucugcagcccaaccagggacagaaugcgccugugcaucgccugcucuccagacaaggcagcaucugucggaaaaaccccaagaaagcugccaagugcugugacaaucugcgcagacagcacucccuuggguga

SEQ ID NO: 67054 - RNA, 1089 nt, Artificial Sequence
  derived and/or modified sequence opt5 from CCR10__Homo_sapiens__NP_057686
augggcaccgaggccacagaacaggugagcugggggcacuacuccggagacgaggaagaugcuuauucugccgagccccugccugaacucugcuacaaggcggacguccaggcuuucagcagagccuuucaaccguccguuucucugacgguggccgcucuuggccuggccgggaacggacucgugcuggcuacccaucuugccgcgcggcgcgccgcuagaagccccacauccgcccaccuccuccagcuggcucuggccgaucuccugcuugcgcugacccucccuuucgccgcugccggcgcucugcagggguggucucuuggaagcgccacaugucggaccaucuccggccuguauagcgccucuuuucaugcuggcuuccucuuucuggcgugcauuuccgccgaccgcuacgucgcuaucgccagagcccugcccgcugggccucggcccagcacaccuggacgcgcccaccucgugucuguuauuguguggcugcuuucccugcuccuggcgcuuccggcucugcuguucagccaagauggccagagagaggggcagcggcgcuguagacugaucuuucccgagggacugacccagacggucaaaggcgccucugccguggcucaaguugcccucggguucgcucugccucuuggagugauggucgccugcuaugcgcugcucggccggacccugcuugccgcucgcggccccgaaagacggcgcgcccugagagugguggucgcucucguugccgcguuuguggugcugcagcugccuuacucccucgcccugcuucuggacacagcugaucuccuggccgcucgggagagaagcugucccgccuccaagcgcaaagacgucgcccugcuugugaccucugggcucgcucuggcgcggugcggacugaauccgguucucuaugccuuccugggccuuagauuucgccaggaucugcggagacuccugcgcgggggaagcuguccuuccggcccccagccucggagagggugcccccgccggcccagacugagcucuuguuccgcuccuacagaaacccauagccuuucuugggacaacuga

SEQ ID NO: 67055 - RNA, 1068 nt, Artificial Sequence
  derived and/or modified sequence opt5 from CCR1__Homo_sapiens__NP_001286
auggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuuga

SEQ ID NO: 67056 - RNA, 1125 nt, Artificial Sequence
  derived and/or modified sequence opt5 from CCR2__Homo_sapiens__NP_001116513
augcugagcaccuccagaucucgguucauccgcaacacaaaugagagcggcgaagaggugacgaccuuuuucgacuacgauuauggggcccccugccacaaguuugacgucaaacagauuggagcucaacuccugccuccgcuuuacucccugguuuucaucuuuggcuucguggggaacaugcucgugguccugauucuuaucaauuguaagaaacugaagugccucacagauauuuaucugcugaaccucgccaucucugaccugcuuuuucugaucacccucccccugugggcgcauagcgcugccaaugaauggguguucggaaacgccauguguaaacuuuuuacaggccuguaccacauuggguauuucggaggcaucuuuuucauuauccuccugaccauugauagauaccuggcuaucguucaugccguguuugcucucaaggcccggacagucaccuucggcgugguuacguccgugauuaccuggcuggucgcgguguucgccucugugccugggaucaucuuuacaaagugccagaaagaggacagcgucuauguuuguggacccuacuucccucgcggcuggaauaacuuucacaccauuaugagaaauauccuugggcuggugcucccccugcuuauuauggugaucugcuacuccggcauucugaagacacuccugcggugucgcaacgaaaagaaaagacaucgggcuguccgcgugaucuucaccaucaugauuguuuauuuucuguucuggacgccuuacaauaucgugauucuccugaacacauuucaggaguucuuuggacuuagcaauugcgagucuaccucccagcuggaucaagccacacaggucaccgaaacccucgggaugacacacuguugcaucaacccgauuaucuaugcuuucgugggagagaaauuuagaagccuguuccacaucgcccuuggcugucggauugcgccccugcagaagccuguuugcggcgggcccggagugcgcccuggcaagaaugucaaagugacgacccaggggcuccuggacggaagaggcaaggggaaaucuaucggacgggcccccgaggcuucccugcaagauaaggaaggcgccuga

SEQ ID NO: 67057 - RNA, 1122 nt, Artificial Sequence
  derived and/or modified sequence opt5 from CCR3__Homo_sapiens__NP_001158152
augcccuucggcaucagaaugcugcuccgggcccacaagccugggcgcagcgagaugaccacaucccuggacacgguggaaaccuuuggaacaaccucuuacuaugaugacgucggccuucugugcgagaaagcugauacaagagcccucauggcgcaguucguuccgccccuguacagccuuguguuuaccguggggcugcucggaaacgucgugguugugaugauucugaucaaguaucggcgccugagaauuaugacaaauaucuaccuccugaaccuugcuauuuccgaccugcucuuucuggucacccuuccuuuuuggauccauuaugugcggggccacaauuggguuuucgggcauggaauguguaaacugcucucuggcuuuuaccacacgggccuguauagcgaaaucuucuuuauuauccugcucaccauugaucgcuaccuggccaucgugcaugccgucuucgcucuuagagcccggacagugaccuuuggggugauuacauccaucgucaccuggggacuggcuguucucgccgcgcugcccgaguucauuuucuacgaaacggaggagcuuuucgaagagacacugugcucugcccucuauccugaagacaccguguacagcuggcgccacuuccacacacugagaaugaccaucuuuugucuggugcucccccugcuugucauggcuaucugcuauaccggcauuaucaagacacugcuccgguguccuuccaaaaagaaguacaaagccauucgccugaucuucgugauuauggcuguguuuuucaucuuuuggacgccguauaacguugccauccuucugagcucuuaccaauccauucucuucgggaaugauugcgagagaagcaagcaucuggaccuggucaugcucgugaccgagguuaucgcguauucucacuguugcaugaaccccgugauuuacgccuuugucggagaacgguuccgcaaauaccugagacacuuuuuccaucggcaccuucugaugcaucucggcagauauaucccuuuucugcccuccgagaagcuggaacgcacaagcucuguguccccuagcaccgcugagcccgaacuuuccauugucuucuga

SEQ ID NO: 67058 - RNA, 1083 nt, Artificial Sequence
  derived and/or modified sequence opt5 from CCR4__Homo_sapiens__NP_005499
augaaccccaccgacaucgccgauacaacgcuggacgagagcauuuacuccaauuauuaccucuaugaaucuaucccuaagccgugcaccaaagagggcauuaaggcuuucggggaacuguuucuucccccucuguacagccucguguucgucuuuggacugcuuggcaacuccguuguggugcugguccucuucaaauauaagagacugcggucuaugacagauguguaccugcucaaucuggccaucagcgaccuucuguuuguuuucucccuccccuuuuggggguauuacgcggcugaucaguggguguucggacugggccuuuguaaaaugauuucuuggauguaccuggucggguuuuauagcggaaucuucuuugugaugcucauguccaucgaccgcuaccuggccauuguucacgccguguucagccugagagcucggacccucacauauggcgucaucaccucucuggccacaugguccguggcuguguuugccagccuuccuggcuuccuguucucuaccugcuacacggagcgcaaccauaccuauuguaagacaaaguacucccucaauagcaccacauggaaaguccugucuucccuugaaauuaacauccuggggcucguuauuccccugggaaucaugcuguuuugcuauagcaugauuaucagaacccuccaacacuguaagaaugagaaaaagaacaaagcggugaagaugaucuucgccguggucgugcuguuucuuggcuucuggacgccuuacaauauuguucuguuucucgagacacugguggaacuugagguccugcaggauugcaccuucgaacgguaccucgacuaugcuauccaggccacagagacccuggcuuuugugcauuguugccugaacccgauuaucuacuucuuucucggggagaaguuccgcaaauauauucugcagcuuuuuaagaccuguagaggacuguucguucucugccaauacuguggccugcugcagaucuauuccgccgauacacccucuagcuccuacacgcagagcaccauggaccacgaucuucaugacgcgcucuga

SEQ ID NO: 67059 - RNA, 1059 nt, Artificial Sequence
  derived and/or modified sequence opt5 from CCR5__Homo_sapiens__NP_000570
auggacuaccaggugagcucccccaucuaugauauuaacuacuauaccucugagccuugccaaaagaucaaugucaaacagauugccgcuagacugcucccgccccuguacagccuuguuuucaucuuuggcuucguggggaacaugcuggugauucucauccugaucaauuguaagcggcuuaaauccaugacagacauuuaucugcucaaccuggccaucucugaucuguuuuuccuccugacggucccuuuuugggcgcacuacgcugccgcccagugggacuucggaaauaccaugugccagcuucugacaggccucuauuuuauuggguucuuuagcggaaucuucuuuauuauccugcuuaccauugaucgcuaccuggcugugguucaugccguguucgcucucaaggccagaacagucaccuuuggcgugguuacauccgugaucaccugggucguggcgguguucgccucucugcccgggaucauuuucacgcggagccaaaaagaaggacugcacuacaccuguuccagccauuuuccuuauucucaguaccaguucuggaagaacuuucagacacucaagaucgucauucugggccuuguucugccccuccuggugauggugaucugcuauuccggcauucuuaaaacccugcuccgcuguagaaaugagaagaaacggcaccgcgcugucagacugaucuucacaaucaugauuguguacuuucuguucugggccccuuauaacaucguucuccugcuuaauaccuuucaagaguucuuugggcugaacaauugcucuagcuccaaccggcucgaccaggcuaugcaagugacggaaacacugggaaugacccauuguugcauuaauccgaucauuuacgccuucgucggcgaaaaguuucgcaacuaucuucugguguucuuucagaaacacaucgcgaagagauucuguaagugcuguagcaucuuccagcaggaggcccccgagcgggcuucuuccguuuacacacgcagcaccggggaacaggagauuuccgugggacucuga

SEQ ID NO: 67060 - RNA, 1125 nt, Artificial Sequence
  derived and/or modified sequence opt5 from CCR6__Homo_sapiens__NP_004358
augagcggcgaguccaugaacuucucugacguguuugauagcuccgaagacuacuucgucucuguuaauaccagcuauuacuccguggauucugagaugcugcucugcagccugcaggaagugagacaauuuucccggcuuuucguccccaucgccuauagccugauuuguguguuugggcuccugggaaacauccuuguugugauuacauucgcuuuuuacaagaaagcccgcucuaugacggacgucuaucugcucaauauggcgaucgcugauauucuguucgugcugacccucccuuuuugggccguuucccacgccacaggcgcuuggguguucagcaacgcuaccugcaagcugcuuaaagggaucuacgccaucaauuuuaacuguggaaugcugcuccugacaugcauuucuauggacagauauaucgccauuguccaggcgaccaaguccuuccggcuucgcagcagaacacugccgcggucuaaaaucauuugucucgugguguggggccuguccgucaucauuagcuccucuaccuuuguuuucaaucagaaguacaacacgcaggggagcgaugugugcgagcccaaguaccaaaccguguccgaaccuauccgcuggaaacugcucaugcugggacuugagcuccuguucggcuuuuucaucccccugauguuuaugauuuucuguuauacauuuaucgucaagacccuugugcaggcccagaauagcaaaagacauaaggcuauucggguuaucauugccgugguccugguguuccucgcuugccagaucccucacaacaugguucugcuggugacagccgcgaaucucggcaaaaugaaccgcucuugucaauccgagaagcugaucggguacaccaagacggucacagaagugcuugccuuucugcauugcugucucaaucccguccuguaugcuuucauuggacagaaauuuagaaacuacuuccuuaagauccugaaagaccucuggugcgugcggcgcaaguauaaaagcucuggcuuuagcugcgccgggagauacuccgagaauauuucucggcagaccagcgaaacagcugauaacgacaacgccuccagcuucaccauguga

SEQ ID NO: 67061 - RNA, 1137 nt, Artificial Sequence
  derived and/or modified sequence opt5 from CCR7__Homo_sapiens__NP_001829
auggaccugggcaagcccaugaaaagcgugcucgucguugcccugcuugugaucuuccaggugugccugugucaagaugaggucaccgacgauuacauuggggacaacacaacgguggauuauacccucuuugaaucccugugcucuaagaaagacguuagaaauuucaaggcuugguuucuuccuaucauguacagcauuaucuguuucgugggacugcucggcaacgggcuggucgugcugacauauauuuacuuuaaacggcucaagaccaugacagauaccuaucugcuuaaucuggccguugcggacauccucuuccugcuuacacugccguuuugggcuuacuccgccgccaagucuuggguguucggaguccacuuuugcaaacucaucuucgcuauuuauaagaugagcuuuuucuccggcaugcugcugcuccuguguaucucuauugaucgcuacguggccaucgugcaggcugucagcgcccauagacaccgggcgcgcguucuucugauuuccaaacucagcugcguggggaucuggauucuggccaccgugcuuucuauccccgagcugcucuacuccgaccugcagagaucuagcuccgaacaggcuaugcgguguagccugaucacggagcaugucgaagccuuuauuaccauccaaguggcucagaugguuauuggauuccucgugccucugcuugccaugucuuucugcuaucuggucaucauucgcacacuccugcaggcgagaaacuuugagcggaauaaggccaucaaagugaucauugcuguuguggucguguucaucgucuuucagcuucccuacaacggcgugguucuggcccaaaccguggcuaauuucaacauuacauccagcaccugugagcucuccaagcagcugaauaucgccuaugaugucacguacucucuggccugcgugcgcuguugcguuaacccuuuucucuaugcuuucauuggcgugaaguuuagaaaugaccuguucaaacuuuuuaaggaucuggggugccucagccaggaacagcugcggcaaugguccagcugucgccacaucagacggucuuccaugagcgucgaggcggaaacaaccacaaccuucucucccuga

SEQ ID NO: 67062 - RNA, 1068 nt, Artificial Sequence
  derived and/or modified sequence opt5 from CCR8__Homo_sapiens__NP_005192
auggacuacacccuggaucucagcgugacaacggucaccgacuauuacuaucccgauaucuucuccucuccuugcgacgccgagcugauucagacaaacggcaaacuucugcucgcuguguuuuacugucugcuuuucguuuuuagccugcucggaaauucccuggugauccugguccucgugguuugcaagaagcugagaucuauuaccgauguguaucuucugaaccucgcccugagcgaccuucuguucgucuuuuccuucccguuucaaacauacuaucuccuggaucaguggguguucgggaccguuauguguaaaguggucucuggcuuuuacuacaucggguucuauagcuccauguuuuucauuacacugaugagcguggaccgguaccucgcggugguccacgcuguuuaugcccugaaggugcgcaccaucagaaugggaacgacccuuugccuggccguguggcucacagcuaucauggccaccauuccccugcuugucuuuuaccagguggcuucugaagauggcguucugcaguguuauuccuucuacaaucaacagacacucaaauggaagaucuucaccaacuuuaagaugaauauucuggggcugcucaucccuuucacgauuuuuauguucugcuauaucaaaauucugcaucagcuuaagcggugucagaaccacaauaaaacaaaggccauccgccuggugcucaucgucgugauugcgagccugcuguuuuggguucccuucaacgugguccuuuuucucaccucucugcauuccaugcacauccuggacggaugcagcauuucucaacagcucacauacgccacccaugugaccgagaucauuuccuucacacacuguugcgucaauccugugaucuacgcuuuuguuggcgaaaaauucaagaagcaccugagcgagaucuuucagaaauccuguucucagauuuucaacuaucuuggcagacaaaugccccgggaaagcugcgagaaguccagcucuugccagcagcauuccagccgcucuagcuccguggauuacauccuguga

SEQ ID NO: 67063 - RNA, 1074 nt, Artificial Sequence
  derived and/or modified sequence opt5 from CCR9__Homo_sapiens__NP_001243298
auggccgacgauuacggcagcgaguccaccucuagcauggaagacuaugugaacuucaauuuuacagauuucuacugcgagaagaacaaugucagacaguuugcuucccacuuccugcccccucucuauuggcugguuuuuaucgugggggcccuuggaaacucucuggugauucucgucuacugguauuguacgcgggugaaaaccaugacagacauguuccugcuuaaucuggcgaucgcugaucuccuguuucugguuacccucccguucugggccauugccgcugccgaccaauggaaguuucagacauucaugugcaaaguggucaacagcauguacaagaugaauuuuuauuccugugugcugcuuaucaugugcauuucuguugaucgcuacaucgcuaucgcccaggcgaugagagcccauaccuggcgggaaaaacgccugcucuacagcaagaugguguguuucacaauuuggguccuggcugccgcucuuugcauccccgagauucuguauucccagaucaaggaagagagcggcauugccaucuguaccaugguguacccuucugacgaguccacgaaacucaagagcgcggugcugacccugaaagucauucucggguuuuuccugcccuucguugugauggccugcuguuauacaaucaucauucacacccuuauccaagcuaagaaaucuuccaagcauaaggcccugaaagugacaauuaccguccucacgguguuuguucugagccaguucccuuacaacugcauccuucuggugcagacaauugaugcuuaugccauguuuaucucuaauugugccgucuccaccaacaucgacauuugcuuccaggugacacaaaccaucgcguuuuuccacagcugccucaaucccguucuguacguguuugucggagaaagauuccggcgcgaucuggugaagacccucaaaaaccugggcuguauuucccaggcucagugggucucuuuuacaagacgggaggggagccuuaagcuguccagcaugcuccuggaaacgaccucuggagcccuuucccuguga

SEQ ID NO: 67064 - RNA, 1071 nt, Artificial Sequence
  derived and/or modified sequence opt5 from CCRL2__Homo_sapiens__NP_001124382
augaucuacaccagauuccugaagggcagccucaaaauggccaacuauacacuggcucccgaggacgaauacgaugugcuuauugagggggaacuggaguccgacgaagccgagcagugcgauaaguaugacgcgcaagcucucucugcccagcuggucccuagccuuuguuccgccguuuuugugaucggagugcuggauaaucuccuggucgugcugauucucguuaaauacaagggccugaaacggguggagaacaucuaucuucugaaucucgcugucucuaaccugugcuuccuucugacgcucccguuuugggcccacgcugggggagaccccauguguaagauucugaucggccuguacuucguggggcucuauagcgaaaccuuuuucaauugccugcuuacaguucagcgcuaccugguguuucuccauaagggaaacuucuuuuccgccagacggcgcgucccuuguggcaucauuaccucugugcuggcgugggugacagccauccuugcuacccugcccgaguucgucguuuacaaaccucagauggaagaucaaaaguauaaaugcgccuuuagcagaacacccuuccucccugcugacgagaccuuuuggaagcacuuccugacgcugaaaaugaauauuuccgugcucgugcugccgcuuuucaucuuuaccuuccuguacguccagaugcggaagacacuccgcuuuagagagcagcgguauagccuguucaaacuuguguuugccauuaugguuguguuccugcucaugugggcgcccuacaacaucgccuuuuuccugucuaccuuuaaggaacauuucucccugagcgauuguaagucuuccuauaaucucgacaaaagcguccacauuacaaagcugaucgcuaccacgcauugcuguaucaacccucuucuguacgccuuucucgauggcacauucucuaaauaucugugccgcuguuuucaccugagauccaauacaccccuucagccucgggggcaaagcgcucagggaaccucccgcgaggaacccgaccacucuaccgagguguga

SEQ ID NO: 67065 - RNA, 1296 nt, Artificial Sequence
  derived and/or modified sequence opt5 from CCRN4L__Homo_sapiens__NP_036250
auguuccacagccccagacggcugugcuccgcccuccugcagcgcgacgcuccuggccuuagacggcugccggcccccgggcuccgcagaccucugucucccccugcggcugugccccggccugccagcccgcgccuucuggccgcugccuccgcugccucuggagcggccagaagcuguucccggaccgucugcucuaugggcacagggacgagccgccucuacuccgcucuggccaagacccugaacagcucugcugccucccaacaucccgaguaucucguuagcccugaucccgaacaccuggagccuaucgaccccaaagaacuucuggaggaauguagagcggugcuccauacacggccgccucgcuuucagagagauuucguggaccugcggaccgauugccccucuacacacccucccauucgcgucaugcaguggaauauccuugcccaggcucugggagagggcaaggacaacuuugugcaaugucccguugaggcccucaaaugggaagagagaaagugccugauucuggaagagauccucgcuuaccagccugauauucugugucuucaggagguggaccauuauuucgauaccuuucagccgcugcucucccggcugggguaccaaggaacauucuuucccaaaccuuggagccccugccuugacgucgaacacaauaacggcccugauggcugugcccuguucuuucuccagaauagauucaagcuggugaacucugccaauauccgccugaccgcuaugacgcucaagaccaaccagguugcgaucgcccagacacuggagugcaaagaauccgggcggcaauuuuguauugcugugacccaccuuaaggccagaacaggaugggagcgcuuccggagcgcccagggcugcgaccugcuccagaaucugcaaaacaucacccagggggcuaaaauuccccuuaucgucugcggagauuuuaaugccgaaccgacggaggagguguauaagcauuucgcguccucuagccugaaccucaauuccgcuuacaaacugcugagcgccgacggccagucugaaccucccuauacaaccuggaagauuagaacauccggggagugucgccacacccucgacuacaucugguacagcaagcaugcccugaacgugcggucugcucuugaucugcucaccgaggaacagauuggaccuaauagacugcccagcuucaacuauccuuccgaccaccugucucuugucugcgauuuuagcuucacagaagaguccgacggccucagcuga

SEQ ID NO: 67066 - RNA, 2703 nt, Artificial Sequence
  derived and/or modified sequence opt5 from CCSER1__Homo_sapiens__NP_001138537
augggcgacagcggguccagacggucuacccuggugagccgccuccccaucuucagacgguccauuaaccgcagacacgauucucugccuagcuccccgucuagcuccaauacagucggaguucauuccucuucccccagcucuacgaacuccagcucuggcuccaccgggaagcggcgcagcaucuuuagaacaccuuccauuucuuuccaccauaaaaagggaagcgagcccaaacaggaaccuaccaaucaaaaccuuuccaucagcaauggcgcccagcccgggcacucuaacaugcagaagcugucccucgaggaacauauuaaaacacggggacgccacagcgugggcuuuucuagcuccagaaauaagaagaucacccggucucugacagaggacuucgaacgcgagaaagagcacagcaccaacaagaauguguuuaucaacugccuuuccagcggcaaaucugaaggggaugacuccggauucacggaggaucagaccagacggagcgucaagcaaucuacacgcaaacugcucccuaaguccuuuagcucccauuacaaguucucuaaaccggugcugcagagccaguccauuucucugguucagcaaagcgaauuuucccucgaggugacccaguaucaggagagagaacccguccuggugcgggcuagcccuucuuguuccguugacgugacagagagagccggcagcucucuucagagcccccugcucagcgcggaucugaccacggcucaaacaccuucugaguuccuugcccugaccgaggacagcgucuccgaaauggaugccuuuagcaagucuggguccauggcuagccacugcgacaauuucggacauaacgauuccacaucucagaugagccucaauuccgccgcugugaccaaaaccacaacggagcugaccggcacagugcccugugccaucaugucuccggggaaguaccgccuggagggacagugcagcaccgaauccaacucucucccugagacaagcgcggccaaucaaaaagaaguccugcuucagauugcugagcugcccgccaccuccguuagccacucugaauccaaccucccugcugacagcgagcgggaggaaaacaucggccugcagaauggcgagacgaugcuugggacaaacucucccagaaagcugggauuuuaugaacagcacaaagccauugcggagcaugugaagggcauccaccccauuuccgauagcaagaucaucccuaccucuggggaccaucacauuuucaauaaaaccucccauggauacgaagccaacccggcuaaggugcucgccagcucccugagccccuuccgcgagggccgguuuaucgagagacgccugcggucuagcuccgaagggacagcuggaucuagcagaaugauucucaaaccuaaggacggcaauaucgaggaagucaacucccugcgcaaacaacgggccggcucuagcuccucuaagaugaauagccuugaugugcugaacaaucucggguccugugagcuggacgaggaugaccuuaugcuggaucucgaguuccuggaagaacagagccugcaccccucuguuugcagagaggacuccuaucacagcguggucucuugugccgcugugguucucaccccuauggaacccaugauugagaugaagaaacgcgaggaaccggaguuuccugaacccuccaagcagaaccugagccuuaaacugacaaaggauguggaccaggaggcgcggugcucccauaucucuagaaugccuaauagccccuccgccgauuggccucuccaaggagucgaagagaacggcgggaucgacagccugcccuuccggcugaugcuucaggauuguacggcugugaaaacccuccugcugaagaugaagcgcguccuccaggagucugccgacauguccccggccagcucuacaaccagccugccugugucuccccuuacagaagaacccguuccuuuuaaagacauuaugaaggaugaaugcuccaugcugaaacuccagcugaaggagaaagacgaacugaucagccaacuucaggaggagcucggaaaggugagacaucugcagaaggcuuucgccucccgggucgauaaaucuacccagacggaacugcucuguuacgacggccugaaucuuaagagacuggagaccgugcaagggggccgcgaagcgacauaucggaacagaauuguuagccagaaucucuccacccgcgauagaaaagcuauccacacaccgaccgaggaccgguuucgcuacagcgccgccgaucagacgucucccuacaagaacaaaacaugccaacugccuucccugugccuuagcaacuuccucaaggacaaagagcuggcugaagugauuaagcacuccagaggaaccuaugagacacugaccucugaugucacccagaaucuccgggccacagugggccagagcucccugaagcccacggcuaaaaccgaagggcuuucuacauuucuggagaagccuaaagaccagguggccaccgcgcgccaacacagcacauucaccggaagauuuggccagcccccucgggggcccaucucccuccauauguacagccgcaagaacguuuuccugcaccauaaucugcacucuacggaacuucagacacucggacagcaagauggcuga

SEQ ID NO: 67067 - RNA, 825 nt, Artificial Sequence
  derived and/or modified sequence opt5 from CCS__Homo_sapiens__NP_005116
auggccagcgacuccggcaaccaggggacccugugcacacucgaguucgcugugcaaaugacgugucagucuugcgucgaugccguuagaaagagccugcagggaguggcgggcgugcaggacgucgaagugcaccuugaggaucaaaugguucuggugcauaccacacuccccucccaggaaguccaggcucugcuugaggggaccggacggcaggccgugcugaaaggcauggggucuggacaacuccagaaucugggcgccgcuguugccauccugggcgggccuggaacagugcagggcgucgugcgcuuucuccagcugaccccggaaagaugucuuauugaggggacaaucgacggacuggagcccggccuccacgggcugcaugugcaccaauacggagaucuuaccaacaauugcaacagcuguggcaaucauuucaacccugacggcgcuucccacgggggaccccaggauucugaccggcaccgcggcgaucuggggaaugucagagccgacgcggauggacgggccauuuuucgcauggaagacgagcagcucaagguuugggaugugaucggcagaagccugauuaucgacgaaggggaggacgaucugggacggggcggccauccucucuccaaaaucacggggaacagcggagagcgccuggcuugcggcauuaucgccagaucugcugggcuuuuccaaaaucccaagcagauuuguuccugcgacggacugaccaucugggaggaacggggccgcccuauugccgggaaaggcagaaaggaaagcgcgcagccgcccgcccaccucuga

SEQ ID NO: 67068 - RNA, 1608 nt, Artificial Sequence
  derived and/or modified sequence opt5 from CCT2__Homo_sapiens__NP_006422
auggccagccugucccucgcucccgugaacaucuucaaggccggcgcggacgaggaaagagcugagaccgcccggcugacaucuuuuauuggggccaucgcuauuggagaucuugucaaaagcacgcugggcccuaaggggauggacaaaauccuccuguccucuggacgcgaugccagccuuaugguuaccaaugacggcgcuacaauucugaagaacaucgggguggauaauccggccgcgaaagugcucgucgacauguccagagugcaggaugacgaaguuggagauggcaccacaucugugaccguccuggccgcugagcugcuccgggaagccgagagccugaucgcuaagaagauucacccccaaacaaucauugccggcuggcgcgaggcgaccaaagccgcuagagaagcccuucuguccagcgcuguggaccaugggucugaugagguuaaguuccggcaggaccucaugaacaucgccggaacgacccuguccagcaaacuucugacacaccauaaggaucacuuuaccaaacucgccguggaagcuguccugcgccugaagggcucugggaaucucgaggcgauucauaucauuaagaaacugggaggcucccuugccgacagcuaccuggacgagggguuccuccuggauaagaaaaucggagugaaccagccuaagagaaucgaaaaugcuaaaauucuuaucgccaacacaggcauggacaccgauaagauuaaaaucuuuggcucucgggugcgcgucgacuccacggccaagguugcugagauugaacacgccgagaaggagaaaaugaaggaaaaaguggagagaauccugaagcacgggaucaauugcuucauuaaccggcagcucaucuauaauuaccccgaacaacuguuuggagcggcuggcgugauggccauugagcaugccgauuucgcuggggucgaacgccuggcccucgugacaggaggcgagaucgcuagcaccuuugaccacccugaacugguuaaacuuggguccuguaagcugauugaggaggugaugaucggagaagauaagcucauccauuucucuggcgucgcccugggcgaggcgugcacaauugugcuuagaggggccacccagcagauccuggacgaagcugagcggagccuccacgaugcccuguguguucuggcucagaccgugaaagacucccgcacagucuauggaggcgggugcagcgaaaugcucauggcccacgcggugacgcaacuggccaacagaacccccggaaaggaggcugucgccauggagucuuacgcuaaagcccuucggaugcugccuacaauuaucgccgauaaugcuggcuaugacuccgcggaccucguggcccagcugagagcugcccauagcgaagggaacaccacagccggccuggauaugcgcgagggaaccauuggcgacauggcuauccuugggauuacggaaucuuuucagguuaagagacaggugcuccugagcgccgcggaggcugccgaggucauccugcggguggauaauaucauuaaagccgcuccgcgcaagcggguucccgaccaccauccuuguuga

SEQ ID NO: 67069 - RNA, 1524 nt, Artificial Sequence
  derived and/or modified sequence opt5 from CCT3__Homo_sapiens__NP_001008800
augaugggccacagacccgugcugguccucagccagaacaccaagcgggaguccgggcgcaaaguucaaucuggaaauaucaacgccgcuaagauucaggugcagcauccugccgcgaaaagcaugaucgaaauuuccagaacacaggacgaggaagugggcgaugggacgaccucugucaucauucuggcuggagagaugcuuagcguggccgaacacuuccuggagcaacagaugcauccgacaguugugaucuccgccuaccggaaggcucucgacgauaugaucucuacccugaaaaagauuagcauccccgucgacauuuccgauagcgacaugaugcuuaauaucauuaacucuuccaucacaaccaaggccauuagccgcuggucuucccuggcuugcaauaucgcccucgaugcggugaaaaugguucaguuugaggaaaacggcagaaaggagaucgacauuaaaaaguaugcccggguggagaaaaucccugggggaauuaucgaggauagcuguguccugcgcggcgugaugauuaauaaggacgugacacaccccagaaugcggcgcuacaucaagaacccuagaaucguccugcucgauucuucccuggaguauaaaaagggcgaaagccagaccgacauugagaucacgcgggaagaggauuucacccgcauucuucaaauggaagaggaguacauccagcagcugugcgaagacauuauccagcucaaacccgacguugugaucacagagaaggggauuuccgaucuggcucaacauuaucuuaugagagccaauaucaccgcuauucggcgcgugagaaaaacagacaacaaucggaucgccagagcguguggagcccgcauugucucucggccugaagaacugagagaagaugacgugggcaccggggcuggacuccuggagaucaagaaaauuggcgaugaguacuuuacguucaucacagacugcaaggauccgaaggccuguaccauccugcuccgcggggcuagcaaagaaauucuguccgagguugaacggaaccuucaggacgccaugcaagugugcagaaauguccugcucgauccccagcuggugccuggaggcggcgccagcgagauggcuguugcgcacgcccuuacagaaaagucuaaagcuaugaccgggguggagcaguggcccuaucgcgccgucgcccaggcucuggaggugaucccucggacccucauucagaacuguggagccuccacaaucagacugcugacgagccuccgcgcgaagcacacccaagaaaauugcgagacauggggcgucaacggggaaaccggaacacugguggacaugaaagagcuuggcauuugggagccccuggcuguuaagcuccagaccuacaagacggccguggaaacagccguccugcuucugcggaucgaugacaucgugucugggcauaaaaagaaaggagacgaucagagcagacagggcggcgcuccggacgccgggcaagaguga

SEQ ID NO: 67070 - RNA, 1530 nt, Artificial Sequence
  derived and/or modified sequence opt5 from CCT4__Homo_sapiens__NP_001243650
augcccgagaacguggccccuagaagcggcgcuaccgccggggcggcuggaggccgggggaagggagccuaccaggaccgcgauaaaccggcccaaaucagauucuccaauauuucugcugccaaggcugucgccgacgcgauccggacaagccugggccccaaagggauggauaagaugcucguugaacuguccaaagcccaggacauugaggcuggagauggcacgaccucuguggugaucauugccggcagccuucuggacuccugcacaaagcuccugcagaaggggauccacccuaccaucauuucugagagcuuucagaaagcucuugaaaagggaaucgaaauucugacagauaugucccgccccgucgagcucagcgacagagagacccugcugaacucugccacaaccucccucaauagcaaagugguuucucaauauuccagccugcuuucuccuauguccgugaacgcggucaugaaggugaucgaucccgccacggcuaccagcguugaccugcgggauauuaaaaucgugaagaagcucggcgggacaauugacgauugugaacuggucgagggacuugugcugacccagaaaguguccaauucuggcaucacacgcgucgaaaaggccaaaaucgggcucauucaguucugccugagcgcuccuaagaccgacauggacaaccagaucguuguguccgauuacgcccaaauggacagagugcugcgggaggagcgcgccuauauucucaaucuggucaaacagaucaagaaaacgggauguaacgugcuucugauucaaaagagcauccucagagaugcucugucugaccuugcgcugcauuuucucaauaagaugaaaaucaugguuauuaaggauaucgaacgggaggacauugaguucaucugcaaaacaauuggcaccaagccgguggcccacaucgaucaguuuacagcugacaugcugggcuccgccgaacuggccgaagaggucaaccucaaugggagcggaaaacugcuuaagaucaccggcugugcuucucccgggaagaccgugacaauuguugugcgcggaagcaacaaacuggucaucgaggaagccgagagauccauucaugaugcgcucugcgugauccggugucuggucaagaaacgcgcucuuauugccggcgggggagccccugaaaucgagcuggcucucagacugacggaauacucucggacccugagcggcauggaguccuauugcgugagagccuucgcugacgccauggagguuauucccagcacacucgcggaaaaugccggccugaacccuaucucuaccgugacagagcuucgcaaucggcacgcucagggggaaaagaccgccggaaucaacgucagaaaaggcgggauuuccaacauccuggaggaacucgugguucagccccugcuggugagcgucucugcucuuacgcucgccacagagaccgugcgcuccauucugaagaucgaugacgugguuaauacccgguga

SEQ ID NO: 67071 - RNA, 1626 nt, Artificial Sequence
  derived and/or modified sequence opt5 from CCT5__Homo_sapiens__NP_036205
auggccagcaugggcacccuggcuuucgacgaguacgggagacccuuucucaucauuaaggaucaggaccggaaaucccgccugaugggacuugaagcccugaagucucacaucauggcggcuaaagccguggccaacacaaugagaacgagccucggcccuaaugggcuggauaagaugauggucgacaaagauggagacguuaccgugacaaacgauggcgcuaccauucuuuccaugauggacguggaucaucaaaucgccaagcugauggucgagcucucuaagagccaggacgaugaaauuggggacggaacaaccggcgugguugugcuggcuggcgcccugcucgaggaagcggagcagcugcuugaucgggggauccacccgauccgcauugccgacggauaugagcaggcugccagagucgcuaucgaacaucuggacaaaauuuccgauucugugcucguugacaucaaggauacagagccccugauucaaaccgccaaaacgacccuuggcagcaagguggucaauuccugccaccggcagauggcggaaaucgccgugaacgcugugcugacagucgccgacauggagcgcagagauguugacuucgagcucauuaaaguggaagggaaggugggaggccggcuggaggauaccaagcugaucaaaggggucaucguggacaaggauuuuagccauccucagaugcccaaaaagguugaagacgcuaaaauugccauccucacauguccuuucgagcccccuaagccgaaaaccaagcacaagcuggaugugacgucugucgaagacuacaaagcccuucagaaguaugagaaagagaaguuugaagagaugauucaacagaucaaagaaacaggagcuaaucuggcgauuugccaguggggcuucgacgaugaggccaaccaccuccugcuucagaauaaccugcccgcugugcgcuggguuggcgggccugaaaucgagcucaucgccauugccaccggaggcagaaucgugccccgguuuuccgagcugacagcugaaaagcugggguucgccggacucguccaagagauuagcuuuggcaccaccaaggacaaaaugcuggugaucgaacaguguaaaaauucucgcgcggucacaauuuucaucagagggggaaacaagaugaucauugaggaagcuaagcggucccuucaugaugcccugugcgugauccgcaaucucauuagagacaaccggguuguguacggcggcggggccgcugagaucagcugugcccuggcugucucucaggaggccgauaaaugcccuacgcuugaacaauaugcgaugagagccuuugcugacgcccuggaggugauucccauggcucucuccgaaaauagcggaaugaacccgauccagaccaugacagagguucgcgccagacaggugaaggagaugaauccugcgcugggcauugauugucugcacaaggggaccaacgacaugaaacagcaacaugucaucgaaacacucaucggaaagaaacagcagauuucccuggccacccagauggugcggaugauccuuaagauugaugacauccgcaaacccggcgagucugaagaguga

SEQ ID NO: 67072 - RNA, 1461 nt, Artificial Sequence
  derived and/or modified sequence opt5 from CCT6A__Homo_sapiens__NP_001009186
auggccgcugugaagacccugaaccccaaagccgaggucgcgagagcucaggccgcccucgcuguuaauaucagcgccgcucggggccugcaagacgugcuucgcacaaaccuggggccuaagggaacgaugaaaaugcucguguccggcgccggggauauuaagcugaccaaagacggaaauguccuucugcacgaaaugggccuccauccgagaaucauuacagagggguucgaagcggccaaggagaaggcucugcaguuucuggaagaggugaaaguuucucgggagauggaucgcgaaacccucaucgacguggccagaacaagccugcggaccaagguccacgcugagcuugccgaugugcugacagaagcgguuguggacuccauucucgccaucaaaaagcaggaugagcccaucgaccuguucaugauugagaucauggaaaugaaacauaagucugagaccgauacgagccuuauucgcggacugguccucgaccacggcgcuagacauccugauaugaagaaacggguggaagacgccuacauccugaccugcaacgugucccuggaguaugaaaagacagaggucaauucuggcuuuuucuacaaaagcgcugaggaacgcgagaagcucguuaaagccgaaagaaaguuuauugaggaucgggugaaaaagaucauugaacugaagcgcaaaguguguggggacuccgacaagggauucgucgugaucaaccagaaaggcaucgaucccuuuagccuugacgcccugucuaaggaggggauuguugcucucagacgggcgaaacgcagaaauauggagcggcugacccuugccugcggaggcguggcucugaacuccuucgaugaccucagcccugauugucuggggcacgccggacuggucuaugaauacacacucggcgaggaaaaguuuaccuucaucgagaagugcaauaaccccagaucugugacgcugcuuauuaaaggcccuaauaagcacacacugacccaaaucaaagacgccguucgcgaugggcuccgggcugugaagaacgccauugacgauggaugugucgugccgggcgcgggggcugucgaaguggccauggccgaggcucugaucaaacauaagcccuccguuaagggcagagcccagcuuggagugcaggcuuuugccgacgcgcugcucaucauuccuaaaguccuggcccagaauagcggguucgaucugcaagagacacucgugaagauccaggcugaacacucugaguccggacagcugguuggcguggaccuuaacaccggcgaacccauggucgccgcugaggugggggugugggacaauuauugcguuaaaaagcagcugcuccauagcuguaccgucauugccacaaacauccugcugguggaugagauuaugcgcgcgggaauguccucucuuaaaggcuga

SEQ ID NO: 67073 - RNA, 1482 nt, Artificial Sequence
  derived and/or modified sequence opt5 from CCT6B__Homo_sapiens__NP_001180458
auggccgcuaucaaggccgugaacagcaaagcggaggucgcuagagcccgggccgcucuggccguuaauauuugcgcugcccgcggccuccaggacgugcugagaaccaaccuugggcccaagggaacaaugaaaaugcugguguccggcgcgggggauaucaagcucacgaaagacggaaauguccugcuugaugaaaugcaaauucagcacccuaccgccucucugaucgcuaagguggccacagcucaggacgauguuaccggcgacgggacaaccagcaacgugcucauuaucggagagcugcugaagcaggccgaucucuacaucuccgaaggccugcauccgcggauuaucgcggagggcuucgaagccgcuaaaauuaaggcccuugagguccuggaggaagugaaaguuacaaaggagaugaaacgcaagauccuccuggacguggcuagaaccucucuucaaacgaagguccacgccgaacuggccgaugugcucaccgagguggucguugacagcgugcuggcugugcggcgccccggguauccuauugaucuguuuauggucgagaucauggaaaugaaacauaagcucggaacagacaccaaagagguuaauuccggcuucuuuuacaagacagcggaagagaaagaaaagcuggugaaagccgagagaaaguucauugaggaucgggugcagaagaucaucgaccuuaaagacaaggucugugcucagucuaacaaaggguuugugguuauuaaucagaagggaaucgaucccuucagccuggacucccucgccaaacacggcauuguggcccugcgcagagcuaagcggcgcaacauggaaagacuuagccuggccugcgggggaauggcggucaauucuuuugaggaucucaccguggacugucugggccaugcuggccuggucuaugaauacacgcucggggaggaaaaguucacauuuaucgaggagugcgugaacccuuguuccguuacccugcuugugaaaggacccaauaagcacacacugacccaagucaaagaugccauucgggacggccuccgcgccaucaagaacgcuaucgaagaugggugcauggugccuggagccggcgcuauugagguugccauggcggaagcccuggugaccuauaaaaauagcaucaaggggagagcucggcuuggaguccaggccuucgcugacgcccugcucauuaucccgaaggugcuggcgcagaacgccggcuacgauccccaggagacacuggugaaaguucaagcugaacacgucgagucuaagcagcucgugggcguggaccugaauacgggggagccuauggucgccgcugaugccggagugugggacaacuauuguguuaaaaagcagcuucugcauuccugcaccgugauugccacaaacauccuccuggucgacgaaaucaugagagcuggcaugagcucucugaaauga

SEQ ID NO: 67074 - RNA, 1020 nt, Artificial Sequence
  derived and/or modified sequence opt5 from CCT7__Homo_sapiens__NP_001009570
augauggacagccagcugguggccggcgucgcuuucaagaaaaccuuuuccuacgccggguucgagaugcaacccaagaaauaucacaacccuaagaucgcgcuccugaauguugaacuugagcugaaagcugaaaaggauaacgccgagauuagagugcauacaguggaagacuaccaggccaucgucgaugcugaguggaauauucucuaugacaagcuggagaaaauccaccauucuggagccaaggugguucuuagcaaacugccgauuggcgauguggcuacgcaguacuuugccgaccgggauauguucugcgcggggcgcguccccgaagaggaccucaagagaaccaugauggccuguggaggcuccauccagacaucugugaacgcucugagcgccgauguucuggggcggugccaaguguuugaagagacccagaucggaggcgagcgcuauaauuucuuuacaggcuguccuaaagcuaagaccugcacauucauucucagagggggagccgaacaguuuauggaggaaaccgagcggucccugcacgacgcgaucaugauuguccgcagagccaucaagaacgauucugugguggcuggcgggggagccauugaaauggagcuuagcaaauaccugcgggacuauucccgcacgauccccggcaagcagcaacuccugauuggggcuuacgccaaagcccuugagaucaucccuagacagcugugugauaaugcuggauucgacgcgaccaacauucucaauaagcugcgggcccgccaugcucagggcggcacaugguacggggucgacaucaacaaugaagauauugccgacaacuuugaggccuucguuugggaacccgcuauggugagaaucaaugcccugaccgcggcuagcgaggccgccugccucauugugucugucgaugaaacaaucaaaaacccucgguccaccguggacgcuccgacggccgcuggacgcggcagagggcggggaagaccccacuga

SEQ ID NO: 67075 - RNA, 4287 nt, Artificial Sequence
  derived and/or modified sequence opt5 from CD109__Homo_sapiens__NP_001153059
augcagggacccccucugcucaccgccgcucaucugcuuugcguguguacagccgcgcuggcugucgccccggggcccagauuccucguuacggccccuggaauuauucggcccggcgggaacgugaccaucggaguggagcugcuugaacacugcccuagccaagucacagugaaggcugagcugcucaaaaccgccuccaaucugacaguuucugugcuggaagcugagggcgucuuugaaaaggggagcuucaaaacccucacacugcccucccuuccucugaacucugccgacgagauuuacgagcuccgcgugaccggaagaacgcaggaugaaauccuguuuagcaauuccacccggcuuucuuucgagacaaagcgcauuagcguuuuuauccagaccgacaaagcgcuguauaagccgaagcaggaagugaaauucagaaucgucacacucuuuuccgauuucaagcccuacaaaaccagccugaacauucugaucaaggacccuaaaucuaaucucauucaacaguggcugucccagcagagcgaucuuggcgugaucucuaagacguuucaacuguccagccaccccauucucggcgacuggucuauccaggugcaggucaacgaucagacauauuaccaauccuuccagguuagcgaguaugugcugccuaaguuugaggugacccuucagacaccccuguacuguuccaugaacucuaaacaucucaaugggaccauuaccgccaaguauacauacggaaaaccggucaagggcgacgugacgcugaccuuccugccucucagcuuuugggggaaaaagaaaaauaucacaaagaccuucaagaucaacggauccgcuaauuucagcuuuaacgaugaagagaugaaaaauguuauggacucuuccaacggccugagcgaauaccuugaucugucuagccccgggccuguggagauucucacaaccgucacggaauccgugacaggaaucucucggaauguuagcaccaacguguucuuuaagcaacacgacuauauuaucgaguucuuugauuacaccacaguccugaaacccucccuuaacuucaccgccacagugaaggucacgcgcgcugacggcaaucagcugacccucgaggaaagacggaacaaugugguuauuacagugacccagcgcaacuauacagaguacuggagcggcucuaauuccgggaaccagaaaauggaagccguccaaaagaucaauuauaccgugccccagagcggaacguuuaagaucgaguucccuauucuggaagacucuuccgagcugcagcucaaagcguacuuucugggcagcaaguccucuauggccguucauagccuuuucaaauccccgucuaagaccuauauccagcugaaaacaagagaugagaacauuaagguggggagccccuuugaacucgucguguccggaaauaagcggcugaaagagcugagcuacauggugguuucucgcggccaacuugucgcuguggggaagcagaacuccaccauguucagccucacaccugaaaauucuuggacccccaaagccugcgugaucgucuacuauauugaggacgauggagaaaucaucuccgacgugcugaagauuccuguucagcugguguuuaaaaacaagaucaagcucuacuggagcaaagucaaggcugagcccucugagaaagugagccugagaauuuccguuacgcagccggauagcaucgugggcauugucgccguggacaagucuguuaaucuuaugaacgccuccaaugauaucacaauggaaaacgugguccacgagcuggaacucuauaacaccggcuacuaucuggggauguucaugaauagcuucgcuguguuucaagaguguggacugugggugcuuacagacgcgaaccucaccaaagauuacauugacggcgucuaugauaaugccgaguacgcugaacgguucauggaggaaaacgaggggcacaucguugacauccaugacuuuucccugggaucuagcccucacgugcgcaagcauuuccccgaaaccuggauuuggcuggauacaaauaugggcuacagaaucuaucaggaguuugaggugacggucccugacuccauuaccucuuggguggccacaggguucguuaucagcgaagaucucggccugggacuuaccacaacccccguggagcugcaggccuuucagccuuucuuuauuuuccucaaccugcccuacuccgucauccggggcgaagaguuugcucuggaaaucacgauuuucaauuaucuuaaagacgccacagaggugaagguuaucauugagaagucugauaaauuugacauccucaugaccagcaacgaaauuaaugcgaccgggcaccaacagacacugcuggugccguccgaggauggagcuaccguccucuucccuaucagacccacacaccugggcgaaauccccauuacggugaccgcccuuagcccuacagccucugacgcuguuacccagaugauccuggugaaggccgaggggauugaaaaauccuacagccaaucuauccuccuggaucugacagacaaccgccuucaguccacccucaagacgcugagcuucucuuuuccgcccaauaccgucacaggauccgagcgggugcagauuaccgcuaucggcgaugugcuggggccuagcaucaacggccucgccucccugauuagaaugcccuauggaugcggcgagcagaauaugaucaacuucgcgccuaauauuuacauccuugacuaucugacaaagaagaagcaacucaccgauaaccugaaagaaaaggcccugagcuuuaugcgccagggguaccagcgggagcuucuguaccagagagaagacggaucuuucagcgcuuuuggcaacuaugaccccuccgggucuacauggcucagcgccuucguccugcgcuguuuucucgaggcugauccuuacauugacaucgaucaaaauguucugcaucggaccuauacguggcuuaaaggacaccagaaguccaacggcgaguucugggaccccgggagagugauucauucugaacugcagggcggaaauaaaagcccggugacacucaccgccuacaucgucaccucccugcugggcuaucgcaaguaccagccuaacaucgaugugcaagagucuauucacuuucuugaaagcgaguucucccgggggaucagcgacaauuauacacuggcgcucauuaccuacgcccugucuuccguuggaagccccaaggcuaaagaagcccucaacaugcugacguggagagcugagcaggagggcgggaugcaguuuugggugucuuccgaaagcaaacuuuccgauucuuggcaaccucgcagccuggacaucgaggucgccgccuacgcucuccugucccauuuccugcaguuccagacaagcgaaggcauucccaucaugcgguggcuuucuagacagcgcaauucccugggcggguuugcgagcacccaagauacaaccguggcccucaaagcucugucugaguucgccgcccucaugaacacagaacggaccaauauccagguuacggugaccggcccgagcuccccuucuccccuggcugucgugcagccuacagccgucaacauuagcgcgaauggauuuggcuucgcuaucugccagcuuaacgugguuuauaaugugaaggccuccgggucuagcagacggagacgcuccauucaaaaccaggaggccuuugaccuggaugucgcugugaaagagaauaaggacgaucugaaccacguugaccucaacguguguaccagcuucucuggacccggccgguccgggauggcccugauggaagucaaucuucugagcggauuuauggugcccuccgaggcgaucucucucagcgaaacagugaagaaaguugaguacgaccacggcaagcugaaccucuaucuggauuccgucaaugaaacccaguucugcgugaacauuccugcugugagaaauuuuaaagucucuaacacgcaggacgccagcguguccaucguugauuacuaugagccgcgcagacaagccgugcggagcuacaauucugaggucaaacuuuccagcugugaccugugcucugaugugcagggcugccgccccugugaagacggggcuuccggaagccaucaccauucuagcguuaucuucaucuuuugcuucaagcugcucuauuuuauggagcuguggcuuuga

SEQ ID NO: 67076 - RNA, 1128 nt, Artificial Sequence
  derived and/or modified sequence opt5 from CD14__Homo_sapiens__NP_001167576
auggagagagccagcugccugcuccugcuucugcucccccuggugcacgucuccgcuaccacaccugaaccgugugagcuugacgaugaagacuuccggugcguuuguaacuuuucugagccccagccugauuggagcgaagccuuccaaugcguguccgcgguggaggucgagauccaugcuggcgggcugaaucucgaacccuuucugaagcgcguggacgccgaugccgacccuagacaguacgcugauacgguuaaagcccugcgggugcgcagacucaccgucggagcugcccaggugcccgcgcagcugcuuguuggcgcccugcgggugcucgcuuauucucgccugaaggagcuuacacuggaagaccucaaaauuaccgggacaaugccuccgcugccccuggaggccaccggacucgcucugagcucccuuagacugcggaacgucucuugggccacaggccgcagcuggcucgcggagcugcaacaguggcuuaagccugggcugaaagugcucuccaucgcccaggcucacagccccgccuucucuugugaacaggugagagcuuuuccugcccugaccucccuggaucucagcgacaaucccggacugggcgagcggggccuuauggccgcucugugcccgcauaaguucccugcgauucaaaaccucgcccugcgcaauacggggauggaaacccccacaggagucugugcugcccuugccgcugccggcguucagccucacucucuggaucucucccauaacagccugagagcgaccgugaaucccucugcuccccggugcaugugguccagcgcccugaacucccucaaucugucuuuugccgggcuugaacaggugccuaagggacugccggcuaaacuccgcguccuggaccugagcuguaacagacuuaaucgggcuccccagccugaugagcuccccgagguggacaaccugacacuggacggcaauccuuuccucguucccgggaccgcccugccgcacgagggauccaugaacagcggcguggucccugccugcgcgagaucuacgcuuuccgugggcguuagcgggacacuggugcuccugcaaggagcccgcggcuuugcuuga

SEQ ID NO: 67077 - RNA, 762 nt, Artificial Sequence
  derived and/or modified sequence opt5 from CD151__Homo_sapiens__NP_001034579
augggcgaguucaacgaaaagaaaaccacaugcgggacggugugucugaaguaccuccuguuuaccuauaauugcuguuucuggcuugccggacuggcugugauggccguuggcaucuggacacucgcgcugaaaagcgacuacauuucccuucuggcuucugggaccuaucucgccacagccuacauccuggugguggcuggaaccgucgugaugguuacaggcgugcuggggugcugugccaccuuuaaggagagacggaaccuccugcgccuuuauuucauucugcuccugaucauuuuucuucuggaaaucaucgcuggcauucucgccuacgcguauuaccagcaacugaauacggagcugaaagaaaaccucaaggauaccaugacaaagagauaccaccagcccggacaugaggccgucaccagcgcuguggaccagcugcagcaagaguuccacugcuguggcuccaauaacucucaggauuggcgggacagcgaauggauccgcucccaggaggccgggggaagaguugugccugauucuugcuguaaaacagucguggcucuuugcggccagcgggaccaugccagcaauauuuauaagguggaagggggauguaucaccaaacuggagacguuuauucaagagcaccuccgcgucaucggcgcgguugggauuggaaucgccugcguccagguguucggcaugaucuuuacaugcugucuguacagaucccuuaagcuggaacauuauuga

SEQ ID NO: 67078 - RNA, 3471 nt, Artificial Sequence
  derived and/or modified sequence opt5 from CD163__Homo_sapiens__NP_004235
augagcaagcugagaauggugcuccuggaggacuccggcucugccgauuuccggcgccacuuugucaaccuuagccccuucaccaucacaguugugcugcuccuguccgcuugcuuugugacgucuagccuugggggaaccgacaaagaacugagacucgucgauggcgagaauaaguguuccgggcggguggaaguuaaagugcaggaggaauggggaacagucugcaacaauggcuggucuauggaggccgugagcguuauuuguaaccaacuggggugcccuaccgcgaucaaggcuccgggaugggccaauuccagcgccggcucuggccgcauuuggauggaccauguguccuguagagggaacgagagcgcucugugggauugcaaacacgacggauggggcaagcauucuaauuguacacaccagcaggaugccggggugaccugcuccgacggaagcaaccucgaaaugcggcugacacgcggcgggaauauguguucuggaagaaucgagauuaaguuccagggccgguggggcaccgucugcgaugacaacuuuaauaucgaucaugcuuccgugaucugucgccaacuugaaugcgggagcgccgucuccuucucuggaagcuccaacuuuggcgaggggagcggacccauuugguucgacgaucugaucugcaauggcaacgagucugcgcucuggaauuguaaacaccagggguggggaaagcacaacugcgaccaugccgaagacgcuggcguuauuuguuccaaaggcgccgaucugagccuuagacugguggacggggugacggagugcucuggacggcucgaaguccgcuuucagggcgagugggggaccaucugugaugacggaugggauagcuacgacgcugccguggcgugcaagcagcugggcuguccuacagccguuaccgcuauugggagagugaacgccuccaaaggcuucggacacaucuggcuggauucugucagcugccaaggccaugaacccgcuauuuggcaguguaagcaccacgagugggggaagcauuauugcaaucacaacgaggacgccggagugacauguuccgauggcagcgaccucgaacugcggcuucgcgggggaggcucuagaugcgccgggaccguugagguggaaauccagcggcugcucggcaaagucugcgauagaggauggggccugaaggaggcugacguggucugucgccagcuugggugcggauccgcgcugaaaacgagcuaccaaguguauucuaagauccaggccacaaauaccuggcucuuucuguccagcuguaacggcaaugaaacaucccugugggacugcaaaaacuggcaguggggcggacucaccugugaucauuacgaggaggcuaagauuaccugcucugcccaccgggaaccuagacugguuggcggggacauccccuguagcggccgcguggaggucaaacauggagauacauggggcuccauuugcgacucugauuucagccuugaagccgcuuccgugcugugucgggagcuccaaugcgggacgguugugagcauccugggaggcgcccacuuuggggaaggaaauggccagauuugggcggaggaguuccagugugaagggcacgagucucaucuuucccugugcccugucgcuccgagacccgaagggaccugcagccacucucgcgacgugggagugguuuguucccgguauacagagaucagacucgucaacggcaagaccccuugcgaggggcgcguggaacugaagacacugggagccuggggcagccucuguaauucucauugggauaucgaggacgcccacgugcugugccagcaacuuaaauguggggucgcucugagcacccccggaggcgcccgguucggcaaggggaacggacagauuuggagacacauguuucauugcacgggcacagaacagcacaugggggauuguccugugaccgcucucggagccucccugugccccagcgagcagguugcgucugugaucuguuccggcaaucaaagccagacccuguccucuugcaacagcuccucucuugggccgacacgcccuaccauucccgaagagagcgccgucgcuuguaucgaguccggacagcuccggcuggugaauggcggcgggagaugcgccggacggguugaaauuuaccaugagggcucuugggggacaaucugcgacgauagcugggaccuguccgaugcucacguggucugucgccagcucggaugcggcgaagccaucaacgcgacggggagcgcccauuucggagagggcaccggcccuauuuggcuggacgaaaugaaauguaaugggaaggagucuagaaucuggcaaugccacucccacggauggggccagcagaacugucggcauaaagaggacgcuggggugauuugcagcgaauuuaugucucuuagacugacauccgaggccagccgcgaggcuugugccggacggcucgaaguuuucuauaacggcgccugggggaccgugggaaagucuuccaugagcgaaacaaccgucggcguggugugcagacagcugggcugugcugauaaggggaaaaucaaucccgcgucccuggacaaggccaugagcauucccaugugggucgauaacguucaaugcccuaaaggaccggacacgcuuuggcagugucccucuagcccuugggagaagcgccucgcuucccccucugaggaaaccuggaucacaugcgauaauaaaauuagacugcaggagggcccuaccagcugcuccgggcggguggaaaucuggcacggaggcucuugggggacagugugugacgauagcugggaccuggaugacgcccaagucgugugccagcagcucggauguggccccgcccugaaggcuuuuaaggaggccgaguucggccaggggaccggaccgaucuggcuuaacgaaguuaaaugcaagggcaaugaguccucucugugggauuguccugcgcgcagaugggggcauagcgaaugcggacacaaagaggacgcugccgugaacuguacggauauuuccguccaaaagacaccccagaaagccaccacaggccggagcucucgccaguccagcuuuaucgcuguggggauucucggaguugugcugcuggccaucuucgucgcgcucuuuuuccuuaccaagaagagacggcagcgccaaagacuggcugugucuucccggggcgaaaaucugguucaucagauucaguaccgcgagaugaacagcugccucaaugccgacgaccuggaucuuaugaacuccucugagaauagccacgaauccgccgacuuuagcgcugccgagcugaucucuguguccaaauuccucccuaucagcggcauggaaaaggaggcuauucugucucacaccgaaaaagagaacgggaaucuguga

SEQ ID NO: 67079 - RNA, 4362 nt, Artificial Sequence
  derived and/or modified sequence opt5 from CD163L1__Homo_sapiens__NP_777601
augaugcugccccagaacagcuggcacaucgacuucggcagaugcuguugccaucaaaaucucuuuuccgccguggucaccuguauucugcuucugaacucuugcuuccucaucagcuccuuuaaugggacagaucuggagcuucggcugguuaacggagacggcccuuguucugggacgguggaagugaaguuccagggacaguggggcaccgucugcgaugacggguggaauacaaccgcuagcacagugguuuguaaacagcucggaugcccguuuuccuucgccauguuucgcuucggccaagcggugaccagacacggcaagauuuggcuggaugacgucucuuguuacgggaacgagagcgcucugugggaaugccagcaucgggaguggggaucccacaauuguuaucauggcgaagauguggggguuaacugcuacggagaggccaaucucggccugcgccuuguggacgggaacaauagcugcucuggaagagucgaggugaaauuucaggaacgguggggcacaaucugugaugacggcuggaaccugaauaccgccgcuguggucugccgccagcucgggugucccuccagcuucauuucuuccggaguugugaacagcccugccgugcugagacccaucuggcuugaugacauccugugccaaggcaaugagcucgcucuguggaacugucggcaccgcggguggggaaaccacgauugcucucauaaugaagacgucacgcugaccuguuaugacuccagcgaucucgagcugagacuugugggcgggacaaaccggugcaugggacgcguugagcugaagauucagggcagauggggcaccgugugucaccauaaauggaauaacgccgcggccgacgucgugugcaagcagcucggguguggaacagcucugcacuuugccggccuuccucaucugcaguccgggucugauguuguguggcucgacggagucagcugcuccggcaaugaauccuuccugugggauugccggcacucugggaccgugaacuuugacugucugcaccaaaaugaugucuccgugaucugcagcgacggcgcugaucucgagcugcgccuugccgacggaucuaacaauuguagcggcagaguugaagugcggauucaugagcagugguggacgaucugcgaucagaacuggaagaaugaacaagcgcuggucguguguaaacagcucgggugccccuucuccguuuucggaucuagacgcgccaagccuagcaacgaggcucgggacauuuggaucaauuccauuagcuguacaggcaacgagucugcccugugggacugcaccuacgaugggaaagcuaagagaacauguuuucgccgguccgacgccggagugaucugcagcgauaaagccgaccuugaucugagacucgucggcgcucacucuccguguuaugggcgccuggaagugaaguaccagggcgaguggggaaccgugugccaugaccggugguccaccagaaaugcggccguugucugcaagcagcugggcugugggaaacccaugcacguguucggaaugacauauuuuaaggaagcuagcggcccuaucuggcucgaugacguguccugcauugggaacgagucuaacaucugggauugugaacacagcggauggggcaaacauaauugcguccaccgcgaggacgugauuguuacguguuccggggaugccaccuggggccugcggcuugugggaggcucuaacagaugcagcgggcgccuggaggucuacuuccaaggacgguggggcacagugugugacgauggguggaauagcaaggccgcugccguugugugcagccagcucgacugucccucuuccaucauuggaaugggccuggggaacgcgagcaccggcuacggaaaaaucuggcuggacgaugucucuugcgacggcgaugaauccgaccuuuggagcuguagaaauucuggguggggaaacaaugauugcagccauuccgaggacgugggcguuaucugcagcgaugcuucugacauggaacuccggcuggucgggggauccagccgcugugccggcaagguggaggugaacgugcagggcgccgucgggauucugugcgcuaauggauggggcaugaacaucgccgaaguuguguguagacagcucgagugcggguccgcuauucgggugucuagagagccucacuuuacagaacgcacccugcacauccuuaugagcaauuccggauguacgggcggggaggccucucugugggauugcauucggugggaauggaaacaaacagcgugucaucucaacauggaggccagccugaucugcuccgcucacagacagccccgccuggucggagccgacaugccguguucuggcagaguggagguuaagcaugcugauaccuggcggagcgugugcgacuccgauuucagccuucacgccgcgaauguccucugucgcgaacugaacugcggcgacgccaucucucuguccgugggggaccauuuuggaaagggcaaugggcucaccugggcugagaaauuccagugcgaaggaagcgagacacaccuggcccuuuguccuauuguucagcaccccgaagauaccugcauccauucuagagaggugggcgucguguguucccgguauacagacguucgccuggugaacggaaagagccaaugcgaugggcaggucgagauuaacgugcucggccacuggggcucucugugugacacgcauugggauccugaagacgcuagagugcugugccggcagcuuuccugugggaccgcccucagcacaaccggaggcaaauacaucggggagcgcuccgucagaguuuggggacaccgguuucauugccugggcaaugaaagccugcucgauaacugucagaugacagugcugggggccccucccugcauucacggaaauaccgugucugucaucuguacgggcagccuuacccaaccccuguucccgugccucgcuaacguguccgaccccuaucugucugcgguuccugagggcagcgcccugauuugccuugaagauaagcgccucagacugguggacggggauucccggugugcuggaagagucgagaucuaccacgacggcuuuugggggacaaucugcgacgauggaugggaccugucugaugcccaugugguuugucagaaacucggcugcgggguggccuucaaugcuaccgucagcgcccacuuuggagagggcuccggccccauuuggcuggacgaucuuaacuguacagggauggaaucucaucuguggcagugcccuagccgcggauggggccaacacgacugucggcacaaggaggaugcgggggugaucugcuccgaguucaccgcucucagacuguauagcgaaacggaaacagagucuugugccggacgccuggaggucuucuacaauggcaccuggggguccgugggacggagaaacauuacaaccgccaucgcuggcauuguuugccgccagcuuggcuguggggaaaauggaguggucagccuggcgccccucucuaagaccggcuccggguuuauguggguggacgauauccagugcccgaaaacacauaucagcauuuggcagugucuguccgccccuugggagcggagaaucucuagccccgcugaagagacguggauuaccugcgaggaccgcauccggguuagaggaggcgauacagaaugcuccgggcggguggagauuuggcacgccggaagcuggggcaccgucugugacgauucuugggaccucgccgaagcugagguggugugccaacagcugggcuguggguccgcccuugcugcccugcgcgacgcgagcuucggacagggcacagggaccaucuggcucgaugacaugagaugcaagggaaacgaaucuuuucugugggauugucaugccaaaccuuggggccagagcgacugcgggcacaaggaggaugcuggcguucgguguuccggacaaucucugaaaagccuuaaugccuccucuggccaucuggcucucauccugagcuccauuuucgggcuccugcuucugguccucuuuauccuguuccugacguggugccgcgugcagaagcagaagcaccuuccccugagagugagcacacggagacgcggaucucucgaggaaaaccuguuucacgagauggaaaccugucucaaacgggaggacccucauggcaccagaacauccgaugacacccccaaucacgggugcgaagaugccagcgacacaucccugcuuggaguccugccggccucugaggcuacgaaguga

SEQ ID NO: 67080 - RNA, 555 nt, Artificial Sequence
  derived and/or modified sequence opt5 from CD164__Homo_sapiens__NP_001135873
augagcagacugucccggucucuccugugggccgcuaccugccuuggcgugcuguguguccucagcgccgacaagaacacaacgcagcaccccaauguuaccacacuggcgccuaucuccaacgugaccucugcuccggugacaagccuuccccuggucaccaccccugcccccgagacaugcgaagggcgcaauuccugugugucuugcuucaacguuagcguggucaauacgaccuguuuuuggauugagugcaaagaugaauccuacuguagccauaacucuacaguguccgacugccaaguuggaaauaccacagauuucuguagcgccaagccuaccgugcagcccucuccuuccacgacaagcaaaaccgucacaaccucuggcaccacaaacaauacggugaccccgacaucccagcccgugagaaagagcaccuuugacgcugccuccuucaucgggggaauuguccucguucugggcgugcaggcugugaucuuuuuccuguauaaauuuugcaagucuaaggagcggaacuaccacacacucuga

SEQ ID NO: 67081 - RNA, 1314 nt, Artificial Sequence
  derived and/or modified sequence opt5 from CD177__Homo_sapiens__NP_065139
augagcgccgugcugcuccuggcucugcuuggcuucauccucccccugccugggguccaggcccuucugugccaauuuggaaccguucagcacguguggaagguguccgaccucccgagacaguggacacccaaaaacacgucuugugauagcggccuggggugccaggacacccugaugcucauugaguccggaccucaagucucucuggugcuuagcaagggcuguacagaagcgaaagaucaggagccccggguuaccgaacaucgcauggggccuggacugucccucaucucuuacacauucgugugcagacaggaggacuuuuguaauaaccuggucaauagccuuccccugugggcuccucagccgcccgccgauccuggcucccuccggugccccgugugucugagcauggaaggcugccuggaggggaccacagaggaaauuuguccuaagggaaccacgcacugcuaugacggccuccugcgccuuagagggggaggcaucuucucuaaccugcggguucaaggguguaugccccagccggugugcaaucuccugaacggaacccaggagauuggcccugucggcaugacagaaaauugcgauaugaaagacuuucuuaccugucaucgcgggacaaccaucaugacgcacggaaaccuggcccaggagcccacagauuggaccacauccaauaccgagaugugcgaagugggccaagugugucaggagacccuccugcugcucgacgucgggcugacaagcacgcuuguuggaaccaagggcugcucuacagugggggcucagaacucccaaaagaccacaauccauagcgccccucccggagugcuggucgcuucuuacacccacuucuguuccagcgaucucugcaauuccgccucuagcuccagcgugcugcuuaacucucugcccccucaggcggccccgguucccggcgacagacaguguccuacgugcgugcagccccucggcacauguuccagcgggucuccucggaugaccugcccccgcggagcuacccacuguuaugauggcuacauucaucugagcgggggaggccuguccacaaaaaugucuauccaagggugcgucgcccagccgagcuccuuucuccugaaucacaccagacagauuggcaucuucagcgcucgggaaaagcgcgacgugcagccucccgccucucaacaugagggaggcggggcggaaggacuugagucccugacauggggcguugggcucgcccuggcuccugcccugugguggggaguggucugccccagcuguuga

SEQ ID NO: 67082 - RNA, 1986 nt, Artificial Sequence
  derived and/or modified sequence opt5 from CD180__Homo_sapiens__NP_005573
auggccuucgacgugagcugcuuuuucugggucguucuguuuuccgcuggcuguaaggugaucaccucuugggaucagaugugcauugagaaagaagccaacaagacauacaauugugagaaccucgggcugagcgaaauccccgacacgcuucccaauaccacagaguuccuggaauuuuccuucaacuuucucccgaccauucacaauagaacauucucucggcugaugaaccuuaccuuucuggaucucacacgcugccaaaucaauuggauucaugaggacaccuuccagagccaccaucagcuguccacgcuggugcucaccggaaacccccugaucuuuauggcggagacaucucuuaauggcccuaaaagccugaagcaccucuuccugauccagaccgggauuuccaaccuugaauuuauccccguccauaaucuggagaaccucgaaagccuguaucugggaucuaaucacauuuccagcaucaaauucccuaaggauuuccccgcuagaaaccucaaggugcuggacuuucaaaauaacgccauucacuacaucucucgggaggauaugcgcucccuugagcaggccauuaaccugagccucaauuucaacggcaauaacguuaaagggaucgaacugggagcuuuugacucuacaaucuuccagucccuuaauuuuggcggcaccccuaaccugagcgugauuuucaaugggcuccagaacuccacgacacaaucucuguggcugggaaccuuugaggauaucgacgaugaagacauuagcuccgccaugcucaagggccugugugagaugagcgucgaaucucuuaaucugcaggagcauagauucuccgauaucagcucuacaaccuuucagugcuucacccagcuccaagagcuggaccuuacagcuacgcaccugaaagggcucccgagcggaaugaagggccugaaccugcucaaaaagcuggugcuuuccguuaaucauuuugaccagcugugucagauuucugccgcgaacuuccccagccucacccaccuguauauccgggggaaugugaagaaacugcaccuuggagucggcugccucgaaaagcugggcaaccugcaaacacucgaucugucccauaaugacaucgaggccagcgauuguugcucucuucagcugaaaaaccucucccaccuucagacccugaaccuuagccauaaugaaccucucgggcugcagucucaggcuuuuaaggaguguccccaacuggaacuccuggaccuugccuucacacgccugcacauuaacgcuccucagucccccuuccagaaucuccauuuucugcaagugcugaaccuuaccuacugcuuccucgauacgagcaaucagcaucugcuggccggacucccggugcugagacaccuuaaccugaaaggcaaucacuuucaggacgggacaaucaccaagaccaaccuccugcagacagucggaucccuggagguucuuauucucucuagcugcggccugcuguccaucgaucaacaggcguuccacucucucgggaaaaugagccauguggaccugucccacaauagccuuaccugugauucuauugacucccugagccaccucaagggaaucuaucugaaccuggccgcuaauucuaucaacauuaucuccccucggcuucugcccauucucagccagcagucuacaaucaaucugagccauaacccucucgauugcacguguuccaauauucacuuucugaccugguacaaggagaaccuucauaaacuggaaggcagcgaggaaacaaccugcgccaacccucccucucuccgcggcgugaagcuguccgacgucaaacugagcugugggaucacagcuauuggaaucuucuuucuuaucguguuccugcuccugcucgccauucugcuguuuuucgccguuaaguaucugcucagauggaaauaccaacacaucuga

SEQ ID NO: 67083 - RNA, 1674 nt, Artificial Sequence
  derived and/or modified sequence opt5 from CD19__Homo_sapiens__NP_001171569
augcccccuccgagacugcuguucuuucugcuuuuccugacccccauggaggugcggccugaggaaccccucgucguuaagguggaagagggcgacaacgccgugcugcagugccuuaaagggacaagcgauggaccuacgcaacagcugaccuggucccgcgaaucuccccucaagccuuuucugaaacugagccucggccugccggggcuuggaauccacaugagaccccuggcuauuuggcucuuuaucuuuaaugucucccagcagaugggcggguucuaccugugucaaccuggacccccuucugagaaggccuggcagcccggcuggacagugaacguugagggcagcggggaacuuuuucgguggaauguguccgaccugggaggccucgggugcggacugaaaaaccgcucuagcgagggcccguccagcccuucugggaagcugaugucccccaagcucuaugucugggcgaaagauagaccugaaauuugggagggagagccucccugucugcccccgcgggacagccuuaaucagucucugucccaggaucucaccauggcucccggcagcacacuguggcuuucuugcggcgugccucccgacuccguuagccgcgggccucuguccuggacccaugugcaccccaagggaccgaaaucucuccugagccuggaacucaaggaugacagaccugcccgggauaugugggucauggagacaggccugcuucugccccgcgccaccgcucaagacgccgggaaauacuauugucauagaggaaaccucacgauguccuuccaccuggaaaucaccgcucggccugugcuuuggcauuggcugcuccgcacaggcggguggaaggugagcgccgucacccuggcguaccugauuuucugccucuguucucugguuggaauccuucaccuccagagagcccucgugcugcggcgcaagagaaaacggaugacagaucccaccagacgcuucuuuaaggugacgccucccccgggcuccggcccucagaaucaguaugggaacguccugagccuucccacacccaccucuggacucggccgggcucaaagaugggccgcugggcugggaggcacagccccuagcuacgggaauccguccucugacgugcaggcggauggcgcccugggaagccgcuccccucccggcguugggcccgaggaagaggagggagaaggcuaugaggaaccugacagcgaggaagacucugaguucuacgagaacgauuccaaucucgggcaggaccaacugagccaggauggaucuggcuacgaaaaccccgaggacgaaccucuugggcccgaggaugaagacuccuuuagcaaugcugaguccuaugagaacgaagaugaggaacugacccagccgguggcccggaccauggacuuccucucuccucacggcagcgcuugggaucccuccagagaggccacaucucuggccggaagccaguccuacgaggacaugcgcggcauccuguaugcugcgccucaacuucggagcauuagagggcagcccggaccgaaucaugaagaggaugccgacucuuacgaaaacauggacaacccugauggccccgacccugcuuggggagggggcgggcgcaugggcacgugguccacccgguga

SEQ ID NO: 67084 - RNA, 984 nt, Artificial Sequence
  derived and/or modified sequence opt5 from CD1A__Homo_sapiens__NP_001754
augcuguuccuccugcuuccccugcucgccgugcugccuggcgacgggaacgcugauggacuuaaggagccgcugagcuuucacgucaccuggaucgccuccuucuacaaucauucuuggaaacagaaccucguuagcggcuggcuguccgaccugcaaacacacacgugggauucuaauagcuccaccauuguguuucucugccccuggucuagagggaacuucagcaaugaagaguggaaggaacuggagacacuuuuucggauccgcaccauuagauccuucgaaggaauccggcgcuaugcgcaugagcugcaguuugaguacccuuucgaaauucaggugacaggcgggugugagcuccacagcggaaaagucucuggcuccuuucugcagcuugcuuaucaaggcagcgacuucgugucuuuucagaacaauuccuggcugcccuacccuguugccgggaacauggccaagcauuucugcaaagugcucaaucagaaccagcacgaaaaugauaucacccacaaccugcugagcgacacaugucccagauuuauccucggacugcuugaugcuggcaaggcccaucugcaacggcaggucaagccugaggcuuggcucucucacgggccgucccccggaccuggccaucugcagcuugugugccacguuagcggguucuaucccaaaccugugugggucauguggaugcgcggagagcaggaacaacagggcacccagagaggcgacauucugcccuccgccgaugggacgugguaccuccgggcgacccuggagguggccgcuggagaagccgcugaccugucuugucgcgugaagcacagcucccucgagggccaagauaucguccuguauugggaacaucacagcucuguuggguucauuauccuugccgugauugugccgcugcuccugcuuaucggacuggcgcucugguuuagaaaacggugcuucuguuga

SEQ ID NO: 67085 - RNA, 1002 nt, Artificial Sequence
  derived and/or modified sequence opt5 from CD1B__Homo_sapiens__NP_001755
augcugcuccugcccuuccagcuucuggccgugcucuuuccuggcgggaacagcgagcacgcuuuccaaggaccgaccuccuuucaugucauccagacaucuagcuucaccaauuccacgugggcccagacacagggcucuggguggcuggacgaucuucaaauucacggaugggacagcgauuccggcaccgcgaucuuucugaagcccuggucuaaagggaacuucagcgacaaggaaguugcugagcucgaagagauuuuuagaguguacaucuucggauuugcccgggaagugcaggauuucgccggcgacuuucagaugaaauauccuuucgagauucagggcaucgcugggugcgagcugcauuccggaggcgccaucgucagcuuucugcgcggggcucucggaggccuggauuuccuuucugugaagaaugccuccuguguucccagcccugaagggggaucuagagcgcaaaaauucugcgcccugauuauccaguaccagggcauuauggagacagugcggauccuccuguaugaaaccuguccccgcuaccuucugggcguccucaacgcugggaaggccgaccugcagagacaagugaagccugaggcuuggcuguccagcggaccgucucccggcccugggcggcuccagcugguuugccacguguccggauuuuaucccaaaccugucugggugauguggaugcgcggcgagcaggaacaacaggggacacagcuuggagauauucugcccaaugccaacuggaccugguaccucagagcgacgcuggacguggccgauggcgaggcugccggccuuagcugucgggucaagcauuccucucuggaagggcaggacaucauucucuauuggcgcaauccgaccagcaucggauccaucguucuggcuauuaucgugccuagccugcuccugcuucugugccucgcccugugguacaugagacggcgcucuuaccaaaacauucccuga

SEQ ID NO: 67086 - RNA, 1002 nt, Artificial Sequence
  derived and/or modified sequence opt5 from CD1C__Homo_sapiens__NP_001756
augcuguuccuccaguuucugcuucuggcccuccugcuucccggcggggacaacgcugaugccagccaagagcacguguccuuccaugucauccagaucuuuucuuucguuaaucagagcugggcgagaggacagggcuccggguggcuggacgaacuccaaacccacggaugggauucugagagcggcacaauuauuuuucugcauaacugguccaaggggaauuucucuaacgaggaacugagcgaccucgaacugcuuuuucgguucuaccuguuuggacucacgcgcgagauccaggaucacgcuucccaggacuauagcaaauacccuuucgagguccaggugaaggccggcugcgaacugcauucuggcaaauccccggagggguuuuuccaaguggccuuuaauggacuugaucugcucagcuuccagaacaccacaugggugcccucuccuggcugugggucccuggcucagagcguuugccaucugcucaaucaccaguaugaaggagugaccgagacagucuacaaccugauuagaucuaccuguccccgguuccuucugggccuccuggacgccgggaagauguaugugcaccgccaaguuagaccugaggcuuggcuuuccagccggcccucccugggaucuggccagcuccugcuggugugccacgccagcggcuuuuacccuaaaccggucugggugacauggaugcgcaaugaacaggagcaacucgggaccaagcauggagauauccugcccaacgcggacggcacgugguaucuucaggugauccuggaagucgccuccgaggaaccugcugggcucagcuguagaguucggcacucuucccugggaggccaggauauuauccuuuacugggggcaccauuucagcaugaauuggauugcccugguggugaucgucccccucgugauucugaucguucuggugcucugguuuaagaaacacugcucuuaccaggacauucuguga

SEQ ID NO: 67087 - RNA, 1008 nt, Artificial Sequence
  derived and/or modified sequence opt5 from CD1D__Homo_sapiens__NP_001757
augggcugccuccuguuccugcuucugugggcccuccugcaggcuugggggagcgccgaggugccccaaagacuuuuuccucugcggugucuccagaucuccucuuucgcgaacagcuccuggacccgcacagacggacuggcuuggcugggcgaacuccagacgcacucuuggagcaaugauuccgacaccgucagaucucugaagccguggagccaggggacauuuuccgaucaacagugggagacccuucagcauauuuuccggguuuaccgcagcucuuuuacaagagacgugaaagaguucgccaagaugcugcggcucuccuauccccuggaacuucaggugagcgccggaugcgaaguccacccuggcaacgcuucuaauaacuuuuuccauguggccuuucaagggaaagauauccuguccuuccagggaaccagcugggagcccacacaggaggcuccucucuggguuaaucuggccauucaggugcugaaccaagacaaguggacccgcgaaacgguccaguggcuccugaauggcaccuguccccaguuugugucuggccuucuggaguccgggaaaagcgaacucaagaagcaaguuaaaccuaaggcguggcuguccagaggaccgucucccggcccugggcggcuucugcucgugugccacgucagcggauucuaccccaaaccugugugggugaaguggaugcgcggcgagcaggagcagcaggggacacaacccggagauauccugccgaacgccgacgaaaccugguaucugagagcuacacucgaugucguugccggcgaggcugccggccuguccugucgggugaaacauagcucucuugaagggcaggacauugugcuguacuggggaggcuccuauaccagcauggggcucaucgcgcuggccguccuugcuugccugcucuuucugcugaucgugggauucacgucucgcuucaagagacagacaagcuaccagggcguucucuga

SEQ ID NO: 67088 - RNA, 1131 nt, Artificial Sequence
  derived and/or modified sequence opt5 from CD1E__Homo_sapiens__NP_001036048
augcugcuccuguuccuucuguuugagggccucugcugucccggggaaaacaccgccgcuccucaggcccugcaaagcuaccaccuugcggcugaggaacagcuguccuucagaaugcuccagacaucuagcuuugccaaucauuccugggcccacucugagggaagcggcuggcugggggaccugcagacgcauggaugggauaccgugcucggcacaauccgguuccugaagccguggucccacgggaacuuuucuaaacaagaacuuaagaaucugcagagccucuuccagcuguauuuucauuccuucauucagaucguccaagcuagcgccggacaguuucagcuugaguaccccuucgagauucagauccuggcuggcugccgcaugaacgccccucaaauuuuucucaauauggcguaucagggcucugacuuccuguccuuucaggggaucagcugggaacccucuccuggagccggcaucagagcucaaaacauuuguaaaguucugaaucgguaccucgauaucaaggagauucugcagucccuucuggggcacacaugcccccgcuuccucgccggacugauggaagcuggcgagagcgagcuuaaaagaaaggugaagccugaagccuggcugucuugugggccgucccccggaccuggccggcuccagcuggugugccacgucagcggcuucuaucccaaaccuguguggguuauguggaugcgcggggagcaggaacaaagaggaacacagcggggcgacgugcugcccaacgcggaugagaccugguaccuccgcgccacacuggacgucgcugccggggaagcugccggacuuuccuguagagugaagcauucuagccugggcgggcacgaucucaucauucauuggggaggcuauuccaucuuucugauucuuaucugccugaccguuaucgugacgcucgucauucuggugguggucgacagccggcugaaaaagcagucuccgguuuuccucaugggcgccaauacccaggauaccaaaaacucccgccaccaauuuugucuggcucaggugagcuggaucaagaauagagugcuuaagaaauggaagacccggcugaaccagcucugguga

SEQ ID NO: 67089 - RNA, 885 nt, Artificial Sequence
  derived and/or modified sequence opt5 from CD200__Homo_sapiens__NP_001004196
auggagagacugacccucacacggacgaucggcgggccccugcuuaccgccacacugcucggaaagaccacaauuaacgacuaccaggugauccgcaugccuuucagccaccuguccaccuauucucuugucuggguuauggcugccguggugcugugcacagcgcaaguccaggugguuacccaggaugaaagagagcagcucuacacgccggcuagccugaaauguucccugcaaaaugcccaggaagcccucauugugaccuggcagaagaaaaaggcugucucucccgagaacauggugacauuuagcgaaaaucauggcguugugauccagccugccuauaaagacaagauuaacaucacccaacuggggcuucaaaauuccacaaucaccuucuggaacauuacgcuggaggaugagggaugcuacaugugucucuuuaauacauucggcuuugggaagaucucuggaaccgcuugccugacagucuaugugcagcccauugugagccuucacuacaaauucuccgaagaccaucugaacaucaccuguagcgccaccgcgcggccugcccccauggucuuuuggaagguuccucgcucuggcauugaaaauuccacagugacgcucagccacccgaacggcaccacaucugugaccuccauccugcauauuaaagaucccaagaaucaggucgggaaagaggugaucugccagguucugcaccucggaacagugaccgacuucaagcagacggucaacaagggcuauugguuuagcgugccucugcuucugucuaucguuucccucgugauucugcuuguccugaucagcauucuccuguacuggaaaagacaccggaaucaggaucgcgagcccuga

SEQ ID NO: 67090 - RNA, 1047 nt, Artificial Sequence
  derived and/or modified sequence opt5 from CD200R1__Homo_sapiens__NP_620161
augcugugccccuggagaaccgccaaccucggccugcuucugauccucacaauuuuccugguggcugaggccgaaggggcggcucagccuaauaacagccuuaugcugcaaacguccaaggagaaucacgcccucgccucuagcucccuguguauggacgaaaaacagaucacccagaacuacucuaagguccuggcugagguuaauacaagcuggccggugaaaauggccaccaacgcugugcucugcugucccccuauugcccugcggaaucuuaucauuaucacaugggaaaucauucugcgcggacagcccuccugcaccaaggcguauaaaaaggagacaaacgagaccaaggaaacgaauuguaccgaugagagaaucacaugggucucucggccugaccaaaacagcgaucuccagauucgcaccguggccaucacacaugacggcuacuauagaugcauuaugguuacccccgaugggaauuuucaccggggauaccaucuucaggugcuugucacgccugaagugacacuguuccagaaccgcaauagaaccgcuguuuguaaagccguggcuggcaagccggccgcgcacaucuccuggauucccgagggggacugcgccacaaaacaagaguauuggagcaacggaaccgucaccgugaagucuacaugucauugggaagugcacaaugucuccacgguuaccugccacgugagccaucucacaggcaacaaaucucuguacaucgagcugcucccugugcccggcgcuaagaaguccgccaaacuguauaucccuuacauuauccuuaccauuaucauucugacaaucgucggguuuaucuggcuccugaaggugaacggaugucggaaauacaagcugaauaaaaccgaaagcacgcccguuguggaggaagaugagaugcagccguaugcuucuuacacagagaagaacaauccucuguaugacaccaccaacaaagucaaggccuccgaagcccuccagagcgagguggauacagaccugcacacccuguga

SEQ ID NO: 67091 - RNA, 987 nt, Artificial Sequence
  derived and/or modified sequence opt5 from CD207__Homo_sapiens__NP_056532
augaccguggagaaggaagcccccgacgcucacuucacagucgauaaacaaaacaucagccuguggccuagagagccgcccccuaaguccggccccucucucguuccugggaaaacgcccaccgugcgggccgcgcugauuugccuuacacuggugcucgucgcuagcgugcugcuucaagccguucuguacccucgcuuuaugggaaccaucuccgacgugaagacaaauguccagcuccugaaaggcagaguggauaacauuucuacccuggacagcgaaaucaagaagaacuccgaugggauggaggccgcuggaguucagauucagauggugaaugaaucucucggcuauguccggagccaauuccugaaacuuaagacauccguggagaaagccaaugcucagauccagauccugacccgcagcugggaggaagugucuacgcucaacgcccagauuccggagcugaaguccgaccuugaaaaagcgagcgcccugaauaccaagaucagagcucuccaagggucucuggagaacauguccaagcugcucaaacggcagaaugauauucugcaggucguuagccagggauggaaguacuuuaaaggcaacuucuauuacuuuucucuuauccccaagacaugguauuccgccgagcaauucugugugagccgcaauucccaucugaccucugugacaagcgaauccgagcaggaauuucucuacaaaaccgcuggcgggcugauuuauuggaucggacuuacgaaggccggcauggagggggacuggagcugggucgaugacacaccuuucaacaaagugcagucuguuagauuuuggauucccggagaaccuaauaacgcgggcaauaacgagcacugcgggaacaucaaggcccccucccugcaggcuuggaaugaugccccgugugacaagaccuuccucuuuaucugcaaacggccuuacgugcccagcgagccuuga

SEQ ID NO: 67092 - RNA, 807 nt, Artificial Sequence
  derived and/or modified sequence opt5 from CD209__Homo_sapiens__NP_001138365
augagcgacuccaaggagcccagacugcagcaacucggccugcuugugucuaaagucccuagcuccaucucucaggaacagagccggcaggaugccauuuaccaaaaccugacccagcucaaggcugccguuggggagcuguccgaaaaaucuaaacuucaggagaucuaucaggaacugacacaacucaaggcggcugugggagagcugccggaaaagagcaagcugcaggaaauuuaccaggagcucacgcgccugaaagccgccgugggcgaacuucccgagaaguccaaacugcaggagaucuaucaagaacucaccuggcugaaggcugccgucgagagacuuugccacccuugucccugggaauggacauucuuucaggggaauugcuacuucaugagcaacucucagcggaauuggcaugacuccauuaccgcuuguaaagaggugggagcccaacugguugugaucaagagcgcggaggagcagaacuuucuccagcugcagucuucccgcagcaauagauucacauggaugggccugucugaucucaaccaagaggggaccuggcagugggucgacggauccccucugcuucccagcuuuaagcaguauuggaaucggggcgaaccuaacaaugugggcgaggaagauugcgccgaguucuccgggaacggauggaaugacgauaaauguaaccuggcuaaguuuuggaucugcaaaaagucugccgcuagcuguucccgcgacgaggaacaguuccucagcccggcccccgcgacaccuaaucccccucccgccuga

SEQ ID NO: 67093 - RNA, 1011 nt, Artificial Sequence
  derived and/or modified sequence opt5 from CD226__Homo_sapiens__NP_001290547
auggacuaccccacccugcuccuggcccuucugcacguguauagagcucucugcgaggaaguccuguggcauacaagcguuccuuucgccgagaacaugucccuugaauguguguacccgucuaugggcauccugacccagguggagugguuuaagauugggacgcaacaggauagcaucgcgauuuucucccccacacacggaauggucauccggaaaccuuaugcugaacgcguguacuuucucaauucuaccauggccagcaacaauaugacacuguucuuuagaaacgccuccgaggacgauguuggcuauuacucuugcagccuguauaccuacccccaggggacauggcagaaggugauucaagucgugcaguccgacagcuucgaggcugccguuccuucuaauucccauaucgugagcgaacccggcaaaaacgucacccucacgugucagccucagaugaccuggccggugcaagcugugcggugggagaagauccagccccgccagauugaucugcuuacauacugcaaucugguccacggaagaaacuuuaccucuaaauucccucggcagaucguuuccaauuguagccaugggcgcuggucugugauugugauccccgacgucacaguguccgauagcggacucuauagaugcuaccugcaagccuccgcgggcgaaaacgagaccuuuguuaugcggcuuacgguggccgagggcaagacagacaaucaguauacccuguucgucgcugggggaacagugcuccugcugcucuuuguuauuucuaucaccaccauuaucgugaucuuccugaaccgcagacggcgcagagaacggcgcgaucuuuuuacagagagcugggacacgcagaaggccccuaauaacuacagaucccccauuagcaccucucaaccgacaaaucaguccauggaugacacccgggaagauaucuaugucaacuacccuacauucagcagacgccccaaaacccggguguga

SEQ ID NO: 67094 - RNA, 2280 nt, Artificial Sequence
  derived and/or modified sequence opt5 from CD22__Homo_sapiens__NP_001172028
augcaucugcucggccccuggcugcuucugcucgugcuggaguaccuugccuucagcgacuccucuaagugggucuuugaacacccugagacccuguaugcuugggaaggggccugcguuuggaucccguguacauacagagcgcucgauggagaccuggagagcuucauucuguuucacaaccccgaauauaauaaaaacacguccaaguucgauggcacccggcucuacgagucuacaaaagacgggaaggugccuagcgagcagaaacgcgugcaauuucugggagauaagaauaagaacugcacccuuuccauccaucccguccaccugaaugacucuggccagcucgggcugagaauggaaagcaaaacagagaaguggauggaacggauucaucuuaacguguccgagcgcccuuuucccccucacauccagcugccgcccgagauucaggaaagccaagagguuacccucacaugucugcugaauuucucuugcuauggauacccuauccagcuccaguggcugcuugaaggcgugcccaugagacaggcugccgucaccuccacgagccugaccaucaaaucuguguucacacgguccgagcucaaguuuagcccucaauggucucaccauggcaaaauuguuaccugucagcugcaggaugccgacgggaaguuccuuuccaacgauacagugcagcugaaugucaagcacacccccaaacucgaaaucaaggugacgccgagcgacgcuauugugcgcgagggagauuccgucacaaugaccugcgagguuucuagcuccaacccugaauauacaaccgugagcuggcugaaagacggcaccucucugaagaaacaaaauacauuuacgcucaaccugagagaggugaccaaggaucaguccgggaaauacuguugccaggucagcaaugacgugggacccggccggucugaagagguuuuccuucaagugcaguacccucccaagaaggucacaaccgugauccagaaccccaugccuauucgcgaaggggacacaguuacccugagcuguaauuauaacuccucuaacccgagcgugacgagauacgaguggaaaccccauggagccugggaggaaccuucccucggcguccugaagauccagaaugugggcugggauaacacaaccauugcuugcgccgcguguaauagcuggugcucuugggccucccccgucgcucuuaacgugcaauaugccccucgggacguucgcgugagaaaaaucaagccccugagcgagauccacucugggaacuccgucagccuccagugcgauuuuuccucuagccacccgaaagaagugcaguucuucugggagaagaacggacggcugcugggcaaggaaucccagcucaauuuugacucuauuagcccugaggaugcuggguccuacagcuguuggguuaacaauucuaucggacaaaccgccuccaaagcguggacacuggaggugcuuuaugcuccccgcagacugcgggucagcaugucuccuggcgaccaggugauggaagggaaguccgccacccucacaugcgagagcgaugccaaucccccugugucucauuacacgugguucgacuggaauaaccagagccugcccuaucacucccagaaacugagacuugaaccgguuaagguccaacauagcggagcuuacuggugucagggcaccaauucugugggcaaagggcgcuccccucucagcacacugaccguguacuauucccccgagacaauuggacggagagucgccgugggccuggggucuugccucgccauccugauucuugcuaucuguggacugaagcuccagcgccgguggaagagaacccagagccaacagggccugcaggagaacuccucugggcagagcuuuuucguucgcaauaaaaaggugcggagagcgccccuguccgaaggcccucacucucuuggaugcuacaacccgaugauggaggauggcaucagcuauacgacccuccgcuuucccgaaaugaacauuccucggacaggggacgccgaguccagcgaaaugcaaagacccccucccgauugugacgacaccgucacauacucugcucugcauaaacgccaggugggagauuaugagaauguuaucccugacuuccccgaggaugaaggcauucacuacuccgagcugauccaguuuggggugggagaacggccgcaagcccaggagaacgucgacuaugugauucucaagcacuga

SEQ ID NO: 67095 - RNA, 1113 nt, Artificial Sequence
  derived and/or modified sequence opt5 from CD244__Homo_sapiens__NP_001160135
augcugggccagguggucacccucauccugcuucugcuccugaagguuuaccaagggaaaggaugccagggcagcgccgaccacgugguguccauuucuggggucccccuucagcugcagccuaacagcauccaaacaaagguggauuccauugcuuggaaaaagcuccugccgucucagaauggauuccaucacauccugaaaugggagaacggcagccuccccuccaauacgucuaacgacagauuuagcuucauuguuaagaaucugucccuucugaucaaggccgcgcagcagcaagauagcgggcucuauugucuggaagugaccucuaucuccggaaaaguccagacagcuaccuuucagguguucguuuuugagagccuucugccugacaagguggaaaaaccccggcuccagggccaaggcaagauucuggaucgcgggagaugccaggucgcccugucuugucucgugucccgggacggaaacgugagcuacgccugguaucgcggcucuaaacugauccagacagcugggaaucuuaccuaccuggaugaggaagucgacauuaacggaacacauaccuauacgugcaauguuuccaacccugugagcugggagucccacacccucaaucugacacaagauugucagaacgcccaucaggaguucagauuuuggcccuuccuugugaucauugucauccugucugcucucuuucugggcacccuggccugcuucuguguguggcggcgcaagagaaaggaaaaacagagcgagacauccccuaaggaauuucucaccauuuacgaggacguuaaagaucugaagacgcggcgcaaucacgagcaagaacagacauuccccgggggaggcagcaccaucuauucuaugauccagucccagagcucugcgccgacaagccaagagccugccuacacccuuuacucccugauucagcccucuagaaaaagcggcucccggaagcgcaaccacagcccuucuuuuaauuccaccaucuaugaagugauugggaaaagccagcccaaggcucagaacccggccagacucucucggaaggagcuggaaaacuucgacgucuacuccuga

SEQ ID NO: 67096 - RNA, 492 nt, Artificial Sequence
  derived and/or modified sequence opt5 from CD247__Homo_sapiens__NP_000725
augaaguggaaagcccuguucaccgcugccauccuccaggcgcaacugcccauuacagaggcucagagcuuuggccuucuggacccuaagcucugcuaccugcuugaugggauccuguucauuuauggagugauccucacggcccuguuucugagagucaaauucucccggucugccgacgcuccggccuaccagcagggccaaaaccagcucuauaaugaacugaaccuugggcgcagagaggaauacgauguucuggacaagcggcgcggaagagaucccgagaugggcgggaaaccucggcgcaagaauccccaggaaggacucuauaacgagcugcagaaggacaaaauggcugaggccuacagcgaaauuggcaugaagggcgagagacggcgcgggaaaggacacgauggccuuuaucaagggcuguccaccgcgacaaaggacaccuacgaugcccuccauaugcaggcucugccucccagauga

SEQ ID NO: 67097 - RNA, 2274 nt, Artificial Sequence
  derived and/or modified sequence opt5 from CD248__Homo_sapiens__NP_065137
augcugcucagacugcuucuggccugggcugccgcgggccccacccucgggcaggacccuugggcugccgagccgcgggccgcuugcggacccagcuccuguuacgcccuguucccucgcagacggacauuucuugaagccuggcgcgccugcagagagcugggcggggaucucgcgacgccccggaccccugaagaggcccaacgcguggacucucuggucggagcuggccccgccagcagacugcucuggaucgggcugcagcggcaggcucgccagugucaacuucagagaccucugcggggauucacauggaccacaggcgaucaggacaccgccuuuacaaacugggcgcagccggccuccggcgggcccugcccugcucaacgcuguguugcccucgaggcuucuggagaacacagauggcuggagggcagcugcacccuugccguggauggguaucugugucaguucggauuugaaggcgccugccccgcucuccaggacgaggcggggcaggccggaccugcuguguacacgacccccuuccaucuggucuccacagaauuugaguggcugccguucggcucuguggccgccguucaaugucaggcuggccggggagccagccuccugugcgugaagcagccugagggaggcgucggguggucccgcgcgggaccccuuugucugggcaccgggugcagcccugauaauggaggcugcgaacacgaguguguggaagagguugacggccaugugucuugcagauguacagaaggguuucggcucgcugccgauggaagauccugcgaggaccccugugcccaagcucccugcgagcagcagugugaaccuggcgggccgcagggauauagcugccacugucgccugggcuuccggcccgccgaggaugacccucauagaugcgucgauaccgacgaaugucaaauugcuggggugugccagcagaugugcgugaacuacgucggcggauuugaguguuauugcucugaaggccacgagcuugaggccgacgggaucuccuguagccccgcgggagccaugggcgcucaggccucucaagaucugggggacgaacuccuggaugacggagaggaugaagaggacgaagaugaggcuuggaaagccuucaauggcggguggacggagaugccuggcauucuguggauggaacccacacagccgccugacuuugcgcucgccuaccgccccuccuucccugaggaucgggaaccccagaucccuuaucccgagccgaccuggccuccuccccugagcgcucccagaguuccguaccacuccucugugcuuagcgugacacgccccgucgugguuuccgccacccauccuacccugcccagcgcucaccagccucccgugauuccugccacacaucccgcccucucucgggaccaccaaaucccggucaucgcugcgaacuacccugaucugcccuccgccuaucagccugggauucuuagcgugucucacagcgcucagcccccggcccaucagccucccaugaucuccacgaaguacccugagcuguuccccgcccaccaaucucccauguuuccugacaccagaguugcuggcacacagaccacaacccaucucccggggauucccccuaaucacgcuccccuggugacgacacugggagcgcagcucccuccccaagcuccugacgcccugguccuucgcacccaggccacccagcugccgaucauucccacagcucagccuagccucaccacaacgucccggagccccgugucuccugcccaucaaaucuccguccccgcggcuacccagccggccgcccugccuacacugcuucccagccagucucccaccaaccagacauccccuauuagccccacccacccucacuccaaagcuccgcaaauccccagagaagauggcccuucucccaagcucgcccuguggcugccuagccccgcuccgacggccgcgccuaccgcccucggggaggcuggacuggccgaacauucccagcgcgacgaucgguggcuucugguggcucuccugguucccacaugcguguuccuggucgugcuucucgcccugggcaucguuuauuguaccagaugcgggccucacgcccccaauaaacggauuacagacuguuaccgcugggugauccaugcuggcucuaagagcccuaccgagcccaugccgccuagaggaucccugacgggcguccagacaugccggaccagcguguga

SEQ ID NO: 67098 - RNA, 411 nt, Artificial Sequence
  derived and/or modified sequence opt5 from CD24__Homo_sapiens__XP_011533677
augagaacccgggacgcccccgugagcucccugcgccucgcugauacaagacggucucagaacaaggcccgcgcgagcggcagagcucggccucgcgggagagcccggcgcucccugagaacgcggaccccgcccgcccgcucugcugaccaaccuggaagaguccgggcccgcagacggcccggcccuguugggcagggacuugcuggcagccccagauccccuccgugccugcggcccccuggggccucuggaagccccuccacacagcacccugcgcgcagagccgcucaucgccggagaggccacggccagagcaaugggggacaagcccgcgcuggcgccgcggccgcugggaccgcccccacacaugcugugcggugugccccggagccuucuuccauccucuga

SEQ ID NO: 67099 - RNA, 531 nt, Artificial Sequence
  derived and/or modified sequence opt5 from CD274__Homo_sapiens__NP_001254635
augagaaucuucgccguguuuauuuucaugaccuacuggcaucugcucaacgcucccuauaauaagaucaaccagcggauucuggucguugacccugugacaagcgagcacgaacuuacgugccaagccgagggcuacccgaaagcggaagugaucuggaccuccucugaucaccagguccugagcgggaagacaaccacaaccaauuccaaacgcgaggaaaagcucuuuaacgugacaucuacccugagaauuaauacgaccacaaacgagaucuucuauuguaccuuucggcgccuugaccccgaggaaaaucauacagcugagcugguuaucccugaacucccccuggcccacccucccaacgagagaacccaucuggugauucucggagccauccugcuuugccugggcgucgcucucacguucauuuuucggcugcgcaaagggagaaugauggaugugaagaaguguggaauccaggacacaaauagcaaaaagcaguccgauacccaccuugaggaaacauga

SEQ ID NO: 67100 - RNA, 951 nt, Artificial Sequence
  derived and/or modified sequence opt5 from CD276__Homo_sapiens__NP_079516
augcugagacggcgcggcagccccgggaugggagugcacgucggcgccgcucucggggcccugugguucugccuuaccggagcgcuggagguucaggugccugaagacccgguggucgcucucgugggcacagaugccacgcuguguugcuccuuuucucccgagccuggguucagccuugcccaacugaaccucaucuggcagcugaccgacacaaagcagcugguucauuccuuugcugaaggacaggaucaaggcucugccuacgcuaauagaaccgcccucuuccccgaccugcuugcgcagggcaacgccagccugcggcuccagcgcgugagagucgcugaugagggguccuuuacauguuucgugucuauucgggacuuuggaagcgccgcuguuucccuucagguggccgcgccuuauagcaaacccucuaugacccuggaaccuaauaaggaucugcgcccgggcgacacagucaccaucacgugcuccagcuacagaggguaucccgaggccgagguguucuggcaagauggacagggcgugccucucaccgggaacgucacaaccucucagauggcuaaugaacagggacuguuugacguucacuccgugcugcgggugguccucggcgccaacggcacauacagcugucuggugcgcaaucccguucuucaacaggaugcucaugggucugugaccauuacgggacagccuaugacauuucccccggaggcccugugggucaccgugggccucuccguuugccugaucgcccuucugguggcucucgcguucgucuguuggagaaaaauuaagcaaagcugcgaagaggagaacgccggggcugaagaccaggauggagagggcgaaggguccaaaacagcccugcagccucugaagcacucugacagcaaggaggacgauggacaggaaaucgccuga

SEQ ID NO: 67101 - RNA, 783 nt, Artificial Sequence
  derived and/or modified sequence opt5 from CD27__Homo_sapiens__NP_001233
auggccagaccccacccuugguggcugugcgugcucggcacccuggucgggcuuagcgcuacaccggcccccaaguccuguccugagcggcauuacugggcgcagggaaaacugugcugucaaaugugcgaacccggcacguuccucguuaaggacugugaucagcaccgcaaagcugcccagugcgacccuuguauccccggggugucuuuuagcccugaucaucacaccagaccgcauugcgaguccugucggcacugcaacucuggacugcuugugcgcaauuguacaauuaccgccaacgcugaaugcgccugcagaaauggcuggcagugucgggacaaggagugcacagaaugugauccccugccuaaccccagccucaccgcucgcuccucucaagcccugagcccucacccccagccgacacaucugccuuaugucuccgagaugcucgaggcgagaaccgccgggcacaugcagacgcuggcugacuuccggcagcuucccgcccgcacccugagcacacauuggccuccccaaagaucucucugcuccagcgauuuuauccggauucuggugaucuucucuggaauguuucuuguuuucacccuggcuggcgcccucuuucugcaccagcgcagaaaauaccgguccaauaagggcgaaagccccguggagccugcggaaccgugucgcuauucuugccccagagaggaggaaggguccacaauuccuauccaggaggacuaccggaagcccgaaccugccuguagccccuga

SEQ ID NO: 67102 - RNA, 306 nt, Artificial Sequence
  derived and/or modified sequence opt5 from CD28__Homo_sapiens__NP_001230007
augcugagacuccugcuugcccugaaccucuuccccagcauccaggugaccggcaagcaccugugcccuuccccgcuuuuucccgggccuucuaaacccuucuggguccugguuguggugggaggcguccucgcuuguuacagccugcuggugacaguugccuuuauuaucuucugggugcgguccaagcgcucuagacuccugcauagcgacuauaugaauaugacgccucggcgccccgggccuaccagaaaacacuaccaaccguaugcgcccccucgggauuuugcugccuaccgcuccuga

SEQ ID NO: 67103 - RNA, 1920 nt, Artificial Sequence
  derived and/or modified sequence opt5 from CD2AP__Homo_sapiens__NP_036252
augguggacuacaucgucgaguaugauuacgacgccguucacgaugacgaacugaccauuagagugggcgagaucauucggaacgugaagaaacuccaggaagagggguggcuggaaggagagcuuaauggccgcagagggauguuccccgauaacuuugucaaggagaucaaacgggaaacagaguucaaggacgauagccugccuauuaaacgcgaaagacauggaaauguggcuucccucguucaacggaucucuacguauggccugccggccgggggaauccagccccacccucagaccaagaacauuaagaaaaagacaaagaagcgccagugcaaagugcuuuuugaguacaucccccaaaaugaggacgaacuggagcucaaggucggcgauauuaucgacauuaacgaagagguggaagagggcugguggagcgggacccugaauaacaagcugggacucuucccuuccaauuuuguuaaagagcuggaagugacagaugacggcgagacccaugaagcgcaggaugacucugagacaguccuugcugggcccaccagcccuaucccgucccugggaaacgugucugaaacggccagcggcuccgugacccagcccaagaaaauuagagggaucggauucggcgacaucuuuaaggagggcagcgucaaacuccggacacgcaccucuuccagcgagacagaagagaagaaaccugaaaagccccugauucuucagucucuggggccuaagacccaauccguugagaucacgaaaacagauaccgaaggaaagauuaaagccaaggaguauuguagaacacucuucgcuuacgagggcaccaaugaagacgagcugaccuuuaaagaaggggagaucauucaccugaucagcaaggagacaggagaagccggcugguggcgcggggagcucaacggaaaggaaggcguguuccccgauaauuuugcugugcagaucaacgagcuggacaaagauuucccgaagccuaaaaagcccccuccucccgccaaagcgcccgccccgaagcccgaacuuauugcugccgagaagaaauauuuuucucugaagccugaggaaaaagacgagaaguccacgcucgaacagaaacccagcaagccugcugcgccccaggucccgccuaagaaacccaccccucccacaaaggccuccaaucugcuucggucuagcggcaccguguacccuaaaagacccgagaagccgguuccucccccucccccgaucgccaaaauuaacggggaaguguccagcaucucuuccaaguucgagacagagcccgucagcaaacugaagcucgauucugaacaacugccucugcggcccaagagcguggacuucgauucccucaccguucgcacgucuaaagagacagacguggucaacuuugaugacauugcuagcuccgaaaaucugcuucaucugaccgccaacagaccuaagaugcccggacggagacucccuggccgcuucaaugggggacacagccccacccacucuccggagaaaauccugaaacuuccuaaagaagaggacuccgcuaaccugaagcccagcgagcucaagaaagauacaugcuacucuccuaagcccuccguguaucugagcaccccguccucugccagcaaagccaauacaacggcuuuucugaccccucucgaaaucaaggcgaaagucgagacagacgaugugaagaagaacucccuggacgaacuucgggcccagauuaucgagcugcucuguauuguugaggcucugaaaaaggaucauggcaaagaacuggagaaacuuagaaaggaccucgaagaggaaaagaccaugcgcucuaaucuggagauggagaucgaaaagcugaaaaaggccgugcucagcuccuga

SEQ ID NO: 67104 - RNA, 561 nt, Artificial Sequence
  derived and/or modified sequence opt5 from CD300A__Homo_sapiens__NP_001243770
auguggcugcccugggcccuccugcuucugugggugccugcuagcaccuccaugacaccggccucuaucacggcggcuaagaccagcacaauuaccacagccuuucccccugucuccucuaccacacucuucgccguuggcgcuacccacagcgccuccauccaggaggaaacggaggaaguggugaacucucaacugccccuucugcucagccugcuggcucuccugcuucugcuccuggucggggccucccuucuggcguggagaauguuccagaaauggauuaaggccggagaccauagcgagcucucucagaauccuaaacaggcugccacccaauccgaacugcacuacgcuaaccuggagcuccugauguggccccuucaggagaagccugccccgccccgggaaguggagguugaauauagcacaguggcgucuccucgcgaggagcugcauuacgccuccgucguguuugauagcaauaccaacagaaucgcugcccagcggccccgcgaagaggaaccugacucugauuauuccguuauuagaaaaacauga

SEQ ID NO: 67105 - RNA, 675 nt, Artificial Sequence
  derived and/or modified sequence opt5 from CD300C__Homo_sapiens__NP_006669
augaccgccagagcuugggccagcuggcgguccucugcgcugcuccugcuucuggugcccggcuacuucccucucagccacccgaugacagucgcugggcccguuggaggcucccugucugugcagugccgcuaugagaaggaacauagaacgcuuaacaaauuuuggugucggccuccccaaauccugcgcugcgacaagauuguggagaccaaagggagcgccggaaagagaaauggccgggucuccauccgcgauucuccugccaaccucagcuucacagugacccuggaaaaucugacagaggaagacgcugggaccuacugguguggaguugauacacccuggcucagagacuuucacgauccuauuguggaggucgagguguccguuuucccggccggcaccacgaccgcuagcucuccccaguccagcaugggcacaucugggccucccaccaaacugccugugcauacauggcccuccgucacccggaaggacagcccggaaccuucuccccacccuggaucccuuuuuagcaacgugcgcuuccugcuccuggugcuucuggagcucccccugcugcucuccaugcugggcgccguccuuuggguuaauagaccccagcggucuagccgcuccagacagaacuggccuaagggggaaaaucaauga

SEQ ID NO: 67106 - RNA, 585 nt, Artificial Sequence
  derived and/or modified sequence opt5 from CD300LF__Homo_sapiens__NP_001276011
auguggcugccccagcucgaccugaugagagugaucagcgccaagucccaaggcuacucuauugucacccagaucacagggccuacgaccguuaacggacuugagcggggcagccugacagugcagugcguguaucgcuccgggugggaaaccuaccucaaauggugguguagaggagcuauuuggcgggauugcaagauccuggucaaaacaucuggcagcgagcaggaagugaagcgcgacagaguuuccauuaaagauaaucaaaagaaccggaccuucacagugaccauggaggaccuuaugaagacggaugccgacaccuauuggugugggaucgagaaaacaggaaaugaucugggcgucaccgugcagguuacaaucgacccggcgcccgugacccaggaagagacgucuagcuccccuacacucaccggccaccaucuggauaacagcucucgcgacguccccagagcugggacagccgccccuggaggccggccccugcucugccgcccugauccggcugccgggagaaaucugcccgcuaagggauaccacgaagccuuucuuuguccuggcuga

SEQ ID NO: 67107 - RNA, 525 nt, Artificial Sequence
  derived and/or modified sequence opt5 from CD302__Homo_sapiens__NP_001185692
augcugagagccgcccuccccgcccugcuucugccucuccugggccuugcggcugccgccguggcugacugcccgagcuccaccuggauccaguuccaagauucuuguuacauuuuucugcaggaggccaucaaggucgaaagcauugaggacguucggaaccagugcacagaucacggggcugacaugaucuccauucauaaugaagaggaaaacgccuucauccucgauacgcugaaaaagcaguggaaaggacccgacgauauccugcucggcauguuuuaugacaccgaugugccuuacaagcgcaaauaucugucugacaaucacauucuuaucagcgcgcuggugauugccuccacagucauccucaccgugcugggggcuauuaucugguuccuuuacaagaagcauucugauagcagauuuacaaccguuuucuccacagcuccccaaagcccuuauaacgaggacugugugcuggucgugggagaggaaaaugaguaccccguucaguuugauuga

SEQ ID NO: 67108 - RNA, 723 nt, Artificial Sequence
  derived and/or modified sequence opt5 from CD320__Homo_sapiens__NP_001159367
augagcggcggguggauggcccaggugggagcuuggagaaccggcgcccuggggcucgcgcugcuucugcuccugggacuuggccuggggcucgaggcugccgccagcccccugucuacaccuacgagcgcucaagccgcuggaaucgaaccgugcacccagaagggccagugucccccucccccuggccugcccugcccuuguacaggggucuccgacugcucuggaggcaccgauaaaaagcuccggaacuguagccgccuggccugccuugcgggggagcugagauguacacucuccgacgauugcauuccgcugaccuggcggugugacggacaccccgauugcccugacucuagcgaugaacuuggcugugggacaaaugagauccugcccgaaggagacgccaccacgaugggcccucccguuacccucgaguccgugacaagccugcgcaacgcuaccacaaugggcccgccugugacccuggagucuguccccuccguggggaaugccacguccucuuccgcuggagaucagagcggcucuccuacagccuacgggguuauugcggccgcugccgugcucuccgcuagccuggucaccgccacacuucugcuccuguccuggcuuagagcccaagaacggcugcgcccccucggacugcugguggcuaugaaagagucucuccugcuuagcgaacagaagaccucccugcccuga

SEQ ID NO: 67109 - RNA, 714 nt, Artificial Sequence
  derived and/or modified sequence opt5 from CD33__Homo_sapiens__NP_001076087
augccccugcuccugcuucugccucuccugugggccgaccuuacccacagaccgaagauccugauucccggcacacucgagccugggcauagcaaaaaccugacgugcuccgugucuugggcuugugaacagggaacacccccuaucuucagcuggcuguccgccgcgcccaccucucucggcccucggaccacacacagcuccguccugauuaucaccccgcgcccccaagaucaugggacaaaucuuaccugccagguuaaguuugcuggagccggcgugacgaccgagagaacaauucagcugaacgugaccuacgucccucagaaucccacaaccgggaucuucccuggagacggcucuggcaaacaagaaacgcgggccggggugguucacggagcuaucggcggggccggagugacagcucuccuggcccuuugucugugccucaucuuuuucauugucaagacccaucgcagaaaagcggcccggacagcugugggccgcaacgauacccaccccaccacagggagcgccuccccgaagcaccagaagaaaagcaagcugcauggaccuacggagaccucuuccuguagcggcgcugcccccacaguugaaauggacgaggagcugcacuaugcgucucucaauuuucauggcaugaacccuuccaaagauaccagcacagaauacucugaggugagaacccaguga

SEQ ID NO: 67110 - RNA, 1158 nt, Artificial Sequence
  derived and/or modified sequence opt5 from CD34__Homo_sapiens__NP_001020280
augcuggugagacggggcgcccgcgcugggcccagaaugccucggggauggaccgcccucugccugcuuagccugcucccguccggcuucaugucucuggacaacaaugggacagcgacgcccgagcuuccuacccagggaacauuuagcaacgucuccaccaauguuucuuaccaagaaacaaccacacccagcacccugggcuccacgucucuccacccugugagccagcaugggaacgaggcuaccacaaauaucaccgaaacaaccgugaaguucacguccacaagcgucauuaccucuguguauggaaacacaaauuccagcguucagucucagaccuccgugaucagcaccgucuuuacaacgcccgccaacgugucuaccccugagacaacccugaaaccgucccugagccccggcaauguuuccgaucucucuacaaccagcacgucccuggccacaagcccuaccaagcccuacaccucuuccagcccuauucuuucugacaucaaagcugaaauuaaguguagcggcauccgcgaggugaaacugacacaagggaucugccucgagcagaacaagaccuccucuugugccgaguucaagaaagauagaggagagggccuggcucggguccuuugcggggaagaacaggccgacgcggaugccggagcucagguguguagccugcuccuggcccaauccgaggugcgcccccagugccugcuccugguccuugcuaauagaacagaaauuagcucuaagcugcagcucaugaaaaagcaccaguccgaccugaaaaagcugggcauccuugauuuuacggagcaagacguugccagccaucagucuuauucccagaagacccucauugcgcuggugacaagcggggcccugcucgcugugcugggaaucaccggcuacuuccuuaugaaccggcgcuccuggucuccgacaggcgaaagacugggggaggauccuuauuacaccgaaaauggaggcgggcaaggauauagcuccggccccgggacgucuccugaggcccagggaaaagcuagcgucaaccggggcgcccaggagaauggcaccgggcaggccacaucccgcaacggacacagcgcuagacaacaugugguugcggacaccgaacucuga

SEQ ID NO: 67111 - RNA, 1419 nt, Artificial Sequence
  derived and/or modified sequence opt5 from CD36__Homo_sapiens__NP_001001547
augggcugcgacagaaacugugggcugaucgccggagcugugauuggcgccguccucgcgguuuucgggggaauccugaugcccgugggcgaucuucugauucagaagaccaucaaaaagcaagugguccucgaggaagggacaauugcuuuuaaaaauugggugaagacgggaaccgagguuuaccggcaguucuggaucuuugacgugcagaacccucaggaagucaugaugaauagcuccaacauccaagugaaacagcgcggcccguauacauacagaguucgguuccuggccaaggagaaugugacccaggaugccgaagacaacacagucucuuuucuucagcccaauggcgcuauuuucgagccuagccuguccguggggaccgaggccgauaacuuuacagugcucaaucuggcugucgccgcggccucucacaucuaucaaaaccaguucguucagaugauucugaauagccucaucaacaaguccaaaucuagcauguuucaggugcgcacccugagagaacuucuguggggauaccgggaccccuuccucucccuggugccuuaucccgucacgaccacagugggccuguuuuacccuuauaauaacaccgcugaugggguuuacaagguguucaauggaaaagacaacauuagcaaggucgccaucauugauacauacaaaggcaagcgcaaccuuucuuauugggagucccauugcgacaugaucaaugggaccgaugcugccagcuuuccgcccuucguggaaaagucucaaguucuccaguucuuuuccagcgacaucuguagaucuauuuacgcgguguucgaguccgaugucaaccugaaaggaaucccuguguaucgguuuguccugcccagcaaggccuucgcuuccccuguggagaaucccgacaacuacugcuuuuguacggagaaaauuaucucuaagaauugcacaagcuauggcguucucgacauuuccaaauguaaggagggccgcccgguguacaucagccugccucacuuccuuuaugccucucccgaugucuccgaaccuaucgacgggcugaaccccaaugaggaagaacauagaaccuaccucgauauugagcccaucacaggauuuacccugcaguucgcuaaacggcuucaagugaaccugcucguuaagccuagcgaaaagauucaggugcugaaaaaucugaagcgcaacuacaucgucccgauucucuggcugaaugagaccggcacaaucggggacgaaaaagccaacauguuuagaucucaggugacgggaaagaucaaucuucugggccucauugagaugauccugcuuagcguggggguugucauguucguggccuuuaugauuuccuauugcgcuugucggucuaaaaccaucaaguga

SEQ ID NO: 67112 - RNA, 846 nt, Artificial Sequence
  derived and/or modified sequence opt5 from CD37__Homo_sapiens__NP_001765
augagcgcccaggaguccugccugucucucaucaaguacuuccuguuuguguucaaccuguuuuucuuuguccuuggcagccucauuuucuguuuugggaucuggauucugaucgacaaaaccuccuucguuucuuuugugggacuugcuuucgugccccugcaaauuuggagcaagguccucgccaucuccggcaucuuuacaauggggauugcgcugcugggaugcgugggcgcucucaaagaacugagaugucuucuggggcucuauuucggaaugcugcuucugcucuuugccacgcagaucacccugggcauucugaucucuacacagcgggcccagcucgagcgcagccugagagauguuguggaaaagaccauucaaaaauacggcacaaauccugaggaaaccgcugccgaggaguccugggacuauguccaguuccagcuucggugcuguggguggcacuacccgcaggauugguuccaagugcugauccuccgcggaaacggcagcgaagcucauagaguucccugcucuuguuauaaucuguccgccacaaacgacagcaccauucuugauaaggugauccugccucagcucucucggcuggggcaccuggcgcgcuccagacauagcgccgacaucugcgcuguccccgccgagucucacauuuaccgggaaggaugugcucagggccuccagaaguggcugcauaauaaccuuaucuccauuguggggaucugccugggagugggccuccuggagcuuggcuuuaugacgcugagcauuuuccucugucgcaaucuggaucacgucuauaacagacuggcccgguaccgcuga

SEQ ID NO: 67113 - RNA, 903 nt, Artificial Sequence
  derived and/or modified sequence opt5 from CD38__Homo_sapiens__NP_001766
auggccaacugcgaguucagccccguguccggcgacaagccuuguugcagacugucucggcgcgcucagcucugucugggggucagcauccuuguucugauucucguggugguccuggccgugguugugccgagauggcggcaacagugguccggacccggcaccacaaaacgcuuuccugaaacgguccuugcgagaugcgugaaguacaccgagauccaccccgaaaugcggcauguugauugucagucugugugggacgcuuucaaaggggccuuuauuagcaagcacccuugcaauaucacagaggaagauuaucagccccugaugaaacucggaacccaaacagucccuuguaacaagauucugcuguggucccgcaucaaggaccucgcccaucaguucacccaggugcagagagauauguuuacacuggaggacacccuucugggcuaccucgcugaugaccugacguggugcggggaguucaauaccucuaaaaucaacuaucaaagcuguccggauuggcggaaggacugcuccaauaaccccgugagcgucuuuuggaaaacaguuucucgcagauucgccgaagcugccugugauguggugcacgucaugcuuaauggaucccggagcaagauuuuugacaaaaacucuaccuucggcuccguggagguucauaaucugcagccugaaaaggugcagacacucgaggcgugggucauccacggcgggcgcgaggauagcagagaccugugccaggaccccaccauuaaggaacuggagucuaucauuuccaaacggaacauccaauuuagcugcaagaauauuuaccgcccugauaaauuccuccagugugugaagaaccccgaagacuccucuugcacgagcgagaucuga

SEQ ID NO: 67114 - RNA, 516 nt, Artificial Sequence
  derived and/or modified sequence opt5 from CD3D__Homo_sapiens__NP_000723
auggagcacagcaccuuccuguccggccucgugcuggccacacuucugucucaggucagccccuuuaagaucccuauugaggaacucgaagacagaguuuucgugaacugcaauacguccaucaccuggguggaggggacagucggaacccugcuuucugauauuacacggcuggaccucggcaaacgcauccuggauccgagagggauuuaccgguguaacggaaccgacaucuauaaggauaaagaaagcacagugcaaguucauuaccgcaugugccaguccuguguggagcuggaccccgcuaccgucgccggcaucauugugacggauguuaucgcgacccuccugcuugcucuggggguguuuugcuucgccggacacgagacaggcagacucucuggcgccgcugacacccaggcccugcuucggaaugaucaggucuaucaaccucugcgcgacagagaugacgcucaguacagccaucucgggggaaacugggcccggaauaaguga

SEQ ID NO: 67115 - RNA, 1533 nt, Artificial Sequence
  derived and/or modified sequence opt5 from CD3EAP__Homo_sapiens__NP_036231
auggaggaaccccaggccggcgacgcugccagauucagcugcccuccgaacuuuaccgcgaagcccccugcuuccgagucuccccgguucagccuggaagcccucacagggccugauacggagcuguggcuuauccaagcccccgcugacuuugccccugaauguuucaauggacgccacgugccgcuguccggcucucagauugucaaagggaagcucgcuggaaaaagacaucgguaccgcguucugagcuccugcccccaggccggcgaggcgacccuucuggccccuucuacagaggcugggggaggccucaccugugccagcgcuccccagggcacacugagaauccuggaagggccucaacagucccucagcggaucuccccugcagccgauuccugccucucccccuccccagauucccccuggccuucggccgcgcuuuugcgcguucgggggaaaucccccugugaccggccccagaagcgcccuggcuccuaaucuccugacauccgggaagaaaaagaaggagaugcaagugaccgaagcccccgucacgcaggaggcugugaacggacacggcgcccuugagguugauauggcccugggcuccccggaaauggacgugcggaaaaagaaaaagaaaaagaaccagcagcucaaggagccugaagcugcggggcccgucggaaccgagccuacaguggaaacccuggagccccugggcguucucuuuccuagcacaaccaaaaagcgcaaaaagcccaaagggaaggagacguucgaaccggaggauaaaacagugaagcaagaacagaucaacaccgagccucuggaagacacaguccuuucucccaccaagaaaagaaagcggcagaaaggaaccgagggcauggagcccgaagagggggugacaguggaaucccaaccucaggucaagguugagccgcuggaagaggccaucccccucccucccacgaaaaagcgcaagaaagagaagggacagauggcuaugauggaaccuggcaccgaggccauggaacccguggagccugagaugaaaccccuggaaagcccgggcgggacaauggccccucagcaacccgagggagcuaagccucaggcccaggcggcucuugccgcccccaaaaagaagaccaaaaaggaaaaacagcaagaugcuacaguggagccggaaaccgaggucgugggcccugagcugcccgacgaucucgaaccucaggccgcucccacguccacaaagaaaaagaagaaaaagaaagagagagggcauaccguuaccgaacccauccagccucuggagccggaacugcccggagagggccagccugaggcccgggcgacacccgggucuaccaagaaacgcaagaaacaaagccaggaauccagaaugccugagacagugccccaggaagagaugccuggcccgccccucaauagcgaaucuggagaggaggccccuacgggccgggacaagaagagaaaacagcaacagcagcaacccgucuga

SEQ ID NO: 67116 - RNA, 624 nt, Artificial Sequence
  derived and/or modified sequence opt5 from CD3E__Homo_sapiens__NP_000724
augcagagcggcacccacuggagagugcuggggcucugccugcuuuccgucggaguuuggggccaagacgggaacgaggaaaugggaggcaucacacagacgcccuacaaggugucuauuagcgggaccacagugauccugaccuguccucaguauccgggauccgagauucucuggcagcauaaugauaaaaacaucggcggcgacgaagaugacaagaauauugggucugaugaggaccaccugagccuuaaagaguucuccgaacuggagcaaucuggauacuaugucugcuacccccggggcagcaagccugaagaugccaacuuuuaucucuaccugcgcgcuagagugugugagaauugcauggaaauggacguuauguccguggccacaaucgucaucguggauauuuguaucaccgggggacugcuccugcuuguuuauuacuggagcaaaaaccggaaggcgaaggcuaaacccgugacacgcggcgccggggccggaggcagacagcggggccagaauaaggagcgcccucccccugucccgaaccccgacuacgagccuauuagaaaagggcagcgggaucuguauucuggacucaaucaacgcagaaucuga

SEQ ID NO: 67117 - RNA, 549 nt, Artificial Sequence
  derived and/or modified sequence opt5 from CD3G__Homo_sapiens__NP_000064
auggagcagggcaaggggcuggccgugcucauccuggcuauuauccuucugcaaggaacccucgcccagagcauuaaaggcaaccaccuggucaagguuuacgacuaucaggaagauggguccgugcuucugacaugcgacgcggaggcuaaaaauaucacgugguucaaggauggaaaaaugauuggcuuucucaccgaagacaagaagaaauggaaccuggggucuaaugccaaggaucccagaggaauguaccaguguaaaggcagccaaaacaaguccaaaccucuccagguguauuaccggaugugccagaauuguaucgagcugaacgccgcuacaaucucuggcuuccuguuugccgaaauugucagcaucuucgugcuugcuguugggguguauuuuauugccggacaggacggcguccgccaauccagagcgucugauaagcagacccugcucccgaaugaccagcuguaccagccccuuaaggaucgggaggacgaucaauauagccaucugcaggggaaccagcuccgcagaaauuga

SEQ ID NO: 67118 - RNA, 834 nt, Artificial Sequence
  derived and/or modified sequence opt5 from CD40__Homo_sapiens__NP_001241
auggugagacugccccuccagugcguccuguggggcugucuucugaccgccguucacccugagccgcccacagcuugccgggaaaagcaauaccucaucaacagccaguguugcucccugugucagccugggcagaaacuugugucugacugcacggaguucaccgaaacagagugucugcccugcggagaaagcgaguuucucgauaccuggaaucgcgagacacauugucaccaacauaaguauugcgacccuaaccugggccugagagugcagcagaaagggaccuccgaaacagauaccauuuguacgugcgaggaaggauggcacugcaccucugaggccugugagagcugcguccuccaucgguccuguucucccggcuucggggugaagcagaucgcgacaggaguuagcgacaccauuugcgaaccuuguccggugggcuuuuucuccaaugucagcucugcuuuugagaaaugccaccccuggacauccugugaaaccaaggaucuggugguucaacaggccggcacgaacaagacagacguggucugcgggccucaggaucgccuuagagcccugguggugauccccauuaucuucggaauccucuuugcuauucugcuuguccugguuuucaucaaaaagguggccaaaaagccuaccaauaaagcuccccacccgaagcaggagccucaagaaauuaacuuucccgacgaucucccuggcagcaauacagccgcgcccgugcaggagacccugcaugggugucagcccgucacccaagaggacggaaaggaaucucggaucuccgugcaggagcgccaguga

SEQ ID NO: 67119 - RNA, 786 nt, Artificial Sequence
  derived and/or modified sequence opt5 from CD40LG__Homo_sapiens__NP_000065
augaucgagaccuacaaccagacaagccccagauccgccgcuacgggccugccuauuucuaugaagaucuucauguaucuccugaccguguuucuuauuacacaaaugaucgggagcgcccuguucgcggucuaccuccaccggcgccuggacaaaauugaagaugagagaaaucuucaugaagacuuuguuuucaugaagaccauccagcggugcaacacaggagagcgcucccugucucuccugaauugugaagagaucaaaagccaguuugagggcuucgugaaggauauuaugcugaacaaagaagagaccaagaaggaaaauuccuuugagaugcagaaaggggaccaaaacccgcagaucgcugcccacgugauuucugaggccagcuccaagacaaccagcguccuccagugggcugaaaaaggauauuacacgaugucuaauaaccuggugacccuugagaauggcaagcagcugacaguuaaaagacaagggcucuauuacaucuaugcccaggugaccuucugcuccaaccgggaagcuagcucucaggcccccuuuauugcgucccugugucuuaagagcccuggacgcuucgagagaauccugcuccgggccgcuaauacacauucuuccgccaagcccugcggccagcaaagcauucaccugggcggggucuuugaacugcagccuggagcuuccguguucguuaacgugaccgaucccucucaggucagccauggcacgggguuuacauccuucggacuccugaaacuuuga

SEQ ID NO: 67120 - RNA, 2229 nt, Artificial Sequence
  derived and/or modified sequence opt5 from CD44__Homo_sapiens__NP_000601
auggacaaguucugguggcacgccgcuuggggccugugccucgugccccugagccuugcccagaucgaucugaacauuaccuguagauuugcgggggucuuccauguugagaaaaauggacgguacuccaucucucgcacagaagcugccgaccucugcaaggccuuuaacagcacgcugccuaccauggcucaaauggagaaagcccuuuccauuggcuucgaaacauguagauauggguuuaucgagggacacguggugauuccgcggauccaucccaauucuaucugcgcugccaacaauaccggcgucuacauucugacaagcaacaccucccaguaugauacauacuguuucaaugcgucugccccucccgaagaggacugcaccagcgugacggaucucccuaacgcuuuugacgggcccaucaccauuacaaucguuaaucgcgauggaaccagauaugugcagaagggcgaguaccggacaaacccugaagacauuuauccguccaaucccaccgaugacgaugucagcucuggcuccagcucugagcgcuccagcacgucugggggauacaucuucuacacauuuuccaccgugcacccuauucccgacgaagauagcccuuggaucacagacuccaccgacagaauccccgccaccacacugaugucuacgagcgcuaccgccacagagaccgcgacaaaacggcaggagaccugggauugguucuccuggcuguuucucccgagcgaaucuaagaaccaucugcacacgacaacccaaauggccggcaccuccagcaauacaauuucugcugggugggagccuaacgaagagaaugaagacgagcgcgauagacaccuuagcuucuccggaucuggcaucgacgaugacgaggauuuuauuagcuccaccaucagcacaacgccccgggccuucgaccauaccaagcagaaccaggauuggacacaguggaacccuucucacuccaaucccgaaguucugcuccaaaccacaacccgcaugacggacguggauagaaacgggaccacagcuuaugagggaaauuggaaccccgaagcccauccuccgcugauucaccacgagcaucacgaagaggaggaaacaccccauagcaccucuaccauccaggccacgccuuccagcacaaccgaggaaacagcuacccagaaagagcagugguucggcaaucgguggcacgaaggcuaccgccaaacccccaaggaggacucccauucuacaacggggaccgcggccgcuagcgcccacacaucccacccuaugcagggaagaaccacacccucuccggaggacagcuccuggaccgacuuuuucaacccuaucagccaucccaugggccgggggcaccaggccggaagacgcauggauauggauucuucccauagcauuacgcuucaaccuacagcuaaucccaacaccggccuggucgaagaccucgaucggaccgggccucugucuaugacaacccagcaguccaauagccagucuuuuagcacaucccacgagggacuggaagaggacaaagaucaccccacgaccagcacacucaccucuuccaacagaaaugacgugacaggcggccgccgggauccgaaccauagcgagggguccaccacgcugcuugaaggauauaccucucacuacccucauacaaaggagagcagaaccuucauccccgugacauccgccaaaaccggcucuuuuggggucacagcgguuaccgugggagacagcaauuccaacgugaaucgcucucugagcggcgaucaagacacguuccaccccuccgggggcagccauacaacccacggaucugaauccgauggccacagccaugggucucaggagggaggcgcuaacaccacauccgggccuauucggaccccgcagauccccgaauggcucauuauccuggccagccuucuggcccucgcucugauccuggccgucuguauugcugugaacucuagacgccggugcggacagaagaagaaacucguuaucaauuccggcaacggggccguggaggacagaaagccuagcggccugaauggagaggcguccaaaagccaagaaaugguccaccuugugaacaaggagucuagcgaaacgcccgaccaguuuaugacagccgaugagacccgcaaucugcagaacguugacaugaaaauuggcguguga

SEQ ID NO: 67121 - RNA, 1179 nt, Artificial Sequence
  derived and/or modified sequence opt5 from CD46__Homo_sapiens__NP_002380
auggagcccccuggcagacgggaaugcccguuccccagcuggcgcuuuccugggcugcuccuggccgcuauggugcuucugcucuacuccuucucugacgccugugaggaacccccuaccuuugaggcgauggaacugaucggaaagcccaaaccuuauuacgagauuggcgagagagucgauuauaagugcaaaaagggguacuucuauaucccgccccuugcuacacacacgauuugugaccggaaccauaccuggcugccuguuagcgaugacgccugcuaccgcgaaacaugucccuauaucagagauccucucaauggacaggccgugcccgcuaacggcaccuacgaguuuggguaccaaaugcacuucauuugcaaugaaggauauuaccugaucggcgaggagauccuguauugugaacucaaaggcuccguggccauuuggucugggaagccgccuaucugcgagaagguccuguguacacccccucccaaaauuaagaacggaaaacauaccuuuagcgaaguggagguuuucgaauaccuugacgcugugacauauuccugcgaucccgccccuggcccggaccccuuuucucugaucggggagagcaccauuuacuguggagauaauuccgucuggagccgggcggccccugagugcaaggugguuaaaugccgcuuccccguggucgaaaacggcaagcagaucucuggguuuggaaagaaauucuauuacaaggcuacggugauguuugagugugacaaaggcuucuaccucgauggcuccgacaccauugugugcgauagcaauucuacaugggacccucccgucccgaagugucugaaaguucuuccucccuccagcaccaagccucccgcccugucucacuccgugagcacauccucuaccacgaaaagcccugcuuccagcgccucugggcccagaccgacauauaagccucccguguccaacuaccccggauauccuaagccggaagagggcauccucgacagccuggaugucugggugaucgcgguuauugugaucgccauugucguggggguugcugugaucugcgucgugcccuaccgguaucugcagcgccggaaaaagaaaggaaccuaccucacagacgaaacccauagagaggucaaguucaccucucuguga

SEQ ID NO: 67122 - RNA, 972 nt, Artificial Sequence
  derived and/or modified sequence opt5 from CD47__Homo_sapiens__NP_001768
auguggccccugguggccgcucuccugcuuggcagcgccugcuguggguccgcgcagcuccuguucaacaagaccaaaucugucgaguuuacauucugcaaugacacgguugugaucccuuguuuugugaccaacauggaagcucaaaauacaaccgaggucuacgugaaguggaaauucaagggaagagauauuuauacauuugacggcgcccugaacaaaagcaccguuccgacagauuucuccucugccaagaucgaagugagccagcuucugaagggggacgcuucccucaaaauggauaagucugacgccgucagccacaccggaaauuacacgugcgaggugaccgaacugacacgggagggcgagaccauuaucgaacugaaauaucgcguuguguccugguuuagccccaacgagaauauucucaucgucaucuucccuauuuuugcuauccugcuuuucugggggcaguuuggaauuaagacacugaaauacagaucuggcggcauggaugaaaagaccaucgcccuccugguggcggggcuugugauuacggucaucguuauugugggagccauccuguucgugcccggcgaguauucccucaagaacgcuacagggcugggacugaucgucaccagcacaggcauucucauccugcuucauuacuauguguuuucuaccgccauugggcugaccuccuucguuaucgcuauucucgugauccaggucaucgccuacauucuggcggugguuggacuuagccuguguaucgccgcuugcauuccuaugcacggcccccuccugaucucuggccuguccauucucgcccuggcucaacuucuggggcucguguacaugaaauucgucgccagcaaucagaagacaauccagccuccgcggaaagccguggaggaaccccugaacgcuuuuaaggaguccaaaggaaugaugaaugacgaauga

SEQ ID NO: 67123 - RNA, 732 nt, Artificial Sequence
  derived and/or modified sequence opt5 from CD48__Homo_sapiens__NP_001769
augugcagcagaggcugggacuccugucuggcccucgagcugcuucugcucccccugucucuucuggugaccagcauccaggggcaccucguccauaugacaguuguguccggaucuaacgugacgcugaauauuagcgaaucccugccugagaacuacaagcaacucaccugguucuauacauuugaucagaaaaucgucgaaugggacucucggaaguccaaauacuucgaguccaaguuuaaaggccgcgugagacuggauccgcagagcggggcucuuuauauuucuaagguucagaaggaagacaauuccaccuacaucaugcgggugcugaaaaagacaggaaacgagcaagaguggaaaauuaagcuccagguccuggaucccgugccuaaacccguuaucaagaucgaaaagauugaggacauggaugacaauugcuaucuuaaacugagcugugugaucccuggcgaaucugucaacuacaccugguauggggauaagcgccccuucccuaaagagcuccagaauagcgugcuggagacaacccugaugccgcacaacuacagcagaugcuacacgugucaggugucuaauuccgucagcuccaagaacggaaccguuugccucucucccccuuguacacuggcccggagcuuuggcguggaauggauugcguccuggcuuguggucaccgugcccacaauccugggccuccugcuuaccuga

SEQ ID NO: 67124 - RNA, 1377 nt, Artificial Sequence
  derived and/or modified sequence opt5 from CD4__Homo_sapiens__NP_000607
augaacagaggcgugcccuuccggcaucugcuccugguccuucagcuggcccuccugccugcugccacccaagggaagaaaguugugcuuggaaagaaaggcgacacaguggagcugacgugcaccgcgagccagaagaaauccauccaguuucacuggaaaaauucuaaccagauuaagauccucgggaaucaaggcagcuuccugacaaaaggaccguccaagcugaacgaucgcgcugacucuagacggagccucugggaucaggggaauuuuccccugauuaucaaaaaccuuaagauugaagacuccgauaccuacaucugugaggucgaagaccagaaagaggaagugcagcugcucguuuucggacugacagccaauucugauacccaccuucugcaaggccagagccucacacugacccuggaguccccucccggcagcucuccuuccgugcagugccgcagccccagagggaagaacauccagggaggcaagacgcucucugucucccaacuggagcuucaggacagcgggaccuggacauguaccgugcugcagaaucaaaagaagguugaauuuaaaauugauaucgugguccucgccuuccagaaggcuucuuccauuguguauaaaaaggagggagaacagguggaguuuagcuucccucuggccuuuacagucgagaaacuuaccggcuccggggaacugugguggcaggcugagcgggccucuagcuccaagagcuggaucacguucgaccucaagaacaaagaaguuucugugaagcgcgugacacaagauccgaaacugcagaugggaaagaaacugccccuccaucugacccuuccucaggcgcugccccaguacgccggcuccggcaaucucacacuggcucuugaggccaagaccgggaagcugcaccaagaagucaaccucgugguuaugagagcuacccagcugcagaaaaaucugacaugcgagguguggggaccuacgagccccaagcucaugcugucucuuaaacuggagaacaaggaagccaaagucagcaagcgggagaaggcgguguggguucucaauccggaagccggcauguggcagugucugcuguccgacucugggcaagugcuucucgagagcaacauuaaaguccugccuaccugguccacacccgugcagccuauggcucugaucguccucggaggcguggccgggcugcuucuguuuauuggacucggcaucuucuuuugcguucgcuguagacaucggcgcagacaggcugaacggaugagccagaucaagcgccugcugucugagaaaaagaccugccaauguccccacagauuccagaaaacaugcucccccauuuga

SEQ ID NO: 67125 - RNA, 1146 nt, Artificial Sequence
  derived and/or modified sequence opt5 from CD55__Homo_sapiens__NP_000565
augaccguggccagacccagcgucccugcugcccugccgcuccugggcgagcuuccccggcugcuccugcuuguucugcucugccugccugcgguguggggagacugugggcugcccccugaugugcccaacgcucagccugcccucgaaggccgcacauccuucccggaggacacggucaucaccuacaagugcgaagagucuuuugugaaaauucccggggaaaaggauagcguuaucugucugaaaggaucccaauggucugacauugaggaguucugcaauagaagcugugaagugccuacacggcuuaacuccgccucucugaagcagcccuauaucacccagaauuacuuuccugucggcacagugguugaguaugaaugccgccccggguacagacgggagccgagccucuccccuaaacugaccugucuucagaaccugaaguggagcacagcuguggaguucugcaagaaaaagucuugucccaauccuggagaaauucgcaacggccaaaucgauguccccggcgggauccucuuuggagccaccauuuccuucagcugcaauacgggcuauaaacuguuugggucuaccuccagcuucugucugaucucuggauccagcgugcagugguccgacccccucccugagugcagagaaauuuacugcccggcucccccucagaucgauaacggcauuauccagggggagcgggaccacuauggauaccgccaaucugugacauacgccuguaauaagggcuuuaccaugauuggcgaacauagcaucuauugcacagucaacaaugaugagggggagugguccggacccccucccgaauguagaggcaaaagccugaccucuaagguuccgccuacggugcagaagcccacaaccgugaacgucccuacaaccgaggugucccccaccagccagaaaacaacgaccaagacaaccacaccuaaugcgcaggccacccggucuacgcccguuagccgcacaaccaaacacuuccaugaaaccacaccgaacaagggguccggaaccacaucuggcacgaccagacuucugagcgggcacacaugcuuuacccucacaggacugcuuggcacccuggugacgaugggccuccugaccuga

SEQ ID NO: 67126 - RNA, 387 nt, Artificial Sequence
  derived and/or modified sequence opt5 from CD59__Homo_sapiens__NP_001120695
augggcauccaagggggaagcgugcuguucggccuccugcuuguccuggccguguuuugccacuccgggcauucucuccaguguuacaacugccccaauccuaccgcugacuguaagacagccguuaacugcagcuccgauuucgacgcgugucugauuacgaaagcuggacuucagguguauaauaagugcuggaaauuugagcacuguaacuucaaugaugucaccacaagacugcgggaaaacgagcucaccuacuauugcuguaagaaagaccugugcaauuuuaacgaacagcuggagaauggcgggacaucucucagcgaaaagaccgugcugcuucugguuacaccguuccucgccgccgcuuggucccugcaucccuga

SEQ ID NO: 67127 - RNA, 1488 nt, Artificial Sequence
  derived and/or modified sequence opt5 from CD5__Homo_sapiens__NP_055022
augcccaugggcagccugcagccucucgccacccuguaccuucuggggaugcucguggcuuccugccugggaagacuuucuugguaugacccggauuuccaagcccggcugacacgcagcaacuccaagugucagggccagcucgaggucuaccugaaagacggguggcacaugguuugcucucagagcuggggaagauccucuaagcaaugggaagaucccagccaggcguccaaagugugucagcggcugaauugcggcgugccucucagccuggggcccuuucuugucacguauaccccucagucuuccaucauuuguuacggacaacugggcagcuucucuaacugcucccauagccgcaaugacaugugucacucucucggccugacaugccuugagccccagaagaccacaccuccgaccacaagacccccucccaccacgaccccugaacccacagcuccgccucggcugcagcucguggcccaguccgggggacaacauugugccggcguuguggaguuuuauagcgggucccugggaggcaccaucucuuacgaagcucaggauaaaacacaggaccuggagaacuuccucugcaauaaccugcaaugugggagcuuucuuaagcaccuucccgagaccgaagccggacgcgcucaggauccuggcgagcccagagaacaucagccccucccuauucaguggaagauccaaaauuccagcugcacgucucuggagcacugcuuccggaaaauuaagccgcagaaauccggccgcguccuugcccugcucuguagcggguuucagcccaaggugcagucuagacugguuggaggcagcuccaucugcgaggggacaguggaaguccggcaaggagcgcagugggccgcucugugugacucuagcuccgcccgcagcucucucagaugggaggaagugugccgggagcagcaguguggcuccgugaacagcuaucgcguccuggaugcuggggacccuaccucuagaggacuuuucugcccccaccaaaaacugucccagugucaugaacucugggagcggaauagcuacugcaagaagguuuuugugacaugucaggauccuaaccccgccggccuggcggccggcaccguggcuuccaucauucuugcccugguccuccuggugguucugcucguggucugcgggccgcuggcuuacaaaaagcuggugaaaaaguucagacagaaaaagcaacgccaguggaucggaccuaccggcaugaaucagaacaugucuuuucaccggaaucauacagccacgguuagaagccacgccgagaaccccaccgcuucccacguggacaaugaauauucucaaccuccccgcaacagccaucuguccgcguacccugcccucgagggggcucugcaccggagcucuaugcagcccgauaacuccagcgacucugacuaugaucugcauggagcccagagacuuuga

SEQ ID NO: 67128 - RNA, 1044 nt, Artificial Sequence
  derived and/or modified sequence opt5 from CD5L__Homo_sapiens__NP_005885
auggcccuccuguucagccugauccuugcuauuugcaccagacccggcuuucuggccuccccuucuggggugcggcucgucggaggccugcaccgcugugaggggagaguugaaguggagcagaagggacaauggggcacagugugcgacgaugggugggacaucaaagaugucgcggugcuuugucgggaacugggaugcggcgcugccagcggcacgccguccgggauucucuacgagcccccugccgaaaaggagcagaaaguucugauccagucugugagcuguaccggaacagaggacacccuggcucagugcgaacaagaggaagucuaugauuguucccaugacgaggaugccggcgcuucuugcgagaaccccgaaagcuccuucagcccugugcccgaggggguucgccucgccgacggaccuggccacuguaaggggagaguggaagucaaacaucagaaucagugguacacagugugccagaccggauggucucugcgggcggccaagguggucugucgccaacuuggcugcggcagagcuguucugacacagaagcggugcaacaaacacgccuaugggcgcaagccgauuuggcucucccagaugagcuguucuggaagagaggcuacccugcaggauugccccuccggcccuugggggaaaaauacguguaaccaugacgaagauaccuggguggagugcgaggaccccuuugaucuucggcuggugggaggcgacaaucucuguagcgggcgccuggaaguccugcacaagggaguguggggcucuguuugcgacgauaacuggggcgagaaagaagaccaaguggucuguaagcagcucgggugcggaaagucccugagcccuuccuucagagaucggaaauguuacggccccggggugggacgcaucuggcuugacaauguuagaugcucuggcgaggaacagagccuggagcaaugucagcaccgguuuuggggguuccaugauugcacacaccaggaggacguggccgucaucugcuccggcuga

SEQ ID NO: 67129 - RNA, 648 nt, Artificial Sequence
  derived and/or modified sequence opt5 from CD63__Homo_sapiens__NP_001244321
auggccguggagggcgggaugaagugcgucaaauuccugcucuacguucugcuucuggcuuuuuguggagccacccccggcagccuccugccuguggugaucauugcggucgggguguuccuuuuucugguugcuuucgugggaugcuguggcgccugcaaggaaaacuauugucucaugaucacauuugccauuuuccugucccugaucaugcucgucgagguggcugccgcuauugccggguacguuuuuagagacaaagugaugucugaguucaauaacaauuuucggcagcaaauggaaaacuauccgaagaauaaccacacggcgagcauccuggaucgcaugcaggccgacuucaaaugcuguggagcugccaauuacaccgauugggaaaagauccccuccaugucuaagaacagagucccugacagcugcuguauuaaugugacagugggcugcggcaucaacuuuaaugagaaagcuauucauaaggaggggugugucgagaaaaucggaggcuggcuucggaagaacguucuggugguggccgcggccgcucucgggauugccuucgucgaagugcugggaaucguuuuugcuugcugccuugugaaauccauucgcucuggcuaugaagucauguga

SEQ ID NO: 67130 - RNA, 984 nt, Artificial Sequence
  derived and/or modified sequence opt5 from CD68__Homo_sapiens__NP_001035148
augagacuggccgugcuguucagcggcgcucugcuugggcugcucgccgaguccaccggaacaacgucucaccggaccacaaagagccauaaaaccacaacccaccgcacaaccacgaccggcacaaccucccaugggcccacaaccgcgacgcacaacccuacaaccacaucucauggaaaugucaccguucacccgaccagcaacuccacagcuacgucucagggccccagcaccgccacacacuccccugccaccacaagccaugggaaugcuaccgugcaccccacgucuaacuccacagccaccagcccuggauuuaccucuuccgcucaucccgaaccuccgcccccuagccccucuccuucccccacaagcaaggagaccaucggcgacuacacauggacgaauggcucccaaccgugcgugcaccuccaggcccagauucagaucagagucauguauaccacacaagggggaggcgaagcgugggggauuucugugcuuaacccuaauaaaaccaagguucagggaagcugugagggcgcccacccccaucugcuccuguccuucccuuacgggcaccugagcuuuggauucaugcaggaucuccagcaaaaaguggucuaucugucuuacauggcuguggaauauaacguuuccuuuccccaugccgcucaguggacauucagcgcccagaaugcgucucuucgggaccugcaggcuccccucggccagagcuuuuccugcucuaacagcuccaucauucugagcccugccgugcaccuugaucugcucucucugcgccugcaagccgcucagcucccgcauaccggcgucuucgggcaauccuuuagcugucccucugacagauccauccugcuuccucugaucauuggacucauccugcuuggccugcucgcccuggugcugauugccuucugcaucauucggcgcagacccagcgcuuaccaggcgcucuga

SEQ ID NO: 67131 - RNA, 600 nt, Artificial Sequence
  derived and/or modified sequence opt5 from CD69__Homo_sapiens__NP_001772
augagcuccgagaacugcuucguggccgaaaauucuagccugcaccccgaguccggccaggaaaacgacgcuaccucuccucauuuuagcacaagacacgagggguccuuccaagucccgguucucugugccgugaugaauguggucuuuaucacgauucugaucauugcgcuuaucgcucugucugugggacaguacaacugccccggccaguauaccuucagcaugccuuccgauagccauguuucuuccuguagcgaagacugggugggguaccagcggaagugcuauuuuauuucuacagucaaacgcuccuggaccagcgcccaaaaugccuguucugagcacggagcuacacucgccgugaucgauuccgagaaggacaugaacuuccugaaaagauacgcuggccgggaggaacauuggguugggcuuaagaaagaacccggacacccuuggaaguggagcaauggcaaggaguuuaacaauugguucaacgugaccggcuccgauaaaugcgucuuucugaagaauacagaggugucuagcauggaaugugagaaaaaccucuauuggaucugcaauaagcccuacaaauga

SEQ ID NO: 67132 - RNA, 1806 nt, Artificial Sequence
  derived and/or modified sequence opt5 from CD6__Homo_sapiens__NP_001241679
auguggcuguucuuuggcaucaccgggcuccugacagccgcucuuagcggacaccccuccccugccccgcccgaccagcugaacacgucuagcgcggaguccgaacucugggagccuggcgaaagacugcccgugcggcuuaccaaugggucuagcuccugcucuggaacagucgagguucgccuggaagcuagcugggagccugccuguggcgcccucugggauuccagagcugccgaggcugugugccgggcccugggguguggaggcgcggaagccgcuagccaacuggcucccccuaccccggagcugcccccucccccugccgccggcaacacaucuguggcggccaaugcuacccucgccggggcucccgcccuucugugcuccggagccgaauggcgccucugugaggucguggagcaugcuugcagaagcgacggccggcgcgcgagaguuacaugugccgaaaaccgggcucugcgccuuguggaugggggaggcgccugcgccgggagagucgagaugcuggaacacggagaguggggcucugugugugacgauaccugggaccucgaagaugcucauguugugugccggcagcugggcugugggugggccguccaggcgcugccgggacuccacuucacgccuggccgcgggcccauucauagagaccaggugaauugcuccggagcugaggccuaccugugggauugcccuggccuucccgggcaacacuauuguggacacaaggaggacgccggcgcugugugcagcgaacaucagucuuggcggcugaccggcggggccgaucgcugugagggacaggucgaaguucacuuuagaggcguguggaacacagugugcgacuccgagugguaccccagcgaagcuaaaguccucugucagucccuggggugcggaaccgccguggagcggccuaagggccuuccgcauucucugagcgggagaauguauuacuccuguaauggcgaggaacucacacugagcaacugcucuuggcgcuucaauaacuccaaucuguguagccaaucucucgcggcccggguucugugcagcgcuuccagaucucuucacaaccugagcacccccgaggugccugccuccguccagacggugacaaucgaaagcucuguuaccgugaaaauugagaauaaggaaucccgcgagcucaugcugcuuauccccagcauuguccugggaauccuccugcugggcucucucaucuuuauugcuuucauccugcuucggauuaaagggaaguauguguuuaugcugccuauccagguccaggcgcccccgccugaggauuccgacagcggauccgacucugauuacgaacacuaugacuucagcgcccaacccccuguggcccucacaaccuuuuacaacucccagagacaucgcguuaccgaugaggaagugcagcaaucucgguuccagaugcccccucuggaggagggccuggaggaacuucacgcuagccauauucccacagccaauccggggcacuguaucacggacccucccucccucggaccccaguaccauccuagaagcaacucugaauccagcaccucuuccggcgaggauuauugcaacagcccgaagucuaaacugcccccuuggaauccccaggucuuuagcuccgaacgcagcucuuuccuggagcaaccucccaaccucgagcuggcugggacacagccugccuuuuccggcagccccuccccgcagccugacucuaccgauaaugacgauuacgacgauauuagcgccgcuuga

SEQ ID NO: 67133 - RNA, 1080 nt, Artificial Sequence
  derived and/or modified sequence opt5 from CD72__Homo_sapiens__NP_001773
auggccgaggcuaucaccuacgccgaccugagauucgugaaggcgccccucaaaaagagcauuuccucucggcugggccaggauccuggggcugacgaugacggagaaaucacauaugagaacguccaaguuccggccgugcuuggcgugcccagcucccuggccucuagcguccucggggauaaagcugccgugaaguccgaacagccuacggcuucuuggcgcgccguuaccagccccgcggugggacggauucugccuugcagaacaaccugucuucgcuaccugcuccugggccugcuccugacaugccuucugcucggggucaccgccaucugucugggagugagauaucuucagguuucccagcaacugcagcagacaaaucgggugcucgaggucaccaacagcucucugcgccagcaacugagacucaaaauuacgcagcugggccaguccgcugaagaccuucagggcagccggcgcgagcuggcccaaucucaggaggcucuccagguggaacaaagagcccaccaggcggccgaggggcagcugcaggcuugccaagccgaucggcagaagaccaaggaaacacuucaguccgaggagcagcaacgcagagcucuggaacagaaacucagcaauauggagaaccggcugaagcccuuuuucaccuguggaucugccgacacaugcuguccuuccggcuggaucaugcaucagaaaagcugcuuuuacaucucccugaccucuaagaauuggcaggaaagccaaaaacagugugagacgcucuccagcaagcuggccacauucucugaaauuuauccgcagucccacagcuacuauuuucuuaacucucugcuccccaaugggggaagcggcaacuccuacuggaccgggcugucuagcaauaaggauuggaaacuuacagacgauacccagcgcaccagaacauacgcucaauccagcaagugcaacaaagugcauaagacguggucuugguggacccuggaguccgagagcugucggucuucccucccuuauaucugcgaaaugacagcguucagauuucccgacuga

SEQ ID NO: 67134 - RNA, 483 nt, Artificial Sequence
  derived and/or modified sequence opt5 from CD74__Homo_sapiens__NP_001020329
augcacagacggcgcagcagauccugccgggaggaccagaagcccgugauggaugaccaacgcgaucugaucucuaacaaugaacagcucccuaugcugggcagacggccgggggcccccgagagcaaauguucccgcggagcucuuuacaccggcuucucuauucuggucacacuccugcuugccgggcaggcgacgaccgcuuauuuucuguaccagcaacagggaagacucgacaagcugacaguuaccagccagaaccugcagcucgaaaaucugcggaugaaacuuccuaagcccccuaaacccguguccaagaugcgcauggccacaccucugcucaugcaagcccugccgaugggcgcucugccccaggggccuaugcagaacgccaccaaguauggaaauaugacagaggaucaugugaugcaccuucuccagucucauuggaacuggagaacccggcugcugggcugggucuga

SEQ ID NO: 67135 - RNA, 681 nt, Artificial Sequence
  derived and/or modified sequence opt5 from CD79A__Homo_sapiens__NP_001774
augcccggcgggccuggagugcugcaggcccucccggcuaccaucuuccugcuuuuucugcucagcgccgucuaccugggccccgggugccaagcgcuuuggaugcacaagguuccugcuucccugauggugucucucggagaggacgcccauuuccaguguccccacaacagcuccaauaacgccaaugugacaugguggagaguccugcauggcaacuauacguggccucccgaauuucuggggccuggagaggauccgaauggcacccucauuauccagaacgugaauaaaucucacggcgggauuuacguuugccgggugcaggaaggaaacgagagcuaucaacaguccuguggcacauaccugcgcgucagacagcccccuccccggccuuuccuugacaugggggaaggaaccaagaaucgcaucauuacagcugagggcaucauccugcucuuuugcgccgugguucccgggacccugcuucuguucagaaaacgguggcagaacgagaagcucggacuggaugcuggcgacgaauaugaggaugaaaaucuguacgagggccucaaccuggacgauuguucuauguaugaggacauuagccgcgggcuucaaggaacauaccaggaugugggcucccugaauaucggggacguccagcucgaaaaaccguga

SEQ ID NO: 67136 - RNA, 690 nt, Artificial Sequence
  derived and/or modified sequence opt5 from CD79B__Homo_sapiens__NP_000617
auggccagacuggcucucagccccgugccuucccacuggauggucgcccugcuucugcuccugucugcggagccgguucccgcugcccggagcgaagaccgcuacagaaacccuaagggcuccgccugcucucggaucuggcagagcccccgcuucauugcuagaaaacggggguuuaccgugaagaugcauuguuauaugaacuccgccucuggaaaugugagcuggcuuuggaaacaagagauggaugaaaauccucagcagcugaagcucgagaaaggccgcauggaagagucccagaacgagagccuggcuacacugacgauccaagggauuagauucgaagacaauggaaucuacuuuugccagcagaaguguaacaauaccucugaggucuaucagggcugcgggacagaacuccgggugaugggauucuccacccuggcccaacuuaagcagcgcaacacacugaaagauggcauuaucaugauccagacccuccugauuauccuuuuuauuaucguucccauuuuccugcuccuggacaaggaugacagcaaagcgggcauggaggaggaucacacauacgaagggcuggacaucgaucagaccgccacguaugaggacauugugacccucagaacaggagaagucaaguggucugugggcgagcauccugggcaagaauga

SEQ ID NO: 67137 - RNA, 723 nt, Artificial Sequence
  derived and/or modified sequence opt5 from CD7__Homo_sapiens__NP_006128
auggccgggcccccuagacugcuccugcuuccgcugcuccuggcucuugcccggggccugcccggagcgcucgcugcccaggaggugcaacagagcccucacugcaccacaguccccguuggcgccuccgugaacaucacguguucuaccagcgggggacugcgcggcauuuaccugagacagcucgggccucagccccaagacaucauuuauuacgaagauggaguggucccuacaaccgaccggcgcuucagaggccggaucgauuuuuccggcucucaggacaaucugacaauuaccaugcaucgccuucagcugagcgauacagggaccuauacgugccaggcuaucaccgaggugaacguuuacggauccggcacacucgugcuggucaccgaggaacaaucucagggguggcacagauguagcgacgccccgccccgggcuuccgcccuuccugcgcccccuacaggaagcgcccugcccgauccgcagaccgcuucugcccucccugaucccccugcugccuccgcgcugcccgccgcucuggccgugaucagcuuccuccugggccuugggcugggaguugcuugcgugcucgcccgcacgcagauuaagaagcuguguucuuggagagacaaaaauuccgccgcuugcgucguguaugaagacaugagccauucucgguguaacacacuuuccagccccaaucaauaccaguga

SEQ ID NO: 67138 - RNA, 867 nt, Artificial Sequence
  derived and/or modified sequence opt5 from CD80__Homo_sapiens__NP_005182
augggccacaccagacggcaggggacaagccccuccaagugcccuuaccugaacuucuuucaacuccuggugcuugccggacugucucauuucuguagcggcgucauccacguuacgaaagaggugaaggaaguggcuacccucuccugcgggcauaaugucucuguggaggaacuggcccagacacgcauuuauuggcagaaagagaagaaaaugguucuuaccaugaugagcggagacaugaacaucuggccggaauacaagaauagaacaauuuuugauaucaccaacaaucuguccauugugauccucgcgcugcggcccucugacgagggcacauaugagugugucgugcugaaguacgaaaaagaugcuuucaagcgcgagcaccucgccgaaguuacccugagcgugaaagccgacuuuccuacgcccuccaucagcgauuucgagauuccuaccucuaacaucagacggauuaucugcuccacaagcgggggauuucccgagccucaucuuucuuggcuggaaaauggcgaggaacucaacgcuauuaauaccacagucucccaggacccggagaccgaacuguaugccgugagcucuaaacuugauuucaacaugacgacaaaucacuccuuuaugugucugaucaaguacggccaccuccgcgugaaccaaaccuucaauuggaacacaaccaagcaggagcauuuucccgacaaucugcugccuagcugggcuauuacccucaucuccgucaacgggaucuucguuauuugcugucugacauauugcuuugcccccagaugucgggagcgcagacggaacgaacgccuuagacgggagucugugcgcccuguguga

SEQ ID NO: 67139 - RNA, 711 nt, Artificial Sequence
  derived and/or modified sequence opt5 from CD81__Homo_sapiens__NP_004347
augggcguggaggggugcaccaaguguaucaaauaccugcucuuugucuuuaacuucguuuucuggcuggccggaggcgugauucuugggguggcucuguggcucagacacgacccccagacaacgaaucugcuuuaucuggaacucggagauaagccugccccgaacaccuucuacgucggcaucuauauucugaucgcggugggggcuguuaugauguuugugggauuccugggcugcuacggcgccauucaagagagccagugucuccuggggacauuuuucacaugccuugucauccuguuugccugugaaguggcugccggaaucuggggcuucguuaauaaagaccagauugcuaaggaugugaaacaguuuuaugaccaagcccuccagcaggcggucguggaugacgaugccaacaaugcuaaggccguggucaagaccuuccaugagacccuggacugcuguggguccucuacacuuaccgcucugacgaccagcguucucaaaaacaaucugugccccuccggaucuaacaucauuagcaaucuguuuaaggaagauugucaccagaaaaucgacgaucucuucuccggcaagcuguaccuuauugggaucgccgcgauugugguggccgucaucaugaucuucgagaugauucugucuauggugcucugcuguggaauccggaacagcuccguuuauuga

SEQ ID NO: 67140 - RNA, 729 nt, Artificial Sequence
  derived and/or modified sequence opt5 from CD82__Homo_sapiens__NP_001020015
augggcagcgccugcaucaaggugaccaaauacuuccuguuucucuucaaccugaucuuuuucauucuuggggcugucauucugggauuuggcguuuggauccucgccgacaaguccucuuucauuagcgugcugcagacauccucuagcucccuuagaaugggggcguauguguuuaucggagucggcgcugugacgaugcugaugggguuccucggauguaucggcgccguuaaugaggugcggugccugcugggccuccugaaacaagaaaugggagggauugucaccgagcuuauccgcgauuacaacucuagcagagaagacucccugcaggaugccugggacuaugugcaggcucagguuaaguguugcggcugggugagcuuuuacaauuggacagauaacgccgagcucaugaaucggcccgaagucaccuauccuuguucuugcgaggugaaaggggaggaagacaacucccugagcgugcgcaagggauucugugaggcuccgggcaauagaacacaaucugggaaccaccccgaagauuggccugucuaccaggagggaugcauggagaagguucaggccuggcuucaggaaaaucugggcauuauccucggcgugggggugggagucgcgauuaucgagcugcugggcauggugcucuccauuugucugugccggcauguucacagcgaagacuauucuaaagugcccaaguacuga

SEQ ID NO: 67141 - RNA, 618 nt, Artificial Sequence
  derived and/or modified sequence opt5 from CD83__Homo_sapiens__NP_004224
augagcagaggccugcagcuccugcuucuguccugcgccuacucucucgcucccgccaccccugaggugaaggucgcguguagcgaagacguugaucugccgugcacagcucccugggacccucaagugcccuauacgguguccugggucaaacuucuggaagggggagaggagcggauggaaaccccucaggaggaucaccuccgcggccagcauuaccaccagaaggggcaaaacggaucuuucgacgcccccaaugagagaccuuauagccugaaaauccggaacacaaccuccuguaauucuggcacauaccgcugcacccugcaggauccggacgggcagagaaaccucagcggaaaggugauucugcggguuacaggcugucccgcccagcgcaaagaagagaccuuuaagaaguauagagcugaaaucgugcuucugcucgcccuggucauuuucuaccuuacgcugaucauuuuuaccugcaaauucgcucggcuccaauccaucuuuccugauuucagcaaggccggcauggagcgcgcguuucugcccgugacaucuccuaauaaacaucuggggcucguuacaccccacaagaccgagcugguguga

SEQ ID NO: 67142 - RNA, 1038 nt, Artificial Sequence
  derived and/or modified sequence opt5 from CD84__Homo_sapiens__NP_001171808
auggcccagcaccaucuguggauccuccugcuuugccugcaaaccuggcccgaggcugccggcaaggacagcgaaauuuucacagugaacgggauccucggagaguccgucacguuuccuguuaauauucaggaaccgagacaggugaaaaucauugcguggaccucuaagacaagcguggcuuacgucacccccggcgauuccgagacagccccugugguuaccgugacacaccggaacuauuacgaacgcauccaugcccuggggcccaauuauaaccuugucaucucugaccugagaauggaggaugcuggagacuacaaagccgauauuaauacccaggcugacccuuauacgaccacaaagcgguacaaccuccaaaucuaucgcagacugggcaaacccaagauuacccagagccugauggccuccguuaauucuacauguaacgugacccucacgugcagcguggagaaggaagagaaaaaugucacauacaacugguccccucugggggaagagggaaaugugcuucagaucuuccagaccccggaggaucaagaacugacauacaccuguaccgcgcagaaccccgugagcaauaacucugacuccauuagcgcccggcagcucugcgcugauaucgccaugggcuuucgcacacaccauacgggccugcuuucuguccuggcuauguucuuucuccugguucugauucucuccagcguguuccuguuuagacuuuucaagcggcgccaggggagaaucuuuccugagggaucuugucugaauaccuucaccaaaaaccccuaugccgcguccaagaaaacaaucuacacauauauuauggccagccggaacacccaaccugcugaaucccgcaucuacgacgagauucuccagucuaaggugcugcccagcaaggaggaaccggucaauacgguguauuccgagguucaguuugccgauaaaaugggcaaggcuagcacacaagacucuaaaccucccgggaccuccagcuacgaaaucgugauuuga

SEQ ID NO: 67143 - RNA, 654 nt, Artificial Sequence
  derived and/or modified sequence opt5 from CD86__Homo_sapiens__NP_001193853
auggacccccagugcaccaugggccugagcaacauccucuucgugauggccuuucugcuuuccgcuaauuucucucaaccugagauugucccgaucagcaacauuacagaaaauguuuacaucaaccugacguguuccucuauucacggguaucccgagccuaagaaaaugagcgugcuccugagaaccaaaaauuccacaaucgaauacgauggaaucaugcagaagucucaggacaacgugaccgagcuuuaugaugucagcauuucccugagcgugucuuuucccgacguuacauccaauaugaccaucuucugcauucucgaaacagauaagacccggcugcugagcucuccuuuuuccaucgagcucgaggacccccagccuccgcccgaucauauuccuuggaucacggccgugcugcccaccgucauuaucugugugaugguuuucugccuuauccuguggaaauggaagaagaaaaagcgcccuagaaacagcuacaaauguggcacaaauaccauggaacgggaggaaucugagcaaacaaagaaacgcgagaagauucacauccccgaaagauccgacgaggcgcagcggguguuuaagagcuccaaaaccucuagcugcgauaaguccgacacguguuucuga

SEQ ID NO: 67144 - RNA, 708 nt, Artificial Sequence
  derived and/or modified sequence opt5 from CD8A__Homo_sapiens__NP_001759
auggcccugcccgugaccgcucuccugcuuccucuggcccuccugcuucacgcggcuagaccgagccaguuccgggucucuccccuggaccgcacauggaaccucggcgagacgguugaacugaagugccaagugcugcucuccaauccuaccagcggguguuccuggcuguuucagcccagaggagccgccgcuucuccuacauuccuucuguaccucagccagaacaaacccaaggccgcugagggccuggauacccagcgguuuuccgggaaacgccuuggagacacauucgugcugacccucucugauuuuagacgggaaaaugagggcuauuacuucugcagcgcccuguccaacagcaucauguauuuuucucauuucgucccuguguuucugccggcgaagcccacaaccacgccugcgccccgcccucccaccccggcuccuacaauugccucccaaccccucagccugagaccugaagccugucggcccgccgccgggggagccguucacacccgcggccuugacuucgcuugcgauaucuacauuugggcuccccuggcuggcacauguggggugcuccugcuuucucuggucaucacccucuauugcaaucauagaaaccggcgcagaguguguaaaugcccucggccgguugugaaguccggagacaagcccagccugucugcccgcuacgucuga

SEQ ID NO: 67145 - RNA, 597 nt, Artificial Sequence
  derived and/or modified sequence opt5 from CD8B__Homo_sapiens__NP_001171571
augagaccccggcuguggcuccugcuugccgcucagcugaccgugcuccacggcaacagcguccugcaacagacgccugccuacaucaagguucagacaaauaaaauggugaugcuuuccugcgaggcgaagauuucucugagcaacaugcgcaucuauuggcucagacagcggcaagcuccguccucugacagccaucacgaguuccuggcccugugggauuccgccaaagggaccauucauggagaagaaguggagcaggaaaagaucgcugucuuucgcgacgccucuagauucauucucaaucugacaagcgugaaacccgaggauuccggcaucuacuuuuguaugaucguugggagcccugagcuuaccuucggaaagggcacacagcugucuguggucgacuuucuccccaccacagcucagccuaccaagaaauccacgcugaagaaacgggugugccgccuucccagaccugaaacccaaaaggggcugaaaggaaagguuuaucaggagccgcucagccccaacgccuguauggauacaaccgcgauucugcagccucaccggucuugccugacacauggcuccuga

SEQ ID NO: 67146 - RNA, 1959 nt, Artificial Sequence
  derived and/or modified sequence opt5 from CD93__Homo_sapiens__NP_036204
auggccaccagcaugggccugcuccugcuucugcuccugcuucugacacagcccggggcuggaacgggcgccgacaccgaggcgguggucugcguugggacagcuuguuacaccgcccacuccggaaagcucucugccgcugaagcccaaaaccauugcaaucagaacggcgggaaucuggcuacagugaaaagcaaggaggaagcccagcacgugcagagaguccuggcgcaacuccugcggcgcgaggccgcucuuaccgccagaauguccaaauucuggaucggacugcagcgggaaaagggcaaaugucucgauccuucucugccgcuuaagggcuuuagcugggugggaggaggcgaggacacacccuauuccaacuggcauaaggagcugcgcaauucuugcauuagcaaaagauguguuucccuccugcuggaucucagccagccucugcuucccucucggcugccuaagugguccgaagggcccugcggaagcccuggcucuccgggguccaacaucgagggauucguguguaaauuuagcuucaagggcaugugccgcccccucgcucugggcgggccuggacaggucaccuacacgacccccuuucaaacaaccucuuccagccuugaagccgugccuuucgcguccgccgcuaauguugccuguggcgagggggacaaagaugagacacagucucacuauuuucugugcaaggaaaaggcucccgacguguucgauuggggaagcuccggcccgcucugugucagcccuaaauacgggugcaacuuuaauaacggaggcugccaucaggacuguuucgagggcggggauggaucuuuucugugcggcuguagacccggguuccggcugcucgacgaucuggugaccugcgccucccgcaauccuuguagcucuagccccugcagaggaggcgccacgugugugcuugggccccacggcaagaacuauacaugccgguguccucagggauaccaacuggacuccucucagcucgauugcgucgacguugacgaaugucaggauagcccgugcgcucaagagugcgugaauacccccggcggguuucgcugugaaugcugggugggauaugagccuggcgggcccggagagggcgcgugucaggacgucgaugaaugcgcccuggggagauccccuugugcucagggcugcacaaacaccgacgggagcuuccacuguucuugcgaggaaggcuacgugcuugccggggaggauggaacccagugucaagacguugaugaaugcgugggccccgggggaccgcugugugacucccucugcuucaauacacagggcagcuuucauugcgggugucugccuggcuggguccuggcccccaacggagugucuugcacgaugggcccuguuucccucgggcccccuagcggacccccggaugaggaggacaaaggcgaaaaggagggguccaccgugccucgggcugccacagcgucucccacccgcggacccgaaggcacaccuaaagcuaccccgacgacaagcagacccucccugucuagcgaugccccuauuaccuccgcuccccuuaagaugcuggccccuagcgggucucccggcgucuggcgggagccuuccauccaccaugccaccgcugccagcggaccccaggaaccggcgggcggggacucuuccguggccacacagaacaaugacggaaccgauggccaaaaacuccugcuguucuacauucuugggacagucguggcuauccuccugcugcucgcccuggcucuuggacugcucguuuauagaaagcgccgggccaagagagaggagaaaaaggagaaaaagccucagaacgcggccgacagcuacucuugggugcccgaacgcgcugaaagccgggccauggagaaucaguauuccccuacgcccggcaccgauuguuga

SEQ ID NO: 67147 - RNA, 1710 nt, Artificial Sequence
  derived and/or modified sequence opt5 from CD96__Homo_sapiens__NP_005807
auggagaagaaauggaaguacugcgccguguauuacaucauucagauccacuucgucaaaggcguuugggaaaagaccgugaacacagaggaaaauguguaugcuacgcuggggagcgacgucaaccucaccugucaaacacagaccgugggauuuuucguucagaugcagugguccaaagugacaaauaagauugaucugaucgccgucuaccauccccaauauggcuuuuacugcgcguaugggagaccuugugagucucuugugaccuucacagaaaccccggagaacggaagcaaguggacgcugcaccuccggaauauguccugcucuguuagcggccgcuacgaguguaugcuggugcuuuaccccgaagggauucagaccaaaaucuauaaccugcucauccagacacaugucaccgcugacgaguggaauagcaaccacacaauugaaaucgagauuaaucagacccuggagaucccuugcuuucaaaacucuagcuccaagauuagcucugaguucacguacgccugguccguggaagauaauggaacacaggaaacccugaucagccagaaccaucucauuucuaauuccacacugcuuaaagacagagugaagcugggcaccgauuaucggcuccaccugagccccguccagaucuuugacgauggccgcaaauucucuugucacaucagaguugggccuaacaagauucuucgguccagcaccacagugaagguguuugccaaacccgagaucccugucauuguggaaaauaacuccacggacguucugguggagcgcagauuuaccugccuccugaagaacgucuucccgaaagcuaauaucacaugguucauugauggaucuuuucugcaugacgagaaggaaggcaucuacaucaccaacgaggaacggaaagggaaggauggauuccucgagcugaaaagcgugcuuacacgcguucacuccaauaagcccgcccaaagcgacaaccugaccauuugguguauggcucucucuccugugcccggcaauaaggucuggaacaucuccagcgagaaaauuacguuccugcuugggucugaaaucagcuccacagauccuccccugucugugaccgagagcacccucgacacacagccguccccugccagcucugucucccccgcgagauauccugccaccagcucugugacacugguugacguguccgcucugcggcccaauacgacaccccagccuagcaacuccucuaugaccacccgcggauuuaauuacccguggacaagcuccggcaccgauacgaagaaaucugucagccggauucccuccgaaaccuauuccucuuccccuagcggcgccgggucuacacuccaugacaacguguucaccuccacagcuagagccuuuagcgagguucccaccacggcgaauggaucuacaaagaccaaccacgugcacaucacaggcaucgucgugaauaaaccuaaggaugggaugagcuggcccgugauuguugccgcucugcuuuucugcuguaugauccuguuuggacucggcguccgcaaguggugccaauaccagaaagaaauuauggagagaccgccucccuucaagccucccccucccccgaucaaauauaccugcauucaggaaccuaacgaguccgaccugcccuaccaugagauggaaacccuuuga

SEQ ID NO: 67148 - RNA, 510 nt, Artificial Sequence
  derived and/or modified sequence opt5 from CD99__Homo_sapiens__NP_001116370
auggccagaggcgcugcccuggcgcuccugcuuuucgggcugcucggagugcuggucgcugcccccgacggcggguuugaucuuagcgacgcccugccuggagaugacuucgaucucggcgacgcuguuguggauggggagaacgacgauccgcggcccccuaaucccccuaagcccaugccuaacccgaaucccaaccacccuuccucuagcggauccuuuucugacgccgaucuggcugacggcgugagcggcggggaaggaaaaggcggguccgauggaggcgggucucaucgcaaggagggagaagaggccgacgcgcccggcgucaucccuggcauugugggggccguuguggucgcuguggccggagcuaucagcuccuucauugccuaccagaaaaagaaacugugcuuuaaggaaaaugcggagcaaggcgagguugacauggaaagccacagaaacgccaaugcugagcccgccgugcagcggacccuccuggaaaaguga

SEQ ID NO: 67149 - RNA, 687 nt, Artificial Sequence
  derived and/or modified sequence opt5 from CD9__Homo_sapiens__NP_001760
augcccgugaagggcgggaccaaaugcaucaaguaccuucucuucggauuuaacuucaucuuuuggcuggccggcauugcuguccuugccauugggcuguggcucagauucgacagccagacaaaauccaucuuugagcaagaaacgaauaacaauaacucuagcuucuauaccggaguuuacauucugaucggcgcgggggcucuuaugaugcuggugggauuucucggcuguugcggcgccgugcaggagucccaguguaugcuggggcuguucuuuggauuccuccuggucaucuuugccauugaaaucgcugccgcuauuuggggcuauucucacaaggaugaggugaucaaagaaguucaggaguucuacaaggacacauauaauaagcugaaaaccaaggaugagccucaacgggaaacacugaaagccauucauuacgcgcucaacugcugugggcuggccggaggcguggagcaguuuaucagcgacauuugcccgaagaaagauguccuugaaaccuucacagugaaguccugucccgacgcuaucaaggagguuuucgauaauaaauuucacaucauuggggccgugggaaucggcauugcugucgugaugaucuucggcaugaucuuuucuaugauucugugcugugccauccgcagaaaccgggagaugguguga

SEQ ID NO: 67150 - RNA, 1476 nt, Artificial Sequence
  derived and/or modified sequence opt5 from CDADC1__Homo_sapiens__NP_001180407
augaaggaggccggccagaugcaaaaccuggaaagcgcuagagccgggcgguccgugucuacccagacaggaagcaugacgggccagaucccccgccucuccaaagucaaucuguucacccuucugucucucuggauggagcuguuuccugcggaagcucagagacaaaagagccagaaaaacgaggaagggaagcacggaccgcuuggcgacaaugaggagcggacacgcguuuccaccgauaaaagacaggugaagcggacagggcugguggucgugaagaacaugaaaauuguuggacuccauugcucuagcgaagaccugcacgccggccagaucgcccugauuaagcauggcucccgccucaaaaauugugaucuguacuucagcagaaagcccugcucugcuugucuuaaaaugaucgugaacgccggggucaaucggauuuccuauuggccugcugaccccgagaucagccugcucaccgaagccucuuccagcgaggaugcgaagcuggacgccaaggcuguggagcgccuuaaaucuaacuccagagcccacguuugcgugcugcuccaaccucuggucuguuacauggugcaguuuguggaagagacaagcuauaagugcgauuucauccagaaaauuaccaagacgcugcccgacgcuaauaccgauuuuuacuaugaauguaaacaggagcggaucaaggaauacgagaugcuguuccucgucuccaacgaggaaaugcauaaacaaauucuuaugacaaucggacuggagaaucucugcgaaaacccuuauuuuucuaaucugcgccagaacaugaaggaccuuauucugcuccuggccaccguugcgagcuccgugccgaauuucaagcacuuuggcuucuacagaagcaaccccgagcagaucaacgaaauucacaaucaaucucugccucaggagaucgcccggcauuguauggugcaggcucgccuccuggccuacagaacagaggaucacaaaaccggggucggagcugugaucugggccgaaggcaagucccggagcugcgacgggacgggagccauguauuuuguuggcuguggcuacaacgcuuuccccguggggucugaguaugcggauuuuccucauauggacgacaaacagaaggauagagaaauucgcaaauuccgguacaucauucacgccgagcaaaaugcucuuacauucagaugccaggaaaucaagcccgaggagcgcagcaugauuuuugucaccaagugcccgugugacgaaugcgugccucugaucaaaggagccggcaucaagcagauuuaugccggggauguugacgugggcaaaaagaaagcugauaucuccuacaugcgguucggagagcucgaaggggucucuaaguuuacauggcagcugaaccccagcggagccuauggccuugagcaaaaugagccugaaagacgcgaguccuga

SEQ ID NO: 67151 - RNA, 3684 nt, Artificial Sequence
  derived and/or modified sequence opt5 from CDAN1__Homo_sapiens__NP_612486
auggccgcugugcuggagagccuccugagagaagaggucuccguugccgcgguggugcgguggaucgcucgcucuacccagggcagcgaagacaacgccggggaggccgcugcccuuuccucucugagagcucuccggaaggaguucguccccuuucugcuuaauuuccugcgcgaacaaagcuccagagugcucccucagggaccgcccacgccugccaaaacacccggcgcgucugccgcucugccugggcggcccggaggcccuccgcgcgggagcagaggagcccggucccagcuguuucccccuaccgaggcucagagcacagccgcggaagcuccccucgcucgcagaggcggccggcgcagagggccuggacccgcccgggagcgcggcgggagaggacuggaagagggcguuucuggggagucccuuccgggagcuggcggccggagacugcgcgggagcggaucuccuucccggcccagccucacccugucugauccucccaaccuuuccaaucuggaagaguuucccccugugggcagcgucccgcccgggccuacaggaaccaagcccuccagacgcauuaacccuacacccgugucugaggaacggagccucuccaaaccgaagaccugcuucacgagcccucccaucucuuguguuccuuccagccaacccucugcccuggacaccagcccuuggggccuggggcuucccccgggaugcagaucccugcaggaggaacgcgagaugcuucggaaagaaagaucuaagcagcugcagcaaagcccuacacccaccugucccacaccugagcucggcuccccgcugcccagccgcaccggcucucuuacggaugaaccugccgaccccgcucggguguccagcagacagcgccuggagcucgucgcgcugguguacucuuccugcauugccgaaaaucuggugccuaaccucuuccuggagcucuuuuucgucuuucagcugcucacagcucggagaaugguuaccgccaaggauagcgaccccgagcuguccccugccgugcuugauucucuggaaagcccccucuuccaguccauccacgacuguguguuuuucgcuguccaagugcuggagugccauuuucagguucugucuaaucucgauaaagggacacugaaacuucuggccgaaaacgagcggcuccuguguuucagcccggcgcugcagggacgccuuagagcugccuaugaaggcuccguggccaaagucagccucgugaugccucccucuacccaagcuguuuccuuccagccugagaccgacaaucgggccaacuuuagcucugauagagcuuuccacacauuuaagaaacagcgcgacguguucuacgagguccugcgggaaugggaggaucaucacgaggaacccgggugggacuuugagaagggacugggcucccgcauuagagccaugauggggcagcucagcgcggccugcucucauagccacuucgugagacuguuucaaaagcagcuucugcagaugugucaguccccgggcggagcuggcgggacgguccucggagaagccccugacgugcugagcaugcugggcgcugauaaacuugggcggcucuggcgccugcaagagagacugauggcgccccagucuuccggaggcccuugcccuccgcccaccuuccccgggugucagggcuuuuuccgggacuuuauccucagcgccuccucuuuccaguuuaaucaacaccugauggauagccuuucccugaagauccaggaacucaacggacuggcccugccccagcaugagccuaaugacgaagauggcgagucugacguugauuggcagggggagcgcaaacaauucgcugugguccuucucagccugagacugcucgccaaguuccugggauuuguggcuuuccuucccuaucggggcccugaacccccuccgacaggggagcugcaggacuccauucucgcccugcgcucucagguucccccugugcuggaugucagaacccuucuccaacggggacugcaggcccgcagagcugugcugacagugcccuggcucguugaauuucugagcuucgcggaccacgucgugccucuucuggaguacuaucgggauaucuuuacccuccugcugagacuucaucgcucccuggugcucagccaggaaucugagggcaaaaugugcuuccugaacaagcuccugcuucuggccguccucggguggcuguuucagauucccacggugccggaggaccuguucuuucuugaagagggcccuuccuacgcuuucgaaguugacacaguggcccccgagcacggacuggauaaugcccccgucguggaccaacagcuccuguauaccugcuguccuuacaucggcgaacuccggaaacugcuugcuagcuggguuucuggguccagcggaagaucuggcggguuuaugcgcaagauuacccccacaaccacaacgucccugggagcccagccuagccagaccucccaaggccuccaggcgcagcuggcucaggccuucuuucacaaccaaccgcccagccugcggagaacaguggaguucgucgccgagcgcaucgggucuaacugcgugaagcauauuaaagcuacccuuguugccgaucuggugcggcaggcggaaagccuccugcaggagcaacucgucacacagggcgaagagggaggcgacccugcucagcugcuugagauccuguguucccagcugugcccccacggggcccaagcccucgcucugggaagagaguucugucagcgcaagucuccuggcgccgugcgggcccuucugcccgaagaaaccccggccgcggugcucagcuccgccgagaauaucgcugucgggcuggccacggaaaaggcuugcgccuggcucucugccaacauuaccgcucugaucagacgggagguuaaggcggccgugagccgcacacuuagagcucagggaccugagcccgccgcccggggcgaacgcagaggcuguucccgggcuugcgagcaucacgccccucugcccucucaucugauuagcgaaaucaaagaugugcucucccuggcggucgggccuagagaccccgaugagggagugagcccggaacaccuugagcagcugcucggccaacuggggcagacccuccgcugucggcaguuucugugcccucccgcugagcagcaccuugccaaguguucuguugaacuggccucccugcucguggcugaccaaauucccauccugggaccuccggcccaguacagacuugagcgcggccaggcgcggagacugcuccauaugcugcucagccuguggaaggaagauuuccaggggcccgucccucuucaacugcugcucucuccccgcaaugugggacugcuugcugacacacggccuagagagugggaucugcuccuguuucugcuccgcgaacuuguugagaaaggccugaugggcagaauggagaucgaagccugccuggggucccuccaccaggcccaguggcccggagacuucgcugaggaacuggccacccuuagcaaccuguuucucgcugagccucaucugccggagccccaacugcgggccugcgaacucgugcagccuaaucgcggcacgguccuugcgcaguccuga

SEQ ID NO: 67152 - RNA, 1011 nt, Artificial Sequence
  derived and/or modified sequence opt5 from CDC123__Homo_sapiens__NP_006014
augaagaaagagcacgugcugcauugccaguucagcgccugguaccccuuuuucagaggcgucaccaucaaguccguuauucucccucugccgcaaaacgugaaagacuaucuucuggaugacgggacacucguggucucuggacgggaugaucccccuacgcacagccagcccgacuccgacgaugaagcugaggaaauccaguggucugacgaugagaauaccgccacacugaccgcgccugaauuucccgaguucgcuacaaaggugcaggaggccauuaacagccuuggcggguccguuuuuccuaaacugaauuggucugccccgcgcgacgcuuacuggaucgccaugaacagcucccucaaguguaagacccugagcgauauuuuccugcucuuuaaaucuuccgacuucaucacaagagauuuuacccaacccuucauccauugcacggacgacagcccugaucccuguauugaauaugagcuggugcuucggaaguggugcgaacugaucccuggagcugaguuucgcuguuucgucaaagagaauaagcucauuggcaucucucagagagacuacacccaguauuacgaucacauuuccaaacagaaggaagagauccggcgcugcauucaagacuuuuucaagaaacauauccaguauaaguuccuggaugaagacuuuguguucgauaucuacagagacagccgggggaaaguuuggcuuauugauuuuaaccccuucggagaggugacagacucucugcucuuuaccugggaggaacugaucuccgagaauaaccugaauggcgauuucagcgaagucgacgcccaggagcaggacuccccggcguuucgcuguacaaacucugaagugaccgugcaaccuagccccuaccucuccuauagacugccuaaggauuucgucgaccuuagcacgggcgaggaugcccacaaacugauugacuuucucaagcugaaacggaaucagcaggaagaugacuga

SEQ ID NO: 67153 - RNA, 1836 nt, Artificial Sequence
  derived and/or modified sequence opt5 from CDC14A__Homo_sapiens__XP_011540643
auggacuucccccugggccagugcagacucguguguagcucccuguacauguggcuugccaagcgggaggauggggcugccauccugaacaugccuucuccgagcuuuuaugcggacuucggaccccucaaucuggcuauggucuaccgcuauugcuguaaacuuaacaagaaacugaaguccuacucucucagccggaaaaagauuguucacuauaccugcuuugaucaaagaaagcgcgccaaugccgcuuuccugaucggcgccuacgcugugauuuaucugaaaaagaccccugaagaggccuacagagcgcuccuguccgggucuaaucccccuuaccuucccuuucgggacgccagcuucggaaacuguacguauaaccugaccauccucgauugccugcagggcauucgcaaagggcuucagcauggauuuuucgacuuugaaacauucgauguggacgaguacgaacacuaugagagagucgagaauggcgauuuuaacuggaucgugccuggcaaguuccuggcuuuuuccgggccgcaucccaaaagcaagaucgaaaauggauacccucuccacgcccccgaggcuuauuucccuuacuucaagaaacauaacguuaccgccgugguccggcugaauaagaaaauuuaugaagcgaagcgcuuuacagacgccggcuucgagcacuacgaucuguuuuucaucgacgggucuacccccuccgauaacauugugagacgguuucucaauaucugugagaacacagaaggagcuauugccguucacugcaaagcuggccuggggcgcaccggaacgcuuaucgccuguuacgugaugaagcauuauagauucacccacgccgagauuaucgcuuggauccggauuugccgcccgggcagcaucauuggcccucagcaacauuuucuggaagagaaacaggcgucucucuggguccagggggacaucuucagauccaagcugaagaaucggcccagcucugaaggauccauuaacaaaauccuuagcggccuggacgauauguccaucgggggaaaccucucuaagacacagaauauggagagauuuggcgaggacaaccuggaagaugacgauguggagaugaaaaaugggauuacccaaggagacaagcugcgcgcccucaaaagccagcggcagccuagaacaucccccagcugugcuuuccgcucugaugacaccaagggccacccccgggccgugucccagccuuuuagacugagcucuagccuucaaggcuccgccgucacgcugaagacaucuaaaauggcucucagcccguccgccaccgcgaagcgcaucaaccggacaagccugucuuccggggcuaccguucgcagcuucucuauuaauuccagacuugccagcucccugggaaaccucaaugccgcuaccgaugaccccgaaaacaaaaagacaucuagcuccucuaaagccggcuuuacggcuagcccuuucaccaaucugcugaacggguccagccagcccacaacccggaauuacccugagcucaacaauaaccaguauaauagaucuuccaacagcaacggaggcaaucugaacucucccccggggccucacuccgccaagacagaagaacauaccacgauccuucgccccagcuacacaggccugucuagcuccagcgcgcgguuccucucuagauccauuccugugagcgcccaaacacccccucccggaccgcagaauccugagugcaacuuuugcgcucugcccucccagccccggcugccuccgaagaaauucaauucugccaaggaggcuuuuuga

SEQ ID NO: 67154 - RNA, 1386 nt, Artificial Sequence
  derived and/or modified sequence opt5 from CDC14B__Homo_sapiens__NP_001070649
augagcagagagggcgccggggcugcccugguggcggaagucaucaaggaccggcucugcuucgcuauucuguacucccgccccaaaucugccagcaacguucacuauuuuuccaucgauaaugagcuugaauacgagaacuucuaugccgacuuuggaccucugaaucucgcuaugguguacagauauuguugcaagauuaacaaaaagcugaaaucuaucaccaugcuucggaagaagauugugcauuucacaggcagcgaucagcgcaaacaagccaaugcugccuuucuggucggguguuacauggugaucuaucucggaagaacgccggaagaggcguaccggauccugauuuucggcgagaccuccuacauccccuuucgcgacgccgcuuaugggucuugcaacuucuacauuacacugcucgauuguuuucacgccguuaagaaagcuaugcaguauggauuccugaauuuuaacagcuucaaucuugacgaauacgagcauuaugaaaaggccgagaacggcgaucugaauuggaucauuccugacagauuuaucgcguucugcggcccccacucccgggcccgccucgagagcggguaccaucagcacucuccugaaaccuauauucaguacuucaaaaaccacaaugugacaaccaucaucagacugaacaagcggauguacgaugcuaagcgcuuuacagacgccggauucgaucaucacgaccuguuuuucgcugauggcuccacccccacggacgccauugucaaagaguuucuugacaucugugaaaaugccgagggggcuauugcggugcauugcaaggccggacucggcagaaccgggacacugaucgcuuguuauauuaugaaacacuaccggaugaccgccgccgaaacaaucgcuuggguucgcaucugcagaccuggaagcgugauuggcccgcaacagcaguuccuggucaugaagcagaccaaccucuggcuggagggcgauuauuuucggcaaaaacuuaaggggcaggagaacggacagcacagagccgcguucucuaaacugcucuccggcguggacgauaucagcauuaaugggguggaaaaccaggaccaacaggagcccgaaccuuacucugaugacgaugagaucaauggagucacgcagggcgaccgccugcgggcucuuaaguccagacgccaaagcaagacaaacgccauuccccugaccguuauccuccaguccucugugcagagcuguaaaacauccgaaccuaauaucagcgggucugccggaauuaccaagcggaccacaagauccgcuagccgcaaaucuagcgugaagucccugucuaucagccggacgaaaaccguccugagauga

SEQ ID NO: 67155 - RNA, 1863 nt, Artificial Sequence
  derived and/or modified sequence opt5 from CDC16__Homo_sapiens__NP_003894
augaaccuggagagacuccggaagcgcgugagacaguaccuggaccaacagcaguaucagagcgcccuuuucugggcugauaaagucgccucccugucucgggaagaaccccaagacaucuacuggcucgcgcagugccuguaucuuaccgcucaguaccaccgcgccgcccaugcucugagaagccggaagcucgauaaacuguaugaagccugucgcuaccuggcugccagaugccacuaugcggccaaggagcaucagcaagcucucgacguucuggauauggaggagccuauuaauaaacggcuuuuugagaaguaccugaaggacgaauccggcuucaaagauccgucuagcgacugggagaugucccagucuagcaucaaguccagcauuugucuccugcgcgggaaaaucuacgaugcccuugacaacagaacacuggcuacguauucuuacaaggaagcccucaaacuggauguguauugcuuugaggcguucgaccugcucaccucccaccauaugcugacagcccaggaggaaaaggagcuucuggaaagccucccccugucuaaacuuuguaaugaggaacaggagcugcuccgguuucuguucgagaacaagcugaagaaauacaauaagccuuccgaaaccgugauucccgagagcgucgauggacuccaagaaaaccuggacgugguugugucucuugcugagcgccacuauuacaauugcgacuuuaaaauguguuauaagcugacauccgucgugauggaaaaagauccuuuccacgccagcugccuccccguucauaucggcacccugguggagcuuaacaaggcuaaugagcuguuuuaccucucccacaagcuggucgaccuguacccuucuaacccggugagcugguucgccgugggguguuauuaccucauggucggacauaaaaaugaacacgccagacgguaucuguccaaggcuacaacccuugagaaaacguacggccccgcguggaucgccuaugggcacagcuuugcuguugaaucugagcaugaucaggccauggccgcuuacuucaccgccgcgcagcugaugaagggaugccaccucccuaugcuguauauuggccuggaauacggccuuacaaacaauuccaaacucgcugagcgcuuuuucagccaagcccugucuaucgcccccgaggacccuuucgugaugcaugaagugggggucguggcuuuucagaacggagaguggaagaccgccgaaaagugguuccuggaugcucucgagaaaauuaaggccaucggcaaugagguuacaguggacaaaugggaaccccugcuuaacaaccuggggcacgucuguagaaagcucaaaaaguacgcggaggcccuggauuaucaucggcaggcucuggugcuuauuccgcagaaugccagcaccuacuccgcuaucggauauauucacucucucaugggcaacuuugaaaaugccguugacuacuuccacacggcgcuggggcugagacgcgaugacacauuuagcgugaccaugcucggacauugcaucgagauguauaucggcgauuccgaagccuacauuggcgcugacaucaaggacaaacugaagugcuaugauuucgacguccacacaaugaaaacccuuaagaacauuaucagcccucccugggauuuucgggaguucgagguggaaaaacaaaccgccgaggaaacagggcugacgccucucgagaccucuagaaagacacccgacucccgccccagccuggaagagaccuuugagauugaaaugaaugagucugauaugaugcuggaaacauccaugagcgaccauuccaccuga

SEQ ID NO: 67156 - RNA, 1434 nt, Artificial Sequence
  derived and/or modified sequence opt5 from CDC20B__Homo_sapiens__NP_001139206
auggaguggaagcuggaaagaaccgcuccccggcgcgugagaacagaggaagagaugcucugggaaagcaucaugcggguccuguccaaagaccuuaagcagaaacgcucucaagauagcgccaacguucuggacuccgugaaugccacguacucugauuucaagagcaacuuugcgaaaagacucuccgcugaggugccugucgccucuagcccgauuaccacacgguggcagcagucccagacccgcgcccugagcucugacuccuucggcgaggaacaaagcacaaccuaucuucccgaggcuucuggguccgugcugaagacaccucccgaaaaggagacccucacgcugggaagcagaaaagagcagcugaagaccccuucuaaaggcaucuccgaaacaagcaauuccgcccuccacuuuugcaaggcuccccaugccauggaucgggacuggaaagagucuguugcgagcaaggggcagaagugucugaaacagcuuuucgugacccaaaacgucgugcagcaggccaauggaaagaugcagcugugcgaacaauccgaguguguuuggaaaggcugcaaggauggggugcgcgacgagagcuuucaccucaaaucuuccggagauauuaacgacagcauccugcagccugaagucaagauucauaucacaggccuuagaaaugauuacuaucugaacauccucgacuggucuuuccagaaucugguggcuauugcccugggcagcgcuguguacaucuggaacggggagaaucacaacggaauugaaaauaucgaucucucccugaccuguaacuauauuucuagcgucuccuggaucaaagagggcacgugccuugccguugggacaagcgaaggagaggugcaacugugggacguggucaccaagaagcggcuccgcaauaugcugggccaucuuucugugguuggggcgcuguccuggaaccacuuuauucucagcucuggauccagacugggccggguguaccaccaugacguccgcguggcccagcaccauguuggcacacugagacacaaacaggcugugugugcccucaaguggagcccggaugggcggcugcuuuccucuggaugcagcgacggccugcucaccaucuggccccacgauccuggggcuuccgcccagggacaaccccugaaagucaucacccagucuacagccgugaagauuuguagccuuaucuggcugccuaaaacgaaggaaauugcuaccggccaggggacacccaagaacgacgucaccguguggacaugcccgaccguuuccagaagcggaggcuucuuuggccaucgcgggcgggugcuccaccugucucuguccccugaucagacgagagucuucagcgcggccgcugacggaacagccucuguguggaauuguuauuga

SEQ ID NO: 67157 - RNA, 1794 nt, Artificial Sequence
  derived and/or modified sequence opt5 from CDC23__Homo_sapiens__NP_004652
auggccgcuagcaccuccauggugcccgucgccguuacagcggcuguggccccugugcugucuaucaacagcgacuucuccgaucucagagagauuaagaaacagcugcuucugaucgccggccucacgcgggaacgcgggcugcuucacucuagcaagugguccgcugagcuggccuuuucucucccggcucugccccuggccgaacuccaaccucccccucccauuaccgaggaagacgcgcaggauauggacgccuacacacuggcuaaagccuauuucgaugucaaggaguacgacagagcugcccauuuucuucacggaugcaauagcaaaaaggcguauuuccuguacauguauucccgguaccucagcggcgagaagaaaaaggaugacgaaaccguggauucucuggggccucuugagaaaggacagguuaagaacgaagcccugcgcgagcucagaguggagcuguccaaaaagcaucaggcucgggaacuggacggcuuugggcucuaucuguacggagucgugcuucgcaagcuggaucucguuaaagaggccaucgacguguucgucgaagcuacacacgugcugccgcuucauuggggcgccuggcuggagcucuguaaucugauuaccgauaaggaaaugcugaaauuucucagccugcccgacacauggaugaaggaguucuuucuugcccacaucuacaccgagcugcaacucaucgaagaggcucugcagaaauaucagaaccuuauugacgugggcuucucuaaguccagcuacaucgucucucagauugcgguugccuaucacaauaucagagauauugacaaagcucuguccaucuuuaacgaacuccggaagcaagauccuuaccgcauugagaauauggacacguucagcaaccugcuguaugugagauccaugaagucugaacucagcuaccuggcccauaaucuuugcgagaucgauaaauaucggguggagaccuguugcgucaucgggaacuacuacucccugcgcagccagcacgaaaaggccgcucucuauuuucagagagcccugaaacugaauccccgguaccuuggagcguggacacucaugggccaugaguauauggaaaugaagaacaccucugcugccauucaggccuaccgccacgcuaucgaggugaauaaaagagacuaucgggccugguacgggcugggacaaacauaugaaauucugaagaugccuuucuacugucucuacuauuacagacgcgcucaccagcugcggcccaacgauuccagaaugcuuguugcccugggcgagugcuaugagaagcucaaucagcugguggaagcgaaaaaguguuacuggcgcgccuaugcugucggggacguggagaaaauggcccugguuaaacuugcuaagcuccaugaacaacugaccgagagcgagcaggccgcgcagugcuacaucaaguauauucaggauaucuacucuuguggagaaaucguggagcaccuggaagagagcacggccuuccgguaccucgcucaauauuacuuuaagugcaaacugugggacgaagccuccacaugugcucagaagugcugcgccuucaacgauaccagagaggagggcaaagcccuucugcgccagauucuccagcugcggaaccaaggcgaaacaccgaccaccgaggucccugcucccuuuuuccugccugcgucucuuagcgccaauaacacacccacgagacgcgugagcccccucaaucuguccucugucaccccuuga

SEQ ID NO: 67158 - RNA, 1575 nt, Artificial Sequence
  derived and/or modified sequence opt5 from CDC25A__Homo_sapiens__NP_001780
auggagcugggccccgaaccuccgcacagacggcgccuccuguucgccugcagcccuccucccgcuucccagcccguggucaaggcccuuuuuggggcgucugcugccggaggccugagccccguuaccaaccucacagugacgauggaccaacugcaggggcuuggauccgauuacgagcagccucuggaagugaagaauaacucuaaucuccagagaaugggcagcuccgagucuaccgacagcggguucugucuggauuccccgggaccccuggacagcaaggaaaaccucgagaauccuaugcggcgcauccauucucugccccaaaaacuucugggcugcuccccugcccucaagagaagccacucugauucccuggaccaugauauuuuucagcuuaucgaccccgaugagaacaaagaaaaugaggcuuucgaauuuaagaagccgguccggccugugagccgcggcugucugcacucucaugggcuccaggagggaaaagaccuguucacacagagacaaaacuccgcccccgcucggaugcugagcuccaaugagcgcgauucuagcgaaccuggcaacuuuauuccccucuucacaccccaguccccuguuaccgccacccugagcgacgaggaugacggguuuguggaccuucuggauggagaaaaucucaagaacgaggaagagacaccgucuugcauggcgucccuguggaccgcuccccuugucaugagaacgaccaaucuggacaaccgguguaaacucuucgauagcccuucucugugcagcuccucuacacgcagcgugcugaagagacccgagcggucccaggaagagagcccucccggcucuaccaaacgcagaaaguccaugagcggggccucuccgaaggaauccacaaauccugagaaagcccacgaaacccuccaccagagccugucccuugcuucuagccccaagggaacgaucgagaacauucuggacaacgauccucgggaccucaucggcgauuuuuccaaaggcuaucuguuccauacaguugccgggaagcaccaagaccuuaaauacaucucucccgagauuauggcgagcgugcugaauggaaaguuugccaaccucaucaaagaguucgucauuaucgauuguagauauccuuacgaauaugaaggcgggcauauuaagggagcugugaaucugcacauggaggaagagguggaggacuuccugcucaagaaacccaucgucccgaccgauggcaagcgcguuauugugguguuucacugcgaguucuccagcgaacgggggccuagaaugugucgcuacguccgggaaagagaccgccugggaaacgaguaucccaaacuucauuaccccgagcuguacgugcucaagggcggcuauaaagaauuuuucaugaagugccagucuuacugugagccuccguccuaucggcccaugcaccaugaagacuuuaaggaggaucugaaaaaguucagaacaaaaagccgcaccugggccggggaaaagucuaaacgggagauguacuccagacugaagaaacuuuga

SEQ ID NO: 67159 - RNA, 1551 nt, Artificial Sequence
  derived and/or modified sequence opt5 from CDC25B__Homo_sapiens__NP_001274445
augcacagcgagacccccaagucccaggugggcacacuccuguucagaucucggagccgccugacgcaucuuucccugucuagacgggccagcgaauccucucucagcuccgagagcucugaauccagcgacgcugggcugugcauggauucuccuuccccgauggacccccacauggccgagcaaaccuuugaacaggcgauccaggcugccagccgcauuaucagaaacgagcaguucgccauucggcgcuuucaaucuaugccugucagacuucugggacauucccccguucuccggaauaucacaaacagccaggcuccugauggccgcagaaaauccgaggccgggucuggagcugccagcuccagcggcgaagacaaggagaaugauggguucguguuuaaaaugcccuggaagccuacccacccgucuuccacacaugcgcuggccgaaugggcuagccggcgcgaggccuucgcucagagacccucuagcgccccugaccugaugugucucucccccgaucggaaaauggagguggaggaacugucuccucuugcgcugggacgcuuuagccucacccccgccgaaggcgacacagaggaagaugacggcuucgucgauauucuggaguccgaccuuaaggaugacgacgcugugccgccugggauggagagccugaucucugcuccccucguuaagacccuggaaaaagaggaagagaaggaucuggugauguacuccaaaugccagagacucuuucggagcccuucuaugcccuguuccgucaucagacccauucugaagcgccuugaacggccucaagacagagauacgccggugcagaacaaacgccggagaagcguuacacccccugaggagcagcaggaagccgaggaacccaaggcccgcgugcugcgguccaagucucucugccacgacgagaucgaaaaucugcuugauagcgaccacagagagcugauuggagauuauuccaaagccuuccuccugcaaaccgucgacggcaagcaucaggaucugaaauacaucucuccugagaccaugguggcucuccugacagggaaguuuagcaacauuguggacaaauucgucaucguugauugucgcuaucccuacgaauaugagggaggccacauuaagaccgcggugaaucuuccgcuggaacgggacgccgaguccuuucuccugaaaagcccuaucgcucccugcucucuugacaagagagugauccugauuuuccauugugaguucuccagcgaacgcgggccucggaugugcagauuuauccgggagcgcgauagagccgucaacgacuaccccucucucuauuacccugaaauguacauucugaagggaggcuauaaagaguucuuuccccagcacccgaauuucugugaaccucaagauuaccggcccaugaaccacgaggccuuuaaggacgagcugaaaacguucagacucaagacacgcuccugggcuggcgaacggagcagacgcgagcugugcucuagacuucaggaucaguga

SEQ ID NO: 67160 - RNA, 1422 nt, Artificial Sequence
  derived and/or modified sequence opt5 from CDC25C__Homo_sapiens__NP_001274511
augagcaccgagcuguucuccucuacaagagaagagggcagcuccgggucuggacccagcuuucgguccaaccagcgcaagaugcucaaucugcuucuggaaagagacacgucuuucaccgugugcccugaugucccgcggacacccguuggcaaauuucucggggacagcgccaaccuguccauccuuagcggaggcaccccuaagcgcugucuggaucucucuaaucuguccagcggggagauuacagcuacccaacugacaaccucugccgaccucgaugaaacgggacaccuggacuccagcggccuucaggaggugcaucuggcgggcaugaaccacgaucagcaucucaugaaaugcucucccgcucagcugcuuuguuccaccccuaaugggcuggacagaggacaccggaagcgcgaugccaugugcagcuccucugccaacaaagagaaugacaacggcaaucucguggauagcgaaaugaaguaccuggggucccccaucacaaccgucccuaagcuggacaaaaacccgaaucucggagaggaucaagcugaagagauuagcgacgagcugauggaauuuucucuuaaggaccaggaggccaaaguguccagaagcggccuguaucggucucccagcaugccugaaaaccucaaucgccccagacugaagcagguugagaaauuuaaggauaacacaaucccugacaaggugaaaaagaaauacuucuccgggcagggaaaacuucggaagggccugugucucaagaaaaccgucucucugugcgauauuacgaucacacaaaugcuggaagaggacagcaaucagggccaucucaucggggauuuuuccaaggugugugcucugcccaccguuagcggaaagcaccaggaccuuaaauaugugaacccggagacagucgccgcgcugcucucuggcaaguuccaggggcugauugaaaaauuuuacgugaucgauugccgcuauccuuacgaguaucuuggaggccacauucaaggggcccugaaccucuacucccaggaagaacuguucaauuucuuccugaagaaacccaucgugccucucgacacccagaagagaauuaucauugucuuucauugugaguucagcucugagcggggaccccgcaugugcagaugucugcgggaggaagauagaucccuuaaccaauaccccgcucuguauuacccugagcucuauauccugaagggcggcuaccgcgacuucuuuccggaauauauggagcugugcgaaccccagagcuacugcccuaugcaccaucaggaucacaaaaccgagcuucuccgguguagaucccagucuaagguucaagagggggaacgccagcugcgggagcagaucgcccugcucgugaaagacaugagccccuga

SEQ ID NO: 67161 - RNA, 2493 nt, Artificial Sequence
  derived and/or modified sequence opt5 from CDC27__Homo_sapiens__NP_001107563
augaccgugcugcaggagcccguccaagccgcuaucuggcaggcccucaaccacuacgcguauagagacgcuguuuuccuggccgaacggcuuuacgccgaggugcauagcgaagaggcucuguuucuccuggccacaugcuauuaccgcuccggcaaggcuuauaaagccuacagacuucugaaggggcacucuuguacgaccccucagugcaaauaucuccuggcgaaguguugcguggaucugagcaaacucgccgaaggagagcagauucuguccggcggggucuucaauaagcaaaagucucaugacgauaucgugacagaguuuggagacagcgcuuguuucacccuuucccugcucggccacguuuacugcaaaacagaucggcuggccaaggggucugaauguuaccagaaaagccuuucccugaacccguuucucuggagccccuucgagucucugugcgaaauuggagagaagccugaccccgaucagaccuuuaaauucacaucccugcagaauuuuagcaacugucucccuaauucuugcaccacgcaagugcccaaccauucccugagccaccgccagccugagaccguccuuacagaaaccccgcaggacacaaucgagcugaauagacucaaccuggaaucuuccaauagcaaguauucccuuaacaccgauucuagcguguccuacauugacagcgcuguuaucucucccgauacggugccucugggcacaggcaccuccauccucagcaagcagguccaaaauaaacccaagacagggcggucucugcugggaggcccugccgcgcucagcccccugaccccguccuucgggauucuuccucuggagacccccucuccuggagacggcagcuaucuccagaacuacacaaauacgccucccgugaucgaugugcccuccaccggggccccgagcaaaaagacauuucgcguccugcagucuguugcuagaauuggacaaaccggcacaaaauccguguucagccagucuggcaacucccgggaagugacccccauccuugcccagacgcagagcuccgggccucaaacaucuaccacaccccagguccugagcccuaccauuaccucucccccgaaugcucucccucgcagauccagccggcuguuuacauccgacagcucuacgaccaaggagaacuccaaaaagcugaagaugaaauuucccccuaagauccccaaccgcaaaacaaagagcaaaaccaauaagggaggcauuacacagccuaacaucaaugacucucucgagaucaccaagcuggauuccagcauuaucucugaagggaaaauuagcacgaucacaccccagauucaagccuucaaccuucagaaggccgcugcggagggacugaugucccuccugagagaaaugggcaaaggguaucuggcccuuuguagcuacaauugcaaggaggcuaucaacauccucucucaucugccgucccaccacuauaauaccggaugggugcugugccagauuggccgggccuacuucgaacucagcgaguacaugcaggccgagcgcaucuucuccgaaguuagacggauugagaacuauagaguggaaggcauggagaucuacucuaccacacuguggcaucuucaaaaagacgucgcucugagcgugcucuccaaggaucugaccgacauggauaaaaauucuccugaagccuggugugcggcugggaacugcuuuagccugcagcgcgagcacgacauugccaucaaguucuuucagcgggccauccagguugaucccaauuaugcuuacgccuauacgcuucucggacacgaguucgugcugacagaagaacuggacaaggcucucgccuguuuuagaaacgcgauucgcgucaauccccggcauuacaacgccugguauggccuggggaugaucuacuacaaacaagaaaaguucucccuugcugagaugcacuuucagaaagcccuggauauuaauccucagucuagcgugcuccugugccauaucggagucgugcaacacgcucugaagaaguccgagaaagcccuugacacccucaacaaggcgauuguuaucgauccgaaaaacccccuguguaaguuccauagagccagcgugcuguuugcuaaugaaaaauauaagucugcccuccaggagcuggaggagcuuaaacagauugucccuaaggaaucccugguguacuuccucaucggcaagguuuauaaaaagcuggggcagacacaccuggcucuuaugaacuuuagcugggccauggaccucgaccccaaaggcgccaauaaccaaaucaaggaggcuauugauaaacgcuaccugccugacgaugaggaacccaucacccaggaggaacagauuaugggaaccgacgagucucaggaauccagcaugacagaugcggacgauacgcaacugcacgccgcugagucugacgaguucuga

SEQ ID NO: 67162 - RNA, 711 nt, Artificial Sequence
  derived and/or modified sequence opt5 from CDC34__Homo_sapiens__NP_004350
auggccagaccccuugugccuagcucccagaaggcucuccugcuugagcugaaaggccuccaagaggagccggucgaaggguuccggguuacccugguggacgagggagaucuuuacaacugggaaguggccaucuuugggcccccuaauacauauuacgaaggcggauauuucaaggcgcgccugaaauuucccauugacuacccuuauucucccccugcuuucagauuucucacgaagauguggcacccgaacaucuacgagaccggcgaugucugcauuagcauccugcaucccccuguggacgauccccaguccggggaacugccuucugagcgguggaaucccacacagaacguucgcaccauucuccugagcgugaucucccuucugaaugaaccgaacacauucucuccugccaaugucgacgccagcgugauguauagaaaauggaaggaguccaagggaaaagaucgggaguacaccgacaucauucgcaagcagguucucggcacaaaaguggaugcugaaagagacggcgucaaggugcccaccacgcuggccgaguacugugugaaaaccaaggcuccugcccccgaugaagggagcgaccuguuuuaugaugacuacuaugaggacggagaagucgaggaggaagcggauucuugcuucggcgacgaugaggacgauuccgggacagaagagagcuga

SEQ ID NO: 67163 - RNA, 1137 nt, Artificial Sequence
  derived and/or modified sequence opt5 from CDC37__Homo_sapiens__NP_008996
augguggacuacagcgucugggaucacaucgagguuuccgacgaugaagacgagacccaucccaacauugauacagccucucuguucagauggcggcaccaggcucgcguggaaagaauggagcaauuucagaaggaaaaagaggagcucgaccggggcugccgcgaauguaagagaaaaguggccgagugccagcggaagcugaaagaacuugaggucgcggaagggggaaaggcugaacuggagcgccuccaggccgaagcccaacagcugagaaaggaggaacggagcugggagcagaaacuugaggaaaugcgcaagaaagagaaguccaugccuuggaauguggauacgcugucuaaagacggcuucagcaaguccaugguuaacaccaagccggagaaaacagaggaagauucugaggaggugagagaacagaagcauaaaaccuuugucgagaaguaugaaaaacaaaucaagcacuucgggaugcuccggcgcugggacgauagccagaaauaccuguccgacaaugugcaucugguuugugaggaaacagcuaacuaucucgugauuuggugcaucgaucuggaggucgaggaaaagugugcccuuauggaacagguggcucaccagaccauugugaugcaauuuauccuggaacucgccaagagccugaaagucgaccccagagcgugcuuccggcaguuuuucacaaagaucaaaaccgccgaccgccaguacauggagggauuuaaugaugagcuugaggcuuucaaggagagaguucggggcagagccaaacugcgcauugaaaaggcuaugaaggaguaugaagaggaggaacggaaaaagagacucgggccuggaggccuggaccccguggagguguacgaaucucugccugaggaacuccaaaaauguuuugaugucaaggacgugcagaugcugcaggaugccaucuccaaaauggaccccacggaugcgaaguaucacaugcagcgcugcauugacagcggccuuuggguuccuaacucuaaggccuccgaggcuaaagagggggaagaggccggaccgggcgauccccugcucgaagcugugccuaagaccggggacgagaaagaugucagcguguga

SEQ ID NO: 67164 - RNA, 1014 nt, Artificial Sequence
  derived and/or modified sequence opt5 from CDC37L1__Homo_sapiens__NP_060383
auggagcagcccuggccuccgcccggcccuuggagccugcccagagccgaaggggaggcugaagaggaauccgacuucgauguguuuccuucuagcccccggugcccucaacucccgggaggcggggcccagauguacucccacggaaucgagcuggcgugucagaagcagaaagaguucgucaagucuagcguugcuugcaaauggaaccuugccgaagcccaacagaagcugggcucccucgcucugcauaauucugagagccuugaccaggaacacgccaaagcucagaccgccguguccgagcugcgccaaagagaggaagaguggcggcagaaggaagaggcgcucgugcagcgcgaaaagaugugucuguggagcacagaugccauuucuaaagacgucuuuaacaaguccuucaucaaucaggauaaaagaaaggacacggaggaugaggacaaaagcgaaucuuuuaugcaaaaguaugagcagaagauucggcauuucgggaugcugucccgcugggaugacagccagagauuucucucugaucaccccuaccuggugugcgaagagaccgcuaaauaucuuauccugugguguuuccaucucgaagccgagaagaaaggagcucugauggagcaaauugcccaccaggcgguugugaugcaguuuaucauggaaauggccaagaacugcaaugucgacccucggggcuguuuccgccuguuuuuccagaaagcuaaggccgaggaagagggcuacuuugaggcuuucaaaaacgaacuggaggccuucaaguccagagugcggcucuauagccaaucccagucuuuucagcccaugacaguucagaaucacgugccucauagcggggucggauccaucggccugcuggaaagccucccccaaaacccggauuaccugcaguauucuauuuccaccgcccuuugcagccuuaauucuguggugcacaaggaggacgacgaaccuaaaaugauggauacagucuga

SEQ ID NO: 67165 - RNA, 5160 nt, Artificial Sequence
  derived and/or modified sequence opt5 from CDC42BPA__Homo_sapiens__NP_003598
augagcggcgaggugagacugcggcagcucgaacaauucauccuggacgggcccgcccagaccaacggacagugcuuuuccgucgagacacuucuggauauucucaucugucuguacgacgaaugcaauaacucuccucuuagaagagagaagaauauucuggaauaucucgagugggcuaagccguucacguccaagguuaagcagaugcggcugcaccgcgaggauuuugaaauccugaaggugauuggcagaggggccuucggagagguggcggucgugaaacucaagaacgcugacaagguuuuugccaugaaaauccugaauaagugggaaaugcuuaaacgggccgagaccgcuuguuuccgcgaggaaagagaugugcuggucaacggcgacaauaaguggaucacaacccuccauuacgccuuucaagaugacaacaaucuguaucuugugauggauuacuauguugggggagaccugcucacacugcuguccaaauucgaggaucggcuccccgaagacauggcucgcuuuuaccuggccgagauggugauugcgaucgauucuguccaccagcuucauuaugugcacagagacauuaagccugacaacauccugauggauaugaauggccauauucggcucgccgacuucggcagcugccugaaacuuauggaagaugggaccgugcaguccucugucgcuguuggaacacccgacuacaucagcccugagauucugcaggccauggaggauggcaaagggcgcuacggacccgaaugugacugguggucccucggcgugugcauguaugagaugcuguacggggaaaccccuuuuuaugcugagagccugguggaaacguacggaaagaucaugaaccacaaagagagauuccaauuuccggcccaggucaccgaugugucugagaaugcgaaggaccucauccggcgccugauuuguuccagagaacaccggcuuggccagaacggcaucgaggauuucaaaaagcaucccuucuuuagcgggauugacugggauaauaucagaaacugcgaagccccuuauauucccgagguuucuuccccuacagacaccagcaacuucgacguggaugacgauugucugaaaaauucugaaacaaugcccccgccuacccacacggcuuuuuccggacaucaccuccccuucgucggcuuuacauacaccagcuccugcgugcugucugaccgcagcugucuucggguuacagccgggccuaccucccuggaucucgacgugaacguccagagaacccuggauaauaaccuggcuacagaggccuaugagcgccggaucaagagacucgaacaagagaagcuggaacuuagccgcaaacugcaggagucuacgcagaccgugcaagcccuccaguacuccacagucgacggaccccugaccgcuagcaaggaucuggagaucaaaaaucuuaaggaagagauugaaaaacuccggaaacaggugacagagucuagccaccuggaacagcaacuggaggaggcgaacgccguuagacaggaacucgacgaugcuuuccgccagaucaaggccuacgagaaacagauuaagacccugcaacaggaacgggaggaccuuaauaaagaacuggugcaggccuccgagagacucaagaaccagucuaaagagcugaaggaugcucauugccaacgcaagcuggccaugcaggaauuuauggagaucaaugaacggcuuacggagcuccacacacagaaacagaagcuggcgagacauguccgggacaaagaagaggagguggaccugguuaugcaaaagguggaaagccuccgccaggagcugagacggaccgaaagagcuaaaaaggagcuugagguccacaccgaagcccuggccgcugaggccuccaaggaucgcaaacuccgggaacagagcgagcauuauucuaagcaacuggaaaacgagcuggagggccuuaaacagaagcagauuuccuacagccccggggugugcucuaucgaacaccagcaagagaucacaaaacucaagaccgaccuggagaagaaguccauuuucuaugaggaggaacugagcaagagagagggaauccacgcuaaugaaauuaaaaaccucaagaaagagcugcaugauuccgaaggccagcagcuugcccugaauaaggagaucaugauucucaaagacaagcuggaaaagacacgcagagagucucagagcgagcgggaagaguuugaauccgaguucaaacaacaguacgagcgcgaaaaggugcugcuuacggaggaaaacaaaaagcucaccucugagcuggauaaacugacaacccucuaugaaaaucugagcauccacaaccagcagcuugaggaggaaguuaaggaccuggcggauaagaaagaguccgucgcccauugggaagcucaaauuacagagaucauccagugggugagcgacgaaaaggaugccagaggcuaccuccaggcucuggccucuaaaaugaccgaggagcuggaagcgcuucggaacuccagccuggggacgcgcgccaccgacaugccuuggaagaugagacgguuugcuaaacucgauaugucugcccgccuggagcuccaauccgcucuggacgccgaaauuagagccaagcaggcuauccaggaggaacuuaauaaggugaaagcgagcaacauuaucacagaguguaagcugaaagauucugagaagaaaaaucucgaacugcugagcgagauugaacagcuuaucaaggacaccgaggagcugcgguccgaaaaaggaaucgagcaccaagacagccagcacucuuuccucgccuuucugaacacaccgaccgaugcucucgaccaguucgaaacggucgauuccacaccccugagcgugcauaccccuacacuucgcaagaagggcugccccggguccaccggauucccucccaaaagaaagacccaccaguuuuucguuaaaucuuuuacaacgccgaccaagugucaucaaugcacaagccugauggugggccucauucggcagggguguuccugcgaggucuguggcuucucuugccacaucaccugugugaauaaagccccuacaaccugccccguuccucccgaacagacgaagggaccucugggcauugacccccagaaggggaucggaacagccuaugagggccaugugcgcauuccgaaaccugcuggggucaagaaaggauggcaacgcgcccuggcgaucgugugugauuuuaaacuuuuccuguacgacaucgcugagggcaaagccagccagcccuccguugugauuucucaggucaucgauaugcgggacgaagaguuuagcguguccagcgugcucgccucugaugucauucacgcuuccagaaaggacauccccugcauuuuccgcguuaccgccagccagcugucugcguccaacaauaagugcagcauccucaugcuggcugauaccgaaaacgagaaaaauaagugggugggggugcuuucugaacugcacaaaauccugaagaaaaacaaguuucgggacagauccgucuacgugccuaaggaggccuaugacagcacacucccgcugauuaaaaccacacaagccgcugccaucauugaucaugagcgcaucgcucuuggcaaugaagagggacuguucguugugcacgucacgaaggacgaaauuauccgggugggcgauaacaaaaagauucaucagaucgagcucauccccaaugaccagcugguugccgugauuuccgggagaaaccgccacguccggcucuuuccuaugagcgcgcuggauggaagagaaaccgacuucuacaaacuuucugagacaaagggcugucaaaccgugacaagcgggaagguucggcauggagcccugaccugccuguguguggcuaugaaacgccagguccucugcuaugagcuguuucaguccaagacgagacaccggaaauucaaggaaauccaggugcccuacaaugugcaauggauggccauuuucucugagcagcuuugugucggcuuucagagcggguuccugcgcuauccucucaacggcgaaggaaaccccuacuccaugcugcacucuaaugaucauacccucagcuuuaucgcucaccagccuauggacgccauuugcgccguugagaucuccucuaaagaguaucugcuuuguuucaacagcaucggcauuuacacagauugccaagggagacgguccagacagcaggaacugauguggcccgcuaauccgagcucuuguugcuacaacgcgccuuaucuguccguguacagcgagaaugccguggacaucuuugaugucaacucuauggaauggauucagacccucccccugaagaaagugcgcccucuuaauaacgagggaucccugaaucuccugggccucgaaacaauccggcugauuuauuucaagaacaagauggcugagggggacgagcuuguugugcccgaaaccagcgauaauuccagaaaacaaaugguccgcaacaucaauaacaagcggagauacucuuuucgcgugccggaggaagaacggaugcagcagagacgcgaaaugcugagagacccugagaugcggaauaaacugaucagcaaccccacaaacuucaaucauauugcccacaugggaccuggcgacgggauccaaauucucaaggaucugcccaugaacccccgcccucaggaguccagaaccguuuuuagcggcucuguguccaucccgagcauuacgaaaucucggcccgaaccuggacgcagcauguccgccucuagcggccuuuccgcuagaucuagcgcccagaauggguccgcgcugaagcgggaguucagcggaggcucuuauuccgcuaagagacagcccaugccuagccccuccgaagggucucucagcuccggaggcauggaccaaggcucugaugccccugcccgcgacuuugauggggaggacagcgauuccccgcggcacagcacagcuucuaacuccagcaaucugucuucucccccuagccccgccagcccuagaaaaaccaagagccugucccucgaaucuaccgaccgcggaagcugggaucccuga

SEQ ID NO: 67166 - RNA, 5136 nt, Artificial Sequence
  derived and/or modified sequence opt5 from CDC42BPB__Homo_sapiens__NP_006026
augagcgcuaaggugagacugaagaagcucgagcagcugcuucuggacggccccuggcggaacgaauccgcucucucugucgagacccugcuugauguucuggugugccucuacacagaauguagccacuccgcccugcgcagagacaaauauguggccgaguuccuggaaugggcuaagccuuuuacgcaacucgucaaagagaugcagcugcaccgggaggauuucgaaaucauuaaggugaucgggcgcggagccuuuggcgagguugccguggucaagaugaaaaauaccgaaagaauuuacgcuaugaagauccuuaacaaaugggagaugcugaagcgggccgagacagcuugcuuccgcgaagagagagacgugcucguuaauggggauugucaguggauuaccgcccugcacuaugcguuucaggacgaaaaccaucuuuaccuggugauggauuauuacgucggaggcgaccuccugacacugcucucuaaauucgaggauaagcugccggaagacauggcccgguuuuauaucggggagauggugcuugcuaucgauagcauucaccaacugcauuacgugcaccgcgacaucaagcccgauaauguccuccuggacguuaacggacacauuagacuugccgacuucggcuccugccugaaaaugaaugaugacggcaccgugcagucuagcguggcugucgggacaccugauuacaucucccccgagauucuccaggccauggaagacggaaugggcaaguaugggccugagugugauugguggagccugggagugugcauguacgaaaugcuguauggcgagacccccuuuuacgcggaaucucucguugagacguaugggaaaaucaugaaccaugaggaacgguuccaguuuccuucccacgugaccgacgucagcgaggaagccaaggaucugauucaacgccuuaucuguucuagagagcggcgccugggacagaauggcaucgaagacuucaaaaagcaugccuuuuucgagggccucaacugggagaauauuagaaaccuggaagccccguacauccccgauguguccagcccuucugacacauccaauuucgauguugacgacgaugugcuucggaacaccgagauucugcccccugggagccacacaggauuuuccggccuccaucugcccuucaucggguuuaccuucacgacagaaucuugcuuuagcgacagaggaucccugaaaagcauuaugcagucuaauacccucacaaaggaugaggacguccagcgcgaucuggagcauucccuucaaauggaggcuuaugagcggagaauccgccggcuggaacaggagaagcucgaacugagcagaaaacugcaggagucuacccaaaccgugcagagccuucacggcuccucucgcgcccucagcaacuccaaccgggacaaggagaucaaaaagcugaaugaagagauugaaagacugaaaaacaagaucgccgauagcaaucgccucgagcggcagcuggaagacacagucgcucuuagacaggagcgcgaggauucuacgcaacggcugagagggcucgaaaagcagcaucgggugguucgccaggagaaagaagaacugcacaagcagcugguggaagcguccgagagacuuaaaagccaagccaaggagcucaaagacgcucaucagcagcggaagcuggcccugcaggaguucucugagcucaacgaaagaauggccgagcugcgcgcucaaaagcagaaagucucccggcagcuuagagauaaggaggaagagauggaaguggccacccagaaaguugacgcgaugcgccaagagaugagacgggcugaaaagcugcgcaaagagcucgaggcccagcuggaugacgccguggcugaagccagcaaggagagaaagcugcgggaacacuccgagaauuuuuguaaacagauggaaucugagcuugaggcucucaaggucaaacaaggaggccgcggcgccggggcgacacuggaacaccagcaggagauuagcaagaucaaauccgaacuggagaagaaagugcuguucuacgaagaggagcuggugagacgggaagccucucauguucuugaggucaagaacgugaagaaagaagugcacgacagcgagucccaucagcuggcucuccaaaaggagauucugaugcugaaagauaaacuugaaaagagcaagcgcgagagacacaaugagauggaggaagccgucggaaccaucaaggacaaauacgagcgggagcgcgcuaugcucuuugaugaaaacaagaaacugacagccgagaaugaaaagcugugcucuuucguggacaaacucaccgcgcagaacagacagcuggaggaugaacuucaggaccuggccgcuaagaaggaguccguugcccacugggaggcucaaaucgccgaaauuauccagugggugagcgaugagaaagacgcccggggcuaucuccaggcucuggcgucuaagaugacggaagaacuggaagcccuuagauccagcucucuggggagccgcacacucgauccgcuguggaaaguccggagaucccagaagcucgacaugagcgcucgccuggagcuucaaucugcccuggaggccgaaauucgggcuaaacagcucgugcaggaggaacugagaaagguuaaggaugccaaucugacccuugaguccaaacugaaggacagcgaggcgaaaaaccgcgaacuccuggaggaaauggagauccucaagaaaaagauggaagagaaauuucgggcugauaccggacugaaacuuccugacuuccaagacuccauuuuugaguacuucaauacagcgccccuggcccaugaucucaccuucagaacaucuagcgcuuccgaacaggagacgcaggccccuaagcccgaagcgucucccagcauguccguggcugccucugagcagcaagaagacauggcccgcccuccgcagcggcccagcgcugucccucugcccaccacacaggcccuggcucuugccggcccuaaacccaaggcgcaccaguuuuccaucaagagcuucucuuccccgacccaauguagccauugcacaucucugaugguggggcucauuagacagggcuaugccugcgagguuuguuccuuugcuugccacgugagcuguaaggauggagccccucaggucugccccaucccucccgagcagucuaaacggccucugggcguggacgugcaacgcgggaucggaaccgcuuacaagggccaugucaagguucccaaaccgacgggggugaagaaaggauggcagagagccuaugccguggucugugauugcaaacucuuccuguacgaccuuccugaaggcaaauccacccagcccggggugauugcuagccagguucuggaucugcgggacgaugaguuuuccgugagcucuguccucgcgagcgacgugauccacgccacacgcagagauauucccuguaucuuccggguuaccgcuucccugcuuggcgccccuucuaagacaagcucccugcucauucugaccgaaaacgagaaugaaaagagaaaaugggugggaauccucgagggccugcaaucuauccuucacaagaaccgccugcggaaccaggucgugcauguuccgcuggaggccuaugacagcucccucccccugauuaaagcuauccuuacggccgcgauuguggacgcugauagaaucgccgucgggcuggaagagggacucuacgugauugaagugacacgcgacgucaucguucgggccgcugauugcaagaaagugcaccagaucgagcuggccccuagagagaagauugugauccuccuguguggccgcaaucaucacguccaucuuuaccccuggucuagccuggacggggcggaaggauccuuugauauuaagcugccugagaccaaaggcugccaacucauggcuacagccacccugaagcggaacagcgggaccugucuuuucguggccguuaaaagacugauccucugcuaugaaauucagcgcacaaagcccuuucacagaaaauucaaugagaucguggcuccuggcucuguccagugccuggccgugcuccgggaccgccuguguguuggauaccccuccggcuuuugccuucugagcauccagggggauggacaaccgcugaaccucgugaauccuaacgaccccucucuggcuuuccuuucccagcagagcuuugaugcccugugugcggucgaacucgaguccgaggaauaucugcugugcuucucucacaugggccucuacguggacccucaggggagacgggcccgcgcucaagagcuuauguggcccgccgcuccggucgccuguagcugcuccccuacgcaugugaccguuuauagcgaauacggaguggaugucuucgacgugagaacaauggaguggguucagaccauuggccugcggagaauccgcccccucaauucugaagggacacucaaccugcuuaauugugagccuccccggcugauuuauuuuaaguccaaguucagcggcgccgugcucaacguccccgauaccucugacaauagcaaaaagcagaugcugagaacgcgcuccaaacggagauuuguguucaaggugccugaggaagaacggcugcagcaacgcagagaaaugcuccgggacccggagcuucgcucuaaaaugaucagcaaccccacaaauuuuaaccacguugcucauaugggaccuggcgaugggaugcagguccugauggaccugccccucuccgcggugccucccucucaggaagagagaccuggaccggcccccaccaaucuggcucggcaaccucccagccgcaacaagccuuacauuuccuggcccagcucuggcggguccgagccgagcgugaccgucccucuuagauccaugucugaucccgaccaggauuucgacaaagaacccgauagcgacuccacaaagcacucuaccccuagcaacuccagcaaucccucuggaccuccgucccccaacagcccucaccggucucagcugccccucgagggccuggaacagccugccugcgauacauga

SEQ ID NO: 67167 - RNA, 4656 nt, Artificial Sequence
  derived and/or modified sequence opt5 from CDC42BPG__Homo_sapiens__NP_059995
auggagagacggcugcgcgcccucgaacagcuggcuagaggcgaggccgggggaugccccggccuugacgggcugcucgaucugcuucuggcgcuccaccaugaacugagcuccggaccucugcggcgcgagagaucuguggcucaauuccucagcugggccuccccguuugucucuaagguuaaagaacugcggcuucagcgcgacgauuucgagauccugaaggugauuggcagaggggccuuuggagaggugaccgucgugcggcagcgcgacacaggccagaucuucgcuaugaaaaugcuccacaagugggaaaugcugaaaagagccgagacggcuuguuuucgggaggaacgcgauguucuugugaagggcgacagcagaugggucaccacacugcauuacgccuuccaagaugaggaauaucucuaccuggugauggacuauuacgcugggggagaucugcucacccugcuuucccgguuugaggaccgccugcccccugaacucgcccaguucuaucuggcugagaugguucuugccauucacucucugcaucagcucggcuacgugcacagagaugucaagcccgacaacgugcugcuggaugugaaugggcacauccggcucgcugacuuuggaagcugccugagacuuaacacaaauggcauggucgacuccagcguugccguggggaccccugauuauauuucucccgaaauccugcaggcgauggaggagggaaaaggccauuacggcccucaaugugacugguggucccucggggugugcgccuacgaacugcuuuucggagagacaccguuuuaugcugaaagccuggucgagaccuacggcaagaucaugaaccacgaagaucaucuccaguuucccccugacgugcccgauguuccugccucugcucaggaccugauucgccagcugcucugucggcaagaggagagacuggggcgcggaggccuugaugacuuccggaaucaccccuucuucgaagggguggauugggagagacuggccuccagcacggccccguauaucccugaacuccgcggacccauggacaccucuaacuuugaugucgacgacgauacacugaaucacccuggcacccugcccccucccucccauggcgcuuucagcgggcaccaucuuccguuugugggauucacauacaccuccggcucucacagccccgaguccagcucugaagcgugggccgcucucgagcggaaacugcagugccuggagcaggaaaagguugagcucuccagaaaacaucaagaagcccugcacgccccuacggaccaccgcgagcuugagcagcugcggaaggaagugcagacacucagagaucgccugcccgagaugcugcgggacaaggcuagccuuucucagaccgaugggccucccgccggaagcccgggccaagacuccgaucucagacaggaacuggaccggcugcaucgcgagcucgcggaagggagagcuggccugcaggcccaggagcaagagcuuugucgggcccagggacagcaggaggaacugcuccaaagacugcaggaagcucaggagcgcgaagccgcuacagccucucagacccgggcgcugagcucccaacuugaggaggccagagcugcccagcgcgaacucgaggcucaggucagcucucuguccagacaagugacccagcugcagggccagugggaacaacggcucgaggaaagcucucaggccaaaacaauucacacggcguccgagaccaacgggaugggaccucccgagggcgggccucaggaagcccagcugcgcaaggaggucgcugcccuuagagaacaacuggagcaggcucauagccaccggcccuccggaaaagaggaagcccucugccagcugcaggaggaaaaucgcagacugucucgggagcaagaacgccuugaggccgagcucgcucaggaacaggagagcaagcaaagacuggaaggcgagcggcgcgaaacagaguccaacugggaggcgcagcuggccgauauccucucuugggugaaugacgaaaaaguuagcagaggguaucugcaggcucuugccaccaagauggccgaggaacuggagucccuccggaacgugggcacacagacccugccugcuagaccccuggaucaccaauggaaagcccgccggcuucagaagauggaagcgagcgcuagacuggagcuccagucugcccuggaggccgaaauucgcgcuaagcagggacuccaagagcggcugacgcagguccaggaagcccagcuucaagcggagagacgccugcaggaggcugaaaaacagucccaggcccuccaacaggagcuggccaugcugcgggaggaacuuagagcucgcggcccgguggacacaaagccuagcaauucucugauccccuuucucuccuuccggagcucugaaaaagauagcgccaaggaccccgggauuuccggagaggcuaccagacauggcggggagccugaccugcggccggaaggacgcagaagccuccggaugggcgccguuuuuccccgcgcgccuaccgccaacacagcuucuaccgaggggcugcccgccaaaccuggcucccacacacuuagaccccggagcuucccuucccccacgaagugucugagaugcaccucucucaugcugggacugggccgccaggggcuuggaugugaugcuugcggcuacuuuugccauacaaccugugccccgcaagccccucccugcccugugcccccggaccugcuccggacagcucuggggguccacccugaaaccggaacgggcaccgcguaugagggguuccucagcgugcccagaccuuccggcgugcgccggggauggcagagaguuuuugccgcucugucugauagccgccuucugcuguucgacgcccccgaucuccggcugucucccccuuccggcgcccuucugcagguccucgaccugagagauccgcaguuuagcgcuacacccgugcucgccuccgacgugauccaugcgcaaagccgcgaucugccuagaaucuuccgggucaccacaucucagcuugcugugcccccuaccacguguacaguucugcugcucgccgaauccgagggggagcgcgaaagauggcuucaggugcugggagagcugcagcggcuccugcucgacgcccgccccagaccucggccggucuacacccugaaggaagcguacgauaauggccuuccccugcugccucacacacucugcgccgcgauucuggaccaagauagacuugcucuggggaccgaggaaggacucuucgugauccaucugcgcagcaacgacauuuuucagguuggcgagugucggagagugcagcagcucacccugucucccuccgccggccuucuggucgugcugugcgggcgcggaccuagcguuagacucuucgcccuggcugagcuugaaaacaucgagguggccggcgcuaaaauucccgaaucucgggggugucaaguccuggccgcgggauccauccuccaggcccggacaccggugcugugcguggcugucaagcgccagguucuguguuaucaacucggcccugggcccggacccuggcagagacggauccgcgagcuucaggccccugcuacggugcagagccugggccugcucggcgacagacugugcgugggggccgccggaggcuuugcucuuuacccccugcucaaugaggcggccccucuggcucugggggccggacucgucccggaggaacuucccccuucccggggcgggcugggagaagcccugggcgcuguggagcucagccugucugaguuccuucugcucuuuaccacagccggcauuuauguugauggggcgggacgcaaaagcagaggccacgaacugcuguggcccgcugccccuaugggguggggauacgccgcucccuaucucaccguguucuccgagaacucuaucgacgucuuugaugugcggcgcgccgaauggguucaaacagugccgcuuaagaaagucagaccucugaaucccgagggcagccuguuccucuacgggaccgaaaaggugcggcugacguaucuuagaaaccagcuggcggagaaggacgaauuugauauuccugaccucacagauaauucccgccggcagcuguucagaaccaaaucuaagcgccgguuuuucuuuagaguuagcgaggagcagcaaaaacagcagcgccgggaaaugcugaaggaccccuucgugagauccaaacucaucucuccucccaccaacuucaaucaccuuguccaugugggaccggccaacggccgcccuggcgcucgggauaagagccccgcccccgaggaaaaggggagaguggcucgcggauccggcccucagcggccgcacagcuuuucugaggcccugagacgccccgcuuccauggggagcgaaggacugggcggggacgccgauccuaugaaaagaaagcccuggacaucucucuccagcgaguccgucucuuguccucaaggaagccugucccccgcgaccagccuuaugcagguuucugagcggccucgcucccugccgcucagccccgaacuggagucuagcccuuga

SEQ ID NO: 67168 - RNA, 1176 nt, Artificial Sequence
  derived and/or modified sequence opt5 from CDC42EP1__Homo_sapiens__NP_689449
augcccggcccucaagggggaagaggcgccgcuaccaugagccuggggaagcucuccccggugggaugggucucuagcucccagggcaaacggcgccugacagccgacaugaucucucacccccuuggggauuucagacauacgaugcacguuggacggggcggcgacguguuuggggauaccagcuuccuguccaaccauggaggcucuagcggguccacacaccgcagcccuagaucuuuucucgcgaagaaacugcagcuugugcggcgcgucggagcucccccuagacggauggccuccccucccgccccgagccccgcuccucccgccauuucuccuaucauuaagaaugcuaucucccugccccagcucaaccaggccgcguacgacagccuggugguuggcaaacugucuuucgauuccagcccgaccuccucuacagacgggcauagcuccuauggacucgauagcggcuuuugcaccauuucucgccugccuagauccgagaagccccacgaccgggaucgcgacggcagcuucccuucugaacccgggcuuagacggagcgauucccugcucucuuuucgccuggaccuugaucugggacccagccuccuguccgagcugcucggcgugaugagccugccugaagccccggcugccgagacacccgcuccugccgcgaaucccccugcccccaccgcuaacccgacggggccugccgcuaaucccccugccaccacagccaaucccccugcucccgcggccaacccgucugcuccugccgccacccccacaggacccgcugccaacccuccggcgcccgcugccuccagcaccccucacggccauugucccaauggggucacggccggacuuggcccuguggcugaaguuaagucuucccccgugggcgggggaccuagaggccccgccgggccggcucugggacggcacuggggcgccgggugggacggcggacaucacuacccugagauggacgcgagacaagagcgcgucgaagugcucccccaggcccgggcuagcugggagucccuggaugaagaguggagagccccucaggcuggcucucgcacacccgugccgagcaccguccaggccaacacauucgaguuugcggacgccgaagaggaugacgaaguuaaaguguga

SEQ ID NO: 67169 - RNA, 765 nt, Artificial Sequence
  derived and/or modified sequence opt5 from CDC42EP3__Homo_sapiens__NP_006440
augcccgccaagaccccuaucuaccugaaagcugccaacaauaagaaaggcaagaaauucaagcucagagacauucugagcccggauaugaucucucccccucuuggggacuuucggcacacaauucauaucggaaaggagggccagcacgauguguucggggacauuuccuuucugcaaggaaacuaugaacuccugcccggcaaucaggagaaagcgcaucuugggcaguucccuggacacaacgaauuuuuccgcgcuaauagcacguccgauucugucuuuaccgagacacccagcccuguucugaagaacgccaucucccucccgaccaucggcggcucucaggcccugaugcugccccuccugagcccugugacauucaauuccaaacaagagagcuuugggcccgcuaaacuuccuagacugucuugcgaacccgugauggaggaaaaggcccaggagaaguccagccuccuggaaaacggaaccguccaucagggcgacacaucuuggggguccagcggaucugcuucccagagcucccaaggccgggauucucacagcuccagccuuucugagcaguacccggacuggccugccgaggauauguucgaccaccccaccccuugugaacugauuaaggggaaaacgaaguccgaggaaagccucucugaucugaccggaagccugcucucccugcagcuugaccugggccccucucuccuggaugaggugcuuaauguuauggacaaaaacaaguga

SEQ ID NO: 67170 - RNA, 255 nt, Artificial Sequence
  derived and/or modified sequence opt5 from CDC42SE2__Homo_sapiens__NP_001033791
augagcgaguucuggcugugcuuuaacuguugcaucgccgaacagccccaaccuaagagacggcgcagaauugaccgguccaugaucggcgagccgaccaauuucgugcacacagcucaugucgggucuggagaucucuuuagcggcaugaacuccguuucuagcauucagaaucagaugcaguccaaagggggauacggcgggggaaugcccgccaacgugcaaaugcagcugguggacacgaaggcgggcuga

SEQ ID NO: 67171 - RNA, 1797 nt, Artificial Sequence
  derived and/or modified sequence opt5 from CDC45__Homo_sapiens__XP_005261342
auguucgugagcgacuuuagaaaggaguucuacgaagucguucagucccaacgggugcugcucuuuguggccucugaugucgacgcucugugcgccuguaaaauccuucaggcgcuguuccagugcgaucacgugcaguauacccucguucccgugagcggcuggcaagagcuggaaacagcuuuucuugagcauaaggaacaguuccacuacuuuauucugaucaacuguggggccaaugucgaccuccuggauauucugcagccugacgaggauacgaucuucuuugugugcgacacccaucgcccgguuaacguggucaauguguauaacgauacacagauuaaacuccugaucaagcaagacgaugaccuugaggugcccgccuacgaagauaucuucagagacgaggaagaggacgaggaacacuccggaaaugauucugacggcagcgagccuuccgaaaaacggacccgccuggaggaagagauugucgagcagacaaugagacggcgccagagacgggaaugggaggcucgcucugggagcggauccgaacccguugccgcugcccucgaaaagagcucuagacuguuugcgggcccuauguccgaucggaccgcuccccgcagcccuagacgggacauccuuuucgauuaugagcaguacgaguaucaugggacaucuuccgccauggugauguuugagcuggccuggaugcucagcaaggaccugaacgauaugcuguggugggcuauugugggacucaccgaccaauggguccaggauaaaaucacgcagaugaaguacgugaccgacguuggcgugcugcaacgccacgucucuagacacaaucaucggaacgaagaugaggaaaauacacuuuccguggacuguaccagaauuagcuucgaguacgaccugcgccucguucuguaucagcacuggucccuucaugauucucugugcaacacaagcuacaccgccgcgcgguucaaacucugguccgugcacggccagaagagacugcaggaauuucuggccgacauggggcucccgcugaaacaagucaagcagaaguuccaggcuauggauaucagccuuaaagagaaucugcgcgagaugauugaagagucugccaacaaguuuggaaugaaagacaugcgggugcagacguucuccauccacuuuggcuucaagcauaaauuucucgcuagcgaugucguguucgccacaaugucucugauggaaagccccgagaaggacggguccggaaccgaucacuuuauccaagcccuugacucucugagcagauccaaucucgauaaacuguaucauggccuggagcucgcuaagaagcagcugcgcgcgacacagcagaccauugccagcugucuuugcaccaaccugguuaucucucaagggccuuuccucuacuguucccugauggaaggaacacccgacgugaugcuguuuagccggccugcuucucuuucccuccugagcaaacaucugcucaaguccuucgucugcucuacgaaaaauagacgcuguaagcugcuuccccuggugauggccgccccgcucagcauggagcacggcaccguuacaguggucggcauuccucccgaaaccgauuccucugaccggaaaaacuuuuucgggagagcuuucgagaaggccgcggaaagcacauccagccgcaugcugcacaaccacuuugaucugucugugaucgagcuuaaggcugaggaccgguccaaauuccucgacgcccugauuagccugcucucuuga

SEQ ID NO: 67172 - RNA, 2409 nt, Artificial Sequence
  derived and/or modified sequence opt5 from CDC5L__Homo_sapiens__NP_001244
augcccagaaucaugauuaagggcgggguguggcggaacaccgaggacgaaauccugaaagccgcugucaugaaguacggaaagaaucaguggagccgcauugccucccuccugcacagaaagucugcgaaacaaugcaaggcucggugguaugaguggcuugauccuagcaucaagaaaacagaauggucccgcgaggaagaggagaagcugcuccaucuggccaaacuuaugccgacgcaguggagaaccauugcccccaucaucggccggacagcugcccagugucuggaacacuacgaguuccuccuggacaaggcugcccagcgcgauaacgaagaggagaccacagacgauccuagaaaacugaagcccggggaaauugacccuaaucccgagaccaagccugcgcggccggaucccaucgacauggaugaagacgagcucgaaaugcugucugaggcccgcgcuagacuugccaacacacaagggaaaaaggcuaaacggaaggcccgcgagaaacagcuggaagaggcgagacggcucgccgcucugcagaagcgcagagaacuucgggccgcuggcauugagauccagaaaaagagaaagcgcaaacggggaguugauuauaaugccgaaauuccuuuugagaagaaacccgcccugggauucuacgacaccagcgaggaaaacuaucaagcucucgaugcggacuuuagaaagcugcgccagcaggaccuggauggcgagcuccgguccgaaaaagagggcagagaccgcaagaaggauaaacagcaucugaagcggaaaaaggaaucugaccuuccuagcgccauccugcaaacguccggggugagcgaguucaccaaaaagagaucuaagcucgugcugcccgcuccgcagauuuccgaugccgagcuucaggaagucgugaaaguuggacaagccagcgagaucgcucgccagacagccgaagagucuggcaucaccaauuccgcgagcucuacacugcucuccgaguacaacgugaccaauaacagcgucgcucugcggacgccuagaacacccgccucccaggaccgcauucugcaggaagcccaaaaucucauggcucugaccaacguggauacaccucuuaaagggggacugaauacaccccuccacgagucugacuuuagcggcguuacgccccagagacaggugguccagaccccuaacaccgugcuguccaccccguuccggacacccagcaauggggccgaaggacuuaccccucggucuggcacaacccccaaaccugugaucaacuccacgcccggccgcacaccgcugagagauaagcucaacauuaauccugaggacgggauggcugauuauagcgaccccucuuacgucaaacaaauggaacgggagagcagagagcaucugcgccugggacuccugggccuuccugcccccaagaacgacuuugaaaucguucugccugagaaugcggaaaaggagcucgaggaacgggagauugaugacaccuacaucgaagaugccgcugacguggaugccagaaaacaggcuauccgcgacgccgagagagugaaggaaaugaaacggaugcacaaggcgguccagaaagaucugccccgcccguccgaggugaacgaaaccauucugagaccucuuaauguugagccuccccucacagaccugcagaagucugaggaacugaucaaaaaggagaugauuaccaugcuccacuaugaucugcuucaucaccccuacgaaccgagcgggaacaagaaaggaaagacagugggcuucgggacgaauaacuccgagcauaucaccuaucuggagcacaaucccuacgaaaaauuuagcaaggaggaacucaaaaaggcccaagacguccuggugcaggagauggaaguugugaagcagggaaugucucacggcgagcuguccagcgaggcuuauaaccaggucugggaagagugcuacucucaagugcuuuaucucccuggccagucccgguacacacgcgccaaucuggcuagcaaaaaggauagaauugaaucccuggagaaacggcucgaaaucaaccgcgggcauaugaccacagaggccaagagagccgcuaaaauggagaagaagaugaaaauccugcuuggaggcuaccagucucgggcgauggggcugaugaagcaacucaaugaccugugggaucagauugaacaggcccaccuggagcuucgcaccuucgaggaacucaaaaagcaugaagacagcgcuauccccagacggcuggagugucugaaagaggacguccagagacaacaggaacgcgagaaggaacuccagcaccgguaugccgaucugcuucuggagaaggagacgcucaaauccaaguuuuga

SEQ ID NO: 67173 - RNA, 1683 nt, Artificial Sequence
  derived and/or modified sequence opt5 from CDC6__Homo_sapiens__NP_001245
augccccagaccagaagccaagcccaggcuacaaucuccuucccuaagcggaaacugucucgcgcccucaacaaggcgaaaaauagcuccgacgcuaagcuggagccgacgaacgugcagaccgucacaugcucucccagaguuaaagcccuuccucugagcccccggaagcgccucggcgaugacaaucuguguaacaccccucaccuucccccuugcuccccgcccaagcaggggaaaaaggaaaauggaccuccccauucucacacacugaaaggcagacggcucguguuugauaaccaacugaccauuaagagcccuuccaaacgcgagcuggccaaggugcaucagaauaagauccucagcucugucagaaaaucccaggaaauuacaaccaacagcgagcagcgguguccccugaagaaagaaucugcuugcgugcgccuuuucaagcaagaggggacguguuaccagcaggccaaacugguucucaauaccgcugugccggacagacugccugcccgggagcgcgaaauggaugucaucagaaacuuucuucgggagcacauuugcggaaagaaagcgggcucccuguaucucagcggggcccccggaacaggcaagaccgcuugucugucucgcauccugcaggaccucaagaaagaacugaagggcuucaaaacaaucaugcuuaauugcaugucccugagaaccgcccaagcuguguuuccugccauugcgcaggagaucugucaggaggaaguuagccggcccgccgggaaggauaugaugagaaaacucgagaagcauaugacggcugaaaagggacccaugauugugcugguccuugacgagauggaucaacuggacuccaaaggccaggaugugcucuacacacuguucgaauggccuuggcugucuaacagccaccucgugcugaucgggauugccaauacccuugaccugacagaucgcauccucccgcggcugcaggcuagagagaagugcaaaccccagcuucugaacuuuccucccuauacccgcaaucaaauugucaccauccuccaggaccggcugaaccagguuuccagagaccaggugcuggauaacgccgccgugcaauucugugcucgcaaggucagcgcggugucuggagacguucggaaagcccucgaugugugcagacgcgcuaucgagauugucgaauccgacguuaagagccagacaauccugaagccucuuucugagugcaaaagccccuccgaaccgcugauuccuaagcgggugggccucauccacauuucucaggugaucagcgaggucgaugggaauagaaugacgcugucccaggaaggagcccaagacagcuuuccccugcagcagaaaauccuuguguguucucucaugcugcugauucgccagcucaagaucaaagaggucacccugggcaaacuuuacgaggccuauuccaaggugugccggaagcaacagguugcugccguggaucagagcgaaugucugucucucuccggccugcuggaggcgagagggauucuuggacucaagcggaacaaagaaacacgccugaccaaggucuucuuuaaaaucgaggaaaaggagauugagcaugcucugaaagacaaggcccucaucggcaauauccuggccacagggcuuccuuga

SEQ ID NO: 67174 - RNA, 1596 nt, Artificial Sequence
  derived and/or modified sequence opt5 from CDC73__Homo_sapiens__NP_078805
auggccgacgugcugagcguccucagacaguacaacauccaaaagaaagagauuguugugaagggcgaugaagugaucuucggggaguuuuccuggcccaaaaaugucaagaccaacuaugugguuuggggaacaggcaaagaagggcagccucgggaguacuauacgcuggacucuauucuuuuccugcucaauaacgugcaccugagccauccggucuacgugcgcagagcugccaccgaaaauauccccguugugcggcgcccugauagaaaggaccuucugggauaucucaacggcgaggcguccacaucugcuagcauugaucgguccgcuccccuggagaucgggcugcagcgcucuacccaggucaagagagccgccgacgaagugcucgccgaggcuaaaaagccucggaucgaagaugaggagugcgugcgccuggacaaagaaagacuugccgcgcggcuggagggacacaaggaaggcauuguccaaacagagcagauccgcagccucuccgaagccaugagcguugagaaaauugcugccaucaaggcuaagauuauggccaaaaagagaucuaccaucaaaacagaucuggacgaugacauuaccgcgcuuaagcagcgguccuuuguggaugccgagguggacgucacgcgcgacaucgugagcagagaacggguuuggagaacccgcacaaccauccugcagucuacaggcaaaaauuucuccaagaacauuuuugcuauccuccaaagcgugaaagcccgggaggaagggagagcucccgagcagcgcccugccccgaaugccgcucccgucgauccuacccugcggacgaagcagcccauuccugcggccuacaacagauaugaccaggaacgcuucaagggaaaagaggagacagaaggcuuuaagaucgauaccauggggacauaccauggaaugacccugaaaucugugaccgagggcgcuuccgcccggaagacacaaacgcccgccgcucagccgguuccuagacccgugagccaggcccgcccuccucccaaucagaaaaaggggucccggacccccauuaucaucauuccggcggcuacaaccucucucaucacaaugcugaacgccaaggaccuucugcaagaucucaaauucguccccagcgacgaaaagaaaaagcagggaugucagagagagaaugaaacccugauucaacgccggaaagaucagaugcagccuggcggcacggccaucuccgugacaguccccuacagagugguugaccagccucuuaagcugaugccccaagauugggaccggguggucgcuguguuuguucaggggccggccuggcaguucaagggauggccuuggcuccugcccgauggcagcccuguggacauuuuugcuaaaaucaaggccuuccaccugaaauaugacgagguccgccucgaucccaacgugcagaagugggacgugaccguucuggagcuuucuuaccauaaaagacaccuggaucggccugucuuucucagauucugggaaacccuggaccgcuauauggugaagcacaagucccaucuucgguucuga

SEQ ID NO: 67175 - RNA, 1725 nt, Artificial Sequence
  derived and/or modified sequence opt5 from CDC7__Homo_sapiens__XP_011540528
auggaggccagccugggcauccagauggacgaacccauggcuuucuccccucaaagagaucgguuucaggccgaggggucucucaagaaaaacgaacagaauuucaagcuggcgggagugaaaaaggacauugagaaacuuuacgaagcugucccgcagcugagcaacguuuuuaagaucgaggauaagauuggcgaggggaccuucuccucuguguaucucgccacagcccaacuucaggugggacccgaagagaaaaucgcucugaagcaccugauuccuacgagccaucccauccgcaucgccgcugaacuccagugccugaccgucgccggcgggcaggacaaugugaugggaguuaaauacuguuuuagaaagaacgaucacguggucauugcgaugccuuaucuggagcaugaguccuuccucgacauccuuaauucucugagcuuucaagaagugcgggaguacaugcugaaccucuucaaagcccugaagcgcauucaccaguuuggcaucguucauagagaugugaagcccuccaauuuccuuuauaaccggcgccugaaaaaguacgcucucgucgacuuuggccuggcccaggggacacacgauaccaaaauugaacugcucaaguucgugcagagcgaggcucaacaggaaagaugcucucagaauaaaucccacaucauuacaggaaacaagaucccucugagcggcccggugcccaaagagcuugaccaacagucuaccacaaaggccuccgucaagcggccuuauaccaaugcgcagauccagauuaaacaagggaaggauggaaaagagggcagcguugggcugucugugcagcgcuccguguuuggagaaagaaacuucaauauccauagcuccauuucucacgagagccccgccgucaagcucaugaaacaguccaagacgguggacguucugagccggaaacuugcuaccaaaaagaaagccaucucuacaaaggugaugaacuccgcugucaugcgcaaaaccgccagcucuuguccugccagccugacaugcgauuguuacgcuaccgacaaggugugcuccauuugucucucuagacggcagcaaguugcgccccgcgccggcacgccgggcuucagagcuccugaagugcugacaaagugccccaaucagaccacagccaucgacauguggagcgccggggucaucuuucugucccuccugagcggacgguacccuuucuauaaggcuucugaugaccuuaccgcccuggcgcagauuaugaccaucagaggcucccgcgagacaauucaggcugccaagacguuugggaaaagcauccucuguucuaaggaagugcccgcccaagaucugcggaaacuuugcgagagacugcgcggaauggacuccagcacccccaagcucacauccgauauucagggccaugcuucucaccagccugccaucagcgagaagaccgaccacaaggcuuccugucugguccagacaccgcccgggcaauacucuggaaacagcuucaagaaaggcgauuccaacagcugcgaacauugcuuugacgaguauaauaccaaccuggaaggcuggaaugaggugccugaugaagccuacgaccuccuggauaaacuucuggaccucaaccccgcgucucggaucacggccgaggaggcucugcugcacccuuucuuuaaagacaugucccuuuga

SEQ ID NO: 67176 - RNA, 3072 nt, Artificial Sequence
  derived and/or modified sequence opt5 from CDCA2__Homo_sapiens__NP_689775
auggacgccaacagcaaggauaaacccccugagaccaaggaauccgcuaugaauaacgccggcaaugcgucuuucauccuggggacaggaaaaauugugacgccgcagaagcacgcugagcugcccccuaaccccugcaccccugacacauuuaaaagcccccucaauuucuccaccgucacaguugaacaacuuggcaucaccccugagucuuuugugagaaacagcgccgggaaguccucuagcuaccugaagaaaugucggcgcagauccgccgugggagcucggggcagcccggaaacaaaucaucucauucgcuucaucgccagacagcagaacauuaagaaugcucggaaaucuccccuggcccaggauuccccuagccaagggucucccgcgcuuuaucgcaacgucaauacccugagagagcggaucuccgccuuucagagcgcuuuccacucuaucaaggagaacgaaaagaugacgggaugccucgaguuuuccgaagccggcaaggagagcgagaugaccgaccugacacgcaaggaaggccuguccgcuugucagcagucuggguucccugccgugcucagcuccaaaagacggcgcauuagcuaccaaagagauucugacgagaaucugaccgaugcggaaggaaagguuaucggccuucagauuuuuaacaucgacacagaucgggccugcgcuguggagaccuccgucgaccugagcgaaauuucuagcaaacucggguccacgcagucuggauuccugguggaggagagccuuccccuguccgaacucacagagaccagcaaugcccugaagguugcugauuguguggucggcaaagggucuuccgacgccgugagcccggauacauuuaccgccgaagugucuuccgacgcugucccugacguucgcagccccgcgaccccugccugcagacgggaucugcccacacccaagacguucgugcucagauccgugcugaaaaagccuucugucaagaugugucuugagagccugcaggaacauugcaacaaccucuaugacgaugacggaacccacccgucccugaucucuaaucuucccaacuguugcaaagagaaggaggcugaagaugaggaaaauuuugaggccccugccuuccugaacaugcgcaaacggaagagagugacauucggcgaagaccucagccccgagguuuuugaugagucccugccugcuaauacaccccugcgcaaaggcgggaccccgguguguaagaaggacuucagcggacucucuucccugcuucuggaacaaagcccuguccccgagccucucccccagccugauuuugacgauaaaggcgaaaaccuggagaauauugagccccuucaggugucuuucgccguucuguccagcccgaacaagucuagcaucuccgaaacccucagcgggacggacacauuuucuuccagcaauaaccaugagaaaaucuccucuccuaaggugggacggauuaccagaaccagcaaucgccggaaccaacuggucuccguggucgaagagucugugugcaaucugcucaacacagaaguucagcccugcaaagagaagaagaucaauagacgcaaaagccaggagaccaaguguacaaaacgggcgcugcccaagaaaucccaggugcuuaagucuugcagaaagaaaaagggcaaagggaagaaaagcguccaaaagucccuguacggagaacgcgacauugcuagcaaaaagccucuccugucuccgauccccgagcugccugaagugcccgagaugacgccuuccauucccagcauccggagacuuggcucuggcuauuucuccagcaacgggaagcucgaagagguuaaaaccccuaagaaccccgugaaacggaaggaucugcugcgccacgacccggaucuccacaugcaucagggauacgacaaauaugaugucucugaguuuuguuccuacaucaagagcuccagcucucugggcaaugccacaagcgacgaagauccuaacaccaauauuaugaacaucaaugagaacaagaauauucccaaagccaagaacaaauccgaaucugagaaugaaccuaaggcugggacagacagccccguguccugcgccucugugaccgaggagagaguugcuagcgauuccccgaaaccugcccuuacgcugcagcagggacaagaguucucugcgggcgggcagaacgccgagaaucucugucaguuuuucaagaucagccccgaccugaacauuaagugcgaacggaaagaugacuuucugggcgcugccgagggaaaacuucaguguaauagacucaugccuaacucccaaaaagauugccacugucugggcgacguccugaucgagaauaccaaggaaagcaaaucucaguccgaggaccucgggcgcaagcccauggaaagcagcuccguggugagcugccgggauagaaaggaccgcagacgguccauguguuacucugauggacgcagccugcaucuugagaaaaacggcaaccacacacccuccagcucugucggguccagcguggaaaucucucuggagaauagcgaacucuucaaggaccuguccgaugcuauugaacagaccuuucagagacggaacucugagacaaaaguucgcagaagcacccggcugcaaaaggaccuugaaaaugagggacucguguggaucucccugccucugccgucuacgagccagaaagccaagcgcagaacaauuugcaccuucgauuccagcggcuucgaaucuaugucccccaucaaagagacagucagcucccggcagaagccucaaauggcgcccccugugucugaccccgagaacagccaggggccugccgcuggcuccucugaugaaccgggaaagcgcagaaaaucuuuuugcauuuccacccucgccaauaccaaggcuacaagccaguucaaaggcuaucggagacggucuucccugaacgggaagggagagagcucucuuacggcccuggaacgcaucgagcacaauggcgaaagaaaacaguga

SEQ ID NO: 67177 - RNA, 807 nt, Artificial Sequence
  derived and/or modified sequence opt5 from CDCA3__Homo_sapiens__NP_112589
augggcagcgccaaguccgugcccgucaccccugcuagaccgcccccucacaacaaacaucuggcccggguugcggacccccgcucuccuagcgcugggauccucagaacacccauucagguggaguccucuccucaaccgggacugcccgccggcgaacagcuugaggggcugaagcacgcccaggauagcgacccucggucccccacgcucggaaucgcucgcaccccuaugaaaacaucuagcggcgaucccccguccccucuggugaagcagcuuagcgaagucuucgagaccgaagacucuaaauccaaucugcccccugagcccgugcugcccccugaggccccgcucagcucugaacuggaucucccccuggggacacaacuuuccguugaggaacagaugccucccuggaaccagaccgaguuuccuagcaaacagguguucucuaaggaggaagcuagacaacccacagagaccccggucgccucccagagcuccgacaagccuucucgggaucccgaaacgccucgcagcuccggaagcaugagaaaucgguggaagcccaacucuuccaaagugcugggccgcagcccucucaccauucugcaggacgauaauucucccggcacacuuacccugagacaggggaagcggccgagcccucucuccgagaacguuucugaacugaaagagggagcgauccugggcacagggcgccuccugaagaccggaggcagagccugggagcaagggcaggaccaugauaaggaaaaucagcacuuuccccuuguggagagcuga

SEQ ID NO: 67178 - RNA, 759 nt, Artificial Sequence
  derived and/or modified sequence opt5 from CDCA5__Homo_sapiens__NP_542399
augagcggcagacggacccgcuccgggggagccgcucagagaucuggcccccgggccccuagcccgacaaagccccugcgcagaucccaacggaaaucugggagcgagcucccuuccauccugcccgaaauuuggccuaagacgcccucugcggcugccgugcgcaaaccuaucguccuuaagagaauuguugcccacgcuguggaggugccggccguccagagcccccggcgcuccccuagaaucagcuucuuucuggaaaaagagaacgaacccccuggacgggagcucaccaaggaggaccuguucaagacacauucugugcccgcuaccccgacauccaccccuguucccaauccugaagccgagagcuccuccaaagaaggcgagcuugaugcgcgcgaccuggagaugagcaagaaagugagacggucuuacucccgccucgaaacacuggggagcgccuccaccucuacgcccggaagacggagcugcuuuggcuucgagggccugcucggggcugaagaucuguccggagucagccccgugguuuguucuaaacuuaccgaggugccuagagucugcgccaagccgugggcucccgacaugacacugccuggcauuucucccccucccgaaaagcagaagcgcaaaaagaaaaagaugccggagauccucaaaaccgagcuggaugaaugggccgcggccaugaacgcugaguuugaagccgcugagcaguucgaccuucugguggaauga

SEQ ID NO: 67179 - RNA, 1353 nt, Artificial Sequence
  derived and/or modified sequence opt5 from CDCA7__Homo_sapiens__NP_114148
auggacgccagacgggugccccagaaggaucugcgcgucaaaaagaaccucaaaaaguucagauacguuaaacugaucagcauggagaccuccucuagcuccgacgauucuugcgacagcuuugcuuccgauaauuucgccaacacaaagccuaaguuucggucugacauuagcgaagaacuugcgaauguguucuaugaagauuccgacaacgagagcuuuuguggcuucucugaauccgaggugcaagauguccuggaccacugcggguuucuccagaaaccgcgccccgaugugacgaaugagcuggcuggaaucuuccaugccgacagcgaugacgaaucuuuuuguggcuucuccgagagcgaaauucaggacgggaugagacuucagucuguucgggagggaugccgcaccagaucccaaugucggcacagcggcccucugcgcguggccaugaaguuucccgcuagauccacacgcggggccaccaacaaaaaggcugagucucggcagccuagcgaaaauuccgucacagauagcaacucugacuccgaggaugaaagcggaaugaauuuccucgagaaaagagcccugaacaucaagcagaauaaggcgaugcuggccaaacucaugucugaacuggagagcuuucccggcuccuuccggggccgccauccucuuccggggucugacagccaguccagacggcccagacgccggaccuucccuggaguggcuagcagacgcaaccccgagcggagagcccgcccucugacacggucuagaucccgcauucucggcagccuggaugcucugcccauggaagaggaagaggaagaggacaaguacaugcuuguucggaaaagaaagaccguggauggguauaugaaugaggacgaucucccgcgcucucggagaucccggagcuccgucacgcugccucacaucauccgccccguggaagagauuaccgaagaggaacuggagaacgugugcucuaauagcagagagaaaaucuacaaccggucccucggaucuacaugucaucaaugcagacagaagaccauugacacaaaaaccaacugucgcaauccugauugcuggggcguccgggggcaguuuuguggacccugccugagaaaccgcuauggcgaagagguuagagacgcccuucuggaccccaauuggcacugcccuccgugucggggcaucugcaacuguagcuucugccgccagagagaugggcggugugcgacgggagugcucguguaccuggccaaguaucacggcuuugggaauguccaugcuuaccuuaagucccugaaacaagaguucgagaugcaggccuga

SEQ ID NO: 67180 - RNA, 1263 nt, Artificial Sequence
  derived and/or modified sequence opt5 from CDCA7L__Homo_sapiens__NP_001120842
auggagacccugagcuccgaagagucuugcgacagcuucgauucccucgaaucuggcaagcagcaagacgugagauuucacagcaaauacuucacagaggaacugcggcgcaucuuuauugaggauacggacuccgagaccgaagauuucgccggguuuacacagucugaccuuaacggaaagaccaaucccgaggucaugguuguggaaagcgaucuguccgacgauggcaaagcuagccucgugucugaggaggaagaggacgaagaggaagauaaggccacaccuagacggucccgcagcagacggucuuccaucgggcugcgcgucgcguuccaguuuccgaccaaaaagcuggcuaacaagcccgacaaaaauucuagcuccgagcagcuuuucagcuccgccagacuccaaaacgagaagaaaacaauucuggaacggaagaaagauugucgccaggugauccagagagaggacucuaccagcgaauccgaggacgauagccgggacgaaucucaggaguccagcgaugcccugcucaagcgcacgaugaauauuaaggagaacaaagcuaugcuggcccaacuucuggcugaacucaauucuaugccugacuuuuuccccguuagaaccccuacaagcgccucccggaagaaaaccgugcgcagagcguuuucugagggacagaucacacggagaaugaaccccacccgcagcgcccggccuccggaaaaguucgcucuggagaauuuuacggucuccgccgcuaaauucgccgaagaguucuauagcuuuagacgccggaagacaaucggcgggaaaugcagagaguaccgccggagacaucgcauuucuuccuuccggcccguggaagauaucaccgaggaagaccuugagaacguugcgauuacagugagagauaagaucuaugacaagguccugggaaauaccugucaccagugccgccagaaaaccauugauacaaagacggugugucggaaccaaggcugcuguggcgugagagggcaguuuugcggaccuugucuccggaaucgcuacggcgaggacgucagaagcgcccugcuggaucccgacuggguuugcccucccugucgggggaucugcaacugcucuuauuguagaaaacgcgacggacggugcgcuaccggcauucucauccaucuggccaaguucuacggguaugauaaugugaaagaauaccuugagucccugcagaaggaacucguggaggacaacuga

SEQ ID NO: 67181 - RNA, 2511 nt, Artificial Sequence
  derived and/or modified sequence opt5 from CDCP1__Homo_sapiens__NP_073753
auggccggccugaacugcggggugagcaucgcucuccugggaguccuucugcucggcgccgcgagacugccccggggagcugaggccuucgaaauugcccuuccucgcgaguccaauaucaccguucugauuaagcucggaacaccgacgcugcuggcuaaacccuguuacaucgugauuucuaagagacacaucaccaugcucagcaucaaauccggcgaacggauuguguuuacauucucuugccagagcccugagaaccacuuugucaucgaaauucaaaagaauaucgacuguauguccgggcccugcccuuucggagaggugcagcugcagcccucuaccagccuucugccuacacucaaccgcaccuuuauuugggauguuaaagcccacaaguccaucggccuggagcuucaguucagcauuccgagacugcggcaaaucggccccggggaaucuuguccugacggagugacacauuccaucagcggccgcauugaugcuaccgucgugagaaucgggacguuuugcucuaauggaaccguuucccggauuaagaugcaggagggcgugaaaauggcccuccaucugcccugguuccacccucgcaacgucagcggguuuucuaucgcgaauagauccagcauuaagcggcuguguaucaucgaauccguguucgagggagagggcucugccacacucaugagcgcuaacuaucccgaaggcuuuccggaggacgaacugaugaccuggcaguucguggucccugcccaccuucgcgcuuccguuagcuuucugaauuucaaccucucuaauugcgagagaaaagaggaacggguggaguacuauauucccggguccacaaccaacccugaaguguucaagcuggaggauaaacagcccggaaauauggccggcaacuuuaaucuuagccugcaagggugugaccaggaugcgcagucucccggaauccuccgccugcaguuccaaguccuggugcagcacccucagaacgaaagcaacaagauuuacguuguggaccucuccaaugagagagccaugucucugacgaucgaaccgcggcccgucaagcaaagcagaaaauuugugccuggcugcuucguuugucuugagucccgcacaugcagcucuaaccugacccucacauccgggagcaagcauaaaauuucuuuucugugcgaugaccuuacccggcuguggaugaauguggagaagaccaucuccuguacagaucacagauauugccagcgcaaaagcuacucccuccagguccccucugacauccugcaucugccuguggaacuccacgauuucagcuggaagcugcuuguccccaaagaccggcugucccucgugcugguuccggcucagaagcugcaacagcacacgcaugagaagccuuguaacaccucuuuuagcuaucuuguggccuccgcuauucccagccaggaccucuacuucggaucuuuuugcccuggcggcuccaucaaacagauucaagucaagcagaauaucagcgugacacugagaaccuucgcccccucuuuucagcaggaagccucccgccaagggcugacaguuagcuucauuccuuacuuuaaagaggaaggaguguucaccgucacgcccgauacaaagucuaaaguguaucuccggaccccgaacugggacagaggccugccuagccuuaccuccgugagcuggaauaucucuguuccccgcgaucaggucgcuugucugacauucuuuaaggagcgguccgggguggugugccagaccgggagagcguucaugauuauccaggagcaacgcacacgggccgaagagaucuuuagccucgacgaagauguccugcccaagccuuccuuccaccaucacucuuuuugggugaacauuagcaauuguuccccgacgucuggcaaacagcuggaccuucucuucagcguuacccugacacccagaaccguggaucugacagucauccucauugcugccgugggaggcggaguucugcuucuguccgcccucggccugaucauuugcugugugaagaaaaagaaaaagaagaccaacaaagggccugcugucggaaucuacaaugacaacaucaauacggagaugccccggcagccuaagaaauuucaaaagggccgcaaagauaacgacucucauguguaugccguuauugaggauaccaugguguacgggcaucugcuucaggacagcuccgggagcuuccuccagcccgaagucgacacauauagaccuuuucagggcaccaugggggugugucccccgucuccucccacaaucugcucccgggcgccuaccgcuaagcuggccacggaggaacccccgccuagaucucccccugagagcgaauccgagcccuacacauucagccaccccaauaacggcgaugugucuuccaaggacaccgauauuccucugcucaacacacaagagccgauggaacccgccgaguga

SEQ ID NO: 67182 - RNA, 2367 nt, Artificial Sequence
  derived and/or modified sequence opt5 from CDH10__Homo_sapiens__NP_006718
augaccauccaccaguuccugcuccuguuucuuuucugggugugccugccccauuuuuguagcccugagauuauguucagacggacaccggucccccaacagcgcauccucuccucuagaguuccucggagcgacggcaagauucugcaccgccagaaaagaggguggauguggaaccaguuuuuccuucuggaagaguacacgggauccgauuaucaauacgugggcaagcuccauucugaccaggauaaaggggacggaagccugaaguauauccuguccggcgauggggccggaacccucuuuauuaucgacgagaaaacaggcgauauccacgcuacccggcgcauugacagagaagaaaaggccuucuacacacugcgggcgcaggcuaucaaucgcagaacccuucggcccguggagccugagucugaauuugucauuaagauccaugauauuaacgacaaugagcccacauucccugaagagaucuauaccgccagcgugccggagauguccguugugggcacgagcgucgugcagguuaccgccacagaugcugacgaucccucuuacgggaacuccgcccgcgugauuuauagcauccugcaaggacagccuuacuuuucugucgaacccgagaccggcaucauuagaacagcucucccuaauaugaaccgggaaaaucgcgagcaguaccagguggugauccaagccaaagacaugggagggcagaugggcgggcuguccggaaccacgacagucaacauuacccuuacagacguuaaugauaaucccccgagauucccucagaacaccauccaucugcgggugcucgaaagcucucccgugggcaccgcgauuggcuccgucaaggccacagacgcugauacggggaaaaacgccgagguggaguauagaaucaucgacggagauggcaccgacauguuugauauuguuacagaaaaggacacccaagaggggaucauuacagugaaaaagccucuggauuacgaaagccgccggcuguauacccucaaggucgaggcugaaaauacgcacguggaccccagauucuacuaucugggacccuucaaagauacaaccaucguuaagauuuccaucgaggacguggacgagccuccggucuuuucucgcagcuccuaccuuuucgaagugcacgaggauaucgaagucggcaccauuaucgggacagugauggcccgggaccccgauagcauuucuuccccuaucagauuuagccuggaccgccacaccgaucucgaccggauuuucaacauccauucuggaaauggcagccuguauacauccaaaccccuugauagagagcugucucaguggcacaaccucacgguuauugcggccgaaaucaacaauccuaaggagaccacacgcguggcugucuuugugcggauccuggacguuaacgauaaugcuccccaguucgccguguuuuacgacaccuucgucugcgagaacgccagaccgggccagcugauucaaacaaucagcgccguggauaaagacgauccucucgggggacagaaguuuuucuuuucccuggcugcggugaaucccaacuucaccguucaggacaaugaagacaacacggcccgcauucuuacccggaaaaauggcuuuaacagacacgagaucagcacauaccugcucccugucgugauuucugauaaugacuaucccauccaguccagcaccgggacacugaccauccgggugugugcuugcgauucucaaggaaacaugcaguccuguagcgccgaagcccuucugcucccugcuggccuguccacgggggcccugauugcgauccuccugugcauuaucauucuucuggucaucgugguucucuucgcugcccugaagcgccagagaaagaaagagccccugauccuuucuaaggaggacauucgggauaauaucgugagcuacaacgacgaaggcggaggcgaggaagauacacaggccuucgacauugggacccucagaaauccggcugccaucgaggagaaaaagcugcgccgggauauuaucccugaaacacuguuuauccccagacgcacccccaccgcuccugacaacacagaugucagagacuucauuaacgagcggcucaaagaacaugaucuggacccgacggcgcccccuuaugacucccuugccaccuacgccuaugagggaaaugauucuaucgcugaaagccuguccagccucgagucuggcacaaccgaaggggaccaaaacuacgauuaucugcgcgaguggggacccagauuuaauaagcuggccgagauguacggcgggggcgaauccgacaaggauagcuga

SEQ ID NO: 67183 - RNA, 2391 nt, Artificial Sequence
  derived and/or modified sequence opt5 from CDH11__Homo_sapiens__NP_001788
augaaggagaacuacugccugcaggccgcucucgugugucugggcaugcuuugccacagccaugccuucgcgcccgaaagacgggggcaccuccgcccuuccuuucauggacaccaugagaaaggcaaggaagggcaaguccuccagagaucuaaacggggauggguuuggaaucaguucuuugugaucgaggaauauaccggcccggaccccgugcuggucgggcgccuucacagcgauauugacuccggagauggcaacaucaaguacauucugucuggcgagggggcuggaacaaucuucgugauugacgauaaaagcggcaauauccacgccacgaagacccucgacagagaggaacgggcccaguauacacugauggcucaagccguugaucgcgacaccaacagaccucuggagcccccuuccgaauuuaucgugaagguccaggauauuaaugacaaucccccugaguuccuccaugagacauaccacgcuaacgugccggaacggucuaacguugggaccagcgugauccaggucacagccuccgaugcggacgaucccaccuauggaaauagcgccaaacugguguacucuauucuugagggccagccuuauuuuuccguggaagcucaaacggggaucauucgcaccgcccugcccaacauggacagagaggcuaaggaagaguaccaugucguuauccaggccaaagacaugggaggccacaugggcgggcucagcggaacaaccaaggugacaauuacccugacggaugugaaugacaacccucccaaauucccgcagucugucuaccagauguccgugagcgaggcggccguuccuggcgaagagguggggcgggucaaggcuaaggaucccgacaucggagaaaauggccuugugacauauaacaucguugauggggacggaauggagucuuuugaaauuaccacagauuacgagacccaagagggcgugaucaaacugaagaaaccugucgacuucgaaaccaagcgcgccuauucccucaaaguggaggcugccaauguccacauugaucccaaguuuaucagcaacggccccuucaaagacacagugacgguuaagauuuccguggaagaugccgacgagccuccgauguuucuggcucccucuuacauccaugaaguccaggagaacgcggccgcugggaccgugguuggaagagugcacgccaaggacccugaugccgcuaauagccccauccgguauuccauugaccgccauacagaucuggacagauucuucaccaucaacccugaggauggcuuuauuaaaacaaccaagccccucgaccgggaagagacggccuggcugaauaucacagucuucgcggcugaaauucacaacagacaucaggaggccaaagugccgguggccauccgcguucuugaugucaaugacaacgcuccuaaguuugccgcucccuacgagggguucaucugugaaagcgaucaaaccaaaccucugucuaaucagcccauugugaccaucuccgccgacgauaaggacgauacagcgaacggaccucgguuuauuuucagccugcccccggagaucauucacaauccuaacuuuaccgugagagacaaucgcgacaacacagccggcgucuaugcucggagagggggcuucucucgccagaagcaggaucuguaccuucugcccaucgugauuagcgacggaggcauucccccuauguccucuacgaauacccucacaaucaaaguuugcgggugugaugugaacggagcccugcugagcugcaaugcugaagccuacauccucaacgcgggccuguccaccggggcccuuaucgcuauucuggccuguaucgucauucuccuggugaucguugugcuuuuugucacacugcggagacaaaagaaagagccgcucaucguguucgaagaggaggacguucgcgaaaacauuaucaccuaugaugacgagggaggcggggaagaggauacggaggcuuuugacauugccacccugcagaaucccgauggcaucaacggauucauuccucggaaggacaucaaacccgaauaccaguauaugccuagacccggccugcgcccugcccccaauagcguggaugucgacgauuuuaucaacacacggauucaggaggcugacaaugacccgaccgcgccucccuacgauucuauccaaauuuauggguacgaaggaagaggcuccguggccgggagccucucuucccuggagagcgcuacaaccgacuccgaucuugacuaugauuaccugcagaacuggggaccucgguucaagaagcucgccgaccuguacggcucuaaagauacguucgacgaugacagcuga

SEQ ID NO: 67184 - RNA, 2283 nt, Artificial Sequence
  derived and/or modified sequence opt5 from CDH13__Homo_sapiens__NP_001207417
augaagacacccccuggcgccagcuccagaaccaaaugcucucgggagcugcgcagcuucugugcuuuuuccugcccgagagccaagcagcccacguguaccgcgugguucccucaacaggaacaccccucugagaacgggccucagaugcccggacgggacccuccggcugccagcacaaugcaagugcuccugcuuaccuccgccgaagaucuggacugcacacccggcuuucagcagaaagucuuccauaucaaucagccugcugaguuuauugaagaucagucuauccucaaccugaccuucagcgacuguaaggggaaugauaaacuucgcuacgagguuuccagccccuauuuuaaggugaacucugacggaggccugguggcccucagaaauauuacagcugucgggaagacccuguucgugcacgcccggacgccucaugcggaggauauggccgaacugguuaucgugggaggcaaagacauucaaggcucccuccaggauaucuuuaaguucgcucgcaccagccccgucccgagacagaaacggucuaucgugguuuccccuauucugauccccgagaaccagcgccaaccuuuucccagagacguggggaaggucguggauagcgaccggcccgaacgcucuaaauucagacuuacaggaaagggcguggaucaggagccuaaggggauuuuucggaucaaugagaacaccggauccgucagcguuacacgcacccuggacagagaagugauugccguguaccaacucuucgucgagacgacagacgugaauggcaaaacccuggaagggccgguuccccuugaggugaucgucauugaucagaacgacaaucggccuaucuucagagaaggacccuauaucggccacgugauggagggcuccccuacagggaccaccguuaugcgcaugacagcuuuugaugccgacgaucccgcgacggacaacgcccugcuccgguacaauauuagacagcagaccccggauaagccuucucccaacauguucuauaucgacccugagaaaggagauauugugacagucgugagccccgcucugcuggaccgcgaaacccucgagaauccuaaguacgaacugaucauugaggcccaggauauggcuggccuugacgucgggcugacaggaaccgccacggccacaaucaugaucgacgauaaaaacgaccauucccccaaguuuaccaaaaaggaguuccaagcuaccguggaagagggcgcgguuggggugauugucaaccucacaguggaagauaaggacgauccgaccacaggagccuggcgggcugccuauacgaucauuaauggcaacccuggccagagcuuugagauccacaccaauccccagacaaacgaagggaugcugucuguugugaaaccccuugacuacgagauuuccgccuuccacacccugcucaucaaggucgaaaaugaggauccucuggugccggacgugagcuacggacccucuagcacagcuaccguucauaucacgguccuggaugugaacgagggcccuguguuuuaucccgacccuaugauggucaccagacaggaagaucucuccguggggucuguucugcuuacagugaaugccaccgaccccgauagccugcaacaccagacaauucgcuacuccgucuauaaagacccugcgggauggcucaacaucaaucccauuaacggcaccguggacacgacagcuguucuggaucgggagagcccguucguggacaauucugucuacaccgcccuuuuucuggccaucgauuccgggaacccucccgcuacaggcaccggaacccuccugauuacacuggaagacgugaaugauaacgccccuuucaucuaucccacgguugcugaggugugcgacgaugccaagaaucucagcgucgugauucugggcgcgucugacaaagaucuucauccgaacaccgacccuuuuaaguucgagauccacaagcaggccgugcccgauaaagucuggaagaucuccaaaauuaacaauacacacgcucugguuagccuccugcagaaccugaauaaggccaacuacaaucuuccuaucauggugaccgacuccgggaaaccucccaugacaaacauuaccgaucucagagugcaagucuguucuugccgcaauagcaagguggacuguaacgcugccggagcgcugcgguuuucccugcccucuguucuccugcuuagccuguucucccucgccugccuguga

SEQ ID NO: 67185 - RNA, 2445 nt, Artificial Sequence
  derived and/or modified sequence opt5 from CDH15__Homo_sapiens__NP_004924
auggacgccgcuuuccugcucgugcugggccuucuggcccagagccucugccugucccuugggguccccggauggagacggccuaccacacuguacccguggcgcagagcgcccgcucucucucggguucgcagagccugggugaucccucccauuagcguguccgagaaccacaagcggcugccuuauccccugguccaaaucaaaucugauaagcagcagcucggcagcgugauuuacuccauccaggggccuggaguugacgaagaaccgcgcggcguguuuucuauugauaaauucacggggaaggucuuucugaaugccaugcuugacagagagaaaaccgaucgguuccgccugagagcuuuugcccucgaccugggaggcagcacacuugaggaucccaccgaccuggaaaucgugguuguggaucaaaacgacaaucggccugcuuuccuccaggaggccuuuacaggccgcguccuggagggggcggugcccggaaccuaugugacaagagccgaagcuaccgaugccgacgauccugagacggacaacgcugcccugcgguucuccauccuccagcagggcagccccgaacuguuuucuauugacgagcuuaccggggagauccgcacaguccaaguuggacuggauagagaagugguggcggucuacaaucucacccuucagguggccgacauguccggcgaugggcugacagcuaccgccagcgcuauuaucacgcuggacgauauuaacgacaaugccccggaguucacacgggaugaauuuuucauggaggccaucgaagcuguuucuggaguggacgucggcagacucgagguggaggaucgcgaccugccuggcucccccaacuggguugcgcgguuuaccauucuggaaggggauccugacggacaguucacaaucagaaccgaccccaagaccaaugagggcgugcucagcaucgucaaggcccuggauuaugaaucuugugagcauuacgaacuuaaaguguccguccagaacgaggcuccccugcaagccgccgcucuccgcgccgagcgggggcaggcgaaggugagaguucacgugcaggacacaaaugaaccuccggucuuccaagagaacccccugcgcacgagccuugcugaaggagccccucccggcacccugguggccacauuuuccgcucgggauccugacaccgagcagcuccagagacugucuuauagcaaagauuacgaccccgaagauuggcugcagguugacgccgcuacagggcgcauucaaacccagcaugugcucuccccggccagcccuuuccugaagggaggcugguaccgggcgaucguccuugcccaggaugacgcuucucagcccagaacggccacaggcacccuguccauugagauccucgaggugaaugaucacgcuccugugcuggcgcccccucccccggggagccugugcucugaaccucaucaaggacccggccuucuccugggggccaccgacgaggaucugcccccucacggagccccguuucacuuccagcucagcccccgccugccugaacuuggccggaacuggucccugucucagguuaaugucagccaugcuagacuccggccccgccaccaggugccugaggggcugcauagacugucccuucuccugcgggacagcggccaacccccucagcagagagagcagccccugaacgugacagucugucgcugcggaaaagacggcgugugucucccgggggccgcugcccugcuugccggaggcaccgggcugucucucggagcucugguuauugugcuggcguccgcccuucuccugcugguccucgugcugcuuguugcucugcgggccagauuuuggaagcaaagccgcggcaaggggcuccugcacggcccucaggaugaccugagagauaacgugcuuaauuaugacgaacagggaggcggggaggaagaucaagacgccuacgauaucucucagcuccggcaccccacagcucugucccugccucucggacccccgccucugcgcagagacgcgccccagggccggcuucauccucagccuccccgcguccugcccacgagcccgcucgauaucgccgacuucauuaacgaugggcuggaggcugccgacuccgaucccucugugccucccuaugacaccgcccugaucuacgacuaugaaggagauggcagcguugcugggacacuuuccucuauucugagcucccaaggcgacgaggaucaggacuacgauuaucucagagacuggggaccucgguuugcccgccuggcggauauguacggccaccccugcgggcucgaguacggagcuagaugggaccaucaggcccgggaaggccugagcccuggggcccuucugccgcgccacagaggacggaccgcuuga

SEQ ID NO: 67186 - RNA, 2424 nt, Artificial Sequence
  derived and/or modified sequence opt5 from CDH16__Homo_sapiens__NP_001191673
auggugcccgccuggcuguggcuccugugcgucagcguuccucaggcccuuccgaaggcucaacccgcggagcuguccguggaagugccugagaacuacggcgggaauuucccccucuaucugaccaaacuuccucugcccagagaaggagcugagggccagaucguccucucuggggacagcggaaaggccacagaaggcccuuuugccauggauccggacuccggguuccugcuggugacgcgggcucucgaucgcgaggagcaggccgaauaccagcugcaaguuacccuugagaugcaggacggacacgugcuguggggcccccagccuguccucgugcauguuaaagaugaaaacgaccaggugccccacuuuucucaagcuauuuauagagcccggcugagccgcggcacaagaccugggauccccuuccuuuuucuggaggcguccgaucgggacgagccgggaaccgccaauucugaucuccgcuuccauauucugagccaggcuccugcccagcccuccccugacauguuucagcuggaacccagacucggcgcucuggcccuuagccccaaggggucuacaucccuggaucacgcgcucgagcggaccuaccaacugcuuguccaggugaaagacaugggagaucaggccagcggccaucaagcuacagccaccguggaagucucuaucauugaguccacguggguuagccuggaaccuauccaccucgcugagaaccugaaggugcuguauccgcaccauauggcccaggugcacuggucugggggagacguccauuaccaccucgagucccaucccccuggccccuucgaagugaaugccgagggcaaccuguauguuacccgcgaacuugacagagaggcucaggcggaauaccugcuccaggugcgggcccaaaauagccacggggaggauuacgcugccccucuggagcuucacguccuggugauggacgaaaacgauaauguucccaucuguccgccucgcgaccccacaguguccauuccugagcucucucccccuggaaccgaagucacaagacugagcgccgaggaugcugacgcccccggcuccccgaacagccauguggucuaucagcugcucucuccugaacccgaggaugggguggagggacgggcguuucagguugaccccaccuccggcagcgugacgcuggggguccuuccucugcgcgcuggacagaauauccuccugcuggugcuugccauggaucucgccggcgcugaaggcggguucucuagcacaugcgagguugaaguggccgucaccgacauuaacgaucacgcuccggaguuuaucacaucccaaauuggacccaucucucugccugaggacguggaacccggcacccugguggccaugcucaccgcgauugacgccgaucuggagccugcuuucagacuuauggacuuugccaucgaaagaggggauacagagggaacguucggccuggacugggaacccgauagcgggcauguucggcuccgccuguguaagaaucuguccuacgaggcugccccuagccacgaggucgugguggucgugcagucuguugcgaaacuugugggccccggaccgggcccuggggccaccgcuacagucaccgugcucguugaacgggugaugcccccucccaagcuggaccaggaguccuaugaagccagcgucccgaucucugcuccugccggauccuuccugcucacaauucagcccagcgauccuaucuccagaacccugcgcuuuucucuugugaacgacagcgagggcuggcugugcauugaaaaauucuccggggagguucacacggcccaaucucuccagggagcucagcccggcgauacauacaccgugcuggucgaggcgcaggacaccgcccugacacuugcucccgugccuagccaauaucucuguaccccgcggcaggaucaugggcugaucguguccggccccagcaaggacccugaucuggccucuggacacggccccuacuccuuuacacucgggccuaaucccacgguccagagagacuggcgccugcaaacccuuaacggaagccaugccuaucugacacucgcucugcacuggguugaaccucgggagcacauuaucccggugguggucucucauaacgcccagauguggcagcugcuugugagaguuaucgugugccgcuguaaugucgaaggccagugcaugcggaaaguggggagaaugaagggaaugcccaccaagcucuccgcgguuggcauucugguggggacacuggucgcuaucggcauuuuccucauccugauuuuuacccacuggacgaugagccgcaaaaaggacccugaucaacccgccgacucugugccucuuaaagccaccguuuga

SEQ ID NO: 67187 - RNA, 2499 nt, Artificial Sequence
  derived and/or modified sequence opt5 from CDH17__Homo_sapiens__NP_001138135
augauccugcaggcccaccuccauagccugugccuucugaugcucuaccuggcuaccggcuaugggcaagagggaaaguucuccggcccccuuaaaccuaugacauuuucuauuuacgaagggcaggagccgagccagaucauuuuccaguuuaaggccaaucccccugcggugacguucgaacugaccggagagacagacaauaucuuugucauugaaagagagggccuccuguauuacaaccgggcucuggaucgcgagaccagauccacacacaaucuccaaguugccgcccuggacgcuaacgggaucaucguggaaggacccgugccuauuaccaucaaagucaaggauauuaaugacaaccggcccacauuccuucagucuaaauaugagggcagcgugcgccagaacuccagaccuggcaagccguuucuguacguuaacgccaccgaucucgacgaucccgcuacgccuaaugggcagcuguauuaccaaaucgugauucagcuucccaugaucaacaaugucauguacuuccagauuaacaauaagaccggagccaucucucugacacgggaaggcagccaggagcucaacccugcgaaaaaucccuccuauaaccuggugaucagcguuaaggacaugggagggcaaucugagaacuccuuuagcgauaccacaucuguggacauuaucgucaccgaaaauauuuggaaagccccgaagccuguggagaugguggaaaacuccacggauccccauccuaucaaaauuacacagguccgcuggaaugaccccggcgcucaguacagccugguugauaaggagaagcuccccagauucccuuuuucuaucgaccaagaaggggacaucuaugugacccagccgcuggaucgggaggagaaagacgccuacguguucuaugcugucgccaaggaugaauacggaaaaccccuuuccuauccucuggagauucacgugaagguuaaagacaucaacgauaaucccccuacaugucccagcccggugaccgucuuugaagugcaggagaacgaacgccucggcaauuccauuggcacccugacagcgcaugacagagaugaggagaacacggccaauucuuuccuuaacuaccggaucguugaacagaccccuaagcugcccauggacggacucuuccugauucaaacauacgcugggaugcugcagcucgccaaacagagccugaagaagcaggauaccccucaauauaaucuuacaaucgagguguccgacaaagauuuuaagacccugugcuucguccagaucaacgugauugacaucaaugaccagauucccaucuuugagaaaagcgauuacggcaaccucacgcuggcugaagacacaaauauugggucuaccauccuuaccauucaggccacagaugccgacgaaccuuucaccggauccagcaagauccuguaucacaucauuaaaggcgauucugaggggcgccucggagucgacacagauccccacacgaacaccggcuacgugaucauuaagaagccgcuggacuuugagacagcugcgguuagcaacaucguguucaaagccgaaaauccugagccccuggucuuuggcgugaaguauaacgcuuccucuuucgccaaauuuacccucauuguuacagaugugaaugaagcuccccaauucagccagcaugucuuucaggccaagguguccgaggacguggccaucgggaccaaaguuggaaacgucacggcgaaggauccugagggccuggacaucagcuacucucuuagaggggauacccggggauggcugaagauugaccacgugacaggcgaaaucuucuccguggcuccgcucgaccgcgaggccgggagccccuauagaguccaggugguugccaccgaagugggcggaucuucccugagcuccgucucugaguuucaucugauucuuauggaugugaaugacaacccuccccggcucgcuaaagauuacacaggccuguucuucugucacccucugagcgcccccgggucccucaucuuugaagcuaccgacgaugaccaacaccuguucagaggaccucauuuuacguucucucuuggcagcgggucccugcagaaugauugggagguuagcaagauuaacggaacacacgcccgccucucuacccggcauacagaguuugaagagagagaauacgugguccugauccgcaucaaugacggcgggcggcccccgcuggagggcauugugucccuuccuguuaccuucugcagcuguguggaaggaucuugcuuuagacccgcgggccaccagaccgggaucccuacagucggaauggccgugggcauucuccugacgacccugcucgugaucgggauuauccuggcugucguuuucauccgcauuaaaaaggauaaaggaaaggacaacguggaguccgcccaagcuagcgaggugaagccccuucggucuuga

SEQ ID NO: 67188 - RNA, 1725 nt, Artificial Sequence
  derived and/or modified sequence opt5 from CDH18__Homo_sapiens__NP_001161139
augaagaucaccagcacauccugcauuugucccgugcuggucugccucuguuucguucagagaugcuacggcacggcccaccauucuagcaucaaagugaugcggaaccaaaccaagcacauugagggggaaacagaggugcaucaccgcccuaaaagaggaugggucuggaaucaguuuuucgugcuggaggaacauaugggcccggacccccaguauguugggaagcugcacuccaacucugauaaaggagacggcagcgugaaguacauccugaccggggaaggagcuggcacaauuuuuaucaucgaugacaccacaggcgauauucacuccaccaagucucucgaccgggagcagaaaacgcauuauguccugcacgcccaagcgaucgaucgcagaaccaauaagccucuugagcccgaaagcgaguucauuaucaaagugcaggacauuaacgauaaugcuccuaaguuuacagacgggcccuacaucguuaccgugccugaaauguccgauaugggaacaagcguccuucaggugaccgccacggacgccgaugacccgacauauggcaacucugcucggguggucuacuccauucuccaggggcaacccuauuucagcguugacccuaaaaccggagugauccgcacagcccugcauaauauggauagagaggcucgggagcacuacucuguggucauccaggccaaggacauggcgggccagguugggggacuguccggcagcaccaccgugaacauuacacucacggaugugaaugacaaucccccucgcuuuccccagaagcacuaccaacuguaugucccggaaucugcccaggugggcuccgcuguugggaaaaucaaggccaacgaugcugacaccggaagcaacgccgauaugacauacuccauuaucaauggcgacgggaugggaauuuucucuaucagcaccgauaaagagacaagagaaggcauccuuucccugaagaaaccucucaacuaugagaagaaaaagagcuacacccugaauauugaaggggcgaacacgcaucuugacuuucgguucucucaccugggacccuuuaaggaugccacaaugcucaaaaucauugugggcgacgucgacgagccuccccuguucuccaugcccagcuaucugauggagguguacgaaaacgcuaagaucggcaccgucguggggaccguucucgcccaggauccugacucuacaaauagccuggugcgcuauuuuauuaacuacaaugucgaggaugacagauucuucaacaucgaugcuaauaccggaacaauccggacgaccaaagugcuugaccgcgaagagacaccgugguacaacauuaccguuacagccuccgaaaucgauaaucccgaccugcucucucaugugaccgucggcauuagagugcuggaugugaacgacaauccucccgagcuugcccgggaguaugauaucauuguuugugaaaacagcaagccugggcaagucauccacacgauuuccgcuaccgacaaagaugacuuugcgaauggacccagauucaacuuuuuccuggacgagcgccucccggugaauccuaacuuuacacugaaggauaaugaagccgcugcccccagcccuucuggcuucgugcaugcccgggagaugggggucugcggccccgcuaugcagaagccuuccugucccagacugguguga

SEQ ID NO: 67189 - RNA, 1473 nt, Artificial Sequence
  derived and/or modified sequence opt5 from CDH19__Homo_sapiens__NP_001257957
augaacugcuaccugcuccugagauucaugcuuggcaucccccugcucuggccuugucugggggccaccgagaauagccagacaaagaaagugaagcaaccgguccggucccaccuucgcguuaaaagaggauggguguggaaccaguuuuucgugcccgaagagaugaauacgaccucucaucacauuggccagcugcggagcgaccucgauaacgggaauaacuccuuucaguauaagcugcugggagcuggcgccgggucuacauucaucauugacgaacgcaccggagauaucuacgcgauucaaaaacucgacagagaggaacggagccuguauauccuucgcgcucaggucaucgauauugccacaggcagagccguggagccugaguccgaauuuguuaucaaggugucugacauuaaugauaacgagcccaaguuccuggacgaaccuuacgaggcuaucguccccgagaugagcccugaaggcacccucgugauucagguuacagccuccgaugcugacgauccgagcucugggaauaacgcccggcugcuuuauucccugcuccagggacaacccuacuuuagcguggagccuaccacgggcgucauccgcauuucuuccaaaauggacagagaacugcaggaugaguauugggugaucauccaggcgaaggacaugauugggcagcccggagcccugagcggcaccacaucugugcucaucaaacuguccgacgucaaugauaacaagccuauuuucaaagaaagccuuuaccggcugaccguuuccgagucugcucccacagggaccagcaucggaacgauuauggccuacgacaaugauaucggcgagaacgcugaaauggacuauuccaucgaggaagaugacagccaaacauuugauauuaucaccaaucaugagacacaggaaggcauugugauccucaagaagaaaguggacuucgagcaccagaaccauuacgggauucgcgccaaggucaaaaaccaccacgugccggagcaacugaugaaguaucauaccgaagcgucuaccacauuuaucaaaauccagguugaggauguggacgaaccuccccuuuuccugcucccuuacuaugucuuugagguguucgaagagacgccccagggauccuucguuggcguggucagcgccaccgaucccgacaauagaaagucuccuauucgguacagcaucacacgcuccaaaguguuuaacauuaaugacaacgggaccaucacaaccucuaauagccuggauagagagauuuccgcuugguauaaccugagcaucacggccacagaaaaguacaauauugagcagaucucuuccaucccgcucuacguccaagugcugaacauuaaugaccacgcucccgaauuuagccaguauuacgagaccuauguuugcgagaacgccggaucuggccaggggcuuuucuucuga

SEQ ID NO: 67190 - RNA, 2649 nt, Artificial Sequence
  derived and/or modified sequence opt5 from CDH1__Homo_sapiens__NP_004351
augggccccuggagcagaucccugucugcccuccugcuucugcuccaggugagcuccuggcugugccaagagccugaaccgugucaccccggguucgacgcugagucuuacaccuuuacagucccucggcgccaucuugaaagaggacggguucugggccgcgugaacuucgaggauugcacggggagacagcggaccgccuauuuuagccucgacacacgcuucaaggugggaaccgauggcgucaucacagugaaaagaccccugcgguuucacaauccucagauucauuuccugguuuacgcgugggacuccaccuaucgcaaguuuucuacaaaagugacccucaacacggucgggcaccaucacagacccccuccgcaccaggcuagcguguccggaauccaagccgaacugcuuaccuuccccaauagcucuccuggccugcggcgccagaagagagauuggguuauucccccuaucuccugucccgagaacgagaaaggcccguuuccuaagaaucucgugcagauuaagagcaacaaagacaaggaagggaaagucuucuacucuaucacaggacagggcgccgauacacccccuguggggguguuuaucauugagcgggaaaccggauggcugaaggucaccgagccccuugaccgcgagagaaucgcuacguauacacuguucucccaugccguuagcucuaauggcaacgcuguggaagaucccauggagauucucaucaccgugacagaccaaaaugauaacaaaccugaauuuacccaggaggucuucaagggguccgugauggaaggagcccugccgggcaccagcguuauggaggugacagcgacggacgccgaugacgacgucaauaccuacaacgcugccauugcuuauacaauccugucccaggaucccgagcucccugacaagaauauguucaccauuaaccggaauacaggcgugaucucuguugugaccacggggcuggauagagagagcuuucccacauacacccuugucgugcaggccgcggaccugcaaggagaaggccucuccaccacagccaccgcugucaucacagugacggauaccaacgacaacccucccauuuucaauccgacaaccuacaaagggcagguuccugaaaacgaggccaauguggucaucacaacccugaaggugacggaugcugacgcccccaacaccccugccugggaagcuguuuauacaauucuuaaugaugacggaggccaguuuguggucaccacaaaccccgugaauaacgaugggauccugaaaaccgcgaagggacucgacuucgaggccaaacaacaguacauucugcacguggcuguuacgaaugucgugccuuuugaggugagccugacaaccucuacagccaccgucaccguggacguucucgaugugaacgaagcccccaucuucgucccgccugagaagcgcguggaaguuuccgaggacuuuggcgugggccaggaaaucacaagcuauacggcucaggagcccgauaccuucauggagcaaaagauuacauaccggaucuggagagacaccgccaauuggcuggaaauuaaccccgauacaggggcgaucucuacccgcgcugagcuugaccgggaagauuuugagcaugucaagaauagcacguauacagcccugauuaucgccaccgacaacggauccccuguggcuaccggcacagggacccuccugcuuauccugucugauguuaaugacaacgccccgauucccgagccuagaacaaucuucuuuugcgaacgcaaccccaagccucaggugauuaauaucauugaugcugaccugcccccuaacacgagccccuucaccgccgagcugacacacggagcguccgccaauuggaccauccaguacaacgauccgacacaggaaagcauuauccugaaaccuaagauggcucucgaggucggcgacuauaaaaucaaucugaaacuuauggacaaccaaaauaaagaucaggugaccacgcuggaagugucugucugugacugcgagggggccgcuggcguuugucggaaggcccagcccguggaggcgggacuccagauuccugccauccugggcauucucgggggaauccuugcucuccugauucugauccuccugcuucugcucuuucugagacgccgggccguggucaaggaaccccugcuuccgccugaggaugacaccagagauaacguguacuacuaugacgaagagggcgggggagaagaggaucaagacuucgaucucucccagcugcaccgcggccuggacgcucggcccgagguuacaagaaaugauguggccccuacccucaugagcgucccccgguaccugccccgcccugccaacccggacgaaaucgggaauuucauugaugagaaccuuaaagcugcggacacagaccccaccgccccucccuaugauucucugcucguguuugacuacgaaggcuccggaagcgaggcugccucccugucuagccuuaauuccucugaaagcgauaaggaccaggauuaugacuaccugaacgaguggggcaauagauucaaaaagcucgccgauauguaugggggaggcgaggacgauuga

SEQ ID NO: 67191 - RNA, 2406 nt, Artificial Sequence
  derived and/or modified sequence opt5 from CDH20__Homo_sapiens__XP_005266739
auguggaccagcggcagaauguccaacgccaagaauuggcuggggcucggaaugucucuguacuucuggggccuuauggaccugacaacgaccgugcucagcgauacacccaccccucagggggagcuggaagcucugcuguccgacaaaccgcaaucucaccagcggacaaagcgcagcugggucuggaaccaguuuuucguucucgaggaauauaccggaacagauccccuguacgugggcaaacugcauuccgacauggauagaggggacggaucuaucaaguauauucucagcggcgagggcgccgggaucguguuuaccauugaugacacgaccggagauauccacgcgauucagcggcuggaccgcgaagagagagcucaauacacacuucgggcccaggcccuggaucgcagaaccggccggccuauggagcccgaauccgaguucaucaucaaaauucaggacaucaaugauaacgaaccuaaguuucucgacgggcccuaugucgcuacagugccugagaugagcccgguuggaaccucugugauucaggucacggccacagacgcugaugaccccaccuacggcaauuccgcccgcgugguuuauagcauccugcaagggcagccuuacuucucuguggauuccaagacaggagucauuagaaccgcgcuuaugaacauggaccgggaggccaaagaauacuaugaggugaucauucaggcuaaggauaugggcggccagcuugggggacucgccggcaccacaacggugaauaucacccugagcgacgucaacgauaaucccccucgcuuuccccaaaaacauuaccagaugucuguucuggaauccgcuccgaucagcuccacaguggggagaguguucgccaaggaccucgaugagggaauuaacgcggaaaugaaauauaccaucgucgacggcgauggggccgacgcuuuugacauuucuacagauccuaauuuccaggugggaaucauuaccguuaagaagccccugagcuuugaguccaaaaagagcuacacgcuuaaaguggagggcgccaacccucaccuggaaaugcgguuccucaaucugggccccuuucaagacacaaccaccguccauaucucuguggaggauguugacgaacccccuguguucgagccgggguucuauuuugucgaagugcccgaggaugucgcuaucggaacaaccauucagaucauuuccgccaaggacccugaugugacaaacaauagcauccgcuacucuauugacagaagcuccgaucccggccgguucuuuuauguugacaucacgaccggggcccuuaugacagcuagaccucuggaucgcgaggaguucucuuggcacaacaucaccgugcucgcgauggaaaugaacaaucccagccaggucggauccgugccgguuacaauuaaagugcuggacgucaacgauaaugccccugaauuuccccgguucuacgaggcuuuugugugcgaaaacgccaaggccggccagcugauccaaaccgugagcgcuguugaccaggacgauccuagaaaugggcagcacuucuacuauucucucgcccccgaggcggcuaacaauccuaacuuuacgauucgcgacaaucaggauaacaccgcccggauccugacaagacgcuccggcuuccggcaacaggagcagagcgucuuucaucuucccauucugaucgccgacucuggacagccggugcucuccagcaccggcacacugaccauucaaguguguuccugcgaugacgaugggcacgucaugucuuguagcccugaagccuacaugcuucccgugucccugucuagaggagcccucaucgcuauccuggccugcauuuucguucugcucgugcugguccuucugauccucagcaugcgccggcauagaaaacagcccuauauuaucgacgaugaggaaaauauucacgagaacaucgugcgcuacgacgaugagggcgggggagaagaggacacggaagcguuugauaucgccgcuauguggaauccucgggaggcccaggcuggcgccgcgccgaagacaagacaggacaugcugcccgaaauugagucccugagccgguauguuccucaaaccugugccgugaacucuacaguccacuccuacgugcuugcuaagcucuaugaggccgacauggaucugugggcucccccuuucgacagccugcagaccuacauguucgaaggggauggcucuguugccggaucccucagcucucugcagagcgccaccuccgacagcgagcaaucuuuugauuuccuuacagacuggggcccccgcuuuagaaaacuggcugaacucuacggggcguccgagggaccugcuccccugugguga

SEQ ID NO: 67192 - RNA, 2487 nt, Artificial Sequence
  derived and/or modified sequence opt5 from CDH22__Homo_sapiens__XP_011527296
augagaccccggccugagggccgcgggcugagagccggaguggcucucagcccggcccugcuucugcuccugcuucugcccccucccccuacccuccugggccggcugugggcggcugggacacccuccccuucugccccgggagcccgccaggacggcgcucucggggccggaagagucaagcggggcuggguuuggaaccaauucuuugugguggaagaguacacgggcaccgaaccccuguaugucgggaaaauccacagcgauuccgacgagggagauggcgcuauuaaguacacaaucucuggggaaggagccggcaccauuuuccuuaucgacgagcugacaggggauauucaugcgauggagcgccucgacagagaacagaaaaccuuuuauacacugcgggcccaggcucgcgauagagccaccaaucggcuucuggagccugaaagcgaguucaucaucaaggugcaggacauuaacgauuccgagccccgcuuucuccacggaccuuacaucggcucuguugcugaacugagccccacgggcaccuccgugaugcaagucauggccagcgacgcggaugacccgacauaugggucuuccgccagacugguguacagcguucucgauggagagcaucacuucaccguggacccuaaaacaggcgucauucggaccgcugugcccgaccuggaucgcgaaucucaggagagauaugaaguggucauccaggccacggacauggcugggcagcuuggaggccuguccgggagcacaaccguuacaauuguggugaccgaugucaaugacaacccuccccgguuuccccaaaagauguaccaguucucuauccaggaguccgccccuauuggaaccgccgugggcagaguuaaggcugaggauagcgacgugggcgaaaauacagauaugacguaccaucucaaagacgaguccucuagcgggggagaugucuuuaaggugaccacagacuccgauacccaggaagcgaucaucguugugcaaaaacgccuggacuucgagagccagccgguccacacagugauucuugaagcccugaacaaguuugucgacccccgguucgcugaucucggcaccuuuagagaccaggccaucgugcgcguugccgugacggaugucgacgagccucccgaguuccggccucccucugggcugcuggaagugcaagaggaugcucagguuggaucccucgugggcgucgugacagccagagacccggaugcggcuaaucgcccugugcgguaugccauugacagagaaagcgaucuggaccagaucuucgauauugacgccgauaccggggcuaucguuaccggcaaaggacuugaccgcgagacagccggcuggcacaacaucaccguccuggcuauggaagccgacaaucaugcgcagcucucucgggccagccugcgcauuagaauccuugaugugaacgacaaucccccugagcuggcuacacccuacgaggccgcugugugcgaagaugccaagccugggcaacucauucagacgaucuccgucguggaccgggaugagccccagggaggccacagauuuuauuuccggcugguuccggaagcgccuucuaacccccauuuuagccugcucgacauucaggauaauaccgccgcugugcacacacaacacgucggguucaaccgccaggagcaggacguguuuuuccugcccauccuuguuguggauuccggaccuccgacccugagcucuacaggcacccucacgaucagaauuugugggugcgacuccagcggcaccauccagucuuguaauacaaccgccuuugucauggcugccucccugagccccggagcccugauugcucugcucgugugcguucugauccuggugguccucgugcugcuuauucugacacuccggagacaucacaagucccaucugucuagcgaugaggacgaagauaugcgcgacaacgugaucaaauacaacgacgagggcgggggagaacaagauaccgaggcguaugacauguccgcccugcggucucuuuacgauuucggcgaacucaaagggggagacggcgggggcagcgcuggaggcggggccggaggcggguccggaggcggggccggcagcccuccccaggcucaccuuccuucugagagacauucccugccccagggaccucccagcccggagccugauuuuucugucuuccgcgacuuuauuuccagaaagguugcccucgcggauggcgaccugagcgugcccccuuaugaugcuuuccagacguacgccuuugaaggggccgacucucccgcugccagccuuuccagccugcacucuggauccagcggcuccgagcaagauuucgcguaccucucuagcugggggccgcgguuccgcccucuggcugcccuguaugccggacacagaggcgacgacgaagcucaggccuccuga

SEQ ID NO: 67193 - RNA, 4146 nt, Artificial Sequence
  derived and/or modified sequence opt5 from CDH23__Homo_sapiens__NP_001165401
augggcagacacguggccaccagcugccaugucgcuuggcugcucguucugaucuccggguguuggggacaggugaaccggcuucccuucuuuacaaaucacuucuuugacacguaccugcucauuucugaggauaccccugugggcagcuccgucacacaacugcuugcccaggacauggauaacgacccgcugguguucgggguuucuggagaagaggcgagccgcuuuuucgcuguggaacccgauaccggcgucguguggcucagacagccucuggaccgggagacaaaguccgaauuuaccguugaguucucugugagcgaucaucagggggucaucacacgcaaagugaauauucaagugggagacgucaacgauaaugcccccaccuuucacaaccagccuuauuccguuagaauccccgagaauacgccugugggcaccccgauuuucaucgugaacgccacagaccccgaucugggcgcugggggaagcguccucuacucuuuucagccucccucccaguucuuugccaucgacagcgcucggggcauugugaccguuauccgcgaacuggauuaugagacaacccaagccuaccagcuuacggugaaugcgacagaccaggacaagaccagaccucugucuacacucgccaaccuggcuauuaucauuaccgauguccaggacauggaucccaucuucauuaaucuuccguauuccaccaacaucuacgaacauagcccucccgggacaacggugcggaucauuaccgccaucgaccaagauaaaggacgcccuagaggcauuggguauacaaucguuucuggaaauaccaacuccauuuucgcucuggacuacaucagcggcgugcucacacugaauggccugcucgaucgggagaacccccuguacucccacggguuuauccuuaccgucaagggaacggagcugaacgacgaucgcacacccucugacgccaccgugaccacaaccuucaauauucucgucaucgauauuaacgacaaugcgccugaauuuaacagcuccgaguauagcguggccaucacagaacuggcucagguuggcuucgcccuuccgcuguuuauucagguggucgacaaagaugagaaucucgggcugaacucuauguucgaaguguaccugguuggaaauaacucccaccauuuuaucaucagccccacgucugugcaaggcaaggcugacauuagaauccgggucgccauuccucucgauuaugagaccguggaccgcuacgauuucgaccuguuugccaaugagagcgugcccgaucacguuggguaugcuaaggucaaaaucacacuuauuaacgaaaaugacaacagaccuaucuucucccagccccuguacaauauuucucucuaugagaacgugaccgugggaacaagcguccugaccgugcuugcgacggauaaugacgccggcaccuuuggcgaaguuuccuacuucuuuagcgaugacccggaucgguucucucuggacaaggacacagggcucaucaugcugaucgcuagacuggauuacgagcucauucagcgcuucacccugacaaucauugcccgggacggaggcggggaagagaccacgggaagagugcgcaucaacguccuugaugugaacgacaauguuccuacauuucagaaagaugccuaugugggcgcucugcgggagaacgaacccuccgucacccaacucgugagacugcgcgccacagacgaggauagcccucccaauaaccagauuaccuacucuaucguuuccgcgagcgcuuucggguccuauuuugacaucucucuguacgaaggcuauggagugauuagcgucucccggccucuugauuacgagcagaucucuaauggccucauuuaucugaccgugauggccauggacgccgggaaucccccgcugaauagcacagugccugucacgaucgaaguuuucgaugagaacgacaauccucccaccuuuuccaagcccgcuuacuucgugagcguggucgagaacauuauggccggagcuacagugcucuuucugaaugccaccgaucuugacagaucucgcgaauacggccaggaguccaucaucuauagccuggaagggucuacacaauuccggauuaacgcgagauccggagagaucaccacgacaagccuccuggaccgcgagaccaaaucugaauacauucugaucguucgggccguggauggcggggucggccauaaucagaagaccggaauugcuacagugaacaucacccuucucgacaucaaugauaaccacccgacauggaaggacgcccccuauuacauuaaccugguugagaugacgccucccgauagcgacgugaccacagucguggcuguugauccugaccugggcgaaaaugggacccucguguauuccauccagcccccuaacaaauuuuacagccugaacucuacaaccggaaagauuagaacgacccacgccaugcuugaucgggagaaccccgacccgcaugaagcggagcugaugcgcaaaaucgucguguccgugacagauugcggcagaccuccccucaaggccaccagcuccgcuacagucuucguuaaucugcuggaccuuaacgacaaugauccuaccuuucagaaccuccccuucguggccgaggugcuggaagggauuccggcuggagucucuaucuaucaagugguugccauugaccuggaugagggccucaaugggcuggugagcuaccggaugccugucggcaugcccagaauggacuuucuuaucaacuccucuagcggagugguugugacaaccacggaacuggaucgcgagcggaucgccgaauaccagcucagagucguggcuuccgacgcgggcacaccuaccaaaucuagcaccuccacacugaccauucacguccuggaugugaaugacgagacgcccacauucuuccccgccguuuauaacgugagcgucucugaggaugugccucgcgaauuuagaguuguguggcuuaauuguaccgacaacgaugucgggcucaaugcugagcuguccuacuucaucacaggaggcaacguggacgggaaguuuagcgugggauaucgggaugccguuguccgcaccguggugggccuggacagagaaacaaccgccgcuuacaugcucauucuggaggccaucgacaacgggccggucggcaaacggcauacgggaaccgcgacaguguucguuaccgugcuugaugucaaugacaaccgccccauuuuucugcagucuuccuaugaagcuagcgugccugaggauauccccgagggccacucuauccuccagcugaaggccacagacgccgaugaaggggaguucggaagaguuugguaccggauucugcauggcaaucacgggaacaauuuucgcauccacguguccaacggacuucugaugagaggcccucggccccucgaccgcgaaagaaauagcucccauguccugauuguggaggcuuauaaccacgaucucggcccuaugcggagcucuguuagagugaucgucuacguggaggacauuaaugaugaagccccgguguucacccaacagcaguacagccgccuggggcuucgggagacggcgggaaucggcacauccgucaucguugugcaagcuaccgacagagauucuggggacggaggccuggugaacuaucgcauucucagcggggccgaaggaaaguuugagaucgaugaauccacaggccugauuaucaccgucaauuaccuggacuaugagaccaaaacaucuuacaugaugaacgugagcgccacggaccaggcucccccuuucaaucagggcuuuugcuccguuuauauuacccuucugaacgagcucgaugaagccgugcaguucucuaaugcuagcuacgaggccgcgauccuggaaaaccucgcccuggggacagagauuguccgggugcaggcuuauuccaucgacaaucuuaaccaaaucaccuacagauucaacgccuacacaagcacccaggcuaaggcccuguuuaaaauugaugccaucacgguucgcggauggggccagggggcucccuuccucccuauuuga

SEQ ID NO: 67194 - RNA, 498 nt, Artificial Sequence
  derived and/or modified sequence opt5 from CDH26__Homo_sapiens__NP_068582
augaagccccugaucuggaccuggagcgacguggagggccagagaccugcccuccugauuugcacagcugccgcggggccgacgcaaggagucaaagaucuugaagagguucccccuuccgcugccucucagagcgcccaggcucggugugcccugggcuccuggggguacggaaagcccuucgaaccucgcucugugaaaaacauccacagcacccccgcuuauccugacgccacaaugcauagacagcuccuggcgccgguggagggccggauggccgaaacccuuaaucaaaagcugcacgucgcuaacgugcucgaggaugaccccggguaccugccucauguuuauuccgaggaaggagagugcggcggcgcccccucucugagcucccucgcuagccuggaacaggagcuucagccugaucugcucgacucucugggguccaaagccacacccuuugaggaaauuuacagcgagucuggagugccguccuga

SEQ ID NO: 67195 - RNA, 2721 nt, Artificial Sequence
  derived and/or modified sequence opt5 from CDH2__Homo_sapiens__NP_001783
augugcagaaucgccggcgcucugcggacccuccugccccuucuggccgcgcuccugcaggcuagcguggaggccuccggggaaauugcccuuuguaagacaggauucccugaggacgucuacucugcuguucugagcaaagaugugcacgaaggccaaccgcuccugaacgugaaguuuuccaauugcaacgggaaacgcaagguccaguaugagucuagcgaacccgccgacuucaaaguggaugaggacggaaugguuuacgcugugagauccuuuccucugucuagcgagcaugccaaguuccucaucuaugcgcaggauaaggaaacgcaggagaaauggcaagucgccgugaagcugucccuuaaacccacccugacagaagagagcguuaaggagucugcugaaguggaggaaauugucuuuccucggcaguucuccaaacacagcggccaucuccagcgccagaagagagacugggugauucccccuaucaaucugccggagaacucucgggggcccuuuccucaagaacuugugcgcaucagauccgaucgggacaagaaucugagccuccgcuacucugucaccggacccggcgccgaucagccucccacaggcaucuucauuaucaacccgauuuccgggcagcugagcguuaccaaaccucuggacagagagcagaucgcucgguuucaccuccgcgcccaugcgguggauauuaauggaaaccaaguggagaaucccaucgacauugucaucaacgugaucgauaugaaugacaacagaccugaguuccugcaccagguuuggaauggcacagugcccgaaggguccaagcccggaaccuaugucaugacggugaccgccauugacgcugaugacccuaacgcccuuaauggcaugcugcgguaccgcaucguuucucaggcuccgagcacacccuccccuaacauguuuaccauuaacaaugaaacaggggauaucauuaccguggccgccggacucgacagagagaaaguccaacaguauacgcugaucauccaggcuacagauauggaaggcaaccccaccuacggccuuagcaauacagcgaccgccgugauuaccgucacagacgugaacgauaauccucccgaguucacggcuaugaccuuuuacggggagguuccggaaaaccggguggacaucauugucgccaaucugacagugaccgauaaggaccagccucacacacccgccuggaacgcuguuuauagaaucucuggaggcgauccuaccgggcgcuucgccauucaaacggaccccaauuccaacgacggacucgugacagucgugaaaccuaucgauuucgagaccaaucggauguuugugcugaccguugcggcugaaaaccaggucccccuggccaagggcauccagcauccgccucagagcacagccaccgugucugugacagucauugacgugaaugagaaccccuacuucgcucccaauccuaaaaucauuagacaagaagaggggcuccacgccggaacgaugcugaccacauuuaccgcucaggauccggaccgcuauaugcagcagaacauccgguacacaaaacuuagcgaucccgccaacuggcugaagauugacccuguuaauggccaaaucaccacgauugcggugcucgauagagagucccccaacgucaagaauaacaucuauaaugccaccuuccuggcuucugacaacggcaucccucccaugagcgggacaggaacccuucagauuuaccugcucgauaucaaugacaacgccccucaggugcugccccaggaagcugagacaugugaaaccccggauccuaauuccauuaacaucacggcccuggacuaugauauugaccccaaugcgggcccuuuugccuucgaccucccccugagcccgguuacaaucaagcgcaacuggaccaucacacggcuuaauggggauuuugcucaacugaaccucaaaauuaaguuccuggaggccggaaucuacgaggugccuauuaucauuaccgacucuggcaaucccccuaaauccaacaucagcauccugagagucaaggugugccagugugauucuaacggggacugcaccgauguugaccgcauugugggcgcuggacuuggcacaggggccaucauugccauccuccuguguauuaucauccugcucauucugguccuuauguuugugguguggaugaagcggagagauaaagaacgccaggcuaagcaacugcucaucgaccccgaggaugacguccgggauaauauucugaaauacgacgaagagggaggcggggaagaggaucaggacuaugaccugucccagcuucagcaacccgauacgguugagccugacgcgaucaagccggugggaauuagacggauggaugaacgccccauccaugccgagccucaguaccccgugagaagcgcugccccucaccccggcgacauuggggauuucaucaacgaaggccucaaagccgcugacaaugauccuaccgccccgcccuaugacucccugcuggucuuugauuacgagggaucuggcagcacagcggggucccucucuagccugaacuccucuagcuccggaggcgaacaggacuaugauuaccuuaaugacugggggccucgguucaagaagcuggcugacauguauggaggcggggaugacuga

SEQ ID NO: 67196 - RNA, 2490 nt, Artificial Sequence
  derived and/or modified sequence opt5 from CDH3__Homo_sapiens__NP_001784
augggccugcccagagggccucucgccagccugcuucugcuccaggugugcuggcugcaaugugcugccuccgagccgugccgggcggucuuccgcgaagcugagguuacccuugaagccggaggcgccgagcaggaacccgggcaggcucugggaaagguguuuaugggcuguccugggcaggagcccgcccucuucucuacagacaacgaugacuuuacggugagaaauggagagaccguccaagaacggcgcagccugaaagagagaaacccucugaagaucuuccccuccaaacggauucuccgcagacacaagcgggauugggugguugcuccuaucucugugccggaaaauggcaaaggccccuuuccucagcgccugaaccagcuuaagagcaauaaggacagagauacaaaaauuuucuacuccaucaccgggcccggagccgacucuccucccgagggcgucuuugcgguggagaaggaaacaggguggcugcuccugaacaaaccgcuugaucgggaggaaauugccaaguaugagcuguucggacaugcuguuagcgaaaauggcgccuccguggaggacccuaugaacaucagcaucauugucaccgaucagaaugaccacaaacccaaguuuacacaagauaccuuccgcgggucugugcucgagggagugcugccuggcacguccgucaugcagguuaccgcuacagacgaagaugacgccaucuacaccuauaacggcgugguggcguacagcauucauucucaggagcccaaggacccccacgaucugauguuuacaauccauagauccaccgggacgauuagcgucaucucuuccggacucgaccgggaaaaagugccugaguauacacugaccauucaggccacagauauggacggcgaugggagcaccaccacagcuguugccguggucgaaauccuugacgcuaaugauaacgccccgauguucgacccccaaaaguacgaggcccacgugccugagaaugcuguuggacacgaagugcagcgccugacggucaccgaucucgacgcgcccaacuccccugccuggagagcuacauaucugaucaugggcggggaugacggagaccauuuuaccauuacaacccaccccgagucuaaucagggcauccuuacgacacggaaaggccuggauuucgaagccaagaaccaacauacccucuacguggaggucaccaacgaagccccguucgugcugaaacugccuacaagcaccgcuacaauuguugugcacgucgaggacgugaaugaggcccccguuuuugugccucccuccaaggucguggaagugcaggaggggaucccuacgggagaacccguuugcgucuacaccgcggaggauccggacaaagagaaccagaagauuagcuauagaauccuccgcgauccugcuggcuggcuggccauggaccccgauucuggacaggugacagccguggggacccuugaccgggaagaugagcaauucgucagaaauaacaucuacgaagugaugguucuggcuauggacaauggcuccccucccacaaccgggacgggcacccuccugcuuacacugauugaugugaacgaccacggaccgguccccgagccucgccagaucaccauuuguaaucagagccccgugcggcagguucucaacaucacagauaaggaccugucuccucauaccagccccuuucaagcccagcugacggacgauuccgacauuuauuggacagcugaagugaaugaggagggcgauaccgucgugcucucucugaaaaaguuccuuaaacaggacacauacgauguucaccugagccucuccgaccaugggaacaaggaacagcugaccgugaucagagccaccgucugcgauugucacggacauguggagacaugcccuggccccuggaaagggggauuuauccugccggugcuuggcgcgguccucgcccugcuguuccuccugcuuguucugcuccugcuggugcgcaagaagcggaaaauuaaggaaccucuucuccugcccgaggacgauacgagagacaauguguuuuauuacggggaagagggcggaggcgaggaagaucaagacuaugauaucacccagcugcaccgcgggcucgaggcucggccugaagucgugcugagaaacgacguugcccccacaauuaucccgaccccuauguaccgcccccggccugcuaaucccgacgagauuggaaacuucaucauugaaaaucuuaaagccgcgaacacagaucccaccgccccuccguacgacacgcugcucguguuugauuaugagggcagcgggucugacgcugccucccugagcucucugacauccagcgcuuccgaucaggaccaggauuacgacuaucuuaacgaguggggaucuagauucaagaaacucgccgauauguacggcgggggcgaagacgauuga

SEQ ID NO: 67197 - RNA, 2640 nt, Artificial Sequence
  derived and/or modified sequence opt5 from CDH4__Homo_sapiens__NP_001239267
augaacggcagcugcgacuucauccuguccgccucuuuucuccccuguuucaaggaggugaaauuuagcuccugcgucgggaccaagggaacacaguacgaaacgaauagcauggauuucaaaguuggcgcugacgggaccguguuugccacaagagagcugcaagugccuagcgaacaggucgcguucaccgugacagcuugggauucccagaccgccgagaagugggacgccguugugcggcuucuggucgcucagacaucuagcccgcacuccggacauaaaccccaaaagggcaagaaagugguugcccucgauccuucucccccucccaaggacacccugcuuccuuggccgcagcaccagaacgcuaaugggcugcgcagacggaaacgcgauugggugauucccccuaucaacguccccgaaaauucuagaggaccuuuuccccagcaacucgugcggauucgcuccgacaaggauaacgacaucccgauuagauauagcaucacgggcgugggcgccgaucagccucccauggaggucuucucuaucgacuccaugagcgggcggauguacguuacccgcccuauggauagagaggaacaugcgucuuaucaucugcgggcccacgcuguggacaugaauggaaacaaaguggagaaucccauugaccuguacaucuaugucauugauaugaacgacaaucgccccgaauuuaucaaccagguguacaauggcuccguugaugaggggagcaagccuggaacauaugugaugaccgucacagccaacgacgcugaugacuccaccacggccaauggcauggugagauaccggauuguuacacagaccccgcaaucucccagccagaacauguucacaaucaacuccgagaccggggauauugugaccgucgcggccggacucgaccgcgaaaaggugcagcaauacacagucaucgugcaggcuacggauauggagggcaaucugaacuauggccuuagcaauaccgccacagcuaucauuaccguuacagacgugaacgauaauccucccgaauuuaccgccucuacguucgccggggaggucccugaaaacagaguggagacaguuguggcuaaucugaccgucauggaccgggaccagccccacuccccgaacuggaaugcgguguacagaaucauuagcggagauccuucuggccacuuuagcgugcgcaccgaccccguuacaaacgaggggauggucaccguggugaaagccgucgauuaugaacucaaucgggcuuucaugcugacagugaugguuuccaaccaggccccucuugccucuggaauccaaaugagcuuccaguccacggcuggcgugaccauuagcaucauggacaucaaugaggcccccuacuuuccuucuaaccauaagcugauuagacucgaagagggggugcccccgggaacaguccugaccacauucuccgcgguugauccugaccgcuuuaugcagcaggcugugcgguauagcaaacugucugaucccgccuccuggcuccacaucaaugccaccaacggccaaauuacgaccgcugccguccuggacagagaaagccuuuacacaaagaacaauguguaugaggcuaccuuccuggccgcggauaacggcauucccccugccuccgggacaggaacccuccagaucuaccugaucgacaucaaugauaacgcuccggagcuucugcccaaagaagcccagauuugugagaagccuaaucucaacgcuaucaauauuacggccgcggacgccgauguugaccccaacaucggcccuuacguguuugaacugcccuucgucccugcugccgugcgcaaaaauuggacaauuacccggcugaacggggacuaugcucagcucucucugagaauccuuuaccuggaggccggaauguaugaugugcccauuaucgucacagacagcggcaauccgccucucuccaacaccucuaucauuaagguuaaggugugccccugugaugacaauggggauugcaccacaaucggcgccguggcugcggccggacugggcacgggggcuauugucgccauccuuauuuguauccugauccuccugaccauggugcugcucuuuguuauguggaugaaacgccgggaaaaggagagacauacaaaacaacugcuuauugacccugaggaugacgugcgcgauaacauccugaaguacgacgaagagggaggcggggaagaggaucaggacuaugaucucagccagcugcagcaacccgaggccaugggacacgucccguccaaagcuccuggcgugcggagaguugacgaacggcccgugggggccgagccucaguaccccauucgccccauggucccucacccgggcgacaucggagauuucauuaaugaaggccugagagcggcugacaacgaucccaccgccccucccuaugacagccuucucguguuugauuacgaggggucuggauccacagccggcagcguuucuucccugaacagcucuagcuccggggaccaggauuacgacuaucugaaugauuggggaccucgguucaagaagcucgcugacauguacggcgggggcgaagaggauuga

SEQ ID NO: 67198 - RNA, 2355 nt, Artificial Sequence
  derived and/or modified sequence opt5 from CDH5__Homo_sapiens__NP_001786
augcagagacugaugaugcuccuggccaccagcggcgcuugccuugggcugcucgccguggcggcugucgccgccgcuggagccaaccccgcucaacgggacacacacucccugcuuccuacgcaucgcagacagaagcgggauuggaucuggaaucagaugcacauugacgaggagaaaaacaccucucugccgcaucacguuggcaagaucaaaagcuccgugucucgcaagaaugccaaauaccuccugaagggggaguaugugggaaaggucuucagaguggaugcggaaacaggcgacguuuuugccauugagcggcuggaucgcgaaaacaucagcgaguaccaucucaccgcugugauugucgacaaagauacaggggagaaucuggaaacccccuccucuuucacaaucaaggugcacgacguuaacgauaauuggccuguguuuacccacagacuuuucaacgccagcguccccgaguccagcgcugugggaacgucugugaucuccgucaccgccguugacgcggaugacccuacagugggcgaucaugccagcgugauguaucagauucugaaaggcaaggaauacuuugcuaucgacaauucugggcggauuaucaccauuacaaaaucccucgaccgcgagaagcaagccagauaugagaucgucguggaagcucgggaugcccagggacugcgcggcgacagcgggaccgccacgguucuugugacacugcaggauauuaacgacaauuuccccuuuuucacccagacaaaguacaccuuugucgugccugaggauaccagaguuggaacaucugugggcucccucuucgucgaagacccggaugagccccaaaaccggaugacgaaauauagcauccugcgcggggacuaccaggaugcuuuuaccaucgaaacaaauccugcgcacaacgagggaauuaucaagcccaugaaaccucuggacuacgaguauauucagcaguacuccuucaucguggaagccaccgaucccacaauugaccucagauauaugucuccgccugcuggcaaucgggcccaagucaucaucaacauuaccgacguggaugagcccccuaucuuucagcagcccuucuaccauuuccaacugaaggaaaaccagaaaaagccccuuauuggcacgguucuggccauggacccugaugcugccagacacagcaucggguauuccauucgccggacaagcgacaaaggacaguuuuucagagugaccaagaagggcgauaucuacaaugagaaagaacucgaccgcgaggucuauccgugguacaaccugaccguggaggcgaaggaacuugauucuacagggacccccacaggaaaagaguccaucguucaggugcacauugaaguccuggacgagaaugauaacgcuccugaauuugccaagcccuaccaaccuaaagugugugagaaugccgugcauggccagcucguucugcagaucagcgcuauugacaaggauaucacgccccggaacgucaaguucaaauuuauucugaauaccgagaacaauuucacacucaccgacaaccacgauaauacagccaacaucaccgugaaguaugggcaguuugacagagaacauacgaaagugcacuuccugccggucgugauuucugacaauggaaugccuagccgcaccggcacauccacccuuacaguugcugugugcaaguguaacgagcaaggcgaauuuaccuucugcgaggauauggccgcgcaggucggggugucuauccaggccguuguggcuauccugcucuguauucugacgaucacagucauuacccuucugaucuuucuccggagacgccugcggaaacaggccagagcucauggaaagagcgugcccgagauucacgaacaacugguuacauacgacgaggaaggcgggggagagauggauaccaccuccuaugacgugagcguccucaauucugugcgccggggcggggccaagccucccagaccugcgcuggaugcccggcccucccuuuacgcucaggugcagaaaccgccucgccacgcccccggcgcucauggaggccccggggaaauggccgccaugaucgaggucaagaaagacgaggcugaucacgacggagauggcccuccguaugacacacugcauaucuacggguaugaaggaagcgagucuauugcggaaucccucagcucccugggcacggauucuagcgacuccgauguugacuacgacuuccugaacgauugggggcccagauuuaagaugcuugccgagcucuacggcucugacccucgggaagaacugcuguauuga

SEQ ID NO: 67199 - RNA, 2373 nt, Artificial Sequence
  derived and/or modified sequence opt5 from CDH6__Homo_sapiens__XP_011512223
augagaaccuaccgguauuuccugcuccuguuuugggugggccagcccuacccuacacuuagcacgccgcuguccaagcgcaccucuggguuccccgccaaaaagagagcucucgagcugagcggaaacuccaaaaaugaacuuaaccggucuaagcgcagcuggauguggaaucaauuuuuccugcucgaggaauauacaggcuccgacuaccaguaugucgggaaacugcacucugaucaggacagaggagauggcagccugaaguacauccucuccggggacggagccggcgaucuguuuauuaucaacgagaauaccggcgacauucaggcgacaaagcggcuugaucgcgaagagaaaccuguuuauauccugagagcucaagccauuaaccggcgcaccgggagacccguggagccugaaagcgaguucaucaucaagauucaugacaucaaugauaacgaacccauuuuuacaaaagagguguacaccgccacggucccugagaugucugacgugggaaccuucguugugcaggucacagcuaccgaugccgacgauccgacauacggcaauuccgcuaaggugguuuauagcauccuccaggggcagcccuacuuuucuguggaauccgagaccggaauuaucaaaacggcccugcuuaacauggaccgggaaaaucgcgagcaauaucaggucgugauucaggcgaaggacaugggcgggcagaugggaggccugagcggcacaaccacagugaacaucacccucaccgaugucaaugacaacccucccagauucccucaaucuacauaccaguuuaagacgcccgaauccagcccgccugggacccccaucggacggauuaaagccuccgaugcugacguuggcgagaaugccgagaucgaauauucuauuacagauggggagggacuggacauguucgaugugaucaccgaccaggaaacacaagagggcauuaucaccgugaagaaacugcucgauuuugaaaagaaaaaggucuacacgcugaaaguggaggcuagcaacccuuauguugagccccgcuuccuuuaccuggggcccuucaaggacuccgccacagugagaaucgucguggaagauguugacgagccuccgguguuuagcaagcucgcguacauucugcagauccgggaagacgcccagauuaacaccaccaucggaucugucacagcucaggaucccgacgccgcuagaaauccugugaaauauuccgucgaucgccacaccgacauggaucggauuuucaacaucgacagcggcaauggcucuaucuuuacaagcaaacuucuggauagagagacgcuccuguggcauaacauuaccgugaucgccacagaaauuaauaaccccaagcaauccucucgcguuccucuguacaucaaggugcucgacgucaaugauaacgcccccgaguucgcugaguuuuaugaaaccuucgugugcgagaaagcgaaggccgaccagcugauucagacacuucacgcuguugauaaggacgauccguacagcgggcaucaguuuuccuucagccuggccccugaagccgcuucuggauccaauuuuaccauccaagacaacaaagacaauacggccggcauucucacccggaagaacggguauaauagacacgagaugagcacauaccugcuucccguggucaucucugauaacgacuauccugugcaguccagcaccggaacagugaccguucgcgucugugcgugcgaucaccauggcaauaugcaguccugucacgcugaggcccugauccaucccacggggcucucuacaggcgcccugguggcuauucugcucugcaucgugauucugcuugucaccgugguucuguucgccgcucuccggagacagcgcaaaaaggaaccucugaucauuagcaaagaggacauccgggauaacaucguguccuacaacgacgaaggaggcggggaggaagauacacaagccuuugacauuggaacccugagaaaucccgaggcgaucgaggauaacaaacuucgccgggacauugucccggaagcccucuuccugccuagacggacccccacagcucgcgauaauacggacgugagagauuuuaucaaccagcggcugaaggagaaugacaccgaccccacagccccuccguacgauucucucgcuaccuaugccuacgaaggcacagggagcguugcggacucccugagcucucuugaguccgugaccacggaugccgaccaggauuaugacuaccugagcgauuggggacccagauucaagaagcucgcugacauguauggcggggucgauucugacaaagauuccuga

SEQ ID NO: 67200 - RNA, 2358 nt, Artificial Sequence
  derived and/or modified sequence opt5 from CDH7__Homo_sapiens__NP_387450
augaagcugggcaaaguggaguucugccacuuucuccagcugaucgcccuuuuccuguguuuuagcgggaugucccaagcugaacucucuagaagccgguccaagcccuacuuccagucuggacgcagcagaaccaaacgguccugggucuggaaccaguuuuucguucuggaggaauauaugggcucugacccucuuuacguggggaagcugcauagcgauguggacaaaggagauggcuccauuaaguauauccucagcggggagggagccucuuccauuuuuaucauugacgaaaauacaggcgauauccacgcgacgaagcgccuggacagagaggagcaggcuuacuauacccugcgggcccaagcccucgaucgccugacaaacaaaccggucgaacccgagagcgaguucgugaucaagauucaggacaucaaugauaacgaaccuaaauuucuugacggccccuacaccgcugggguuccugagaugucucccgugggaacauccgucgugcagguuaccgccacagaugcugacgauccuaccuauggcaauagcgccagaguggucuacucuauucugcaggggcaaccguacuucuccguggaacccaagacgggagugaucaaaaccgcgcucccuaacauggaccgggaggccaaggaccaguaucugcuugucauucaggcuaaggauaugguuggccagaaugggggacugagcggcacaaccuccgugacagugacccucacggacgucaacgauaaucccccucgcuuucccagacggucuuaccaauauaacgugccggaaagccugccuguugccuccguggucgcucgcaucaaagccgcggacgccgauauuggcgcuaaugccgagauggaauacaagaucguggacggggauggacugggcaucuucaaaauuagcguugacaaggagacacaggaggggaucauuaccauccagaaagaacucgauuuugaggcuaagacaucuuauacccugagaauugaagccgccaacaaagacgcugauccccgguuccuuucccugggaccuuucagcgacaccacaacggugaagaucaucgucgaggacguggaugaaccucccgucuuuucuagcccccucuacccgauggagguguccgaggcgacccaaguuggcaauauuaucgggacaguggccgcucaugaccccgauucuagcaacuccccuguccgcuauagcauugacagaaauaccgaucuggaacgguacuucaacaucgacgccaacucuggagugauuacaaccgccaagucccuugauagagagacgaaugcuauccacaacaucacaguucuggccauggaaagccagaaucccucucaggugggccgcggcuacgucgcgauuaccauccucgacauuaacgauaaugcuccugaguuugccauggacuaugaaaccacagugugcgagaacgcccagcccgggcaagugauccagaaaauuuccgcuguugauaaggacgagccgagcaauggacaucaguucuacuuuucccugaccacagaugccacgaacaaucacaacuucucucugaaagacaauaaggacaacaccgcuagcauccucacacggagaaauggcuuucgccggcaggaacaauccgucuauuaccugccuauuuucaucguggauucugggagccccucccuuagcucuaccaacacacugaccaucagagugugugacugcgaugccgacggagucgcgcagacguguaaugccgaggcuuaugugcucccugccggccuguccaccggggcucuuauugccauccuggcgugcguucucacacugcuggugcucauucugcuuaucgucaccaugcgccggcgcaaaaaggaaccccugauuuuugaugaggagagagacauccgggaaaacaucgugagauacgaugacgagggcggaggcgaagaggauacagaagccuucgacauggcugcccuccgcaaccugaauguuauucgggauaccaagacgagacgggacgugacaccugagauccaguuucugagccgccccgcuuucaaaucuauuccggauaacgucaucuuuagagaguucauuugggaacggcuuaaggaggccgacguggacccuggggccccucccuaugauucccuccagaccuacgcuuucgaaggaaauggcagcguugcggagucucugagcucccuggacagcaucucuuccaacagcgaucaaaauuacgacuaucucuccgauugggggcccagauuuaaacgccuggccgacauguacggaacaggccaggaaucucuuuauagcuga

SEQ ID NO: 67201 - RNA, 2400 nt, Artificial Sequence
  derived and/or modified sequence opt5 from CDH8__Homo_sapiens__NP_001787
augcccgagagacuggccgaaaugcuccuggaccuuuggaccccucugaucauucucuggaucacacugccgcccugcauuuacauggcuccuaugaaccagagccaagugcuuauguccggcucuccccuggagcucaauagccugggggaagaacagcggauccugaaccgcuccaagagaggaugggucuggaaucagauguucguucucgaagaguuuucuggcccugagcccauucugguggggcggcuucacacggaucuggacccuggaagcaaaaagaucaaauauauccucuccggcgauggggccggaaccauuuuccagaucaacgacgugacaggcgauauucaugcgaucaagcgccuggacagagaagagaaagcugaauacacccuuacagcccaagccgucgauugggagaccucuaagccgcuggagcccccuagcgaauuuauuaucaaggugcaggacauuaaugauaacgcucccgaguuccucaauggcccuuaucacgccacaguucccgaaauguccauccuggggaccagcgugacgaacgucaccgcuacagacgccgaugacccgguguacggaaauucugcgaaacugguuuauuccauccucgagggccagccuuacuuuagcauugaacccgagaccgccaucauuaagacagcucugccuaacauggaucgggaggccaaagaagaguaucuuguggucauccaggcuaaggacaugggagggcauucuggcgggcuguccggaaccacgacacucaccgugacacugaccgacgugaaugauaacccucccaaauucgcccaaagccuuuaccacuuuucuguccccgaagacguugugcugggcaccgcgauuggccgcgugaaggccaaugaucaggacaucggggagaacgcucaguccagcuacgauaucauugacggagauggcacagcccucuucgaaaucacguccgacgcucaggcccaagaugggauuaucagacugcggaagccgcuggacuuugagaccaaaaagucuuauacacucaaagucgaggccgcuaaugugcauauugauccccgcuucagcggaagaggcccuuuuaaggacaccgcgacaguuaaaaucguggucgaagacgccgaugagcccccuguguucuccagccccaccuaccugcuugaaguucacgagaacgcugcccugaacucugugaucgggcaggucacggcccgggacccggauauuacauccagcccuauccgcuuuucuauugacagacacaccgaucucgaacggcaguucaauaucaacgcugacgauggaaagauuacccuggccacaccccuugaccgcgagcugagcguguggcauaauaucaccauuaucgcgacagagaucagaaaccacucccaaauuucucgggucccuguggcuaucaaaguucucgaugugaaugacaacgcccccgaguucgccagcgaguaugaggcuuuucugugugaaaauggcaagccuggccaggucauucagacgguguccgccauggauaaggacgaucccaaaaacgggcauuacuuccuguauagccuccugccggagaugguuaauaacccuaauuuuaccaucaagaaaaacgaagacaauucucuuuccauucuggcuaagcacaacggauucaauagacagaaacaagagguguaccuccugcccaucaucauuagcgacucuggcaaucccccucuguccagcacauccacccuuacaauccgcgucugcggguguucuaacgauggaguggugcagagcugcaacguugaagccuauguccucccgauuggccuguccaugggggcgcugaucgccauucucgcuuguaucauccugcuucuggugauugugguccucuuugugacccugcggagacacaagaacgagccccugaucauuaaggacgaugaagacguucgcgagaauaucauucgguacgaugacgagggcggaggcgaagaggauacggaagccuucgacaucgcuacccuucagaacccugaugggaucaauggauuucuccccagaaaagacauuaagccugaucugcaguucaugccccgccaaggccuggccccugugcccaacggggucgacguggaugaguuuaucaauguucggcuccaugaagcggacaacgacccgacagccccucccuacgauucuauucagaucuauggauacgagggcagagggagcguggcuggcucccugagcucucuugaguccaccacaagcgacucugaucagaauuucgacuaucuguccgauuggggaccucgcuuuaaacggcucggcgaacuguacagcgucggggagucugacaaggaaaccuga

SEQ ID NO: 67202 - RNA, 2370 nt, Artificial Sequence
  derived and/or modified sequence opt5 from CDH9__Homo_sapiens__XP_011512224
augagaaccuaccacuauaucccccuguucauuuggacauacauguuucauacgguggacaccauccuccugcaggagaagccuaacagcuaucuuuccucuaaaaagauugccggccugacaaaagaugacgggaagaugcuccggcgcaccaaaagaggauggauguggaaucaauucuuucugcuugaagaguacacaggcaccgauacacaguaugucgggaagcugcacaccgaccaggauaagggagacggcaaccucaaauacauccugacgggggauggagcuggcagccuguucguuauugacgaaaauaccggcgauauccaugccgcgaagaaacucgaccgggaggaaaagucccuguauauccuucgcgcuaaagccauugauagaaagacagggagacagguggagccggagucugaauuuaucauuaagauccacgacauuaacgauaaugagcccaaauucaccaaggaccuguacacagccagcgugccugaaauguccggagucggcaccucugugauccaaguuacggcuacagacgccgaugacgcuaacuacgggaauagcgccaaaguggucuauuccauucuccagggacagcccuacuuuagcguggauccugagucuggcaucaucaagaccgcgcugcccgacaugucccgcgagaacagagaacaguaucaaguugugauucaggccaaagauaugggagggcagaugggcggccuuagcgggacaaccaccgucaauaucacacugacggacgugaacaauaacccuccgcgguucccccagucuaccuaccaauuuaauuccccugagagcgugccccucggaacacaucugggccgcauuaaggcuaacgauccugacgucggggaaaaugccgagauggaauauucuaucgcugagggagauggcgccgacauguucgauguuauuaccgacaaagacacacaggaggggaucaucaccgugaagcagaaccuggauuuugaaaaccaaaugcucuacacgcugagaguggacgcguccaauacacaccccgauccgcgguuccuucaccugggaccuuuuaaggacaccgccgucgugaaaauuagcguugaggauaucgacgaacccccuguguucaccaaggucuccuaucucauugagguggaugaagacguuaaagagggcucuaucauuggccaggugacagcuuacgaucccgacgcccgcaacaaucugaucaaguacagcgucgauagacauaccgacauggaucggaucuucgggauucacuccgagaacggaagcaucuuuacacuuaaagcucuggaccgcgaaucuucccccuggcauaauauuacggugaccgccacagagaucaacaauccuaagcagagcucucacauuccggucuucauccggauucucgacaucaacgaucacgcccccgaauuugcuauguauuacgagaccuucgugugcgaaaaugcgaagccuggccagcugauccaaacaguuagcgugauggacaaagaugaucccccucgggggcauaaguuuuucuuugagcccgucccggaguucacccugaacccuaauuuuacgauuguggacaacaaagacaauaccgccggaaucaugacaagaaaggauggcuauucccgcaacaaaaugucuaccuaccuccugcccauucuuaucuucgacaaugauuauccuauucagagcuccacagggacccugacgauccggguuugugcuugcgacaaccagggcaacaugcagagcuguacagccgaagcccucauccugucugcuggacuuuccaccggcgcccugguggcgauucuccugugcguccugauccuccugauucuuguggugcuguuugcugcccucaagagacaacgcaagaaagagccccugaucauuagcaaggaugacguucgggauaauaucgucacauacaacgacgaagggggaggcgaggaggacacccaggccuucgauaucgggacccugagaaauccugaagcucgcgaggacucuaaacuucggagagaugugaugcccgaaacaauuuuucagauccgccggacggugccgcucugggagaacauugacguccaggauuucauccacagacgccugaaggaaaaugacgccgauccuuccgcuccucccuaugacagccuggccaccuacgcguacgagggaaacgauuccauugccgacucucucagcucccuggagucucuuacagcugauuguaaucaagacuaugacuaccugagcgauuggggcccccgguucaaaaagcucgccgacauguaugggggcgaugacuccgauagagacuga

SEQ ID NO: 67203 - RNA, 2238 nt, Artificial Sequence
  derived and/or modified sequence opt5 from CDHR1__Homo_sapiens__NP_001165442
augagacggugccgcugggccgcucuggcccucggccugcuuagacugugucucgcgcaggcuaacuucgcuccccacuuuuucgacaauggggugggaagcaccaacggcaauauggcccuguuuucccuuccugaggauacaccggucgggucucauguuuacacgcugaacggaaccgaccccgaaggcgauccuaucagcuaucacauuuccuucgaccccucuacacggagcguguuuuccguggauccuaccuucgggaauaucacacucgucgaggaacuggaccgcgagagagaagaugagauugaggccaucauuucuaucagcgacggacugaaccucguggccgaaaagguugugauccuggucaccgaugcuaaugacgaggcgccccgguuuauucaagaaccuuacguggcccuuguuccggaggauauccccgccggcuccauuaucuucaaagugcaugcugucgaccgcgauacaggcagcgggggaucugugaccuauuuucugcagaaccuccacuccccuuucgccguggacagacauagcggcguccugcggcuucaggcuggggccacgcuggacuacgagcgcucuagaacccacuauauuacaguuguggcgaaggauggaggcgggcggcuccacggagccgacguggucuuuuccgcuaccacaaccgugacgguuaauguggaagauguccaggacauggcccccguguucguuggcacaccuuacuauggcuacguguacgaggauacccugcccgggagcgaaguccugaaaguggucgcuauggacggagaucgcggcaagccgaacagaauccucuauucucuggugaaugggaacgacggagccuuugagauuaaugaaacauccggcgccaucagcaucacccaauccccugcucagcuucagcgggagguuuacgagcugcaugugcaggucaccgaaaugucucccgcggggagcccugccgcucaagccacagugcccguuacgauucgcaucguggaucucaacaaucacccucccaccuucuauggagaguccggcccgcagaacagauucgaacugagcaugaacgagcaucccccucagggcgaaauucuucgggggcugaaaaucacagucaaugacucugaucagggagccaacgcuaaguuuaaucuccaacuggugggccccagagggauuuuccgcgugguuccucagaccguccugaacgaggcccaggugacaaucaucguggagaacuccgcggcuauugacuuugaaaagagcaaaguccucaccuucaagcugcuugccguggagguuaauacgcccgaaaaauuuucuagcacagccgacguggucauccaacugcucgauaccaaugacaacgugccgaaguucgauucccuguacuauguugcucggauuccugagaaugcccccggaggcucuagcguggucgcugugaccgccguugacccugauacagggcccuggggcgaagugaaauacuccaccuauggaacaggcgcggaccuuuuucugauccacccuagcacggggcucauuuacacccagcccugggccucucuggaugcugaggccacagcuagauacaacuucuaugucaaggccgaggacauggaaggaaaguacuccguggcggagguguuuaucacccugcucgaugucaaugaccacccgccucaguucggcaaaagcguucagaagaaaacaauggugcuggggacccccgugaagaucgaagccauugaugaggacgcugaggaacccaacaaucuugucgauuauucuaucacgcaugccgagccugcuaacguguuugacauuaauucccacaccggagaaaucuggcugaaaaacagcauucgcucccucgacgcccugcauaacaucacaccgggccgggauugccuguggucucuugagguucaagccaaggacagagggagccccuccuucucuaccacagcucuccugaaaauugauaucaccgacgcggaagugcgccggcugagauacaugaagaauagcaacuuuccuggcacgacaaaguccguccgcaaacccaaguucaaaccuaagaaaccccacagcucucagggacucuuccugcauccucacugugagaucgcccuuuuuaaucuguccaacgugaaucucuauagccggguuuuccagggcgcugcccaggccucuuga

SEQ ID NO: 67204 - RNA, 3933 nt, Artificial Sequence
  derived and/or modified sequence opt5 from CDHR2__Homo_sapiens__NP_001165447
auggcccagcuguggcucagcugcuuccugcuucccgcucugguggucuccguugccgcgaacguggcuccuaaguuucucgccaauaugaccucugugauccugccggaggaccuucccgucggcgcccaggcuuucuggcugguggccgaagaucaagacaacgauccucucacauacgggaugagcggacccaaugcuuauuucuucgccguuacgccuaaaaccggcgaggugaagcuggcguccgcccuggacuacgaaacacucuauaccuuuaaagucacaauuucugugagcgaucccuacauccagguucagagagagaugcuggugauugucgaagaccggaacgauaaugcuccuguguuccaaaacaccgccuuuuccacaucuaucaaugagacccuuccgguggggagcgucguuuucuccgugcuggcuguggacaaggauaugggaagcgccggcauggucguguauucuauugagaaaguuauccccuccacgggggacagcgaacaccucuuucgcauccuggcgaacggaucuauugugcuuaauggcucccugagcuacaacaauaagucugccuucuaucagcucgagcugaaggcuugugaucugggcgggauguaccauaacaccuuuacaauccagugcucccucccugucuuccugagcauuuccgugguugaccagcccgaucuugacccucaauuugugagagaauuuuacucugccagcgucgcugaggacgccgccaaaggaaccuccgugcugacagucgaggcuguggauggcgacaaggggaucaaugaucccguuauuuauagcaucucuuacuccacccggccgggaugguucgacauuggcgcggauggggugauccgcgucaacggaagccucgacagagaacagcugcuugaggccgaugaagaggugcagcugcagguuacggcuacagaaacccaccucaauaucuauggccaagaggccaaagugucuauuugggucacagugcgggugauggacguuaacgaucauaagccugaguuuuacaacuguagccugcccgccugcaccuucaccccugaagaggcucaggucaauuuuacaggcuauguggacgaacacgccagcccccgcauccccauugaugaccugacgaugguggucuacgacccugauaaagggucuaacggaaccuuccuccugagccuuggcgggccggacgcggaggcuuuuuccgugagccccgaaagagccguuggaucugccuccgugcagguccuggugcggguuagcgcucucguggauuaugagcgccaaacagccauggcuguccaggugguugccaccgacucugugucccagaauuucagcgucgcgauggugacaauccaucugagagauauuaacgaccaccggccuaccuuuccccagucccuuuacgugcugacggucccugagcacucugccacaggcagcguugugaccgauuccauccaugcuaccgaccccgauacaggggccuggggacaaaucaccuacucucuccugccgggcaauggcgcugaccuguuccagguggauccugucagcgggacagugacgguucgcaacggagaacuccuggacagagagucccaggccguguauuaccuuacccugcaggcgacagauggcgggaaucucuccucuuccaccacacugcaaauucaucugcuugacaucaacgacaaugcccccgucgugagcggaucuuauaacauuuuuguucaggaagaggaaggcaauguguccgucaccauccaggcucacgauaacgacgagccugggacgaauaacagccggcuccuguucaaucugcuccccggcccuuacucucacaacuuuagccuggaucccgacaccggacuucugcgcaaccucggcccgcuggauagagaggccauugacccugcucuggaagggcggaucgugcuuacaguucucguguccgauuguggagagcccguccugggcaccaaggugaaugugacaaucaccgucgaagacauuaacgauaaucugcccaucuucaaccagagcucuuauaauuuuacgguuaaggaggaggacccuggggugcucgugggagucgugaaagccugggaugccgaccaaacagaagcuaacaauagaauuuccuucagccuguccggcucuggggcgaacuacuucaugauccgcggccuuguucugggagccggcugggcugagggguaucuccggcugccgcccgaugugagccuggacuacgaaacccagccugucuuuaaucuuacaguguccgccgagaaccccgacccucagggaggcgaaaccauuguugaugugugcgucaaugugaaggacgucaacgauaaucccccuacccucgacguggccucucugagagggauccgcguugcugagaacggaagccagcacggccaaguggccgucgugguugcguccgauguggacacaucugcucagcuggagauucagcucgucaauauccuguguacgaaagccgggguggaugugggcagccuuugcuggggaugguucuccguugccgcuaacggcagcgucuacaucaaccaaucuaaggccauugacuaugaagcgugugaucuggugacccucgugguccgggcuugcgaccuggccacagaucccggguuucaggccuacuccaauaacggaagccugcuuaucaccauugaggacgugaaugacaacgcuccguauuuccucccugaaaauaaaacauuuguuaucauucccgagcuggugcugccuaacagagaagucgccucugugcgcgcucgggaugacgauuccggcaauaacgggguuauccucuucagcauccugagaguggacuuuauuucuaaggauggagccaccauccccuuccagggcgucuuuuccauuuucacgagcuccgaggcggacguguuugccgggagcauccagccgguuacaucucuugauagcacccugcaaggcaccuaccaggugacaguccaggcucgcgaccggccuucccucggacccuuccuggaggccaccacaacgcugaaucuuuuuaccguggaucagucuuauagaagccgccugcaauucuccacaccuaaagaagaggugggcgcuaaccggcaggccauuaaugccgcucucacccaggcgacaagaaccacggucuacaucguugacauccaggauauugacucugccgcucgggcccgcccccauagcuaucuggaugccuacuucguguuucccaacggguccgcucucacccuggacgaacuuucugugaugaucagaaaugaccaagauagccugacacagcuccugcagcugggacuugucgugcugggcucccaagagagccaggaaucugaccucuccaagcagcugauuagcguuaucauugggcucggaguggcccugcuucugguccucgugaucaugaccauggcguucguuugugugcggaagucuuacaacagaaaacugcaggcuaugaaggccgccaaagaggcucgcaagacagccgcgggcgucaugccuuccgcuccggccauccccggcaccaauauguauaacacagagcgggccaacccuaugcugaaucuucccaacaaagaucuggggcucgaauaccugagcccuuccaaugaccucgauucugugagcgucaacucccuggacgauaauagcguggacguugauaagaacucucaagagauuaaggaacacagacccccucauaccccgcccgagccugaccccgagccucuuuccguggugcugcugggacgccaggcuggcgccagcgggcagcucgaaggacccucuuauacgaaugcuggccuggauacaaccgaccuuuga

SEQ ID NO: 67205 - RNA, 2658 nt, Artificial Sequence
  derived and/or modified sequence opt5 from CDHR3__Homo_sapiens__NP_689963
augcaggaggccaucauucugcucgcucugcuuggcgccaugagcgggggagaagcgcugcaccucauccugcuucccgcuaccggcaacguggccgaaaauuccccuccggggacaucuguccauaaguucagcguuaaacuguccgccucucucagccccgugauuccuggauuuccccaaaucgugaacuccaauccucugacggaagccuucagagucaacuggcugucuggcaccuacuuugaggugguuacaaccgggauggaacagcucgacuucgagacaggacccaauauuuuugaucugcagaucuaugugaaggacgaggucggcgugaccgaucuucagguucugacagugcaagucaccgacgugaacgaaccuccgcaguuccagggcaaucucgccgaggggcugcaccuuuacaucguggaacgggcuaaccccggauuuauuuaucaggucgaggccuucgauccugaggacacgagccgcaauaucccccuguccuacuuucucauuagcccucccaaaucuuucagaauguccgcgaacggcacccuguuuagcacaaccgaacuggauuucgaggccgggcaucggucuuuucaccucaucguugaagugcgcgacuccggaggccugaaggcuagcacagagcuucaagugaauauugucaaccugaaugaugaagugccgagauucaccucuccuacgcggguuuauacagugcucgaggagcugucccccgggaccaucgucgccaacauuacagcugaagacccugaugacgagggauuccccagccaucuucuguacuccaucaccaccgugucuaaauauuuuaugaucaaucagcucacaggcacgauucagguugcccagcgcaucgauagagacgcgggcgaacugcggcaaaaccccaccauuagccuggaggugcucgucaaggaccgcccuuacgggggacaggaaaacagaauccagauuacauucaucguggaggaugucaaugacaacccggcuaccugccaaaaguuuacauucuccaucauggugcccgagcggaccgcuaaaggcacgcugcuucuggaucucaauaaguuuuguuucgacgaugacagcgaagccccuaacaaucgcuuuaacuucacaaugcccucugggguuggauccggcagcagauuucugcaggauccugcugggucuggaaaaauugugcuuaucggcgaccuggauuacgagaaucccagcaaccucgccgccggcaauaaguauaccgucauuauccaggugcaggacguugcuccgccuuacuauaaaaacaauguguacgucuauauucugaccucccccgaaaacgaguucccucugaucuuugaucggcccucuuacguguucgacgugagcgaacgcagaccugcgcggacaagaguugggcaaguccgcgccaccgacaaggaucucccccaguccagccugcuuuauucuaucuccacaggaggcgcuagccugcaguacccgaauguguuuuggauuaacccuaagacgggggagcuccagcuggugaccaaagucgacugcgagacaacccccaucuacauucugcggauccaagccacaaauaacgaagauaccucuuccgugacgguuaccgugaacauucuugaggaaaaugacgagaagcccaucuguacaccuaacagcuauuuccucgcccugccggucgaucugaaagugggaaccaauauucagaacuucaagcucacaugcaccgaccuggauuccucuccccggagcuuucgcuacuccaucggcccugggaauguuaacaaucacuucacguuuucucccaacgcuggcagcaaugugacacggcuucugcucaccuccagauucgacuaugccggaggcuuugauaaaaucugggacuacaagcugcuggucuaugugacagaugacaaccuuaugagcgaucgcaaaaaggcggaggcucucguugaaaccgggaccgugacacugucuauuaaggucaucccucaccccacgaccauuaucacaaccacaccucggcccagagugaccuaccaggugcugcgcaaaaaugucuauuccccgagcgccugguacguuccuuucgugauuacgcucggaucuauccugcuucugggccuccugguguaccuggucgugcuucucgccaaggcuauccaucggcacugucccugcaaaacagggaagaacaaagagccucugaccaagaagggagaaaccaaaacagccgagagagacguuguggucgaaaccauucagaugaauacaaucuuugacggcgaggcuauugaucccgugacgggggagaccuaugaguucaacuccaagacaggcgcccgcaaauggaaggacccgcugacccaaaugccuaaauggaaggagagcucucaucagggagcggcccccagaagaguuacagcuggcgaagggaugggaagccuccgguccgccaauugggaggaagaugagcugagcggcaaggcuugggccgaggacgcggggcuuggaucucgcaacgaaggcgggaaacugggcaacccuaagaauagaaaccccgccuuuaugaaucgggcuuaccccaaaccucacccgggaaaguga

SEQ ID NO: 67206 - RNA, 2520 nt, Artificial Sequence
  derived and/or modified sequence opt5 from CDHR5__Homo_sapiens__NP_001165439
augggcagcugggcccugcucuggcccccucugcuuuucaccgggcugcucgugcggccgcccggaacaauggcucaggcccaauacugcuccgucaacaaggacaucuuugagguugaagagaauacgaacgugaccgaaccucugguggauauucacguccccgagggccaggaagugacacuuggggcgcugucuaccccuuucgcuuuucggauccagggaaaucaacucuuccugaacguuacacccgacuaugaggagaaaagccugcucgaagcccagcugcuuugucaguccggcgggacccuggugacacagcuccgcgucuuugugucuguucuggaugugaaugacaacgccccugaguucccguuuaagaccaaagaaauuagagucgaggaggauacgaaggugaauagcaccgugauccccgaaacacagcuucaagcugaggaccgggauaaagacgauauucuguucuacacccuccaggaaaugacagccggagcuuccgacuauuuuucucuggucagcguuaaccgcccugcccugagacucgaucggccccuggacuucuacgagcgcccuaauaugaccuuuuggcuucuggugagagauacgcccggcgaaaacguggagccgucccauacagcgaccgccacacucguccugaaugugguuccugcugaccuucggcccccuugguuccugcccugcaccuuuagcgacggcuauguguguauccaggcccaguaccacggggcuguccccaccggacauauccucccuucuccgcuggugcugcgccccggcccuauuuaugccgaggauggggacagaggaaucaaccaacccauuaucuacuccauuuuccggggcaauguuaacgggacauucaucauucacccugauagcggaaaucucacgguggcgcgcucuguccccuccccgaugaccuuucugcuucuggugaagggccagcaggccgaccucgcuagauacagcgucacacaagugaccguugaagccguggcugccgccggcucuccuccccgguucccucagcgccuguauagagggacagucgcucggggagcgggcgccggggugguugugaaggaugcugccgcccccucccagccucuuagaauccaggcucaagaccccgaguuuagcgaucugaacuccgccaucaccuaccgcauuacgaaccauucucacuuccggauggaaggagaggucgugcucacaaccaccacacuggcgcaggcuggcgccuuuuaugccgaaguggaggcucacaauaccguuacaagcgggacggccaccacagucaucgagauucagguguccgaacaggagccgccuagcaccgaagcuggaggcacaaccggccccuggacgucuaccacauccgaggugcccagaccuccggaacccagccaagggccuucuaccacaagcuccggaggcgggaccggaccccauccucccucuggcacgacacugcgcccucccaccagcuccacacccgggggcccucccggagccgagaacagcaccucucaccagccugcgacccccggcggggacacagcccagacgccgaaaccuggaaccucccagcccaugccucccggcgucgggacaagcaccucucaucaacccgcuacaccuuccggaggcaccgcccagacgccggagcccgggacaagccagccuaugcccccuuccaugggcaccucuaccagccaccagcccgcuacaccuggaggcgggaccgcccaaacaccggaagcgggaacgucccagcccaugccucccggcauggggaccucuacaagccaccagccuaccacacccggaggcgggaccgcccaaacgccggagccuggcaccucccagcccaugccccucagcaagucuacaccuuccagcggaggcgggcccucugaagauaaacgguucuccgugguugacauggcugcccugggaggcgugcuuggggcucugcuccugcuggcccuucucggacuggccguccuggugcauaagcacuacggcccuagacucaaaugcuguagcgggaaggcuccggagccccagccucagggcuuugauaaucaagcguuccugcccgaccauaaggccaacugggcuccuguucccucuccgacccacgacccuaaacccgccgaggccccuaugcccgcugaaccugccccgccgggaccugcgagccccggcggggcucccgagccuccggccgccgcucgcgccggaggcucccccacagcggugcggagcauccuuaccaaggaaagacgcccugaagggggauauaaagcugucugguuuggcgaggauauuggcacagaggccgacgugguugugcugaaugcccccacccucgaugucgacggggcuucugauuccggaagcggcgacgagggggaaggagccggcagagggggaggcccuuacgaugcucccggcggggacgauuccuauaucuga

SEQ ID NO: 67207 - RNA, 642 nt, Artificial Sequence
  derived and/or modified sequence opt5 from CDIPT__Homo_sapiens__NP_006310
augcccgacgagaacaucuuccuguuugugccuaaucucauuggcuacgccagaaucgucuucgcuauuaucagcuuuuauuucaugccgugcuguccccugaccgccuccucuuuuuaccuucugagcgggcuccuggaugcguucgacggacacgcugcccgggcccuuaaccagggcacacgcuuuggggcuaugcuggauaugcucacggacagaugcuccaccaugugucugcugguuaaucucgcccugcuuuauccuggagcuacacuguucuuucaaauuucuaugagccucgauguggccucccauuggcugcaccuucauucuagcgugguccggggcuccgaaagccacaagaugaucgaccugucugggaaccccgugcuccgcaucuacuauaccuccagaccugcgcuguucacacugugcgccggaaaugagcucuuuuacugucugcuuuaucuguuccauuuuagcgaaggcccccucguuggcucuguggggcuguuccggaugggacuuugggucaccgcuccuauugcccugcucaaaucccugaucagcgugauucaccugaucacagcugcccgcaacauggcggcccucgaugcugccgacagagcuaagaaaaaguga

SEQ ID NO: 67208 - RNA, 819 nt, Artificial Sequence
  derived and/or modified sequence opt5 from CDK10__Homo_sapiens__NP_443713
auggacaaggagaaagauggcauccccauuagcucccugagagaaaucacccuccugcuucggcugcgccacccuaacauuguggagcucaaggaagucguuguggggaaucaucuggagucuaucuuccuugugaugggauacugcgaacaggaccuggccagccuccuggagaacaugccgacacccuuuuccgaggcucaagucaaauguauugugcugcagguucucagaggccugcaguaucuucaccggaauuucaucauccaucgcgaucugaaggugucuaaccuccugaugacggacaaagggugcgucaagaccgccgauuuuggacuugcgagagcuuacggcgugccuguuaagcccaugacaccuaaaguggucacccugugguaucgggcccccgaacuccugcuggggacaaccacacagaccacgagcauugacaugugggccgugggauguauccucgcugagcugcuugcccaccgcccucugcucccgggcaccuccgaaauucaucaaaucgaucugauugugcagcuucugggcacacccucugagaauaucuggccuggguucagcaagcucccccuggucggacaguacucccugagaaaacagccuuauaacaaucucaagcacaaauuucccuggcugagcgaggcuggccuucggcugcuccacuuccuguuuauguacgacccgaagaagcgcgccaccgcgggggauugccuugaaucuuccuauuucaaagagaagccucugagacuccccauuagcggaguuugugaaggcugccgggagccuggguga

SEQ ID NO: 67209 - RNA, 2388 nt, Artificial Sequence
  derived and/or modified sequence opt5 from CDK11B__Homo_sapiens__NP_001778
augggcgacgagaaggauagcuggaaagugaagacccuggacgaaauccuccaggagaaaaagagacggaaagaacaagaggaaaaggccgagauuaagcgccugaaaaacuccgaugacagagauucuaagcgggacagccuugaggaaggggagcugcgcgaucacagaauggaaaucacaauucgcaauucccccuaccgcagagaggacucuauggaggaucggggagaagaggacgauagccucgcuaucaaaccuccgcagcagaugucccgcaaggaaaaagcccaucacagaaaggacgagaagcggaaagaaaagcgcagacaucggucucacagcgcggagggcgggaaacaugcucgcgucaaggagaaagaaagagagcacgaacggagaaagcgccaccgggaggaacaggauaaagccagacgcgagugggagcggcaaaagagacgcgaaauggcccgggagcauuccagacgcgaacgggacagacuggagcagcuugaacgcaagcgggagagagagcggaaaaugcgcgaacagcagaaggagcaaagagaacagaaagagcgggagagacgcgcugaagaacggagaaaggaacgcgaggccagacgggaaguuagcgcucaccaucgcacgaugagagaggacuauucugauaaagugaaggccucccacuggagccggucucccccucggcccccuagagagcgguucgaacugggagacggccgcaagcccggggaggcgagaccugccccggcucagaaacccgcccagcucaaggaagagaaaauggaggagcgggaucugcuguccgaccuccaagauauuagcgacucugagcgcaagaccuccagcgcugaauccucuagcgccgaguccggaagcggcucugaagaggaagaggaggaagaggaagaggaggaagaggaaggcuccacaagcgaggaaucugaggaggaagaggaagaggaagaggaggaagaggaagagaccgggagcaacuccgaagaggcgucugagcagagcgccgaagagguguccgaagaggagaugagcgaagaugaggaaagagagaaugaaaaccaucugcuugucgugccugagucucgguuugacagagauuccggagagagcgaagaggcugaagaggaaguuggcgaggggacaccccagucuuccgcccugaccgagggagacuacgugccugauagccccgcucucuccccgaucgaacugaaacaagagcuuccuaaguaucugcccgcccuccagggcugccgcucugucgaagaguuccagugucugaaucggaucgaagaggggacauacggagugguuuauagagccaaggacaaaaagaccgacgagauuguggcucugaaacgccucaagauggaaaaagagaaggaaggcuuuccuaucacgagccugcgggagauuaacaccauccuuaaggcgcagcaccccaauauugucacagugagagagaucguggucggcuccaacauggauaaaauuuacaucguuaugaauuauguggaacacgaccugaagucucucauggagaccaugaaacaacccuuccugccuggggaagugaagacacuuaugauccagcugcuccgcggagucaaacaucugcacgauaacuggauucugcaucgggaccucaagaccagcaaucugcuucugucccacgccggcauccucaaagugggggauuuuggacuggcuagagaguacggcagcccgcuuaaggccuacacgcccguuguggucacacugugguaucgcgccccugaacuccugcugggggcuaaggaguacucuaccgccguggacaugugguccguuggaugcauuuucggcgagcuccugacacagaaaccccuuuuuccuggcaagagcgaaaucgaucagauuaacaaaguguucaaggaccuggggacccccucugagaaaaucuggccgggauauuccgaacucccugcggucaagaagaugaccuuuagcgagcaccccuacaauaaccugcggaaaagauucggcgcucugcuuucugaucaaggguuugaccucaugaauaaguuccugacauauuuuccuggacggcgcaucagcgccgaagauggccugaaacaugaguacuucagagagacgccccucccuauugaccccuccauguucccgaccuggccugccaagagcgaacagcagcgggugaaacgcgggacaucucccagacccccugagggcggacugggcuauucccagcuuggggaugacgaccugaaggaaaccggauuucaccucacaaccacgaaccaaggcgcuagcgccgcugggccgggauucucccugaaguuuuga

SEQ ID NO: 67210 - RNA, 4446 nt, Artificial Sequence
  derived and/or modified sequence opt5 from CDK12__Homo_sapiens__NP_055898
augcccaacagcgagagacacggcgggaagaaagacggauccggcggggccucuggaacccugcagccuagcuccggcgggggaucuagcaauucccgggaacgccauagacucgugucuaagcacaaacggcauaagagcaaacacuccaaggauaugggccuggucacaccggaggcugccagccuuggcacgguuaucaagccccugguggaauacgacgauauuucuuccgacagcgauaccuucucugacgauauggcguuuaaacucgaccgcagagagaacgaugaacggcgcggguccgacagaagcgaucggcugcauaagcaccgccaccaucaacacagacggucucgcgaccuucugaaagcuaagcagacagagaaagagaagucccaggaagugagcuccaagucuggaagcaugaaagauagaaucuccggcagcucuaagcgguccaaugaggaaaccgacgacuaugggaaagcccaggucgccaagagcucuagcaaagagucccgcucuagcaagcuccauaaagagaagacaagaaaggaacgggagcugaaauccggacacaaggauagaagcaaaucucaccgcaagcgggaaaccccuaaauccuacaagacaguggacagccccaagagacgcucucgguccccucauagaaaauggagcgauuccucuaagcaagacgauagccccuccggcgcuucuuaugggcaggacuacgaucugagcccuucccgcagccacaccucuuccaacuaugacagcuacaaaaagucuccgggauccacgagccggagacagucuguuagcccucccuauaaagagcccuccgccuaccagagcucuacccgcuccccuagccccuacucccggagacaacgcucugugagcccguauucccggagacggucuagcuccuacgaacgcucuggcagcuauuccggcagaagcccuucucccuacgggcggagacgcuccagcucuccuuuccucuccaagcggagccugucuagaagcccccuucccucccgcaaguccaugaaaagcagaucucggagcccugcuuauucccgccauucuagcucccacucuaagaaaaagagaagcuccucucggagccgccauuccagcauuucuccggucagacugccccucaauuccagccugggagccgagcuuucucggaaaaagaaggagcgcgcggccgcugccgcugccgcgaaaauggauggcaaggaauccaaagggagcccuguguuucugcccagaaaggagaacuccucuguugaagccaaagacagcggacucgaguccaagaaacugccucggagcgugaagcuggaaaagucugcucccgauacagagcucgucaaugugacccaccugaacacagaggugaaaaauuccagcgacaccggcaaggucaaacuugacgaaaacucugagaagcaccugguuaaagaucucaaggcccaggggacgcgcgacagcaagccgaucgcucugaaagaagagauugugacaccuaaggaaaccgagacauccgagaaagaaacacccccuccccuuccuaccaucgccucucccccgccuccccugcccaccacgaccccuccgccccagacaccuccccucccuccccugccucccaucccggcccugccucagcaacccccucugcccccgagccagccugcuuucucccaggugcccgcgucuagcaccuccacacucccucccagcacccauucuaagacguccgccgucagcucccaagcuaauucucagcccccugugcagguuagcgugaaaacacaggucuccgugaccgccgccauuccgcaccuuaagaccucuacacugcccccucucccccugccuccccuucugccuggagaugacgauauggacagcccgaaggagacccuccccuccaaaccuguuaagaaagaaaaggagcaaagaacacggcaucugcugacggaucucccccugccucccgagcuuccgggcggcgaccugagcccucccgauucucccgaaccuaaagcuaucacacccccucagcagccguacaagaagagacccaaaauuugcuguccucgcuauggggagcggagacagaccgaauccgacuggggaaagcgcugcguggauaaauuugacaucauuggcaucauuggggagggaaccuacggccaagucuacaaggccaaagauaaggacacaggggaacucguggcgcugaaaaagguccggcuggacaacgagaaggagggcuuccccaucaccgcuaucagagaaauuaaaauccuucgccagcucauucaccggagcgugguuaauaugaaggagaucgugacggauaaacaggacgcccuggauuuuaagaaagacaagggagccuucuaucuggucuuugaauacauggaucacgaccucaugggccugcuugagucugggcuggugcauuucuccgaagaucacauuaagagcuuuaugaaacagcucauggagggacuggaguauugucauaagaaaaacuuccugcacagagacaucaagugcucuaauauccuucucaacaacagcggccaaauuaaacuggcugauuuugggcuggcccgccucuacaauuccgaagagucucggccuuauaccaacaagguuaucacacugugguacagacccccggaacuucugcucggagaggaacgguauaccccugcuauugacguguggagcuguggcugcauccugggggagcuguucacaaagaaacccauuuuccaggccaaucuugagcucgcgcagcuggaacugaucucccgccucuguggcagcccuugccccgccgucuggccugaugugaucaagcugcccuacuuuaacaccaugaaaccgaagaaacaguacagacggcgccuuagagaggaguucuccuuuauuccuucugcugcccuggaccuccuggaucauaugcugacgcuugaccccagcaagcgguguacagcugaacaaacccuccaguccgacuuccugaaggauguggagcugucuaaaauggcgcccccugaccucccgcacuggcaggauugccacgaacuguggagcaagaaaagacgccggcaaagacaguccggaguugucguggaggaacccccucccucuaagacaagccgcaaagagaccaccuccggcacaagcacggaaccugugaaaaauucuucccccgccccuccgcagcccgccccugggaaggucgagagcggagcuggcgacgccaucgggcuugcugauauuacccagcaacugaaccagucugagcucgccgugcugcugaaucuucugcagucccagacagaccucagcaucccccaaauggcccagcugcucaacauucauucuaauccugaaaugcagcagcaacuggaggcucuuaaccaguccaucagcgcgcugaccgaagccacaucccagcaacaggauagcgagaccauggcucccgaagagucucucaaggaggccccgagcgccccuguuauucugcccuccgcugaacagacgacacuggaggccucuagcacccccgcggacaugcagaauauccuugcugugcugcucucccaacugaugaagacccaggaaccugccggaucucucgaggaaaacaauagcgauaaaaacuccggcccccaggggccucggagaacaccgaccaugccccaggaggaggccgcugaaaagcgcccucccgagccucccggcccgccucccccucccccucccccgccucuggucgaaggagaccuuucuagcgcgccccaagagcugaaucccgccgugacagcugcccuccugcagcugcuuucccagccugaggccgaaccgcccggccaucugccucacgagcaccaggcucuccggcccauggaauauagcacgagaccucgccccaacagaaccuacgggaacacagauggaccugagaccggcuuuucugccaucgacacagacgaacgcaauuccgggcccgcucugaccgagagccucguucaaacgcuggugaaaaaccggaccuucucuggaucccuuagccaucugggcgaguccucuagcuaucaggggacaggcuccguccaguuuccgggagaucaggaccugagauucgcccgggugccucucgcgcugcaccccguugugggccaaccuuuucuuaaggccgaagggagcucuaauuccgucgugcacgcugagaccaaacugcagaacuacggagaacucggccccgggacaaccggagccagcucuagcggcgcuggccugcauuggggagggccgacacaguccucugccuauggcaagcucuaccgcgggccuaccagagugccuccccggggaggcagagggcgcggaguccccuauuga

SEQ ID NO: 67211 - RNA, 4539 nt, Artificial Sequence
  derived and/or modified sequence opt5 from CDK13__Homo_sapiens__NP_003709
augcccagcuccucugacaccgcccugggcgggggaggcgggcucagcugggcugagaagaaacuggaagagagacggaagcgcagacgguuccuuuccccucagcaaccgccccugcuccugccucuucugcagccccagcuccugcagccucccccuccgcccccuccccugcucuuucuggccgcgccuggaacagcugccgccgcugccgcugccgcggccgcuucuagcuccugcuucucucccggcccgccucuugaagugaaacgccuggccagagggaagcggcgcgcuggaggcagacaaaaacggcgcagaggcccccgggccgggcaggaggcggaaaagcgcagagucuuuagccucccucagccccagcaagauggaggcgggggagccuccagcggcgggggaguuacgccccugguggaguacgaggacgugucuucccagagcgaacagggccuucugcucggcggggcuucugccgcuaccgccgccacagcugcgggaggcaccgggggauccggcgggagcccugccucuuccagcggaacacagcggcgcggcgagggcuccgaaagacggccgagacgcgaucggagaucuagcuccgggcgcagcaaggagcggcacagagagcaucgccggagagacggacaacgcggcgggucugaagcuagcaaaagccggucuagacacagccauuccggagaggaacgcgccgaggucgccaagucuggcagcuccuccucuuccgggggccggagaaaaagcgcuucugccaccuccagcuccucuagcucccggaaggaucgcgacucuaaagcgcacagaagccggacaaaguccagcaaggaacccccuucugcuuauaaagagcccccuaaggccuacagagaggauaaaaccgaacccaaggccuaucgccggagacgcucccugagcccgcugggaggcagagacgauucuccugugucccaucgggcuagccagucucuccgcagcagaaaaucccccagcccugccgggggagggucuucccccuacagccggcgccugccuagaucccccucuccguauagccggcgcagauccccuucuuacagccggcacuccucuuaugagcgcgggggagacguuagccccucccccuacucuagcuccagcuggagacggucuagauccccuuacagcccggugcuucgccggucuggcaaguccagaagccgcucccccuauagcucucggcacagcagaucccgcucucggcauagacugagccgcucccggucuagacacagcuccaucucuccuagcacgcucacccugaaauccagccuugcugccgaacugaacaagaauaagaaagcgcgggccgcugaggccgcucgcgccgcggaagccgcuaaggccgcugaggccacaaaagccgcugaggcggccgcuaaggccgccaaggcuucuaacaccuccacacccaccaaagggaauacggaaacaagcgccucugcgucccagaccaaccaugucaaggaugugaaaaagauuaaaaucgagcacgcuccuagccccuccucuggcggaacacucaagaaugacaaagccaagaccaagccuccccugcaaguuaccaaaguggaaaacaaucugauugucgauaaggccacgaaaaaggcugugaucgugggcaaagagagcaaguccgccgcgacaaaggaagagagcgucucucucaaagagaagaccaaaccgcugacaccuuccauuggggcuaaggaaaaagagcagcacguugcccuugugaccagcacacugcccccucucccccugccgccuaugcuucccgaagacaaggaggccgacucucugagaggaaacaucagcgugaaagcugucaagaaggagguggagaaaaagcuccggugucugcuggccgaucucccucugccucccgagcuucccggcggggacgaucuguccaaaucuccggaagagaagaaaaccgcuacgcagcuccauagcaagcgcagacccaagaucugcggaccucgguacggcgaaacaaaagagaaggacauugauugggggaaaagauguguugacaaguucgauaucauuggcaucauuggagagggcaccuauggccagguguacaaagcccgcgacaaggauaccggagaaauggucgcgcugaagaaagugcggcuggacaaugagaaggaaggcuuucccaucacagccauuagagagaucaaaauccuucgccaacucacccaccaguccauuaucaacaugaaggaaauuguuacagauaaagaggacgcucuggacuucaagaaggauaaaggggccuuuuaucugguguucgaguacauggaccaugaucucaugggacugcuugaaucuggccugguccacuuuaaugagaaccauaucaagagcuucaugcggcagcucauggaagggcuggacuauugccacaaaaagaauuuucugcacagagauauuaaauguuccaacauccuucucaauaaccgcggccagaucaagcuggcugacuucggacuggcccggcucuacagcucugaggaauccagaccuuacacgaacaaagugauuacccugugguauagacccccugagcuucugcucggcgaggaacgcuacacaccggccaucgaugucuggagcugcggguguauucugggagagcuguuuaccaagaagcccaucuuccaagcuaaucaggaacuugcgcagcucgagcugauuucccggaucugcggcucuccuugucccgccguguggccugacguuaucaaacugcccuauuucaacacaaugaagccgaaaaagcaguaccgcagaaaacuccgggaggaauuuguguucauuccugcugccgcccuggaucuuuuugacuauaugcuggcucucgaucccagcaagcgcugcaccgccgagcaagcgcugcagugugaguuccugagagacgucgaacccuccaagaugccucccccugaucuuccgcucuggcaggacugccaugaacuguggucuaaaaagcggagacgccagaaacaaauggggaugacggacgaugugagcaccaucaaggcuccccggaaagaccugucccucggacuggaugacagcagaacaaauaccccucagggcguucuucccucuucccagcucaagagccaagggucuuccaacguggccccugucaagacaggccccggacagcaccugaaucauagcgagcuggccauucugcuuaaccugcuccagucuaaaaccagcgugaauauggcugauuuugugcagguucugaacaucaaggucaauuccgagacgcaacagcagcucaacaaaauuaaucugccggccggcauccuugcgacaggggaaaagcagaccgacccuucuacaccccaacaggagagcuccaaaccucugggaggcauucagcccagcucccagaccauccaaccuaagguggaaaccgaugcugcccaggccgcugugcagucugccuucgcuguccuccugacacaacugaucaaggcccagcagagcaaacagaaggacgugcuucuggaggaacgcgagaacggguccggacacgaggcgucucuccaacugcggcccccgccugaacccagcacgcccguuuccggccaggaugaccucauucagcaccaggauaugagaauccuggagcuuaccccugaaccggaccggccccgcauucugccucccgaucaaagaccucccgagccuccggaacccccucccgugacagaggaggaccucgacuaccggaccgaaaaucagcaugucccuacaaccucuagcucccugacggauccccacgccggcgugaaagcugcccugcuucagcugcucgcucagcaucaaccgcaggacgauccuaagcgcgaagggggaaucgacuaucaggccggcgauacauacguuagcaccucugacuacaaagauaacuuuggguccagcucuuucuccagcgcccccuaugugucuaaugacggacugggcuccagcuccgcucccccucucgaaagacggagcuuuauugggaacucugauauccagagccuggacaacuacuccaccgcgucuagccacuccggagggcccccucaaccgucugccuucagcgaguccuuucccucuagcgucgcuggcuauggcgauaucuaccuuaaugccggaccuaugcuguucuccggcgacaaggaccaucgcuuugaguauagccacgggcccauugccgugcuggcuaacucuuccgauccuagcacaggacccgaaucuacccacccgcucccugccaagaugcauaauuacaacuauggcgggaaucugcaggagaaccccuccggaccuagccuuaugcacggccagacauggacgucccccgcgcaaggcccuggguacucucagggauacagaggccauaucagcaccuccacagggcggggacgcggcagagggcugcccuauuga

SEQ ID NO: 67212 - RNA, 1410 nt, Artificial Sequence
  derived and/or modified sequence opt5 from CDK14__Homo_sapiens__NP_001274064
augugcgaccugaucgagccccagccugccgaaaagauuggcaaaaugaagaaacucagacggacccugagcgaguccuucucucgcaucgcucuuaagaaagaugacacaacguuugaugaaauuugugugaccaagaugagcacaagaaacugccaagggauggacuccgucaucaagccgcuggauaccauucccgaggacaaaaagguucgggugcagcgcacacagucuaccuucgauccuuuugaaaaacccgccaaucaggugaagagaguccacagcgagaacaaugcguguaucaacuucaaaacauccucuaccggaaaggagagcccuaaggugcggcgccauuccagccccucuuccccuacgagcccgaaauuuggcaaggcugacucuuacgaaaaacucgagaagcugggggaaggauccuaugccaccguuuacaaaggcaagagcaaagugaaugggaaacuugucgcccugaaggugaucagacuccaagaggaggaaggaacacccuucaccgcuauucgggaggccucucugcugaagggccucaagcacgcuaacaucguucugcuucaugauauuauccacacaaaagaaacccugacgcucguguuugaguauguccauacagaccugugccaguacauggauaagcacccuggcgggcuucaccccgacaaugugaaacuguuccucuuucagcugcugcgcggacucuccuauauucaucagagauacauccugcaccgggaucuuaagccucaaaaccugcucauuagcgacaccggcgaacugaaacuugccgacuucgggcuggcgcgcgccaaguccgugcccucucauacauauagcaaugaggucguuacccucugguacagaccgccugaugugcugcugggauccaccgaguacagcacaugucucgacauguggggcguggggugcaucuuugucgaaaugauccagggaguggcugccuuccccggcaugaaggauauucaggaccagcuggagcggaucuuucuuguucugggcacgccuaacgaagauaccuggcccggggugcacucucucccccacuucaaaccugagcgcuucacacuguauuccagcaagaaucuuagacaggcuuggaacaaacugucuuacgucaaucaugccgaagaccucgcgagcaagcugcugcaauguuccccgaagaaccggcucucugcccaggcugcccugagccacgaguauuuuuccgaucuucccccuagacugugggagcucaccgacaugagcucuauuuucacagugcccaauguucgccugcaaccugaagcuggagaguccaugcgggccuuuggcaaaaacaacagcuacgggaagucucuguccaauagcaaacauuga

SEQ ID NO: 67213 - RNA, 1290 nt, Artificial Sequence
  derived and/or modified sequence opt5 from CDK15__Homo_sapiens__NP_001248364
augggccaggagcugugcgccaagaccgugcaacccggguguagcugcuaccacuguuccgaaggaggcgaggcucauucuugcagacggagccagccugaaacaacggaggccgcguucaaacucaccgaccugaaggaagcuagcuguucuaugacauccuuucacccgcgcgggcuucaggccgccagagcucagaaauucaaguccaaacggccccgcucuaacagcgauugcuuucaagaggaggaccugagacagggauuccaguggcggaagucccucccuuuuggcgccgcuagcucuuaucugaaucuugaaaagcugggggagggauccuacgccaccgucuauaaaggcaucagccgcauuaacggccagcucguugcgcugaaggugaucucuaugaaugccgaagagggggugcccuucacagcuauuagagaggccucccugcucaaaggacugaagcaugcuaacaucguccuucugcacgauauuauccauaccaaagaaacacucaccuuuguguucgaguacaugcacacggaccuggcccaauauaugagccagcacccuggcgggcuucauccccacaauguucggcuguuuauguuccagcuccugcgcggacuggcguacauccaucaccagcacgugcuccauagagaucugaagccucaaaaccuucugauuucucaccucggcgaacugaaacuugccgacuuugggcuggcucgggccaaguccaucccgagccagaccuauuccucugaggucgugacacucugguacagacccccugaugcucugcugggagccaccgaauacagcuccgagcucgacauuuggggcgccggcuguaucuucauugagauguuucaggggcaaccccuguucccuggaguuagcaauauccuugaacagcuggagaagauuugggaagugcucggcguccccacagaggauaccuggccgggggugucuaaacugccuaacuauaaucccgaaugguucccucuucccacgccccgcucccugcauguggucuggaaccggcucggacgcguuccugaggcugaggaccuggcgagccagaugcugaagggcuuuccgagagaucgggugucugcccaggaagcucucgugcacgacuacuucagcgcccugcccucccaacuuuaucagcugccugaugucucuggggugagacucaaacccgagaugugcgaccugcuggccagcuaccagaagggacaucacccugcucaguuuuccaaauguugguga

SEQ ID NO: 67214 - RNA, 1713 nt, Artificial Sequence
  derived and/or modified sequence opt5 from CDK16__Homo_sapiens__NP_001163931
augccccuguacggcagagcccgggaccacgugacccauccuagcauccucgggacacgcccgggaagacccauggcuggcccuauuacggccgcgguccccgagaagaucugcaacggggcuuucuguuccugcucuggagccuuuccucuggaucccaauaacccuagccuuggcccgcugcccuccauuucucaccucaaucugcggacccagaucgccauggaccgcaugaaaaagauuaaaagacaacuuagcaugacacugcgcgggggacgcggcaucgauaagaccaacggcgcuccugaacagaucgggcucgacgaguccggaggcgggggaggcucugaucccggggaagccccuacaagagcugcccccggagagcugcggagcgcgcgcggcccgcuguccagcgccccugaaauuguucaugaggaccucaaaaugggcucugauggggaguccgaccaggcuagcgccaccucuuccgaugaagugcagagccccgugagaguccggaugcgcaaucacccucccagaaagaucucuacagaggacauuaacaagcggcugucccuucccgcugauauccgccugccugaaggauaucucgagaaacugacccuuaauagcccgauuuucgacaagccccuguccagacggcucagacgcgugucucugagcgagaucggcuuugggaaacuggaaacguacauuaagcucgauaaacugggagagggcaccuaugccacaguuuacaaggggaaguccaaacuuaccgacaaccugguggcgcucaaggaaauccggcuggagcaugaagagggagccccuuguacagcuaucagagaggucagccuucugaaagaccucaagcacgccaauauugugacccugcacgauaucauucauacggaaaaaucucugacacucguuuucgaguaucuggacaaggaucuuaaacaauaccuggacgauugcggcaacaucauuaauaugcacaacgugaagcucuuucuguuccagcuucugcgcggccucgcuuauugucaucggcagaagguccugcacagagaccugaaaccccagaaucuccugaucaacgaacgcggggagcuuaagcuggccgauuuuggacucgcccgggcuaaauccaucccuaccaagacauacagcaaugaaguggugacccugugguacagacccccggacauucugcuuggcucuaccgauuauagcacacaaaucgacauguggggagucgggugcauuuucuacgagauggcgacgggccgcccucucuuucccggguccaccguugaggaacagcugcacuucaucuuucggauucugggcacaccuaccgaggaaacauggcccggaauccucucuaacgaggaguucaaaaccuauaacuacccuaaguauagagccgaagcucugcuuagccaugcuccccgccuggauuccgacggcgccgaccuccugacgaagcugcuucaguuugaggggcggaauagaaucagcgccgaagaugccaugaaacacccguucuuccucucucugggagagcggauucauaagcugccugacacaaccuccaucuuugcgcucaaagaaauucagcugcaaaaggaggcuagccuucggucuuccagcaugcccgauuccggcagacccgccuuccgggugguggacaccgaguuuuga

SEQ ID NO: 67215 - RNA, 1572 nt, Artificial Sequence
  derived and/or modified sequence opt5 from CDK17__Homo_sapiens__NP_002586
augaagaaauucaagagacggcugagccucacccugcgcggcucccagacaaucgacgagucucuuagcgaacuggccgagcaaaugacgauugaagagaacuccucuaaagauaaugaacccaucgugaagaacgggagaccuccgaccagccacuccaugcauucuuuucuccaccaguacacaggcagcuucaaaaagcccccucugcggcgcccccauuccgucauuggagggagccuuggaucuuuuauggcuaugccuagaaauggcucccggcuggacaucguucacgagaaccucaagauggggagcgauggagagucugaccaggccuccggcaccagcucugaugaagugcagucccccacaggcgugugccugcgcaaucggauucauagacgcaucagcauggaggaccugaacaaaagacucucccugccugcggauauccggauuccggacggguaucuugaaaagcugcaaaucaauucucccccuuucgaucagcccaugagccgcagaucccggcgcgcuagccucucugagauuggauuuggcaaaauggagaccuacaucaagcuggaaaaacuuggggagggaacauaugccaccgucuacaagggcagauccaagcugacggaaaaccucguggcccugaaagagauucggcuggaacacgaggagggggcuccuuguaccgccaucagagaaguuagccuccugaaggaccuuaaacacgcuaauauugugacacugcaugauaucguccacaccgacaagucucucacacugguguucgaguaucuugauaaagaccugaagcaguacauggacgauugcggaaacaucaugagcaugcauaauguuaaacucuuucuguaucagauucugcgcggccucgccuacugucaccggagaaaggugcugcaccgcgaccuuaagccccaaaaccugcucaucaaugaaaaaggcgagcugaaacuugcggauuucgggcuggcccgggcuaaguccgucccgaccaagacguacucuaacgaaguggugacacucugguauagaccucccgacguccugcugggaagcuccgaguacagcacccagauugauauguggggcguugggugcaucuuuuucgagauggccucuggacgcccucucuuucccggcuccacaguggaagacgagcugcaucuuauuuuccggcugcucgggacccccagccaggaaaccuggccuggaaucucuuccaaugaggaauuuaaaaacuauaacuucccgaaguacaagccccagccucugaucaaucacgcucccagacuggauagcgagggcauugagcuuaucacaaaauuccuccaauaugaauccaagaaacgcgugucugccgaggaagcgaugaagcaugucuacuuucggagccugggcccucgcauucacgcccugcccgaguccgugucuaucuucagccucaaagagauucagcugcagaaggacccgggguuuagaaacuccagcuauccugaaacgggacauggcaagaaucggagacaaucuaugcuuuucuga

SEQ ID NO: 67216 - RNA, 1425 nt, Artificial Sequence
  derived and/or modified sequence opt5 from CDK18__Homo_sapiens__NP_002587
augaucaugaacaagaugaaaaauuucaagagacgguuuagccuguccgugccccgcaccgagacaauugaagagucucucgccgaguucacggaacaguuuaaccaacugcacaauagacggaacgaaaaucuucagcugggcccucucgggcgcgacccgccccaggagugcagcaccuucuccccuacagauucuggagaggaacccggccagcugagcccugggguccaauuucagagacggcagaaccagcgcagauucuccauggaggacguuucuaaacggcuuagccugcccauggauauccgccucccucaagaauuucugcagaagcugcagauggaguccccggaccuccccaaaccucugagcagaaugucucggcgcgcuucccuuagcgauauuggauucggcaagcuggagaccuacgugaagcucgacaaacugggggaaggaacauaugccaccguguuuaagggcagaucuaaacuuacagagaaucuggucgcgcucaaggaaauccggcuggagcaugaagagggcgcucccuguaccgccauucgcgaggugucccugcucaaaaaccugaagcacgccaauaucguuacgcuucaugaucugauccacaccgacagaagccucacacugguguucgaauaccuugauucugaccugaagcaguaucucgaucauugcgggaaccugauguccaugcacaaugucaaaauuuuuauguuccaacugcuccggggacuggcuuacugucaccauagaaagauccuucaccgcgaccugaaaccucagaaccuccugauuaaugagcggggcgaacuuaagcuggccgauuuugggcucgcuagagccaaaagcgugcccaccaagacauauuccaacgagguugugacccugugguaccgcccgccugacguccugcucggaucuacggaauauagcacacccaucgacauguggggcguggggugcauucauuacgagauggcgaccggacggccucuguuccccggcuccacagugaaagaggaacuucaccugaucuucagacuccugggcacccccaccgaggaaacauggccuggggucacggccuuuagcgaguuccgcaccuacucuuuuccguguuaucugccccagccucuuauuaaucacgcuccccggcucgauacagacggaauccaucugcuguccagccuccugcuuuacgaaucuaagagcagaauguccgccgaggcugcccugucucacagcuauuuccgcucccucggcgagcggguucaucaacuggaagauaccgcgagcaucuuuucucugaaggagauucagcuucagaaagacccuggguacagaggacucgccuuccagcaacccggccgcgggaagaaccggagacaguccaucuuuuga

SEQ ID NO: 67217 - RNA, 1329 nt, Artificial Sequence
  derived and/or modified sequence opt5 from CDK19__Homo_sapiens__NP_001287892
augagcgccugcagagagaucgcucugcuccgggaacugaagcaccccaacgugauugcccuucagaaagucuuccugucccauucugaccgcaagguuuggcuccuguuugauuacgcggagcacgaccuuuggcauaucauuaaauuccacagagcuagcaaggccaauaaaaagccuaugcaacugccgcgguccauggugaagucucuccuguaucagauccuggauggcauucauuaccuccacgccaacugggugcugcaccgcgaccuuaaacccgcuaauauccuggucaugggggaaggaccugagagaggccgggugaagaucgccgauaugggguuugcucgccucuucaacagcccccugaaaccucuugccgaccuggaucccguuguggucaccuuuugguauagagcgccugaacuccugcugggagcccggcauuacacaaaggcuauugacaucugggccauuggcuguaucuucgcugagcuccugacguccgagccgauuuuucacugccgccaggaagauaucaaaaccucuaaucccuuccaucacgaccagcuugauagaauuuuuagcgugaugggguucccugccgacaaggauugggaggacauccggaagaugcccgaauauccuacacugcaaaaagacuuucgcagaaccacauacgcgaacuccagccucaucaaguauauggagaaacacaagguuaaacccgauucuaagguguuccugcuucugcagaaacuccugaccauggacccgacaaagcggauuaccuccgagcaggcccugcaggauccuuacuuucaagaagacccccucccuacgcuggaugucuucgcuggaugucagauccccuaccccaagcgcgaguuccuuaaugaagacgauccugaggaaaaaggcgacaagaaccagcagcaacagcagaaucaacaucagcagccgaccgccccuccccagcaagcugccgcgcccccucaggcucccccgccucagcagaacagcacacaaaccaauggcacagccgggggagccggcgcuggggugggaggcaccggggccggacugcagcacucucaggauuccagccucaaccaggugcccccuaauaaaaagcccagacugggcccuucuggcgccaacuccgggggacccgucaugccgagcgacuaucaacauuccucuagccggcuuaauuaccaguccagcguucaggggucuucccagagccaaucuacgcugggcuauagcuccucuagccagcaguccagccaauaccacccuucucaucaggcucacagauauuga

SEQ ID NO: 67218 - RNA, 723 nt, Artificial Sequence
  derived and/or modified sequence opt5 from CDK1__Homo_sapiens__NP_203698
auggaggacuacaccaagaucgagaaaauuggcgaagggacauauggaguggucuacaagggcagacacaaaacgaccgggcagguuguggccaugaagaaaauccggcuggaaagcgaggaagagggagugcccuccacagcuauucgcgagaucucucuccugaaggaacuuagacauccuaacauugucagccugcaagaugugcucaugcaggacucccggcuguaucuuaucuucgaguuucugucuauggaucucaagaaauaccuggacagcaucccgcccggccaguauauggauuccucucugguuaagguggucacccucugguaccgcagcccugaagugcugcuuggguccgccagauauagcacacccguugacauuuggucuaucggaaccauuuucgcggagcuggcuaccaaaaagccucucuuucacggcgauuccgagaucgaccagcuguuccggauuuuucgcgcccuuggcacacccaauaacgaaguguggccugaggucgaaagccugcaagauuacaaaaauacguucccgaaguggaagcccgggucucucgccucccaugugaaaaaccuggacgagaauggacuggaucuccugagcaagaugcuuaucuacgacccugcuaaaagaauuucuggcaagauggcccugaaccaccccuauuuuaaugaucucgacaaccagaucaaaaagauguga

SEQ ID NO: 67219 - RNA, 1041 nt, Artificial Sequence
  derived and/or modified sequence opt5 from CDK20__Homo_sapiens__NP_001034892
auggaccaguacugcauccugggcagaauuggggagggagcccacggcaucguguucaaggcuaaacaugucgaaaccggggagauuguugcccucaagaaaguggcgcugcggcgccuugaagauggauuucccaaccaagcucugagagagaucaaggcccuccaggaaauggaggacaaucaguaugugguccagcugaaagccguguucccucacggcgggggauuuguucuugcuuucgaguuuaugcugagcgaucucgccgaagugguccggcaugcucaacgcccgcuggcccaggcccaggugaaguccuaccugcagaugcuccugaagggcguugcguucugucacgcuaacaauauugugcauagagaccuuaaacccgccaaccugcucaucucugcuagcggccaacugaagaucgccgauuuugggcuugcgcgggucuucuccccugacggaucucgccuguauacacaccagguggccacgagaugguaccgggcucccgagcuccuguauggcgcccgccaguacgaucaggggguggaccuguggagcgucggaugcauuaugggcgaacuccugaauggguccccucuuuuucccggcaaaaacgauaucgagcaacuguguuauguucuccggauucugggaaccccuaauccccagguguggccggagcuuacagaacugccugacuacaacaagaucucuuucaaagaacaggugcccaugccucucgaggagguccugcccgaugugagcccgcaagcucuggaccuccugggccaguuucuucuguacccuccccaccagagaauugccgccuccaaggcucuccugcaucaguauuucuuuaccgcgccucuucccgcccaccccagcgaacugccuaucccgcaacgccucgggggacccgcuccuaaggcccaucccggcccuccccacauucacgauuuccauguugacagaccgcuggaggagucucugcucaauccugaacugauccggcccuucauccuugagggguga

SEQ ID NO: 67220 - RNA, 348 nt, Artificial Sequence
  derived and/or modified sequence opt5 from CDK2AP1__Homo_sapiens__NP_004633
augagcuacaagcccaaccuggccgcucacaugccugccgcggcucucaaugccgccggcuccgugcauucuccgagcaccuccauggcuacaucuagccaguauagacaacugcuuuccgacuacgggcccccuucucugggauauacgcagggcaccgggaacagccaggucccccaguccaaauacgccgagcuccuggcuaucauugaggaacuuggaaaggaaauccggccuacauaugccggcagcaaaucugcgauggagcgccugaagagagggauuauccacgcccggggacucguucgcgaaugccuggcugagaccgagagaaaugcccgguccuga

SEQ ID NO: 67221 - RNA, 381 nt, Artificial Sequence
  derived and/or modified sequence opt5 from CDK2AP2__Homo_sapiens__NP_005842
augagcuacaagcccaucgccccugcuccguccucuacccccggcagcuccacaccugggcccggaacgccugugcccaccggcucugucccuagcccguccgggucuguucccggagccggcgcgccuuucagaccccuguuuaacgacuucgggccucccagcaugggauaugugcaggcuaugaaaccgccuggcgcccaaggcucccagagcacauacaccgaucuccugucugugauugaggaaauggggaaggagauccggcccacauaugccggauccaaaagcgcuauggaacgccuuaagagaggcauuauccacgcccgggcucugguccgcgagugccucgccgaaaccgagagaaaugcgcggacauga

SEQ ID NO: 67222 - RNA, 897 nt, Artificial Sequence
  derived and/or modified sequence opt5 from CDK2__Homo_sapiens__NP_001789
auggagaacuuccagaagguggagaaaaucggcgaagggaccuacggagucguuuauaaggccagaaauaaacugacaggcgaagugguggcucucaagaaaauucggcuggacacggagaccgaagggguccccagcacagccauccgcgagauuucccuucugaaggagcucaaccacccuaauaucgugaagcugcuugauguuauucauaccgaaaacaaacuguaccucguguuugaguuccugcaccaagaccugaagaaauuuauggaugcgucugcucucacaggaaucccgcugccccuuaucaagagcuaucuguuccagcuccugcagggccuugccuuuugccauucccacagaguccugcaucgggaccucaaaccucagaaucugcugauuaacaccgaaggggccaucaagcucgcugauuucggacuggcccgcgcuuuuggcgugcccguuagaacauacacccacgagguggucacgcuuugguaucgggccccugagauucugcucggcuguaaguacuauucuaccgcgguggacaucuggagccuggggugcauuuucgccgaaauggugacacgcagagcucuuuuucccggagauuccgagaucgaccaacuguuccggauuuuucgcacccucggcacaccugaugaagucguuuggccgggggugaccucuaugcccgacuacaaaccuagcuuccccaagugggccagacaggauuuuuccaaaguggucccuccccuggacgaggauggacggagccugcucucucagaugcugcacuacgacccgaauaagcgcaucuccgcuaaagccgcgcuugcccauccuuucuuccaggacgugacgaagcccguuccucaccugagacucuga

SEQ ID NO: 67223 - RNA, 918 nt, Artificial Sequence
  derived and/or modified sequence opt5 from CDK3__Homo_sapiens__NP_001249
auggacauguuccagaagguggagaaaaucggcgaagggaccuacggagucguuuauaaggccaaaaacagagagacaggccaacugguggcucucaagaaaauucggcuggaucuugaaauggagggggugcccagcacggccauccgcgaaauuucccugcucaaggagcugaagcacccuaauaucgucagacuucuggacgugguucauaacgagcggaaacucuaccugguguuugaguuccugucucaggaucucaagaaauauauggacagcaccccgggauccgaacugccccuucaccugauuaagucuuaccucuuucagcugcuucagggcgucagcuucugccauucccaccgcgugauccauagagaucugaaaccucaaaaucuccugaucaacgaacugggggcgauuaagcucgcugacuuuggacuggcccgggccuucggcguuccccuucgcacauauacccacgagguggucacacugugguacagagcuccugagauccuccugggcucuaaguuuuauaccacagccguggauauuuggagcaucggguguauuuucgcugaaauggugacccggaaagcccuuuuucccggagacuccgagaucgaucagcuguuccgcauuuuuagaaugcucggcacgccuagcgaagacaccuggccgggggucacacagcugcccgauuacaagggaucuuucccuaaauggacccggaagggccuggaggaaaucguucccaaucucgagccugaggggcgcgaccugcuuaugcagcugcuccaauacgaucccucccagagaaucacagcgaaaaccgcccuggcucacccguauuuuagcucuccugaacccuccccugccgcucggcaguacgugcuucagcgcuucagacauuga

SEQ ID NO: 67224 - RNA, 912 nt, Artificial Sequence
  derived and/or modified sequence opt5 from CDK4__Homo_sapiens__NP_000066
auggccaccagcagauacgagcccguggcugaaaucggcgucggggccuauggaacaguuuacaaggcgcgggacccucacuccggccauuucguggcucugaaaucugugcgcgucccgaacgggggaggcgggggaggcggccuccccauuagcacggugagagagguugcccugcuucggcgccuggaagccuuugagcacccuaauguggucagacucauggaugugugcgcuaccucccggacagaccgcgaaaucaagguuacccugguguucgagcaugucgaucaggaccuuagaacauaucuggauaaagcucccccucccgggcucccugccgagaccauuaaggaccugaugcggcaauuucugcgcggacucgauuuccugcacgccaacuguaucgugcauagagaccuuaaaccggaaaauauucuggugacaucuggcgggaccgucaagcucgcggauuuuggacuggcccggaucuacagcuaucagauggcucuuacgcccguuguggugacccugugguaccgcgccccugagguccuccugcaguccacauaugcuacccccguggacauguggucuguuggcugcaucuucgccgaaauguuuagacggaagccucuguucugugggaacagcgaggcggaucagcucggaaaaauuuuugaccugaucggccuucccccggaggaugacuggccucgcgacgugucccugcccagaggcgccuucccuccccgggggcccagaccuguccaaagcgugguuccggaaauggaggaaucuggagcucagcuccugcuugagaugcugacauuuaauccccacaagcgcauuuccgccuuccgggcucuccagcacagcuaccugcauaaagaugaaggcaacccugaguga

SEQ ID NO: 67225 - RNA, 783 nt, Artificial Sequence
  derived and/or modified sequence opt5 from CDK5__Homo_sapiens__NP_001157882
augcagaaguacgagaaacuggaaaagaucggcgaggggaccuauggaacaguguucaaagccaagaacagagaaacgcacgagauugucgcucucaaacggguucgccuggacgaugacgaugaaggcgugcccagcuccgcccuuagagagaucugccugcucaaggagcugaagcauaaaaauauugugcggcuucacgacguccugcauucugauaagaaacucacccugguguuugaguucugugaccaagaucugaagaaauacuuugacagcugcaacggggaucucgacccugagaucguuaagaauggagaacugaagcuggcggauuucggccuugcucgcgccuuugggauuccggugagauguuauuccgccgaggucgugacacucugguaccggcccccugacguucuguucggagcuaaacuuuauucuaccagcaucgauaugugguccgccggcugcaucuuugcugagcuggccaacgcgggccgcccccucuucccugggaaugacguggacgaucagcugaagagaauuuuucggcugcucggaacacccaccgaagaacaguggccuucuaugacaaaacugccggacuacaagcccuauccuauguaccccgccaccacgagccuugucaacguggugccuaaacugaaugcuaccggccgcgaucuccugcagaaccuucugaaguguaaucccguccaaagaaucuccgccgaagaggcucuccagcacccguacuucagcgacuuuugcccucccuga

SEQ ID NO: 67226 - RNA, 924 nt, Artificial Sequence
  derived and/or modified sequence opt5 from CDK5R1__Homo_sapiens__XP_011523740
augggcaccgugcugagccucucccccucuuacagaaaggccacacuguucgaggacggggcugccacggucggacacuauaccgcgguucagaacagcaaaaaugcuaaggauaaaaaccuuaagcggcauuccaucauuucugugcugccuuggaaacgcaucguggccgucagcgccaagaagaaaaauuccaagaaagugcaaccgaacucuagcuaccagaauaacauuacacaccucaauaacgaaaaucugaagaaaucccuuagcugcgcuaaccugucuaccuuugcccagcccccucccgcucagccucccgccccuccggcgucccaacucagcggcucucagacagggggauccagcucuguuaagaaggcuccccauccugccgugaccuccgccggcacacccaaaagagucaucgugcaggcuagcaccuccgagcugcugcggugucucggggaguuccugugccgcagauguuaucggcuuaagcaccugucuccuacggaccccguucucuggcugcgcagcguggauagaucccuucugcuccagggauggcaagaccagggcuuuauuaccccggccaaugucguguuccuguacaugcugugccgggaugugaucagcucugaagucggcuccgaccaugaacuccaggcgguucugcuuacaugucuguaucucagcuacucuuauauggggaacgagaucagcuacccucugaaacccuuucuuguggaguccugcaaggaagccuucugggaucgcugucugucugugauuaaucucaugagcuccaaaaugcugcagaucaacgcugacccucacuacuuuacccaagucuucagcgaucugaagaaugagucuggacaggaagacaaaaagagacuccugcuuggccuggaucgguga

SEQ ID NO: 67227 - RNA, 1104 nt, Artificial Sequence
  derived and/or modified sequence opt5 from CDK5R2__Homo_sapiens__NP_003927
augggcaccgugcugagccucucccccgccucuagcgcuaaggggagacggccuggaggccugccggaggagaaaaagaaagcgcccccugccggggacgaagcucuuggaggcuacggggcucccccugucggaaagggcggcaaaggggaaucccgccugaagagacccucuguucucaucagcgcccugacauggaagcggcuuguggccgccuccgcuaaaaagaaaaagggaucuaaaaaggugacgccuaagccggccagcaccggccccgauccucugguccagcaacgcaacagagagaaucuccugcggaaagggcgcgaucccccugacggaggcgggacagcgaagccccuggccgugccgguuccuaccgugcccgcugccgcugccacaugcgaaccucccuccggaggcagcgcggccgcucagcccccuggcucugggggaggcaaaccgcccccucccccucccccggccccucaggucgcucccccugugcccgggggauccccuagacggguuauugugcaggccagcaccggcgagcuccugcgcugucuuggggacuucgucugcagacgguguuaucgccugaaggagcucucucccggagaacuggugggcugguuuagaggcguggaucggucccuucugcuccaaggguggcaggaccaggccuucaucacaccggcuaaccuggucuuuguuuaccugcucugccgcgagagccugagaggagaugaacuugcgucugccgcugagcugcaggccgccuuccucaccugucuguaucuugcuuacuccuauaugggcaaugagauuagcuacccucugaaacccuuucucguggaacccgacaaggagcgguucuggcaaagaugccugcgccugauccagcggcucuccccucagaugcugagacuuaacgccgauccgcacuuuuucacccagguguuucaagaccugaaaaaugaaggggaggcggcugccucuggaggcgggcccccuagcggcggagcccccgcugccuccagcgcugcccgcgauucuugugcggccggcacgaagcauuggacaaugaaccucgaccgguga

SEQ ID NO: 67228 - RNA, 1761 nt, Artificial Sequence
  derived and/or modified sequence opt5 from CDK5RAP1__Homo_sapiens__NP_001265096
augcacccccugcagugcgugcuccaaguccagagaagccugggcugggggccucuugccuccguuucuuggcugagccuccggaugugucgcgcucauuccucucugagcuccaccaugugcccgucucccgagagacaggaagacggagcccggaaggauuucagcucccgccuugcggcuggcccuacauuucagcacuuccugaaaagcgccucugcuccccaagagaagcucuccagcgaaguggaggacccucccccuuaccugaugauggaugaacugcucgggagacagcggaaaguguaucuggagacguacggaugucagaugaacgucaaugacaccgagaucgcuuggucuauucuucagaaguccggcuaucugcgcacaagcaaccuccaagaagccgaugugauccugcuuguuaccugcucuauuagagagaaagcugaacagacaaucuggaaucggcugcaucagcucaaggcccugaagacccgcagaccgcggucccgcgugccccugagaauugggauccucggauguauggcggagcggcugaaagaggaaauccuuaaccgcgagaagauggucgacauucuggccggcccugaugcuuacagagaccucccccggcugcuugccguggcugaaagcggccagcaagccgcgaauguucugcucucccuggaugagacauaugccgacgugaugccuguccagaccucugcuagcgccacguccgcuuuugugagcaucaugagagggugcgauaacauguguucuuacugcauugugcccuucacccgcggacgggaaagaucccgcccgaucgccagcauucuggaggaggucaaaaagcucucugaacagggccugaaagagguuacacuucuggggcaaaaugugaacagcuuucgggacaauuccgaagugcaguucaacucugccgucccuaccaaucucagcagaggauuuacaaccaacuauaagacgaagcagggcgggcugcgcuucgcucaccuucuggaucaggugucccggguugaccccgagaugagaauccgcuuuacaagcccucaucccaaagacuuccccgaugaagugcuccaacugauucacgagcgggacaauaucuguaagcagauccaccuuccugcgcagucuggauccagcagaguccucgaggccaugcgccggggcuacucuagagaagccuacguggagcugguucaucacauucgggaauccaucccgggcgugagccuuuccucugauuuuauugccggguucugcggagagaccgaagaggaccauguccagacagugagccugcuccgcgagguccaauauaacaugggcuuucuguucgccuacuccaugagacagacccgggcuuaucacagacugaaagaugacgugcccgaagagguuaagcugcgccggcucgaggaacugaucaccauuuucagagaggaagccacaaaagcgaaucagacgucugugggguguacccagcugguccucguggagggacugagcaagcgcuccgcuacagaucuuugcggcagaaacgacgggaaccugaaaguuaucuuuccugaugccgaaauggaggacgugaauaaccccggacuccggguccgcgcccaaccuggcgauuacgugcuggugaagaucaccagcgcuucuucccagacacugagaggccacguucuuugccggaccacgcuccgcgacagcucugccuauuguuga

SEQ ID NO: 67229 - RNA, 5445 nt, Artificial Sequence
  derived and/or modified sequence opt5 from CDK5RAP2__Homo_sapiens__NP_001011649
augauggaccuggugcucgaggaagaugucaccguucccggcacacugagcgggugcuccggacuugugccuucugugccggacgaucuggacggcaucaaccccaaugccgggcucggaaacggccugcuuccuaaugucagcgaggaaacggugucccccaccagagcucggaacaugaaggauuucgagaaucagauuacagaacugaaaaaggagaacuuuaaucucaaacugcgcaucuacuuccuggaggaaagaaugcaacaggaguuucacgggccuaccgaacacauuuauaagacaaacaucgagcucaaaguugagguggaaucucugaagcgggagcuucaggaacgcgagcagcugcucauuaaggccagcaaagccgucgaaucccuggcugaggccggaggcucugagauccaaagagugaaggaagacgcccggaaaaagguucaacagguggaggaucuucugaccaaacgcauccuccugcuggaaaaggacgucacagcugcccaggcugagcucgaaaaggccuucgcgggcaccgagacggagaaagcccugagacuucggcuggaaagcaagcucuccgagaugaaaaagaugcacgaaggggaucuggcuauggcccuugugcuggacgagaaagaucgccucauugaagaacugaagcugagccucaaaucuaaggaggcucugauccaaugucuuaaggaagagaaaucccagauggccugccccgacgaaaaugugagcucuggagagcugagaggccucugugcggccccucgggaggaaaaggagcgcgaaaccgaggcugcccagauggaacaccagaaagagagaaacuccuuugaggaacggauucaagcucuggaggaagaucuucgcgagaaggaaagagagaucgccacagagaaaaagaauagccugaagcgggacaaagccauucaggggcucaccauggcucugaagucuaaagaaaagaaagucgaggaacugaacuccgagaucgaaaagcucagcgcggccuucgcuaaggccagagaggcccugcagaaagcucaaacacaggaguuucagggauccgaagacuacgagaccgcccuuucuggcaaggaagcgcugagcgcugcccuccgcucccagaaucugacgaaaagcacagagaaccaccggcugagacgcucuauuaagaaaaucacccaagagcuuuccgaucuccagcaggaacgggagagacuggaaaaggaccuggaggaagcccaucgcgagaaaagcaaaggggauugcacaauccgggaccucagaaaugagguugaaaagcugcgcaacgaggugaacgaacgggagaaagcuauggaaaauagauauaagucucuucugagcgaguccaacaaaaagcuccacaaucaggagcaagugauuaaacaccugaccgaaucuaccaaccagaaggauguccugcuucagaaguucaaugagaaagaccucgaagugauccagcaaaacuguuaccugauggccgcugaggaucuggaacuccgcagcgagggacugauuacagagaagugcuccagccagcagccgcccggcucuaaaacgaucuuuuccaaggagaagaagcagagcucugacuaugaggaacuuauucaaguucugaagaaagagcaggauaucuacacccaucucgugaagucccugcaggagagcgacuccaucaauaaccugcaagccgaacuuaauaaaauuuucgcgcuccggaagcagcuggagcaggauguccugucuuaucagaaccucagaaaaacacuggaagaacagaucagcgaaauucggcgcagagaggaggaauccuuuucucuuuacagcgaccagaccuccuaccugagcaucugucucgaggaaaauaaccgguuccagguggagcacuuuucucaggaagaacugaagaagaaaguuuccgaccugauucaacuugugaaggagcucuauacagauaaucagcaucugaaaaagaccaucuucgaccugagcugcaugggcuuccaggggaacggauuuccugauagacucgccucuacggaacagacagagcugcuugcuuccaaagaagacgaggauaccaucaagauuggcgaagacgaugagaucaauuuccugagcgaccaacaccuccagcagucuaacgagauuaugaaggaucugagcaaagggggauguaagaacggcuaccugcgccacaccgaauccaaaaucagcgacugcgauggggcccaugcucccggaugucuugaggaaggcgccuuuauuaaucugcucgcgccucuguucaacgagaaggccacacuccugcuugagucucggcccgaccugcucaaagucgugagagaacugcugcuuggccaacuguuucucaccgagcaggaagucuccggggagcaccuggauggaaagacagagaaaacgccgaagcagaagggcgagcucgugcauuucguucagaccaauagcuuuuccaaaccucacgacgagcugaaacuuucuugcgaagcucaacuggugaaagccggggagguccccaaggugggacucaaagacgcuagcguucagacaguggccaccgaaggcgaucugcugcgcuucaagcaugaggccacaagagaggcuugggaggagaagccuaucaacaccgcgcuuuccgccgaacaccggcccgagaaucugcacgggguccccggcuggcaggcugcccuccugucucucccuggaauuacgaaccgcgaagccaaaaagagcagacugccgauccuuaucaaacccucccggucucugggcaauauguaucgccugccugcuacccaggagguggugacacaacuccagagccagauucuggaacuucagggggagcugaaggaguuuaaaaccugcaacaagcaacuccaucagaagcugauccucgccgaagcgguuauggagggaagacccacaccugacaaaacccugcuuaaugcucagcccccggucggcgccgccuaccaggauuccccuggggaacaaaagggaauuaaaacgacaagcucuguguggcgggacaaggagauggauuccgaccagcagcgcagcuaugagaucgauucugaaauuugucccccugacgaucuggcuucccugcccagcugcaaagagaacccugaagacgugcucucucccaccuccgucgccacauaccugagcuccaagagccaaccgucugcgaaggugagcguuaugggcaccgaucaguccgagucuaucaauaccagcaacgaaacagaguaucuuaaacagaagauccacgaccuggagacggaacucgagggguaccagaauuucauuuuucaacugcagaaacauucccaguguucugaagcuaucauuaccgugcucugcggcacagagggagcccaggauggccugagcaagccuaaaaacggguccgacggagaagagaugaccuucucuagccuucaccaagucagauacgugaagcacguuaagauccugggcccccuggcccccgagaugauugacucccgggugcucgaaaaucugaaacagcagcuugaggaacaggaguauaagcugcaaaaagaacagaaccucaacaugcagcuguuuagcgagauccauaaucuccaaaacaaguuccgcgaucugucuccuccgagauacgacucccuuguccagagccaggcucgggagcugucucugcagagacaacagaucaaagaugggcacggaauuugugugaucucccgccagcauaugaauacaaugauuaaggccuucgaagaacuccugcaggcuagcgacguugauuauugcguggccgaaggcuuucaagagcagcuuaaccagugugcggagcugcucgaaaaacuggagaagcuguuccucaaugggaaguccgucggcguggaaaugaacacccagaaugagcuuauggaacggaucgaggaggacaaccugacguaccaacaucugcuccccgaaucuccugagcccagcgccucccaugcucugagcgauuaugaaacaucugagaaauccuuuuucagcagagaccagaagcaggauaaugaaaccgagaaaaccucugugauggucaacagcuuuucccaggaccuucugauggagcacauucaagaaauccgcacacuccggaagagacuggaggaaucuaucaaaaccaaugagaagcugcgcaagcagcucgaacggcagggaagcgaguucguucaaggcuccacaucuauuuuugccagcggguccgagcuucacagcucucugacguccgaaauccauuuccugagaaaacagaaccaggcucucaaugccaugcugauuaagggaagccgcgauaaacagaaggagaacgacaaacuucgggaaucccugucuagaaagaccgugagccucgagcaucugcaacgggaguacgccuccgugaaggaagagaaugaacgccugcagaaagagggcucugaaaaggagagacauaaccagcagcucauccaagagguccggugcagcgggcaggaacuuucccgcgugcaggaggaaguuaaacugagacagcaacugcucagccagaacgacaagcugcuucagucucugcggguggagcucaaggcuuaugaaaagcuggaugaggagcacagacgccugcgggacggagauaaguacccuauggaauccgacaauagcuuugaucucuucgacucuucccaagcggucacacccaaaagcgugucugagaccccuccccuuagcggcaacgauacagacucccugucuugugauagcggguccagcgccaccuccacgccgugcguuucuagacuggugaccggccaucaccucugggcuagcaagaauggacgccacguccugggccuuauugaagacuacgaggcccugcucaaacagaucucccaggggcagcggcugcuggccgaaauggauauucaaacacaggaggcuccuucuagcaccucccaggagcucggaacaaagggcccccauccugcgccccuuucuaaauuugugagcuccguuagcaccgcgaagcugacacuggaagaggcuuauagacgccucaaacugcuuuggcgggugucucugccggaagacgggcaguguccucuccacugcgagcaaaucggagagaugaaggccgaagucaccaagcugcauaaaaagcuguucgagcaggagaaaaagcuccagaacacgaugaaacuucugcagcuguccaagagacaagagaaggugaucuuugaucagcucguggucacacacaaaauucugcgcaaggccagaggcaaucuugaacugcggcccggcggggcucacccuggaaccugcagccccucucgccccggcuccuga

SEQ ID NO: 67230 - RNA, 1521 nt, Artificial Sequence
  derived and/or modified sequence opt5 from CDK5RAP3__Homo_sapiens__NP_788276
auggaggaccaccagcaugugcccaucgauauucaaaccagcaagcugcucgacuggcuggucgauagacggcacugcucccuuaaauggcagucucugguucucacaauccgcgaaaagauuaacgccgcuauccaggacaugccugagagcgaagagauugcccagcugcuuuccggcucuuacauccauuauuuccacugucugagaauccucgaucugcugaaagggacggaagcgagcaccaagaauauuuuuggacgguacuccucucaacgcaugaaagacuggcaggagaucauugcucucuaugagaaggauaacacauaccugguggaacuuagcucccugcucgugagaaaugucaacuaugagaucccgagccugaagaaacagauugccaagugccagcaacuucagcaggaauacucucggaaagaggaggaaugucaggccggcgcugccgagaugcgcgaacaauucuaucauuccugcaagcaguacgggaucaccggagagaaugugagaggcgaacugcucgcucugguuaaagaccugcccagccagcucgccgagauuggggcggccgcucaacagucucugggagaggccaucgauguguaccaggcuuccgucggcuuugugugugaaagcccuacagagcagguucuucccaugcugcgguucgugcaaaagcgcggcaacucuaccgucuaugaauggagaacagggaccgagccuuccgugguggaacggccccaccucgaggagcugccugaacaggucgccgaggacgcgaucgauuggggagacuuuggcguugaagccgugagcgaggggacggauuccggaauuucugcugaagccgcuggcaucgacugggggauuuucccggagagcgacuccaaggaucccggaggcgacggcaucgauuggggagacgaugccguggcccuucagauuaccguccuggaggcugggacacaggcgccugaaggcguggcccgcgggcccgacgcucucacccugcuggaguacacagaaaccagaaaucaauuucucgaugagcugauggagcuugaaaucuuccuggcccagcgggccguugagcucagcgaagaggcugacgugcugucugucucccaguuucagcuugccccugcgauccugcaaggacagacgaaagaaaagauggugacaaugguuagcgugcucgaggaucugauuggcaaacugaccucucuccagcugcagcaccuuuucaugauccuggcuagcccccgcuaugucgacagagugacagaguuucuccaacagaagcugaaacagucccaacugcuugcccucaagaaagaacugaugguccagaagcagcaggaggcccuggaggaacaagcugcccucgaaccgaagcuggaucuucugcucgagaaaaccaaggagcugcagaaacugauugaagcugacaucucuaagcgguacagcgggagaccugugaaccuuaugggaaccucccucuga

SEQ ID NO: 67231 - RNA, 981 nt, Artificial Sequence
  derived and/or modified sequence opt5 from CDK6__Homo_sapiens__XP_006715898
auggagaaggacggccugugcagagccgaucagcaauacgaauguguggcugagaucggggaaggagccuauggcaaagucuucaaggcgcgggaccucaaaaacgggggacgcuuuguugcucugaagagagugcgggugcagaccggcgaggaagggaugccccuuagcacaauucgcgaggucgccgugcugagacaccucgagacguucgaacauccuaauguugugcggcuguuugaugucugcaccgugucccgcacagacagagagaccaaacuuacacugguuuucgaacacguggaucaggaccucaccacauaccuggauaaggucccggagcccggagugccuaccgagacgaucaaggacaugauguuucagcugcuccggggccuggauuuccuucauucucaccgcgugguccauagagaccugaaaccccaaaacauucucguuaccagcuccggccagaucaagcuggccgauuuugggcuugcucggauuuauucuuuccagauggcccugacaagcgugguggucacccucugguaccgcgcuccugaagugcugcugcaguccucuuaugccacacccguugaccucuggagcgugggauguaucuuugcggagauguucagacggaaaccucuguuucgcggcuccagcgaugucgaccaacuugggaagauccuggacgugauuggacucccgggcgaagaggauuggcccagagacguugcccugccucggcaggcuuuccacucuaaauccgcccagcccaucgaaaaguuugugaccgauauugacgagcuugggaaggaucugcuccugaaaugccugacguucaauccugcuaagagaaucagcgccuacucugcgcucucccaccccuauuuccaggaccuggagcgcuguaaagaaaaccuugauagccaucugccgccuucucaaaauacauccgagcucaacaccgccuga

SEQ ID NO: 67232 - RNA, 1041 nt, Artificial Sequence
  derived and/or modified sequence opt5 from CDK7__Homo_sapiens__NP_001790
auggcccuggacgucaagagcagagcuaaacgguacgagaagcucgauuuccugggcgaagggcaguuugccaccguguauaaagcgcgcgacaagaacacaaaucagauuguugcuauuaaaaagaucaaacuuggacacagauccgaggccaaggauggcauuaaccggacggcccugcgcgaaaucaagcuccugcaggagcuuucucaucccaauauuaucgggcugcucgacgcuuucggacacaaaagcaacaucucccugguguuugauuucauggaaaccgaccuggaggugauuaucaaggauaauucucucguccugacaccuagccauauuaaagccuacaugcuuaugacccugcagggccucgaguaucugcaccagcauuggauccuucacagagaccugaagccgaacaaucuccugcuggaugaaaacggggugcucaagcuggcugacuuuggacuugccaaauccuucggcucucccaaucgggcguacacacaccaaguugugacccgcugguauagagccccugagcugcucuuuggcgcucggauguacggggucggaguggauaugugggccguuggcugcauucuggcugaacuucugcuccgcgugcccuuccugccuggggacagcgaucuggaccagcucacaagaaucuuugagacccugggaacgcccaccgaggaacaguggccugacauguguucccuuccggauuaugucacauucaagagcuuucccggcauuccucugcaucacaucuucucugccgcgggggacgaucuccuggaccuuauccagggacuguuucucuucaaccccugcgcccggauuaccgcuacacaagcccugaaaaugaaguacuucuccaaucgcccuggccccaccccgggcugucagcugccuagacccaacugcccuguggagacgcucaaagaacagagcaaucccgcucuggccaucaagcggaaacgcacagaggcccuugaacaagggggacugcccaagaagcucaucuuuuga

SEQ ID NO: 67233 - RNA, 1395 nt, Artificial Sequence
  derived and/or modified sequence opt5 from CDK8__Homo_sapiens__NP_001251
auggacuacgauuucaaggugaaacugagcuccgagagagaacgggucgaggaccucuuugaauaugagggcugcaagguugggcgcggaaccuacggccacguguauaaagccaagagaaaagaugggaaggacgauaaggacuacgcucugaaacagaucgaaggaacaggcauuucuaugagcgccugucgggagaucgcgcuucugcgcgagcucaagcaucccaacgugauuucccugcaaaaagucuuccuuucucacgcugauagaaagguguggcugcucuuugacuaugccgaacaugaucuguggcacaucauuaaauuccaucgggccagcaaggcuaauaagaaaccuguucagcugccgcgcgggauggugaagucccuccuguaccagauccuugacggaauccacuaucugcacgccaacuggguccuccauagagaucugaaacccgcuaauauucuugugaugggcgagggcccugaacgggggcgcguuaagaucgccgacaugggauuugcgagacuguucaacucuccccucaaaccucuggccgaucuggaccccguggucgugacguuuugguaccgggcuccugagcuccugcuuggcgcccgccacuacaccaaggcuauugacaucugggccauugggugcaucuucgcggagcugcucacaagcgaaccgauuuuucauuguagacaggaggauaucaaaaccuccaaucccuaucaccacgaccaacuggaucggaucuucaacgugaugggauuuccugccgacaaggauugggaagacauuaagaaaaugcccgagcauagcacacuuaugaaggauuuccgcagaaauaccuacacaaacugcucucugaucaaauauauggaaaagcacaaagucaagccugacuccaaggcuuuucaucuccugcagaaacugcucaccauggaucccauuaagcggaucacgagcgagcaggccaugcaggacccguacuuccuggaggauccucuucccaccucugacguuuucgcuggcugucaaauuccuuaucccaaaagagaauuucugacagaggaggaacccgacgauaagggggacaaaaagaaucagcagcagcaacagggaaacaaucacaccaacggcacaggccauccugggaaucaggauuccagccacacccaaggaccgccccucaagaaagugcgcguggucccucccacgacaaccucuggcgggcugaucaugacauccgacuaccagcggagcaacccucacgccgccuaucccaauccgggaccuuccaccucucagccccagagcuccaugggcuacagcgcuaccucucaacagccuccccaguacucccaucagacacacagauauuga

SEQ ID NO: 67234 - RNA, 1119 nt, Artificial Sequence
  derived and/or modified sequence opt5 from CDK9__Homo_sapiens__NP_001252
auggccaagcaguacgacagcguggagugccccuucugugaugaagucuccaaauaugagaagcuggcuaaaaucggccaagggaccuuuggagaaguuuucaaggccagacaccggaaaacaggccagaagguggcgcucaagaaagugcugauggagaacgaaaaggagggguuuccuauuacggcucugcgcgagaucaaaauucuucagcuccugaagcaugaaaaugucgugaaccuuaucgagauuugcagaaccaaagccucuccguacaaucgguguaagggaagcaucuaucugguuuucgacuuuugcgaacacgaucucgccggccugcuguccaacgugcucgucaaguucacacugucugagaucaaacgcgugaugcagaugcuucugaaugggcucuacuauauucauagaaacaagauccugcaccgggacaugaaagcugccaauguucuuauuacccgcgauggagugcugaagcucgcugacuuuggccuggccagagcguucagccuggccaaaaacucccaacccaaucgguacacaaaccgcgucgugacccucugguauagaccucccgagcugcuucugggcgaacgggauuacgggccucccaucgaccucuggggagcuggcuguauuauggccgagauguggacacgcucuccuaucaugcaggggaauaccgaacagcaucagcuggcucuuauuagccaacugugcggauccaucacgccggagguguggcccaacgucgauaauuacgaacucuaugagaagcuggagcugguuaaaggccagaagagaaaggugaaagaccggcucaaggccuacgugcgcgauccuuaugcgcuggaccuuaucgauaaacugcucguccuggaccccgcccagagaauugacagcgaugacgcucuuaaccacgacuuuuucuggucugauccuaugcccuccgaucugaaggggaugcucagcacccaccugacaucuauguuugaauaccuggccccgccucggagaaaaggaucccagaucacccaacagagcacaaaucagucucgcaaccccgcuaccacgaaccaaacagaguucgaacggguguuuuga

SEQ ID NO: 67235 - RNA, 1740 nt, Artificial Sequence
  derived and/or modified sequence opt5 from CDKAL1__Homo_sapiens__NP_060244
augcccagcgccuccugcgacacccugcucgaugacaucgaggauauugugucucaggaagacagcaagccucaagauagacacuucguccggaaagacguugugccgaaggugcgcagacggaacacacagaaauaccugcaggaggaagaaaauucucccccuuccgauagcacgauccccggcauucagaagaucuggauucgcaccuggggguguucccauaacaauucugacggagaguauauggcuggccaacuugccgcguacggguauaaaaucacagagaacgcuagcgaugccgaccuguggcuccuuaauuccugcaccgucaagaacccugccgaggaucacuuuagaaauagcaucaagaaagcucaggaagagaacaagaaaauugugcuggccggauguguuccccaggcucagccucggcaagacuaccugaagggccucucuaucauuggggugcagcagaucgaucgcgucguggaaguuguggaggagacaauuaaaggacauuccgucagacugcugggccagaagaaggacaauggccggcgccucgggggagccagacuggaccuuccgaaaauccggaagaacccccugauugaaaucaucagcauuaauaccggcugccucaacgcguguacauauugcaaaaccaagcacgcccgcgggaaucuggcuucuuacccuaucgaugagcuuguggacagagccaaacaauccuuccaggaaggagugugugagauuuggcugacgagcgaagauaccggcgcuuaugggcgggacaucggaacaaaccuccccacccugcuguggaagcucgucgagguuauuccugagggcgccaugcugcgccuuggcaugacaaaucccccguacauccuggaacaucucgaggaaauggcgaaaauccugaaccacccuagaguguacgccuuucuucacauucccgugcagucugcuuccgauagcguccugauggagaugaagcgggaauauugcguggccgacuucaagagaguuguggauuuucucaaagagaaggucccugggaucaccauugcuacggacaucauuuguggauuccccggcgagacagaucaagacuuucaggaaaccgugaaacugguugaggaauacaaguuccccucccuguuuaucaaccaguucuauccucgcccggggacacccgccgccaaaauggaacaggugccugcucaagucaagaagcagcggaccaaagaucucucuagaguguuucauagcuacucccccuaugaccacaagaucggagagcgccagcagguccuggugaccgaggagagcuucgacucuaaauuuuacguugcgcauaaucaauucuaugaacaggugcuugucccuaagaaccccgccuucaugggcaaaaugguggagguugauauuuacgaauccgggaagcacuuuaugaagggacagccggugagcgacgcuaaagucuacacaccuucuaucagcaagccccuggccaaaggcgagguguccggccucacgaaggauuuccggaaugggcugggaaaccagcuuucuagcggcucccacaccagcgccgcuucucaaugcgacuccgccagcucuagaauggugcugccuaugccccgccuccaucaggauugugcgcugcggauguccguugggcuggcucuccugggacuucuguuugccuucuuugucaaaguguauaauuga

SEQ ID NO: 67236 - RNA, 1077 nt, Artificial Sequence
  derived and/or modified sequence opt5 from CDKL1__Homo_sapiens__NP_004187
augauggagaaguacgagaaaaucggcaagauuggggaaggaagcuauggcguggucuucaaaugcagaaaccgggacaccgggcagaucguugccauuaagaaauuucuggaauccgaggaugaccccgugaucaagaagauugcucuccgcgaaaucagaaugcugaaacaacuuaagcacccuaaucuggugaaccuccuggaggucuuccggcgcaaaagacggcuucaucugguguuugaguacugugaucacacaguucuccaugaacuggaccgcuaucagagaggagugccggagcaccuggucaagucuaucacguggcagacccuccaggccgugaauuucugccauaaacacaacuguauucaccgggauguuaagcccgaaaauauccugauuacaaagcauagcgugaucaaacuuugcgacuuuggcuucgcgcgccugcucaccgggccuuccgauuacuauacagacuacgucgcuaccagaugguaucggucucccgagcugcuugugggagauacacaauacggcccucccguggacgucugggccauuggcuguguuuuugccgagcugcucagcggggugccucuguggccgggaaaguccgauguggaccagcuguaccucauccgcaaaacccugggcgaucuuauucccagacaccagcaggucuucucuacgaaccaauauuuuagcggggugaagaucccugaccccgaagacauggagccucuggaacucaaauuccccaauaucuccuacccggcucugggacuucugaagggcugccuccauauggauccuacccagcggcugacaugugagcagcugcuccaccaccccuauuuugaaaacauucgcgagaucgaggaccuggccaaagaacauaauaagccuaccagaaagacacuucggaaaagcagaaagcaccauugcuucaccgagacgucuaaacugcaguaccucccccaacugacaggguccagcauucuucccgcucuggauaacaagaaauauuacugugacaccaagaagcucaauuaucgcuuuccuaacaucuga

SEQ ID NO: 67237 - RNA, 1482 nt, Artificial Sequence
  derived and/or modified sequence opt5 from CDKL2__Homo_sapiens__NP_003939
auggagaaguacgaaaaccugggccucgugggggagggaagcuauggcauggucaugaaaugcagaaauaaggacaccgggcggaucguugccauuaaaaaguuccuggaauccgaugacgauaaaauggugaagaagaucgcuaugcgcgagauuaaacuucugaagcagcucagacacgaaaaccuggugaaucuucuggaggucuguaaaaagaaaaagcggugguaccucguguuugaguucguugaccauacaauccuggaugaccuggaacucuuucccaacggacuggauuaucaagugguccagaaguaccuuuuccagauuaucaauggcaucggguuuugccacucucauaacauuauccaccgcgacauuaaaccugagaauauccuggugagccaguccggaguugugaagcucugugauuucggcuuugccagaacgcuggcggcuccgggcgaagucuauaccgacuacguggccacacggugguaucgcgcccccgagcuucuggugggggaugucaaauacggaaaggcuguugacgugugggccauuggcugccucgugaccgagauguucaugggggaaccucuguuucccggagauucugacaucgaccaacuguaccauauuaugaugugucucggcaaccugaucccuagacaccaggagcuuuucaauaaaaaccccgucuuugcuggggugcggcugccugaaaucaaggagcgcgaaccgcucgagagacgguaucccaaacugagcgagguugugauugaucuugccaagaagugccugcacaucgacccugauaaacgccccuucugugcggaacuccugcaucacgacuuuuuccagauggauggauucgccgagagauuuucccaggaacugcaacucaagguccagaaagacgcucggaaugugucucugagcaagaaaucccagaaccgcaagaaggagaaagaaaaggaugacagccuuguugaggagagaaaaacacuggugguccaggauaccaaugccgacccuaagauuaaagauuacaaacucuucaagaucaaaggcucuaagauugacggcgaaaaagcugagaaggggaaccgggccuccaaugcgagcugccugcaugacucuagaacaucccacaacaaaaucgugcccagcaccucucuuaaggauuguuccaacgucagcguggaccacacgcgcaauccguccguugccaucccuccccugacccauaaccucucugcuguggccccuagcauuaauuccggaaugggcacagaaaccauccccauucaaggguaucgggucgaugagaagacaaagaagugcagcauccccuuugugaaaccuaacagacacucuccguccggaauuuacaauaucaacguuaccacgcuggugagcgggcccccucugucugacgauagcggcgcugaccucccccagauggaacaucagcacuga

SEQ ID NO: 67238 - RNA, 1779 nt, Artificial Sequence
  derived and/or modified sequence opt5 from CDKL3__Homo_sapiens__NP_001107047
auggagauguacgaaacccugggcaaggugggggagggaagcuauggcacagucaugaaaugcaagcacaaaaacacggggcagaucguugccauuaagaucuucuacgaaagacccgagcaauccgugaauaaaauugcuaugcgggaaaucaaguuucucaagcaguuccaucacgagaaccuggugaaucuuauugaggucuuucgccagaaaaagaaaauccaucugguguucgaauuuaucgaccacaccguucucgaugagcugcagcauuauugucacggacuugaaucuaagagacugcggaaauaccucuuccaaauucugcgcgccaucgacuaucugcacagcaacaauauuauccauagagauauuaagccugagaacauccucgugucccagucuggcauuacaaagcugugcgacuuuggguucgcgcggacccuugcugccccgggagauaucuacacagacuaugucgccacccgcugguacagagcucccgagcuggugcucaaagauacaagcuacggcaagccuguugacaucugggcccugggcuguaugauuaucgaaauggcuaccgggaaucccuaucuuccuuccucuagcgaucuggaccuccugcacaaaauugugcugaaggucggaaaccucagcccccaucugcagaauaucuuuuccaaaucuccuauuuucgccggcguggugcuuccgcagguccaacaccccaagaacgcgcggaaaaaguacccuaagcugaaugggcuccuggccgauaucguucacgcuugccuucagaucgaccccgccgaucgcauuuccagcucugaccugcuccaucacgaguauuuuacgagagacggauucaucgaaaaauuuaugccugagcugaaggcuaaacugcuccaggaagccaaggugaacucccugauuaaacccaaggagagcucuaaggagaaugaacuucggaaagaugagcgcaagaccguguacacaaacacccugcucuccagcuccguccugggcaaagaaaucgagaaggagaaaaagccgaaggaaauuaaagugagaguuaucaaggugaaagggggacggggcgacaucucugagccuaagaaaaaggaauaugagggcgggcuuggacagcaagaugcgaaugaaaacguccaucccaugagcccugacacaaagcuggugaccauugagccucccaaccccaucaauccguccacgaacuguaauggccucaaagaaaacccccacugcgggggaagcguuacaaugccucccauuaaucugaccaacucuaaucugauggccgcuaaccucuccagcaaucuguuccauccuucugugcgccuuacagagagagccaagaaacggagaaccagcucccagucuaucggccaggucaugcccaacagccgccaagaggauccggggccuauucagucccagauggaaaagggaaucuucaaugagcggaccggccacagcgaccagauggcuaacgaaaauaaaagaaagcugaacuuuucucgcuccgaucggaaagaguuccacuuucccgagcucccugugacaauucaaagcaaggacacgaagggcauggaagucaaacagaucaagaugcugaaaagagagucuaagaaaaccgaauccagcaagauccccacacugcuuaauguggaucagaaccaggagaagcaagaagggggagacggccauugugaggggaaaaaccucaagcgcaaucgguucuuuuucugguga

SEQ ID NO: 67239 - RNA, 948 nt, Artificial Sequence
  derived and/or modified sequence opt5 from CDKL4__Homo_sapiens__NP_001009565
auggagaaguacgaaaaacuggccaagaccggcgaggggagcuauggaguggucuucaaaugcagaaacaagacauccggccagguuguggcugugaaaaaguuugucgaaucugaggacgaucccgugguuaagaaaaucgcccuccgggaaauucgcaugcugaagcaacuuaaacacccuaaucuggugaaccucaucgaggucuucagacggaagcgcaaaaugcaucugguguuugaguacugugaccacacgcuucugaaugaacucgagagaaacccgaaugggguugcggauggagugauuaagagcguccuguggcagacccugcaggcucucaacuucugccauauccacaauuguauucaucgggacaucaagcccgaaaacauccugauuacaaaacagggcaucauuaagaucugcgauuuuggguucgcccaaauucuuaucccuggagacgccuauaccgauuacguggcuacacgcugguauagagcccccgagcugcucgugggcgacacccaguacggcuccucugucgauauuugggcuaucggguguguuuuugccgagcugcuuacaggacagccucuguggcccggcaaaagcgacguggaucagcucuaucugaucauucggacccuggggaagcucaucccucgccaccaauccauuuucaaaucuaauggauuuuuccacggcaucagcauuccggaacccgaggacauggaaacgcuggaggaaaaguuuuccgaugugcauccugucgcgcuuaacuucaugaaagggugccugaagaugaaucccgacgacagacucaccuguagccagcugcuugagucuuccuacuuugauagcuuccaggaggcccagaucaagcggaaagcucgcaacgaaggaagaaaucggcgcagacaacaggugcugccucucaagucuuga

SEQ ID NO: 67240 - RNA, 3093 nt, Artificial Sequence
  derived and/or modified sequence opt5 from CDKL5__Homo_sapiens__NP_001032420
augaagauccccaacauuggcaaugugaugaacaaauucgagauccugggggucguuggagaaggcgccuacgggguggugcucaagugcagacacaaagagacccaugaaauugucgcuaucaagaaauuuaaggacucugaggaaaaugaggaggugaaggaaacaacgcugcgggagcuuaaaaugcugcgcacccucaagcaggaaaacauuguugagcugaaagaggccuucagacggcgcggaaaacuuuaucugguguuugaauacgucgagaaaaauaugcucgaacugcuggaggaaaugccuaacggcgugccgcccgagaagguuaaguccuauaucuaccaacucaucaaagcgauucacuggugucauaagaaugauaucgugcacagagacauuaaaccugagaaccugcuuaucucucauaaugauguccugaagcucugcgacuucggguuugcucggaaccugagcgaaggaaauaacgccaauuauacagaguacguggccacccgcugguauagaucccccgaacuucugcucggcgcuccuuacggcaaaucuguggauauguggagcgucggguguauucugggagagcuguccgacggccagccccucuucccuggggaaucugagaucgaucagcuguuuacaauucagaagguucuuggaccgcugcccagcgagcaaaugaaacucuucuacuccaacccucgguuucacggccugcgcuuccccgccgugaaucacccucagagccuugaaagacgguaucuggggauccucaacucugugcugcuggaccucaugaagaaccugcuuaagcuggaucccgcugaccgcuaccucaccgagcagugccugaaucauccgacauuucagacccaaagacuucuggaucgguccccuagccgcucugccaaaagaaagcccuaucacgucgaauccagcacgcucucuaaccggaaucaggcgggaaaauccaccgcccugcagagccaucacagauccaacucuaaggacauccagaaucugagcgugggccucccucgcgcugaugagggccugcccgccaacgaauccuuccuuaaugggaaccuggcuggagccagccucucuccccugcacacaaaaaccuaccaagcguccagccagccuggcucuacaagcaaggaccugaccaauaacaauauuccgcaucuucucucccccaaggaggccaaaucuaagacggaguuugacuucaacaucgauccuaaacccagcgaagggccuggaacaaaguaucugaaauccaauagccggucucagcaaaacagacacuccuucauggagagcucucaguccaaggcuggcacccugcagcccaaugaaaagcagagccgccauuccuacauugacacaaucccgcaaucuagccgguccccuucuuauagaaccaaagccaagagccacggggcucucuccgauagcaaaucuguuuccaaccugagcgaggcccgcgcccagauugcugagcccucuaccucccgguacuuuccuagcucuugucuugaccugaacagccccacauccccuacgcccaccagacauagcgauacacgcacccuccugucuccguccggacggaauaacagaaaugaaggcacacuggacagccgccggaccacgacaagacacuccaagaccauggaggaacuuaaacucccugagcacauggauucuagccauucccacucucugagcgcgccccaugaauccuucucuuacggccugggguauaccagccccuuuuccagccagcagcggccucaccgccacucuauguacgugacaagagacaagguccgggccaagggacucgauggcucccugagcaucgggcaaggaauggcugccagagccaacucucuucagcugcucuccccgcagcccggcgagcagcugccucccgagaugaccguggcucgcagcucuguuaaagaaacaucccgggaggggacgagcuccuuccauaccagacaaaagagcgaaggcggaguguaucacgacccucauucugaugacggcacagcccccaaagagaaucgccaccuguacaacgacccuguccccagacggguggggagcuuuuaucgcgucccguccccuagacccgauaauucuuuccaugaaaacaaugugagcacccggguuuccucucuuccuagcgaguccucuagcggaacaaaccacuccaagcgccagcccgcguuugacccguggaaaagcccugagaauaucucucacuccgaacagcucaaggagaaagaaaagcagggcuucuuuagaagcaugaagaaaaagaaaaagaaaucucaaaccgugcccaacuccgauagcccugaccugcugacgcuccagaaguccauucauucugcuagcacccccuccagccggcccaaggaguggcgcccugaaaagaucucugaucugcagacacaaucccagccgcuuaagagccugagaaaacuccugcaccugucuagcgccuccaaucaucccgccucuagcgacccucgguuccagccccuuaccgcucagcaaacaaagaacuccuuuucugagauucgcauccacccucucagccaggccuccgggggaagcucuaauauuagacaggagcccgcuccuaaaggccggccggcccugcagcugcccgaugggggcugcgacggaagacgccaacggcaucacuccggcccucaggauagacgcuucaugcuccggaccacggaacagcagggggaguacuuuuguugcggagaccccaagaagccucacacacccugugucccgaacagagcgcugcaucgcccuaucagcucccccgcccccuauccugugcuucaaguucggggcaccucuaugugccccacacuccaggugagagggaccgaugcuuucagcuguccuacccagcaauccggauucagcuuuuucguccgccacgugaugcgggaagcccugauccauagagcucaggugaaccaggccgcgcugcugacauaccacgagaaugccgcucuuacgggcaaauga

SEQ ID NO: 67241 - RNA, 495 nt, Artificial Sequence
  derived and/or modified sequence opt5 from CDKN1A__Homo_sapiens__NP_000380
augagcgagcccgccggcgacgugagacagaacccuugcggguccaaggcuugucggcgccuguucggaccggucgauucugaacaacucagcagagacugcgaugcccugauggcgggcuguauucaggaggcucgggaacgcuggaauuuugacuucguuaccgagacaccccuugaaggggauuuugccugggagagagugcggggacugggccucccuaaacuguaccuucccacggggccucgcagaggacgggacgagcugggcggcgggcgcagacccggaaccuccccugcccuccugcagggcacagcugaagaggaucacguggaccugucucucagcugcacccuggucccgcgguccggggaacaggccgagggaucucccggcgggccuggagauagccaaggccgcaagagacggcagacauccaugaccgacuucuaucauagcaaacgcagacuuaucuuuucuaagcggaaacccuga

SEQ ID NO: 67242 - RNA, 597 nt, Artificial Sequence
  derived and/or modified sequence opt5 from CDKN1B__Homo_sapiens__NP_004055
augagcaacgugagagucuccaauggcucucccagccuggagcggauggacgcccgccaggcugaacacccuaagccguccgccugcagaaaccucuucgggcccguugaucaugaggaacugacccgggaccuugagaaacacugucgcgauauggaagaggcgucucaaagaaaguggaauuuugacuuccagaaccauaaaccucuggagggaaaguacgaauggcaggagguggaaaaaggcagccuccccgaguuuuauuaccggccuccccgcccuccgaagggggcuugcaaggugcccgcccaggagucccaagaugucucuggaagcagaccugccgcuccccugaucggcgccccugcuaauuccgaagacacacaccuuguggaucccaaaacggacccgagcgauucucagaccgggcuggccgagcagugugcgggcauucggaagcgcccugccacagacgauuccagcacccagaacaaaagagcuaaucggacagaagagaacguuucugacggaucccccaaugccggcagcguggaacaaaccccuaagaaacccgggcuccgcagacggcagacauga

SEQ ID NO: 67243 - RNA, 951 nt, Artificial Sequence
  derived and/or modified sequence opt5 from CDKN1C__Homo_sapiens__NP_000067
augagcgacgccucccugagaucuaccagcacaauggagcggcucguggcucgcggcacguuccccguccugguuagaaccuccgccugccggucucuuuuugggccuguggaucacgaggagcugagccgcgaacuccaggcgagacuggcugagcuuaacgccgaagaccaaaaucggugggauuacgacuuccagcaggauaugccgcugcgcggacccggcagacuccaguggacagagguggacuccgauucugucccugccuuuuaucgggagaccgugcaaguugggcgcuguagacugcugcucgcuccccggccuguggccgucgcuguggccguuagcccuccccuggaaccggcggccgagucccuugacggacuggaagaggcucccgagcagcucccuagcgugcccgucccugcccccgcuucuacaccgccucccgugccugugcuggcccccgcgcccgccccugcuccggcccccgucgcugccccuguugccgcucccguggcgguggccguccuugcuccugcccccgccccggcuccugcccccgcgccugcucccgccccuguggccgcucccgccccggcuccugcccccgcgcccgccccugcuccggcccccgcuccugcccccgaugcggccccucaggaauccgcugagcagggcgccaaccaagggcagcgcggacaggaaccccuggcugaccagcuccauagcggcaucucuggcagaccugccgccgggaccgcugcggccuccgcuaauggagccgccauuaagaaacugagcggcccccugaucucugauuucuuugcuaagcggaaacgcuccgccccggaaaagagcuccggggacguuccugcgcccugcccuucucccagcgcugccccgggagugggcuccgucgaacaaacaccuagaaaacggcucagauga

SEQ ID NO: 67244 - RNA, 471 nt, Artificial Sequence
  derived and/or modified sequence opt5 from CDKN2A__Homo_sapiens__NP_000068
auggagcccgccgcuggcagcuccauggaaccuucugccgacuggcuggcgaccgcugccgccagagggcggguggaggaaguccgcgcucuccuggaggccggagcccuuccgaacgcucccaauagcuacggcagacggccuauccagguuaugaugaugggguccgcgcgcguggccgaacugcuccugcuucacggagcugagcccaacugcgccgauccugcuacacugacgagacccgugcaugacgccgcgcgggagggcuuccucgauacccuggucgugcugcaccgcgccggggcuagacucgacguucgggaugccuggggacgccugccuguggaccuugcugaggaacugggccauagagaugucgcccgguaucuccgcgccgcugcgggcgggacaagaggaucuaaucacgcccggauugacgcugccgaaggcccgagcgauauccccgacuga

SEQ ID NO: 67245 - RNA, 1743 nt, Artificial Sequence
  derived and/or modified sequence opt5 from CDKN2AIP__Homo_sapiens__NP_060102
auggcccaggaggugagcgaauaccugucccaaaaccccagagucgcugccuggguugaggcgcuccggugcgacggcgaaaccgauaagcacuggcgccauagacgggacuuccugcuucgcaaugcuggggaucuggccccugccggaggcgcugccucugcuagcacagacgaggccgcggaugccgaauccgggacgagaaaccggcagcuccagcagcugaucucuuuuagcauggcuugggccaaucacguguuccuuggaugucgcuauccgcaaaaagugauggacaagauucuguccauggcugagggcaucaaagucaccgaugcccccacauacaccacaagagacgagcucguggcgaagguuaaaaagcgggggauuucuagcuccaacgaaggaguggaggaaccuagcaagaaacgcgucaucgagggcaagaauagcuccgccguggagcaggaucaugcuaaaaccagcgccaagacagaaagagcuucugcccagcaggagaacuccucuaccugcauuggcucugccaucaaauccgaaagcgggaauagcgcucggucuagcggaaucuccagccaaaacucuuccacgagcgacggcgaucgcucuguuagcucccagucuagcuccagcgugucuucccaggucaccacagcggggagcggaaaggccucugaggcugaagcccccgacaagcacggcuccgccagcuuugugucccugcugaaaucuagcgucaauucccauaugacccagucuacagauagcagacaacaguccgggagcccuaagaaaucugcucucgagggauccagcgccucugcgucccagagcucuagcgagauugaagugccccugcuuggcuccagcgggucuuccgagguugaacugccucuccugagcuccaagccgucuagcgagaccgcuuccucugggcuuacgagcaaaacauccucugaagccagcguguccagcucuguggccaagaacuccuccucuuccggaaccagccugcucacacccaaaucuuccagcuccaccaauaccagccugcugacaucuaagagcacgucccaagucgcugccucucuccuggcuagcaaguccucuagccagaccuccggcucucuugugagcaaauccacaagccuggccucuguuucccagcucgcgagcaagucuuccagccagaccuccacaucucaacugccuagcaaauccaccagccagucuuccgagagcucugugaaguucagcuguaaacuuacgaacgaggacgucaagcagaagcagcccuuuuucaaucggcuguauaaaacaguggccuggaagcucguugcugugggcggauuuuccccuaacgucaaucacggcgaacugcugaacgccgcuaucgaggcccucaaagcgacccuggacguguucuuugucccccuuaaggaacuggccgaucucccgcaaaacaaaucuagccaggaguccauugugugcgaacugcgcuguaagucuguuuaccuugggaccggaugcggcaagagcaaagagaaugcuaaggccguggcuuccagagaggcccugaaacucuuccugaagaaaaaggucgugguuaagaucuguaaacggaaguauagaggcagcgaaauugaggaccuggugcuccuggaugaagagucucgcccugucaaccuucccccugcccugaaacacccccaggagcuccuguga

SEQ ID NO: 67246 - RNA, 417 nt, Artificial Sequence
  derived and/or modified sequence opt5 from CDKN2B__Homo_sapiens__NP_004927
augagagaggaaaacaagggcaugcccagcgggggaggcuccgacgaggggcuggccucugcugccgcgcggggacucguggaaaaaguccgccagcugcuugaggcuggcgccgauccuaaugggguuaacagauucggacggcgcgccauccaagugaugaugaugggcagcgcuagaguggccgaacugcuccugcuucacggcgcugagccgaauugcgccgaccccgcgacccugacacggccuguccaugaugccgcucgcgagggguuucucgacacgcuggugguucugcacagagccggagcucggcucgaugugcgcgacgccuggggcagacugcccgucgaucuugcggaggaacgggggcaucgcgacguggccggauaccugagaaccgcuacaggcgauuga

SEQ ID NO: 67247 - RNA, 507 nt, Artificial Sequence
  derived and/or modified sequence opt5 from CDKN2C__Homo_sapiens__NP_001253
auggccgagcccuggggcaacgaacuggcuagcgccgcggcuagaggggaccucgagcagcugaccucccuucugcaaaauaacgugaaugucaacgcccagaauggauucggccggacagcccuccagguuaugaagcuggggaacccugaaaucgcucgcagacuucugcuccggggagccaauccggaucugaaagaccgcacgggcuuugcugugauucacgaugccgcgagagccggguuccuggacacccuccagacacugcuugaguuucaagcugaugugaacaucgaagacaaugagggaaaccugccccuccaucuggccgcuaaggagggccaccuucgggucguggaguuccugguuaaacauaccgccucuaaugugggccaccgcaaccauaagggggauacagcgugcgaccucgccagacuguacggacggaaugaagucgugagccugaugcaggcuaacggcgccgggggagcuaccaaucuccaguga

SEQ ID NO: 67248 - RNA, 501 nt, Artificial Sequence
  derived and/or modified sequence opt5 from CDKN2D__Homo_sapiens__NP_001791
augcugcucgaggaagugagagccggcgaccggcugagcggggcugccgcgcgcggagauguccaggagguuagacggcuucugcaccgcgaacucgugcaucccgacgcucugaacagauucggcaagaccgcccuucaagugaugauguuuggguccacagccaucgcucuggagcuccugaaacagggagccucuccuaauguccaggauacgagcggcaccuccccggugcacgacgcugcccggacaggguuccuggauacccucaagguucugguggaacauggagcggacgucaacgugcccgauggcacaggcgcccuuccuauucaccuggcuguucaggaggggcauaccgccguggucucuuuucucgcugccgagagcgaccugcaccgcagagaugcgcggggacuuacaccccuggaacucgcccugcaacgcggcgcucaggaccugguggauauccuccaggggcacaugguggccccucuguga

SEQ ID NO: 67249 - RNA, 519 nt, Artificial Sequence
  derived and/or modified sequence opt5 from CDKN3__Homo_sapiens__NP_001124323
augaagcccccuagcuccauccagaccucuugcaaauucaaggacgugagacggaacguccaaaaagauacagaggaacucaagagcuguggcauucaggacaucuuuguuuucugcacgcgcggggagcuguccaaauacagagugccgaaucugcuugaucuguaucagcaguguggaauuaucacccaccaucaccccauugccgacggcgggacaccugauaucgcuucuugcugugaaaucauggaggaacucaccacaugccugaagaacuaccggaagacccuuauucauuguuauggaggccuggggcgcagcugccucguggccgcgugucugcugcucuaccuguccgacacaaucucucccgagcaagcuauugauagccuuagagaccugcggggauccggcgccauccagaccauuaaacaguauaauuaccuccacgaguuucgcgauaagcuggccgcucaucuuagcucuagagacucccagagccggucugucucccgcuga

SEQ ID NO: 67250 - RNA, 564 nt, Artificial Sequence
  derived and/or modified sequence opt5 from CDNF__Homo_sapiens__NP_001025125
auguggugcgccagccccguggcugucguugccuucugugcgggccugcucgugucccacccugugcugacccaggggcaagaggcuggaggcagaccgggggccgacugcgaagucuguaaggaguuucuuaaccgguucuacaaaucucugaucgaucgcggagugaauuuuagccucgacacaauugaaaaggagcugaucuccuucugccuugauacgaaaggcaaggaaaacagacuguguuauuaccucggggccaccaaagacgcugccacaaagauucugucugagguuacccggcccaugagcgugcauaugccugcuaugaagaucugcgagaaacugaagaaacucgauucccagauuugugaacugaaguaugagaaaacacuugaccuggccucugucgaucuccgcaagaugagaguggcggaacugaagcagauccuucacagcuggggagaggagugccgggccugugcugagaaaaccgacuacguuaaucugauccaggaacucgcccccaaguaugcugccacacauccuaaaaccgaacuguga

SEQ ID NO: 67251 - RNA, 603 nt, Artificial Sequence
  derived and/or modified sequence opt5 from CDO1__Homo_sapiens__NP_001792
auggagcagaccgaagugcugaagcccagaacacucgccgaccugauccggauucuucaccaacuguucgcuggcgaugaggucaacguugaagaggugcaggccaucauggaagcguacgagagcgacccuacggagugggcuauguaugccaaauuugaucaguaccgcuauaccagaaaucucguggaccaggggaacggaaaguucaaucugaugauucuuugcuggggcgaagggcauggauccucuauccacgaucauacaaacagccacuguuuucugaaaaugcuccaaggcaaucugaaggagacccuguucgccuggccggacaaaaaguccaacgaaauggucaagaaaucugagcgggugcuccgcgagaaucagugcgcuuacauuaacgauagcaucgggcugcauagaguugaaaauaucucccacacagagcccgccgugucucuucaccuguauagcccucccuuugacaccugucaugcuuucgaucagcggacaggacacaagaacaaagucaccaugacguuucauuccaaguucggcauucgcaccccuaaugccacaagcggcucucucgaaaacaauuga

SEQ ID NO: 67252 - RNA, 3864 nt, Artificial Sequence
  derived and/or modified sequence opt5 from CDON__Homo_sapiens__XP_011541167
augcaccccgaccugggcccucucugcacccugcuuuacgugacacugacgauccucuguagcuccgucucuagcgaucuggccccguauuucaccuccgagccccuuucugcuguucagaagcucgggggaccuguggugcuccauugcagcgcccaacccgucacaaccagaauuuccuggcugcacaacggcaaaacacuggacgggaaucucgaacaugugaagauccaccagggaacccugacaauucuuucucugaacagcucccuccugggcuacuaucagugucuugcgaauaacagcaucggggcuauuguuucuggaccugccaccguguccgucgccgugcugggcgauuuuggcagcucuacgaaacauguuaucaccgcugaggaaaaguccgccggguucaucggaugccgggugcccgagagcaauccuaaagcugaaguccgcuacaagauuagaggcaaguggcucgagcacucuacagagaacuaucugauccugccguccgggaaucuccagauucugaacgugagccuugaagacaaaggauccuacaagugugccgcguauaaucccgugacccaccaacugaaagucgagccuaucggccggaagcuccugguuucucgccccagcuccgaugacgugcauauucuucacccuacacauagccaggcccuggcugugcucucuagaucccccgucacccuggaaugcgugguuagcggggugccggccccucaggucuacuggcugaaagauggacaggacaucgcucccggcucuaacuggcggcgccucuacagccaccuggccacggauuccguggacccugcggauucuggcaauuauagcuguauggccgggaacaaguccggagacguuaaguacgugacauauauggucaaugugcuugagcacgcuagcauuucuaaaggccugcaagaucagaucgucucccucggggccaccgugcauuuuacaugcgacguucacggaaaccccgcucccaauuguaccugguuccauaacgcccagccuauccacccgagcgccagacaucugaccgcuggcaacgggcuuaagauuucuggagugacagucgaggacgugggcauguaccagugcguugcggauaauggcaucggguuuaugcacuccacgggacggcuggaaauugagaacgacggcggguucaaacccgugaucauuaccgccccugucagcgcuaagguggccgauggagacuuugugacacucuccuguaaugccucuggccugcccguuccugucauccgcugguaugauagccacgggcugaucaccucccaucccucucaagugcucagaagcaaaucccgcaagagccagcugucucggccggaaggccuuaaccuggagccuguguacuucguccucucccaggcuggagccagcucucugcacauucaagcggugacacaggaacaugcuggcaaauauaucugcgaggccgccaaugagcacgggaccacgcaggcugaagccucccugaugguugugcccuuugagacaaacaccaaggcugaaaccgucacacuuccugacgccgcgcagaaugaugacagaagcaagcgggauggaucugagaccggccuccugagcuccuuccccgugaaaguucacccuagcgccguggaaucugcucccgagaagaacgccuccgggauuagcgucccggacgcuccuaucauucuguccccgccccaaacacauacgccugauaccuacaaucucguguggcgcgccggaaaagacggcgggcugccgaucaacgcguacuuuguuaaguauagaaaacuugacgauggcgugggaaugcugggcucuuggcacacaguccgggugcccgggagcgagaaugaacuccaucuggccgagcuggaaccuuccucucuuuacgaggugcucauggucgcuagaagcgccgcuggagaaggccagcccgccaugcugaccuuccgcacauccaaggagaagaccgccucuagcaaaaacacgcaggcuuccagcccucccguugggaucccuaaguaucccguggugucugaggcggccaauaacaauuuuggagucgugcugaccgacuccagccggcacucuggcguuccggaagcuccugauagacccacaauuuccaccgccagcgagacaucuguguacgucaccuggaucccucgcgccaacgggggcucccccauuacggcuuucaaaguggaauauaagcggaugagaacaagcaacuggcucguugccgcggaggacaucccgccuuccaaacugagcguggagguccgcucucuugaacccggaagcaccuacaaguuccgggugauugcuaucaaucauuauggcgaguccuuuagaucuagcgccucccgcccuuaccagguugugggguuccccaaccgguuuucuagcagacccauuacaggaccucacaucgccuacaccgaagcugucuccgauacccaaaucaugcugaaguggacauauauuccgucuagcaauaacaauacgcccauccagggcuucuacauuuauuaccgcccuaccgacuccgauaacgacagcgauuauaaacgggacgugguggaggggucuaagcaguggcacaugaucggacaucuccagcccgaaacauccuacgauauuaaaaugcaaugcuuuaaugagggcggggagagcgaguucucuaacgucaugaucugugaaaccaagguuaaaagagugccuggcgccuccgaauaucccgugaaggaccugagcacaccucccaauucccugggaucuggcgggaacgucggacccgcgaccagcccugcucgguccagcgauaugcuuuaccucaucgugggcugcguucugggggugaugguccugauucucaugguguuuaucgccaugugucuguggaagaaucgccagcagaacacgauucagaaauacgaucccccuggauaucuuuaccaaggcucugacaugaauggccagaugguugacuauacaacccuguccggggccagccagaucaacggaaaugugcacggcggguuccucaccaacggaggccugucuagcggguacucccaucugcaccauaagguccccaacgcugugaauggaauugucaacggcucucuuaauggcgggcucuauagcggacacuccaacucucugacaagaacccacguggacuuugagcauccgcaccaucugguuaauggcgggggaauguacacagccgugccucaaaucgauccccucgaaugcgucaacugucggaauugcagaaacaauaaccgcuguuucacgaaaaccaauagcacauuuuccagcucucccccucccgugguuccuguggucgcuccguauccccaggacggccuggagaugaagccucuuucccacgugaaagugcccguuugccugaccagcgccgucccugauugugggcagcuccccgaggaauccgugaaggacaacguggagccggucccuacacagcggaccugcugucaagauaucgugaaugacguuucuagcgauggauccgaagaccccgcggaguucucuagaggccaggaaggcaugauuaaccugcgcaucccugaucaucugcagcuugccaaaagcugcgugugggagggggacuccugcgcucacagcgagacggaaauuaauaucgucucuuggaacgcccugauucugcccccugugcccgagggaugugcugaaaagaccaugugguccccgccuggcaucccccuggauagccccacagagguucuccagcaaccuagagagaccuga

SEQ ID NO: 67253 - RNA, 789 nt, Artificial Sequence
  derived and/or modified sequence opt5 from CDR1__Homo_sapiens__NP_004056
auggccuggcuggaggacguggauuuccucgaagacgucccccugcuugaggauaucccucugcucgaagacguuccgcugcuugaggaugugccccugcucgaagacaccagcagacuggaggauauuaaccugauggaggacauggcucuccuggaagauguggaccuucuggaggauacagacuuucucgaagaucuggacuucuccgaggccauggaccuucgggaggauaaggacuuucuggaagauauggacucucucgaggauauggcgcugcuggaagacgucgaucuccuggaggacacggauuuccuugaagacccugauuuucuggaggcuaucgaccuccgcgaggacaaagauuuccuggaagacauggauagccuugaggaccuggaagccauuggcagaugcggguuuuccggacggcacggcuucuuugggcgcagacgguucucuggacgccccaagcucagcggcagacuggggcugcucggacggcgcggcuuuuccggcagacuugggggauacuggaaaaccuggaucuucuggaagacauggaucuuuuggaaaaccuggauuuuccggaagacauauaucggcuggaagaccuggauuuucucugggcgcuguggacugacaggcagaccuggguuuggaggccggcgcagauucuuuuggaaaacccugacggauuggaagaccuggaucagcuucuggaaaacacucauugacuggaagaccuggaucuccuuuuggaaaacacugauugauuggaagaucuga

SEQ ID NO: 67254 - RNA, 1365 nt, Artificial Sequence
  derived and/or modified sequence opt5 from CDR2__Homo_sapiens__NP_001793
augcuggccgagaaccucguggaagaguucgaaaugaaggaggacgaacccugguacgaucaccaggaccugcaacaggaucuucagcuggcugccgagcucggcaaaacccugcuugacagaaauacagagcuggaagauagcguccagcaaauguauacgaccaaccaggagcagcuccaggaaaucgaguaccugacaaagcaaguugagcugcuccggcagaugaaugaacagcaugcgaaaguguaugagcagcuggacgugaccgcucgcgaacuugaggaaacaaaccaaaagcuggucgccgauuccaaagccucucagcagaagauucucagccugaccgagacaaucgagugccuucaaaccaauauugaccaccuucagucccagguggaggagcucaagucuagcgggcagggaagacgguccccuggcaaaugugaucaagaaaagccggcucccucuuuugccugccugaaagagcuguacgaccuccgccagcauuucguuuaugaucacguguuugcugaaaagaucacgagccugcaggggcagccuucccccgacgaggaggaaaacgagcaucuuaaaaagaccgucacaaugcugcaagcccagcucagccuggaaagacagaagcgggugaccauggaggaagaguacggacuuguucugaaagaaaauucugaacucgagcagcaacugggcgcgacaggggccuaucgcgcuagagcccuggaacucgaggcugagguggccgaaaugcggcagaugcugcaguccgagcacccuuucgucaacggaguggaaaagcuggugcccgauagccuguacgucccuuuuaaagagccgucucagucccuccuggaagagauguuccuuaccguucccgagagccaccgcaagccucugaaaagaucuuccagcgaaacgauucucuccucucuggcgggcagcgacaucgugaagggccaugaggaaacauguauccggcgcgccaaagcugugaagcaaagagggauuucccugcuccacgaggucgacacccaguacagcgcccugaaggugaaauaugaggaacuucugaagaaaugccaggaggaacaagauucucucucccauaaggcuguucagacaagccgggccgccgcuaaagaccugaccggagugaaugcgcagucugagcccgucgccagcggcugggaacuggcuuccgugaacccugagcccguuucuagcccgaccacaccucccgaauacaaggcccuuuuuaaggagaucuucuccuguauuaaaaagacgaaacaggagaucgaugaacaacgcaccaaguauagaagccucucuucccacagcuga

SEQ ID NO: 67255 - RNA, 1338 nt, Artificial Sequence
  derived and/or modified sequence opt5 from CDS2__Homo_sapiens__NP_003809
augaccgagcugagacagcggguggcccacgaacccgucgcuccuccggaggacaaggaaagcgaguccgaagccaaaguugauggcgagacagcgucugacagcgagucccgcgcugaaucugcuccccucccugugagcgccgaugacacgcccgaggugcugaacagagcccuuuccaaucugucuagccgguggaagaacugguggguccgcgggauccucacccuggccaugauugcuuucuuuuucaucauuaucuaccuuggaccuauggugcugaugauuaucguuaugugcgugcaaaucaaauguuuucaugaaauuaucacaauuggcuauaaugucuaccacuccuaugaucuccccugguucagaacccugagcugguacuuucugcucugcgugaacuauuucuuuuacggggagacaguuaccgacuauuucuuuacacuggugcagcgggaggaaccucuucgcauccugucuaaguaccauagauucauuuccuuuacccucuaccugaucggauucuguauguuuguccuuagccuggugaaaaagcacuaucggcuccaguucuacauguucggcuggacgcaugugacccugcugauugucguuacacagucucaccucgugauccacaaucuguuugaggggaugaucugguucauugugccgaucuccugcgucauuuguaacgauaucauggccuauauguuuggauucuuuuucggccgcacaccccuuauuaagcugagcccuaaaaagaccugggaaggcuuuaucgggggauucuuugcgaccgugguuuucggccuccugcuuucuuacgugauguccggguauagaugcuuugucugucccguggaguacaauaacgacacgaauagcuucacaguugauugcgaaccuuccgaccuguuucggcuccaagaguauaacauccccggagugauucagucugucaucggcuggaaaaccgugcgcauguacccguuccagauucauagcaucgcccuguccacauucgcuagccugauugggccuuuuggaggcuucuuugccucuggcuucaagagagcuuuuaaaaucaaggauuucgccaauaccauccccgggcacggaggcauuauggaccgguuugauugucaguaccucauggcgaccuucgucaacguguauaucgccuccuuuauucgcgggccuaaucccagcaagcugauccaacaguuccuuacacugagacccgaccagcagcuccauauuuuuaacacgcugcggucucaccuuaucgacaaaggaaugcugaccagcacaaccgaggaugaauga

SEQ ID NO: 67256 - RNA, 1641 nt, Artificial Sequence
  derived and/or modified sequence opt5 from CDT1__Homo_sapiens__NP_112190
auggagcagagacgggugaccgacuucuuugcccgcagacggcccggcccuccgcgcaucgcucccccuaagcuggccugcagaacacccagcccugcgcggcccgcucuccgcgccccugccuccgcuacgucugggagcagaaaacgggcccgcccgcccgcugccccuggaagagaucaagcgcggcccccugcccgcagacggcugcgccuuuccgucgacgaaguuucuagccccuccaccccggaggcuccugauauucccgccuguccuucucccggccagaagaucaaaaagagcacacccgcugccgggcagccuccgcaccugaccuccgcgcaggaccaagauacaauuagcgaacucgccucuugccugcagagagcucgggagcuuggagccagagugcgcgcucugaaagccuccgcccaggacgcuggcgaaagcuguacccccgaggcggaggggcggccugaggaacccugcggagaaaaggccccugcuuaccagagauuccaugcccucgcccaacccggccugccgggccuggugcucccuuauaaguaccagguccuggcugagauguuucgcucuauggauacaaucguggggaugcuucacaaccgguccgagacccccacguucgccaaaguucagagaggagugcaggacaugaugcgccggagauuugaagaguguaaugucggccaaauuaagaccguguauccugcgagcuaccgcuuccggcaggaaagaucuguucccacauuuaaagaugggacccgccgguccgacuaucagcugacaaucgagccucuccuggaacaagaggcugauggagccgcuccccagcuuaccgccagcagacugcuccagcggcgccagaucuucucccaaaagcugguggagcaugucaaagaacaccauaaggccuuucuggcuucucucagcccggccaugguggugccugaggaccagcugacgagauggcacccccgguucaacgucgaugaaguucccgacauugagccugcggcccuuccgcagcccccugcuacagaaaagcugaccacagcccaggaggugcucgcuagagcccgcaaucugaucucccccagaauggagaaagcgcuuagccaacuggcccucagaucugcugccccuuccagccccggcucuccucgccccgcucugccggccaccccucccgccaccccucccgcugcgagcccguccgcccugaagggggugucucaggaccuccuggaacggauucgggcuaaagaggcccagaagcagcuugcccaaaugacacgcugcccugaacaggagcagagacugcagcggcucgaacgccugcccgagcuugcuagaguccugcggagcguguuuguuuccgagcgcaaaccugcccucagcauggaaguggcgugugcuagaauggucggaucuugcuguacgaucaugucccccggcgagauggaaaagcaucugcugcuccugagcgagcuucugcccgauuggcucucucugcaccggauucgcaccgacacauacgugaaacuggauaaggccgccgaccuugcucacaucaccgccagacucgcgcaucaaacacgggcugaggaaggccuguga

SEQ ID NO: 67257 - RNA, 642 nt, Artificial Sequence
  derived and/or modified sequence opt5 from CDV3__Homo_sapiens__NP_001127894
auggccgagaccgaagagagaagccuggacaacuucuuugcuaagcgggauaaaaagaaaaagaaagaacgcuccaauagagccgcgucugcugccggcgccgcugggagcgccggaggcuccucuggggcugccggagcggccggcgggggagcuggcgccggcacacggcccggggacggaggcacggcuagcgccggggcggccggaccuggcgcugccaccaaggcugugacaaaggaugaggacgaauggaaagagcucgagcagaaggaagucgauuacuccgggcugcgcguucaagccaugcagaucucuagcgagaaagaagaggacgauaacgagaagagacaggacccgggagauaauugggaagagggcggcgggggaggcgggggaauggaaaaauccagcggccccuggaacaagaccgccccugugcaggcucccccugcgcccgugauugucacagagaccccugaaccggccaugacaucugggguguaucggcccccuggagcucgccuuaccacgaccagaaagacaccccaaggcccucccgagaucuacuccgacacccaguucccgagccugcagucuacagccaaacacguugagucccggaaucgcuaucucaaguga

SEQ ID NO: 67258 - RNA, 798 nt, Artificial Sequence
  derived and/or modified sequence opt5 from CDX1__Homo_sapiens__NP_001795
auguacgugggcuauguccuggacaaggauagccccguuuacccugggccggccagacccgcuucccucggacugggcccucaggccuaugggcccccugcgcccccuccggcucccccucaauaccccgacuucucuagcuauucccacguggagccugcccccgccccgccuaccgcuuggggagcccccuuuccugcucccaaagaugacugggccgcggccuacggccccgggccugcugccccggcugccucucccgcgagccuugccuucggaccucccccugauuuuucccccgugccggcuccucccggcccuggccccgggcugcucgcccagccucugggaggccccgggacaccgucuagcccuggagcucagcggcccacgcccuaugaauggaugcgcagauccgucgccgccggcgggggaggcggcagcgggaagacccggacaaaagacaaguaccgcgugguuuacaccgaucaucagagacuugagcuggaaaaagaguuccacuauucucgguacaucacaauucgcagaaaguccgaacucgcugcgaaccugggacugaccgagcggcaagugaagaucugguuucagaaucgcagagccaaagagcggaaggucaacaaaaagaaacagcagcaacagcagccuccgcagcccccuauggcucaugacauuacagccacccccgccggcccuagccucgggggacugugccccucuaauacgucccuucuggcuaccagcucuccuaugcccgugaaggaagaguuccucccguga

SEQ ID NO: 67259 - RNA, 942 nt, Artificial Sequence
  derived and/or modified sequence opt5 from CDX2__Homo_sapiens__NP_001256
auguacgugagcuaucugcucgacaaggaugucuccauguaccccucuagcguuagacacuccggcgggcugaaccuugccccucagaauuucgugucuccgccccaauauccugacuacggaggcuaucauguggcugccgcggcugccgccgcugccaaccuggauagcgcucagucccccgggccuucuuggcccgccgcguacggagccccucuccgggaggacuggaauggcuaugcucccgggggagccgcugccgcggccaacgcugucgcccacggccugaauggcgggagcccggcugccgccaugggauacuccagcccugcugauuaccauccccaccaucacccucaccaucacccccaucacccggcggccgcuccuucuugcgccuccggccuucugcagacccucaaccccgggccucccggacccgccgcuacagccgcggcugaacagcugagcccuggcgggcaacgcagaaaucugugugaguggaugcggaaaccggcccagcagucucucggaucccaggugaagacgcgcaccaaagacaaguauagaguuguguacacagaucaccaacggcuggaacuugagaaagaauuucauuauagccgcuacaucaccauuagacggaaggccgagcuggcugccacacucggccugucugagcgccaggucaagaucugguuccagaacagacgggcuaaagaacgcaagauuaauaaaaagaaacuucagcaacagcagcaacagcagcccccucagcccccucccccgccuccccaaccuccccagccucagcccggcccgcugagauccgugccugagccccucagccccguuuccucucugcaggccagcguguccgggagcgucccuggagugcugggcccgaccgggggagugcucaaccccacagucacccaauga

SEQ ID NO: 67260 - RNA, 855 nt, Artificial Sequence
  derived and/or modified sequence opt5 from CDX4__Homo_sapiens__NP_005184
auguacggcagcugccugcucgagaaggaagccgggauguaucccggaacccugauguccccuggcggggacggaacagcuggcaccgggggaacgggcggcgggggaucuccgaugcccgccagcaacuucgcggcugccccugccuuuucccacuacaugggcuauccccauaugccuucuauggauccccacuggccuagccuugggguguggggauccccguacucucccccuagagaggacuggagcgucuaucccggcccuuccagcacaauggggaccguucccgugaaugaugugacaucuuccccggcugccuucuguagcaccgacuacucuaaccugggaccugucggcggcgggacauccggaagcucucuccccggccaggcugggggaucccuggugccuaccgaugccggcgcggccaaagcuagcucccccucucggagccgccauucccccuaugccuggaugagaaagacgguucaagugaccgggaaaacacggaccaaggaaaaauaccgcgucguguacacagaccaccagagacuugagcuggaaaaggaguuucauugcaaucgguauaucaccauucagcgcaagagcgagcucgcuguuaaccugggacugucugaaagacaggugaaaaucugguuccaaaaucggcgcgccaaggagagaaaaaugauuaagaaaaagaucucccaguuugaaaacagcggcggcucuguccagagcgauuccgacucuauuagcccuggggagcucccgaauacguucuuuacaacccccuccgcggugcggggauuccagccuaucgagauccaacaggugauugucagcgaauga

SEQ ID NO: 67261 - RNA, 1623 nt, Artificial Sequence
  derived and/or modified sequence opt5 from CDY1B__Homo_sapiens__NP_001003894
auggccagccaggaguucgaaguggaggcuaucgucgacaagagacaagauaaaaacggcaauacccaguaccugguucgguggaagggguaugacaaacaggaugacacaugggaacccgagcagcaccucaugaacugcgaaaagugugugcaugauuuuaaucgcagacaaacggagaaacagaagaagcugaccuggacaaccacaucccggauuuucucuaacaaugcccgcagacggaccagccgcuccacaaaagcgaacuacucuaagaauagcccuaaaaccccggugacggacaagcaccauagauccaaaaaccggaaacuuuuugcugccucuaagaauguccgcagaaaagccgcuagcauccuguccgauaccaagaacauggagauuaucaauagcacaauugaaacccucgcccccgacucuccuuucgaucacaaaacaguguccggauuucagaagcuggagaaacuugaccccaucgcugccgaucagcaagacaccguuguguucaaggucacggaaggcaaacugcuccgggauccucugagccgccccggggcggagcagacaggaauccagaacaagacccagauucauccucugaugucucaaauguccggcagcgugacagccucuauggcuaccggguccgccaccagaaagggaaucguugugcucauugacccgcuggcugccaauggcacaacggacaugcacaccagcgucccccgggugaaaggcgggcagcgcaacaucacagaugacuccagagaucagccuuuuauuaagaaaaugcacuucaccauccggcuuacagagucugcgagcaccuauagagacauuguggucaagaaagaagauggauuuacgcaaaucguucuguccacacgcagcaccgagaagaaugcccucaacaccgaagugaucaaggagauugugaacgcucuuaauucugccgcugccgacgauuccaaacugguccuguucagcgccgcuggcucuguguuuugcugugggcucgacuucggauacuuuguuaagcaucugcggaacaauagaaacacagcgagccuggaaaugguggauaccaucaaaaauuucgucaacacauucauucaguuuaagaaacccaucgugguuuccgugaauggcccugccauugggcucggagcuucuauccugccccuuugcgaccuggucugggccaacgagaaggccugguuccagacgccguauaccacauuuggccagagcccugauggcuguuccagcaucaccuuccccaagaugauggggaaggcuucugccaaugagaugcucauugcgggacgcaagcugacagcucgggaagccugcgccaaaggccuugugucccaagucuuucugaccgggacguucacccaggaggugaugauccagauuaaggaacucgcuagcuacaacccuaucguucuggaggaauguaaagcccuggugagaugcaauauuaagcucgagcuggagcaggcuaacgaacgcgagugugaaguccuucggaagaucuggucuuccgcccaaggaaucgagagcaugcugaaauauguggaaaauaagauugacgaguuuuga

SEQ ID NO: 67262 - RNA, 1626 nt, Artificial Sequence
  derived and/or modified sequence opt5 from CDY2B__Homo_sapiens__NP_001001722
auggccagccaggaguucgaaguggaggcuaucgucgacaagagacaagauaaaaacggcaauacccaguaccugguucgguggaagggguaugacaaacaggaugacacaugggaacccgagcagcaccucaugaacugcgaaaagugugugcaugauuuuaaucgcagacaaacggagaaacagaagaagcugaccuggacaaccacaucccggauuuucucuaacaaugcccgcagacggaccagccgcuccacaaaagcgaacuacucuaagaauagcccuaaaaccccggugacggacaagcaccauagauccaaaaacugcaagcuguuugcugccucuaagaauguccggcgcaaagccgcuagcacccuguccgauacaaagaacauggagaucauuaauagcaccaucgaaacacucgcccccgacucuccuuucgaucacaaaaagaccguguccggauuucagaaacuggagaaacuugaccccauugcugccgaucagcaagacacgguuguguucaaggucacagaaggcaagcugcucagagauccucugagccaucccggggcggagcagaccggaauccagaacaagacacagaugcacccucugaugucucaaauguccggcagcgugaccgccucuauggcuaccggguccgccacacggaaaggaaucguugugcucauugacccgcuggcugccaauggcacgaccgacaugcacacaagcgucccccgcgugaagggcgggcagagaaacaucaccgaugacucccggggacagccuuuuauuaaaaagaugcauuucacaauccgccuuaccgagucugcgauuacguauagagauaucguggucaaaaaggaagacggcuuuacacaaauuguucugagcacccgguccaccgagaagaaugcccucaacacagaagugaucaaagagauggugaacgcucugaauagcgccgcugccgaugacucuaaacuuguccuguucuccgccgcugggagcguguuuuguugcggacucgauuucggcuacuuuguuagacaccuucgcaacgaccggaauaccgcgucucuggaaaugguggauacaaucaagaacuucgucaauacguucauucaguuuaagaaacccaucgugguuagcgugaacgggccugccauuggacucggcgcuuccauccugccccuuugugaccuggucugggccaaugagaaggccugguuccagaccccguauacaaccuuuggccagucuccugaugggugcagcuccauuacauuccccaagaugaugggaaaagcuagcgccaacgagaugcucaucgcgggcagaaagcugaccgcucgcgaagccugugccaaagggcuugugucucaagucuuucugacgggaaccuucacacaggaggugaugauccagauuaaggaacucgcuuccuacaaugccaucguucuggaggaaugcaaagcucuggugcgguguaacauuaagcucgagcuggagcaggccaaugaaagagagugcgaaguccuucgcaagaucuggagcucugcgcaaggcauugaguccaugcugaaauauguggaaaacaagaucgacgaguuuuga

SEQ ID NO: 67263 - RNA, 1521 nt, Artificial Sequence
  derived and/or modified sequence opt5 from CDYL2__Homo_sapiens__NP_689555
auggccagcggcgaccuguacgagguggaaagaaucgucgauaagcggaaaaacaagaaagggaagugggaguaucucauucgcuggaaaggauacggcuccaccgaagacacaugggagcccgaacaccaucugcuucacugcgaggaguucaucgaugaauuuaaugggcugcauaugucuaaggacaagagaauuaaaagcggaaagcaguccucuacgagcaaacuccugcgggauucccgcggcccuucuguugagaagcucagccacagaccguccgaccccgggaaaagcaagggaaccucucauaagcggaaacgcaucaacccuccccuggcuaagccuaaaaagggcuauuccggcaaacccagcucugggggagauagagccacaaagaccguguccuaccggacaaccccuagcggccuccaaauuaugccgcugaaaaagucucagaaugggauggaaaacggagacgcgggcuccgagaaggaugagcgccacuucgggaauggaagccaccagcccggccuggaccucaacgaucaugugggcgaacaggacaugggggagugugaugucaaucacgcuacacuggccgaaaacggacuuggcuccgcccugaccaaugggggacucaaccugcauucuccugugaaaagaaagcuggaggcugaaaaagacuauguuuuugacaagcggcugcgcuacagcgugagacaaaaugaguccaacugccgguuccgcgauaucgucgugagaaaagaggaaggcuuuacgcacauccuccugagcucucagaccuccgacaauaacgcccugacacccgagauuaugaaggaaguucggagagcucucuguaaugccgcgaccgaugacagcaagcugcuucugcucucugccguggggagcgucuucugcuccggacuggauuauucuuaccuuaucggccgccugagcuccgaccggagaaaagagagcacacgcauugcugaagccauccgggauuuugugaaggcuuucauucaguuuaaaaagccuaucguggucgccauuaacggccccgcgcucgggcugggagccucuauccugccgcucugugacaucguuugggcuuccgagaaagccugguuccagaccccuuacgcuacgauuagacugacacccgccggcugcagcucuuauaccuuuccucaaauccuugggguggcccuggcuaacgagaugcuuuucuguggacgcaagcugacagcgcaggaagccugcucccggggccuugugagccaggucuuuuggcccaccaccuucucccaggaggugaugcugagaguuaaggaaauggcuucuuguagcgccgugguccucgaggaauccaaaugccuggugcgcucuuuccuuaagagcguucucgaggaugugaaugagaaagaaugucugaugcuuaagcaacugugguccagcucuaaagggcucgacucccuguuuagcuaccugcaggauaagauuuaugaggucuga

SEQ ID NO: 67264 - RNA, 1239 nt, Artificial Sequence
  derived and/or modified sequence opt5 from CDYL__Homo_sapiens__NP_001137442
auggaccuggccaagagcggcaucaaaauucucgugcccaaguccccugucaaaucuagaaccgcuguugauggguuccagagcgaguccccggaaaagcuggaccccguggagcaaggacaggaagauacaguggccccugaggucgcggcugaaaaacccgugggcgcccuucuggggccuggagccgagcgggcucgcaugggcucuagaccccggauccacccucucguuccccaggugccggggccugucacggccgcuauggccaccggacuggcggugaacggcaagggcacaagccccuuuauggacgcccuuaccgcuaaugggacaaccaacauucagacauccguuaccggagugacggccucuaagcgcaaauucaucgaugacagacgggaucaaccuuuugacaagcgccugagauucagcguccggcagaccgaguccgcuuaccgcuauagagauauuguggugcggaaacaggacggcuuuacacauauccuccugagcaccaagucuuccgaaaauaacagccugaaucccgaggucaugcgcgaaguucagucugcccucuccacagcggccgcugaugacagcaaacuggugcuucugucugccgugggguccgucuucugcuguggacucgauuuuaucuacuucauuagacggcugaccgacgaccgcaagagagagagcacgaagauggcugaggccauccggaacuuugugaauacauucauucaauuuaaaaagccgaucauuguugccgugaacggcccugcuaucgggcuuggagcguccauucugccccucugcgaugucgugugggccaaugaaaaggcuugguuccagaccccuuauacaaccuuuggccagucucccgacggcuguagcaccguuauguuccccaaaaucaugggaggggccuccgccaacgagaugcugcugagcggcagaaaacucacagcucaggaagccugcgggaagggacuggugucucaagucuucuggccuggcacguuuacccaggaggugaugguccgcaucaaagaacuugcguccuguaauccggugguucuggaggagagcaaggcucucgugcggugcaacaugaagauggaacuggagcaggccaaugaaagagagugugaaguccuuaaaaagauuugggggucugcccaaggaauggauagcaugcugaaauaccuccagcgcaagaucgacgaguucuga

SEQ ID NO: 67265 - RNA, 1278 nt, Artificial Sequence
  derived and/or modified sequence opt5 from CEACAM16__Homo_sapiens__NP_001034302
auggcccugaccggcuacagcuggcuccugcuuuccgcuacauuccugaacgugggggccgagaucucuauuacgcucgaacccgcgcagccuagcgagggagacaaugucacccugguugugcacggccuuuccggggaacugcucgcuuauucuugguacgccggaccgacacugagcguguccuaucuggucgccucuuacaucgugagcaccggcgaugagacacccgggccugcucauaccggaagagaagccguucggcccgacggcucccucgauauucaaggcauccugccucgccacagcgggacauauauucuucagaccuuuaacagacagcugcagacggaggugggauacggccauguccaagugcacgagauccucgcucagcccaccguucuggccaauucuacagcgcuuguggaacggcgcgacacccugagacucaugugcuccagcccuucuccgacagccgagguccggugguucuuuaacgggggagcucugcccguggcccugcgccucggccuguccccugaugggagagugcuugcucggcauggaauccgcagagaagaggccggcgcguaucagugugaggucuggaaucccguuagcgugucucgguccgaaccuauuaaccugaccguguacuucggccccgagcgcgucgccauccuccaggacagcacgacaagaaccgggugcacaauuaagguggauuuuaauaccucccugacccuuugguguguuucucggagcugcccggaaccugaguacguguggacauucaacggacaagcucugaaaaauggccaggaccaccucaacaucuccagcaugacggccgcucaggaagggaccuauacauguauugccaagaauaccaaaacacugcugucuggauccgccagcgucgugguuaagcucucugcugcggccguggcuaccaugaucguccccgugccuacgaaacccacagagggccaggaugucacccugaccgugcaaggguaccccaaggaccuucugguuuaugccugguaccgcggaccugccagcgagccgaacagacuccugucccagcuucccucuggcacauggauugcuggcccugcccacaccgggcgggaagugggauuucccaauugcagccugcucguccagaagcugaaccugacagauacgggcagauauacccucaaaacagugaccguucaagggaagacagagacccuggaaguggagcuucaggucgcgccucugggauga

SEQ ID NO: 67266 - RNA, 900 nt, Artificial Sequence
  derived and/or modified sequence opt5 from CEACAM19__Homo_sapiens__NP_001121365
auggagauccccaugggcacccaggggugcuucagcaagucccugcuccugucugccagcauucuugugcuguggaugcuccaaggaucccaggcugcccuguacauccagaaaauuccugaacagccgcaaaagaaccaggaccuucugcucucuguccagggcguucccgauacauuucaggacuucaauugguaucugggggaggaaacguacggaggcaccagacuguuuacauauaucccugggauucaacggccccagcgcgauggaagcgcgaugggccagagagacaucgugggcuucccuaacggguccaugcuccugcggcgcgcucagcccaccgauucuggaacauaccaaguggccaucaccauuaauagcgaguggacaaugaaagccaagaccgaaguccagguggcugagaaaaacaaggagcuuccuuccacgcaccuuccgaccaaugccggcauccucgcugccacaauuaucgggagccuggcggccggagcucugcugauuucuuguaucgccuaucuccugguuaccagaaacuggcggggccagucccaucgccugcccgcuccuagagggcaaggaagccucucuauucugugcuccgccgugagccccgucccuucugugacacccuccaccuggauggcgacgacagaaaagccggagcuuggcccugcccacgacgcuggcgauaauaacaucuacgaaguuaugcccagcccugugcugcucgucucccccaucucugacacccggagcauuaaucccgcccgcccucugccgacacccccucaucuucaggcugagcccgagaaccaccaguaucaggaucugcucaauccugaccccgccccguacugucaacuggugccuaccuccuga

SEQ ID NO: 67267 - RNA, 1395 nt, Artificial Sequence
  derived and/or modified sequence opt5 from CEACAM1__Homo_sapiens__NP_001020083
augggccaccugagcgcuccccuccauagagugcgggucccuuggcaggggcugcuucugaccgccucccuccugacauucuggaacccgcccacgaccgcccaacuuacaaccgagucuaugccuuuuaauguugcggaaggaaaggaggugcugcuccuggugcacaaccugccccagcaacucuucggcuacagcugguauaaaggggaacgcgucgacggaaauagacagaucgugggcuacgcuauugggacacagcaggccaccccuggacccgccaacuccggccgggagacaaucuauccuaaugcuucucugcuuauucagaacguuacccagaaugauacgggcuuuuacacccugcaagugaucaagagcgaccucgucaacgaagaggccacagggcaguuccauguguauccggagcugcccaaaccuuccauuucuagcaauaacuccaaucccguugaagauaaggacgcuguggccuuuaccugcgagccugaaacacaggauaccacguaccuuugguggaucaacaaucagagccugcccgucucuccgcgccuccaacuguccaacggaaauagaacacugacccuccugagcgugacacggaacgacaccggcccuuaugagugugagauccagaaccccgugucugcgaaucgcuccgauccugucacccuuaacguuacauacgggcccgacacgcccaccauuagcccuucugauacauacuauagaccgggagccaaucugucccucagcugcuacgcugccuccaaucccccugcucaguauucuuggcugaucaacggcaccuuccaacagagcacacaggaacuuuuuauucccaacaucaccgugaauaacuccgggagcuacacgugucacgccaauaacucugugacaggaugcaaucggaccaccgucaaaacaauuaucgugaccgagcuguccccuguuguggcgaagccccagauuaaggccagcaaaacaacggucaccggcgacaaggauucugugaaccucacauguagcaccaaugacacaggcaucuccauccgcugguucuuuaaaaaccaaucucugccgagcuccgaaagaaugaagcugagccaggggaauaccacgcucucuauuaacccuguuaaacgggaggaugcuggaaccuauuggugcgaaguguucaaccccaucuccaagaaucagagcgacccuauuaugcugaacgucaauuacaacgcccuuccccaggagaauggccugucuccuggggcuaucgccggaauugugaucggcgucguggcccucguugcucugaucgcgguggcccuugcuuguuuucugcauuucgggaagacaggauccagcggcccccuccaauga

SEQ ID NO: 67268 - RNA, 882 nt, Artificial Sequence
  derived and/or modified sequence opt5 from CEACAM21__Homo_sapiens__XP_006725457
augggacccccuagcgccugcccgcacagagaguguauccccuggcaggggcugcuccugaccgcuucccuucugacauucuggaacgccccuacgaccgcguggcucuuuauugcuucugcccccuucgaaguggccgagggagaaaauguccaucugagcguuguguaccuuccugagaaccuguauuccuacggcugguauaaggggaaaacaguggaacccaaucaacucaucgcugccuacgucauugacacccacgugcggacaccuggaccggcuuauucuggccgcgagaccaucagccccuccggggaucugcauuuucagaacguuacacuggaggacaccggauacuauaaucuccaggugacguacagaaacucucagauugaacaagccagccaccaucugcgggucuacgaguccguggcgcagccuagcauccaggccucuuccaccacaguuaccgaaaagggcagcgugguccuuacaugccacaccaauaacacgggcacaucuuuccaguggaucuuuaauaaccaacgccuccaggugaccaaaagaaugaagcuguccugguucaaucacgugcugacaauugaucccauccggcaggaggacgcuggggaguaucagugugaagucagcaacccuguuucuuccaaucgcagcgauccccuuaaacugaccgugaaguccgacgauaacacccucggcauucugaucggcgugcuggucgggucucuccugguggccgcucuuguuugcuuucugcuccugagaaagacaggacgggccagcgaccaauccgauuuccgcgagcagcagccgccugcgagcacgcccggccaugggccuucugacuccagcauuucuuga

SEQ ID NO: 67269 - RNA, 639 nt, Artificial Sequence
  derived and/or modified sequence opt5 from CEACAM3__Homo_sapiens__NP_001264092
auggggcccccuagcgccuccccgcacagagagugcauccccuggcagggccugcuccugaccgcuucucuucugaacuucuggaauccucccacaacggccaagcucaccauugaaagcaugccucuguccguggcggagggaaaagaaguccuucugcucguucauaaccugccccaacaccuguuuggcuacucuugguauaagggggagcggguggacggaaauagccucaucgugggcuacgucauugggacacagcaggcuaccccuggagccgccuauuccggccgcgaaacaaucuacaccaacgcuucucugcuuauucagaaugugacacaaaacgauaucggcuucuauacccugcagguuaucaaaagcgaccucgugaaugaggaggccacggggcaguuucaugucuaccaggaaaacgcuccgggacugcccgugggcgccguugcggggauugugaccggaguccuugugggcguggcccuggucgcugcccucguuuguuuccugcugcucgcuaagacagggagaccuuggucccugccccaacuuugccugcucgaugugccuagccugcacugucccggaccgccuacccagccccaggacucuuccuuucaucuuuga

SEQ ID NO: 67270 - RNA, 735 nt, Artificial Sequence
  derived and/or modified sequence opt5 from CEACAM4__Homo_sapiens__NP_001808
auggggcccccuagcgccgcuccgagaggcggacaccggcccuggcagggccugcucaucaccgccucccugcuuacauucuggcauccucccacgaccgugcaauuuacaauugaggcgcugccuucuagcgcugccgaagggaaggacguccuccugcuugccugcaacaucuccgagaccauucaggcuuacuauuggcacaaaggaaagacagccgaaggcucuccccugaucgcuggguacauuaccgauauccaggccaauaucccuggagcggccuauagcggccgcgagacaguuuacccgaacggcucccuccuguuccagaauauuacccuggaagacgcugggucuuauacgcucagaaccaucaacgccagcuacgauuccgaccaagcuacaggacagcugcaugugcaccagaauaacgugcccggccuuccugucggggccguggcgggaauuguuaccggcgugcuggucgggguggcccucguugcugcccugguguguuuucuucugcucagccggacaggacgcgcuucuauccagagagaucugcgggagcaacccccucccgccuccaccccgggccauggcccuagccaccgcucuacguucuccgcuccccugccuagccccagaacagccacccccauuuaugaggaacuccuguacucugacgcgaauaucuacugccagauugaucacaaagccgacgucguguccuga

SEQ ID NO: 67271 - RNA, 2109 nt, Artificial Sequence
  derived and/or modified sequence opt5 from CEACAM5__Homo_sapiens__NP_001278413
auggagagccccuccgccccuccgcacagauggugcauccccuggcagcggcugcuccugaccgcuucucuucugacauucuggaacccucccacgaccgccaagcucacaauugaaagcaccccuuuuaauguggcggagggcaaagaaguccugcuucugguucauaaccucccccaacaccuguucggguacuccugguauaagggagagcgcguggacggcaauagacagaucauuggguacgugaucggaacacagcaggcuaccccuggcccggccuauucugggcgggaaauuaucuaccccaacgccagccugcucauccaaaauauuauccagaacgauacaggauuuuauacccugcaugucauuaaauccgaccuugugaaugaggaggcuacgggccaguuccgcguuuacccugaacugcccaagccuucuaucagcuccaacaauagcaaacccguggaggauaaggacgccgucgcuuuuaccugugaaccggagacacaggaugccaccuaucucuggugggugaacaaucaaucucugccuguuucccccagacuucagcugagcaacggcaaucggacacucacccuguucaacgugacgcgcaaugacacagcgucuuacaagugcgagacccagaacccugucuccgccagacggagcgauucugugauucugaacgugcucuacgggcccgacgcucccacaaucuccccucugaauaccagcuaucgcuccggagaaaaccuuaaucugucuugucacgccgcuagcaacccgcccgcccaguacuccugguuugucaauggcaccuuccaacagagcacacaggagcucuuuauuccuaacaucacgguuaauaacucuggguccuauaccugccaagcgcauaauagcgauacaggacugaacagaaccacagugaccacgaucacaguguacgccgaacccccuaaacccuucauuaccucuaauaacagcaauccggucgaggacgaagaugcuguggcccuuaccugugagccugagauccagaacacaaccuaucugugguggguuaauaaccagucccuccccgugucuccucggcugcagcugagcaacgacaaucgcacacucacgcugcuuuccgucaccagaaacgaugugggccccuacgaaugcgggauucaaaaugagcugagcguugaccacucugacccugugauccucaacguccuguauggacccgaugacccgacaauuuccccuagcuacaccuacuaucggcccggcgugaaucuuucucuguccugucacgcugccagcaaucccccugcccaguacuccuggcucaucgauggcaauauccagcagcauacacaagaacuguuuauuucuaacaucaccgagaagaauagcgggcuguauacgugccaggcuaacaauuccgcgucuggacacagccgcaccacagucaaaaccauuacaguguccgccgaacucccgaagcccagcaucucuuccaacaauagcaaaccuguugaggacaaggaugcuguggccuucaccugugagcccgaagcccagaacacgacauaccuguggugggucaauggccagucucuuccugugucccccagacugcaacucagcaacgggaaccggacccugacacuguuuaauguuaccagaaacgacgcucgcgccuaugugugcggcauucagaacucugucagcgcgaaccgguccgauccugugacccuugacgugcucuacggacccgauacaccgaucaucagcccucccgacucuuccuaucugagcggggcuaaucugaaccucuccugucauucugccagcaauccuucuccccaguacuccuggagaauuaacggaaucccgcagcaacacacgcagguucuguucauugccaagaucaccccuaauaacaauggcacauacgcuugcuucgucagcaaccuugccaccggccgcaauaacuccauugugaaaucuaucacagugagcgcuuccgggaccagccccggacugucugccggcgcgacggucgggauuaugaucggagugcucguuggcguggcccugaucuga

SEQ ID NO: 67272 - RNA, 1035 nt, Artificial Sequence
  derived and/or modified sequence opt5 from CEACAM6__Homo_sapiens__NP_002474
auggggcccccuagcgccccgcccugcagacugcacgugccuuggaaggagguccuccugaccgcuucccuucugacauucuggaaucccccuacgaccgccaaacucacaaucgaaucuacccccuuuaacguugcggagggcaaggaagugcugcuucuggcucauaaccucccucagaaucggauuggauacagcugguauaaaggcgagcgcguggacgggaacucccugaucgucggauacgugauuggcacacaacaggccaccccggggcccgccuauucuggaagagaaacaaucuacccuaaugcuagccugcucauucagaacguuacccagaaugauacgggcuucuauacccugcaagugaucaaguccgaccuugucaacgaggaggccacaggccaguuucacguguaccccgaacugccuaaacccucuaucagcuccaauaacagcaauccgguugaggauaaggacgcuguggccuucaccugugaaccugagguccagaacacaaccuaucucuggugggugaaugggcagucucugcccguguccccucggcuucaacugagcaacggaaauaugacgcucacacugcugucugucaagcgcaacgaugcgggcuccuacgagugcgaaauucagaaccccgccagcgcuaauagaucugaccccguuacccucaacgugcuguacgggccugaugugccgacaaucucccccagcaaagccaauuaucggccuggagagaaccuuaaucuguccugucaugcugccucuaaucccccugcgcaguacagcugguuuauuaacggcaccuuccagcaauccacccaggaacucuuuauccccaacauuacagucaauaacagcgggucuuauaugugccaggcccacaauuccgcuacgggacugaaccgcaccacagugaccaugaucacaguuagcggcucugccccggugcuuagcgcugucgccaccgugggcauuacgaucgggguucuggccagaguggcucucaucuga

SEQ ID NO: 67273 - RNA, 798 nt, Artificial Sequence
  derived and/or modified sequence opt5 from CEACAM7__Homo_sapiens__NP_001278414
augggcagccccuccgccugcccuuacagaguguguaucccguggcaggggcugcuccugaccgcuucucuucugacauucuggaaccuccccaauagcgcccaaacgaacauugacgucguuccuuuuaauguggcggagggaaaggaagugcugcuugucgugcacaacgagucccagaaucuguauggcuacaacugguauaaaggggaacggguucaugcuaauuaccgcaucauuggauaugugaagaacaucucucaggagaaugcccccggcccugcccacaacgggagagaaaccauuuaccccaauggaacacuccugauccagaacgucacccauaaugaugcuggcaucuauacacugcacgugauuaaagagaaccucguuaaugaggaagugacccggcaauucuacgucuuuagcgagccuccgaagcccuccaucacaucuaacaacuucaauccuguggaaaacaaagacauugugguccugaccugccagcccgagacgcagaauaccacauaccuuugguggguuaacaaucagagccugcucguguccccucgccugcuucugagcaccgauaacagaacacucgugcugcugucugccaccaagaaugacaucggccccuaugagugugaaauucaaaacccggucggggcuucccggagcgauccugugacgcucaauguucgcuacgagucugugcaggccuccagccccgaccugucugcgggaacagccgucuccaucaugauuggcgugcuugcugggauggcccugaucuga

SEQ ID NO: 67274 - RNA, 1050 nt, Artificial Sequence
  derived and/or modified sequence opt5 from CEACAM8__Homo_sapiens__NP_001807
augggccccaucagcgccccuuccugcagauggcggauuccguggcaggggcugcuccugaccgcuucucuuuucacauuuuggaaucccccuacgaccgcccaacugacaaucgaggcggugcccagcaacgcugccgaaggaaaggagguccuccugcuuguucacaaccugccucaggacccccgcggcuacaauugguauaaaggggaaaccguggaugccaacagacggauuaucggauacgugauuuccaaucagcagaucacaccuggcccggcuuauucuaaccgcgagaccaucuaccccaaugccagccuccugaugagaaacgucacacggaaugacaccggguccuauacgcugcaagugauuaagcucaaccugaugucugaagagguuaccggacaguucagcgugcauccugagacacccaaaccuuccaucagcucuaauaacuccaaucccgucgaagauaaggacgcuguggccuuuaccugugagccggaaacacagaacaccacguaccuuugguggguuaauggccagagccugccugugucuccccgccuccaacuguccaacggcaacagaacacuuacccugcucagcgucacacggaaugauguggggccuuaugagugcgagauucagaaccccgcgucugccaauuucuccgaccccgugacccugaacguccuguacggaccugaugcuccgaccaucagccccuccgacacauacuaucacgccggcguuaaucucaaccugucuugucaugcugccagcaauccucccucccaguacagcuggucugugaacgggacguuucagcaauauacccagaaacuuuucauuccuaauaucacaaccaagaacuccggaagcuacgcgugccacacaaccaauucugccacgggccgcaacagaacaaccgugcggaugauuaccgucagcgaugcucuggugcagggguccucucccggacucagcgcccgcgcuacaguuuccaucaugaucggcgugcuggccagagucgcccuuauuuga

SEQ ID NO: 67275 - RNA, 1182 nt, Artificial Sequence
  derived and/or modified sequence opt5 from CEBPA__Homo_sapiens__NP_001274353
augagaggccgggggcgcgccggaagccccggcgggagacggcgcagaccugcucaggccggaggccggcgcggguccccgugcagagagaacucuaauagccccauggaauccgcggacuucuacgaggcugaaccucggcccccuaugucuagccaucugcaaucucccccucacgccccguccagcgccgcuuuuggauucccccgcggcgccggcccugcucagcccccugcgcccccggccgccccugagccccucgggggaaucugugaacacgagaccuccauugauaucagcgcuuauauugacccugccgcuuuuaacgaugaguuccuggccgaccuuuuucagcauucuagacagcaagaaaaggcgaaagccgcugugggccccacagggggaggcgggggaggcgauuucgacuaccccggcgccccugcugggccgggaggcgccgucaugcccgggggagcccacggcccucccccuggguauggaugcgcugcggccggcuaccuggauggccggcucgagccccuguaugaacgcguuggggcuccggcccuuagaccucuggugaucaagcaggagccccgggaggaagacgaggccaaacagcucgcucuggccggacuguuuccuuaccagcccccucccccgccuccucccucccauccccacccgcaucccccucccgcgcaccucgcugccccucaucugcaauuccagauugcccacuguggccagacgaccaugcaccuucagcccgggcacccuacacccccgccuacccccgugccuagcccccauccggcuccugcccugggagcugccggccuccccgggccuggcucugcgcugaagggacuuggcgccgcucaccccgaucugcgcgccuccgggggaagcggcgcugggaaagccaagaagucugucgacaaaaauuccaacgaauauagagugcggagagagcgcaauaacaucgcgguuagaaagagccgggauaaagccaagcaacgcaauguggaaacacagcagaaaguccucgagcugaccuccgacaacgaucggcugagaaagcgcguggagcaacucucucgggaacuggacacacuuagaggaaucuuucgccagcugcccgagagcucccucguuaaggcuaugggcaauugcgccuga

SEQ ID NO: 67276 - RNA, 1038 nt, Artificial Sequence
  derived and/or modified sequence opt5 from CEBPB__Homo_sapiens__NP_005185
augcagagacugguggccugggaccccgcuugccucccucugccgcccccucccccugccuucaagagcauggaggucgcgaacuuuuacuaugaagcugauugucuugccgccgcuuacggcgggaaagccgcucccgccgcgccuccggccgcucggcccggaccuagacccccugccggcgagcugggguccaucggagaccacgaacgcgcuauugauuucucucccuaucucgagccgcugggcgccccucaagcgcccgccccugcuaccgccacagacacguuugaagcugccccucccgcccccgcuccggcgcccgccagcuccgggcagcaucacgauuuccuuucugaccuguuuagcgaugacuacggaggcaagaauugcaaaaagccugcugaguauggcuacguuucccucgggcggcugggagccgccaaaggcgcucugcaucccggguguuucgccccucuccaucccccgccucccccucccccucccccggcggagcugaaggcugaaccuggauuugagcccgccgauugcaagcgcaaagaagaggccggcgcucccgggggaggcgccggcauggcugccggguucccuuaugcgcuuagagccuaccugggauaccaggcugugccgucuggcagcuccgggagccucucuaccuccagcagcuccucucccccuggaacacccucuccugccgacgcuaaggcgcccccuaccgccuguuaugccggcgcugcccccgcuccgucccaggugaaaagcaaggccaaaaagacagucgauaagcacuccgacgaguacaaaauccggcgcgaaagaaacaauauugccgugcggaagucucgcgauaaagcuaagaugagaaaccuggagacccaacacaaaguucuugaacugacagcggagaaugaacggcuccagaagaaaguggagcagcugagccgcgagcuguccacccucagaaaccuguuuaagcagcuuccugaaccccugcucgccagcucugggcacugcuga

SEQ ID NO: 67277 - RNA, 810 nt, Artificial Sequence
  derived and/or modified sequence opt5 from CEBPD__Homo_sapiens__NP_005186
augagcgccgcucuguucucccucgacggccccgccagaggggcgccuuggccggcugagcccgccccuuuuuacgaacccggacgggccggcaagccugggcgcggagcugagcccggcgcccugggggaaccuggagcugccgcgccggccauguaugaugacgagucugcuaucgauuucagcgccuacauugacuccauggcugccgugcccacccuugaacugugccacgaugagcucuuugcggaccuguucaacucuaaucauaaagccggcggcgcugggccucuugagcugcuccccggaggcccugccagaccccuggggccgggaccugcugcuccccggcugcucaagcgcgaaccugauuggggcgacggggaugcccccggaagccugcuucccgcccaggucgcggccugugcucaaacaguugugucccuggccgccgcuggccagccuacgccgcccaccucuccugagcccccuagaagcagcccccggcagacaccggccccuggccccgcgcgcgaaaaguccgcugggaagagaggaccugaccggggcucucccgaguaucgccagagacgggagcgcaacaauaucgccgugagaaaaucccgggauaaggccaagcgcagaaaccaagaaaugcagcagaaacucgucgagcugagcgcugaaaaugagaaacuucaccagcggguggaacaacugaccagagaccucgccgggcugcgccaguuuuucaaacagcugccuucucccccguuucucccugcugccggaacagcggauugccgguga

SEQ ID NO: 67278 - RNA, 846 nt, Artificial Sequence
  derived and/or modified sequence opt5 from CEBPE__Homo_sapiens__NP_001796
augagccacggcaccuacuaugagugcgaacccagagggggacagcaaccucuggaguucuccggcgggcgggccggaccgggcgaacucggggacaugugugagcaugaggcuucuaucgaucugagcgccuacauugaguccggagaggaacagcuucugucugaccucuuugcggugaagcccgcuccugaggcccgcggccugaaaggccccgggacacccgccuucccccacuaucuuccuccggaucccagaccuuuugcuuacccuccucauacguucggacccgaccggaaggcccugggcccggggaucuauagcuccccuggaucuuacgauccccgcgcugucgccguuaaagaagaaccuagaggccccgaggggagccgggcggccucccgcggaagcuauaacccccuccaguaccagguggcucacugcggccaaaccgccaugcaucugccuccgacacuggcugcccccggccagccucucagagugcugaaggcgccccuugccaccgcugccccucccuguucuccgcugcucaaagcuccuucccccgccgggccucugcacaagggaaagaaagccgucaauaaggacagccuugaauaccggcugcgcagagagcggaacaauauugcugugcgcaaaucuagagauaaggcgaaacggcgcauccucgaaacacagcagaagguucuggaguauauggccgaaaacgagagacugcgguccagaguggagcaacucacccaggaacuggacacacuucgcaaucuguuucggcagauucccgaggcugccaaccucaucaagggcgucgggggaugcagcuga

SEQ ID NO: 67279 - RNA, 453 nt, Artificial Sequence
  derived and/or modified sequence opt5 from CEBPG__Homo_sapiens__NP_001239225
augagcaagaucucccagcaaaacucuacccccggcgugaaugggauuagcgucauccacacacaggcccaugcuuccggacugcagcagguuccucaacucgugccggccggccccgggggaggcgggaaagcgguggcuccuucuaagcagagcaaaaaguccucucccauggacagaaacagcgaugaguaccggcagcgcagagaacggaauaacauggccgucaaaaagucccgccuuaagagcaaacagaaggcccaagacacgcugcagagagugaaucagcugaaagaggaaaacgagcggcucgaagcuaagauuaaacugcuuaccaaggagcugucuguucucaaggaucuguuccuggagcacgcccauaaucucgcugacaacgugcaguccaucagcacagaaaauaccacagccgauggagacaacgcgggccaauga

SEQ ID NO: 67280 - RNA, 3165 nt, Artificial Sequence
  derived and/or modified sequence opt5 from CEBPZ__Homo_sapiens__NP_005751
auggccgcugugaaggagccccuggaguuccacgccaaaagaccuuggcggccggaggaagcggucgaggaccccgaugaagaggacgaggauaacaccagcgaagcugagaauggcuuuucccucgaagagguucugcgccuugggggaacaaagcaggacuaccugaugcucgccacgcuggaugagaacgaagaggugaucgacggcgggaaaaagggagccauugaugaccuucaacagggcgaacuggaggcuuucauccagaaucucaaccuggccaaauauaccaaggcuucucugguggaagaggaugagccugccgaaaaggagaauagcuccaaaaaggaagucaaaauucccaagaucaacaauaaaaacacagcggagucucagagaaccagcgugaauaagguuaagaacaaaaaucggccugaaccccauuccgacgagaacgggucuacaaccccuaaggugaaaaaggauaaacaaaauauuuuugaguucuuugaacgccagacacuccugcuuagaccgggaggcaagugguacgaccuggaguauagcaacgaauacucccucaaaccccagccucaggaugucgugagcaaguauaagacccuggcccaaaaacuuuaccagcacgagaucaaucuguucaagucuaaaacgaacucccagaagggcgcuagcucuaccuggaugaaagccaucguuuccagcgggacacucggagaccggauggcugccaugauucugcugauccaggacgaugcggugcauacccuccaauuugucgaaacacuggugaaccuugugaagaagaaaggcucuaagcagcagugccugauggcccucgacaccuucaaagagcugcuuauuacggaucugcuccccgacaaucgcaagcugagaaucuuuucccaacggccuuucgauaaacuggagcagcucagcuccgggaacaaggacucucgcgauagacggcugauucuuugguauuuugaacaccagcugaagcaucucgucgcugaguucguucaggugcuggaaacacuuagccacgacacccuggugacaaccaaaacccgcgcccucacagucgcucacgagcugcuguguaauaagcccgaggaagagaaagcccuccuggugcaaguugugaacaaacuuggagauccgcagaauagaaucgccacgaaggcuucccaucugcucgaaacccugcugugcaagcacccuaacaugaagggcgucgugagcggggagguugaacggcuucucuuucgcucuaauauuuccagcaaagcgcaguacuacgccaucuguuuccugaaccagauggcucugucucaugaggagagcgaacucgccaauaagcugaucacaguguauuucugcuuuuucagaaccugugucaaaaagaaagacguggaguccaagaugcuuucugcccugcucacaggagucaaccgggcuuaccccuauagccaaaccggcgaugacaaagugagagaacagauugacacgcuguuuaagguucugcacaucgugaauuucaacacauccguccaggcccuuaugcuccuguuucaggugaugaauagccaacagaccauuucugaucgcuacuauaccgcgcuguaccggaagaugcucgacccuggccugaugacaugcuccaaacaggcuauguuccuuaaccugguuuauaagagccucaaagccgauaucgugcugagacgcgucaaggccuuugugaaacggcugcuucaggugaccugucaacagaugccucccuucauuugcggggcucucuaccugguuucugagauccugaaggccaagcccggacucagaucccagcuggacgaucacccggaaagcgacgaugaggagaauuuuaucgacgcuaacgaugacgaagauauggagaaauucacagacgccgauaaggaaacggagauugucaaaaagcuggaaaccgaggagacagugcccgaaaccgacguggagaccaaaaagccugaagucgcguccugggugcauuuugacaaccugaagggcgggaaacaacucaauaaguacgaucccuucucucgcaacccucuguuuuguggagccgagaauacaagccugugggagcuuaaaaagcucuccguucacuuccaucccucuguggcucuguucgccaaaacgauccugcagggcaacuauauucaguacagcggggacccgcuccaggauuuuacccugaugcgguuccuugacagauuugucuaucgcaauccuaagccccacaagggaaaagaaaacacagauuccgugguuaugcaaccuaagcggaaacauuucaucaaggacauuagacaccuucccgugaauagcaaagaguuucucgcuaaggaagagucucagaucccugucgaugaaguguucuuucaccgcuacuauaaaaagguugccgugaaggagaaacagaagcgggacgcggaugaggaauccaucgaggacgucgaugacgaagaguucgaagaacugauugauaccuuugaggacgacaacugcuucagcucuggcaaagaugacauggauuuugccggcaaugugaagaaaagaacaaagggggcuaaggacaacacccuggaugaagacuccgagggaagcgaugacgaacuuggcaaucuggaugacgaugaggugucucucgggagcauggacgacgaagaguucgccgaggucgaugaagacggaggcacguuuauggauguucuggacgaugaguccgaaagcgugcccgagcucgaggugcauucuaaagucuccacaaagaaaagcaagcggaaagggaccgacgauuucgacuucgcuggcuccuuucagggaccgcgcaagaagaaaagaaaccugaaugauucuagccuuuucguguccgccgaagaguuuggccaucugcucgacgaaaacauggggucuaaguucgauaauaucggaaugaacgccauggcuaacaaagacaaugcgagccugaagcaacugcggugggaggccgaaagagaugacuggcuucacaaccgcgacgcuaaauccauuaucaagaagaaaaagcacuuuaaaaagaaacggauuaagacaacccagaagaccaaaaagcagagaaaauga

SEQ ID NO: 67281 - RNA, 813 nt, Artificial Sequence
  derived and/or modified sequence opt5 from CECR1__Homo_sapiens__NP_803124
auggacagccuggaguggaacugggcccucguguacgaacuguccggcgagcaccaugaugaagaguggucugucaagaccuaucaggaaguugcucaaaaauucguggagacacaccccgaguuuaucgggauuaagaucauuuacagcgaccauagauccaaagauguggccgucaucgcggaaucuauucggauggcuaugggacuucgcaucaaguucccuacggugguugccggcuuugaccugguggggcacgaggauaccggacauagccuccacgacuauaaagaagcccugaugaucccggcuaaggauggcgucaaacuucccuacuucuuucacgccggggagacagacuggcagggaaccuccauugauagaaauauccuggacgcucucaugcugaacacaacccggauuggccauggcuucgcccugucuaagcacccugcggugcgcacauauagcuggaagaaagauauccccauugagguuugcccuaucuccaaucaggugcucaagcuggucagcgaccuuagaaaccaucccguggccacccugauggcuacggggcacccuauggugauuucuuccgaugacccggccauguuuggagcuaaaggccucagcuacgacuucuaugaagucuuuauggggaucggaggcaugaaggccgaucugcggacccuuaagcagcuggcgaugaacucuaucaaauacuccacacuccuggagagcgaaaagaauaccuucauggagauuuggaaaaagcgcugggacaaauuuaucgccgauguugcuacaaaguga

SEQ ID NO: 67282 - RNA, 4395 nt, Artificial Sequence
  derived and/or modified sequence opt5 from CECR2__Homo_sapiens__NP_001276976
augugccccgaggaaggcggggccgcuggacugggcgagcucagaagcuggugggaagugccugccaucgcgcacuucuguucccuguuucggaccgcuuuccgccuuccggacuuugagauugaggaacuggaggccgcccuccauagagaugacgucgaguucaucucugaucugauugcuugccuucugcagggguguuaccaacggcgcgacaucacaccccagacguuucacagcuaucucgaagauauuaucaacuacagaugggaacuggaggagggaaagccuaauccccugcgggaagccuccuuccaggaccucccucugcgcaccagaguugagauccuucaucggcugugcgauuaucgccucgacgcugaugacguguuugaucugcuuaaaggccuggacgccgauucucucagaguggaaccccugggggaggacaacagcggagcgcuguacugguauuucuacggcacacggauguauaaggaagacccuguccagggcaaauccaauggggagcucucucugagccgcgaguccgaaggacaaaagaacgugagcucuauuccgggcaaaaccgggaagagacggggaagacccccuaagcgcaagaaacuucaggaggaaauccugcucuccgagaaacaggaagagaauagccuggccucugagccccagacacggcacggcucccaagggccuggacagggcaccugguggcuucugugucagacagaagaggaauggagacagguuaccgagagcuuucgcgaacggacgucucucagagagcgccaacuguacaagcugcucuccgaggauuuccugcccgaaauuugcaacaugaucgcucagaaaggcaagcggccgcagagaaccaaggccgagcuucauccucgcuggaugagcgaccaccuguccauuaaacccgugaagcaagaagagacaccuguccucacccggaucgagaaacagaagagaaaagaagaggaagaggaacgccagauucugcuugcugugcagaagaaagagcaagagcagaugcugaaggaggaacggaagagagaacucgaggaaaaaguuaaggccguggaggaucgcgcgaaacggagaaagcugcgggaggaacgcgccuggcugcucgcucaggggaaagagcugccucccgaacuuucucaccuggaccccaauagcccgaugagagaggaaaagaagacaaaagaucucuuugagcuggacgaugacuucaccgccauguacaagguccuggauguggugaaagcucauaaggacuccuggcccuuucuugagccugucgaugaaagcuaugcccccaacuacuaucagaucaucaaagccccuauggacauuucuuccauggagaagaagcucaauggaggccuguacuguacgaaagaagaguucguuaacgacaugaagacaauguuccggaauugcagaaaauauaacggggagagcucugaauacaccaagaugagcgauaaucuggagcgcuguuuucaccgggcuaugaugaaacauuuccccggagaagacggcgauacagacgaggaauuuuggaucagagaggaugagaagcgcgaaaagagacggucccgcgcggggagaucuggaggcagccacguguggacccggucccgcgacccggagggcagcucuagaaaacaacagccuauggaaaacgggggaaagucccugcccccuacccggcgcgcccccagcucuggcgaugaccaguccagcuccucuacacagccucccagagagguggggacgagcaauggacggggcuucucccacccgcuccauugcgggggcaccccuucucaagcucccuuucuuaaccagaugcgccccgccgucccuggaacauucggcccgcugagagggagcgaucccgccacccucuauggauccagcggcgugccugaaccccacccuggggagcccguucagcagcggcaaccuuuuacaaugcagcccccggugggaauuaacucucugagaggcccucgccuggggacccccgaggaaaaacagauguguggcggacuuacgcaucucuccaauaugggcccucaccccgggagccugcaacugggacagaucucuggcccgucccaggacgggagcauguacgcuccugcccaguuccaacccggauuuauuccuccccggcauggcggggcgcccgcuagaccuccggauuuccccgagucuagcgaaaucccucccucccacauguaccgcagcuauaaguaccucaaccggguccacucugccguguggaauggcaaccauggagccacaaaucagggcccucuggggcccgacgagaaaccucaccuuggaccgggccccucccaucagccuagaacccuggggcacguuauggauagccgcgugaugcggcccccugugcccccgaaccaguggaccgaacaauccggauuucucccucacggcguccccucuagcggguauaugagacccccuugcaaguccgcuggccaucgccugcagcccccuccgguccccgccccuucuagccuguucggagcucccgcccaggcgcuucggggcgugcaagggggagacuccaugauggacucuccugagaugaucgccaugcagcagcucagcuccagaguuugucccccgggcgugccuuaccacccccaucagccugcucacccccggcugccugggcccuuuccgcaagucgcccauccuaugagcgugacaguuucugcucccaaacccgcccugggaaauccuggccgcgcgccggagaacuccgaagcccaggagcccgaaaaugaucaggcugagccucuccccggccuggaggaaaagccucccggggugggaaccagcgagggcgucuaucuuacacagcugccucacccgacgcccccucuccaaaccgacugcacaagacagucuagcccccaggaacgggagaccguggggccugaacugaaguccucuuccagcgaguccgccgauaacugcaaagcuaugaagggcaaaaaucccuggccgagcgacucuagcuacccuggacccgccgcccaggggugugugcgcgaucuguccacaguugcugacagaggagcgcuuucugagaacggcgucauuggcgaagccagccccugcggguccgagggaaagggccucgggucuagcggauccgaaaaacugcuguguccucggggcagaacccuccaagagacgaugcccugcaccgggcagaaugcugccacaccuccgucuaccgaucccggacugacaggcggcaccgugagccaguucccuccccuuuauaugccugggcuggaauaccccaacuccgccgcucacuaccauaucagcccgggacuccagggcguggggccugucaugggaggcaagucucccgccucccacccucaacauuuucccccucgcggguuccagagcaaucacccccauucuggaggcuucccgcgguauagaccuccccagggcaugcgcuacuccuaucaucccccuccgcagcccagcuaccaccacuaucaacggacgccuuacuaugcguguccccaguccuuuucugacuggcagagaccucugcacccccaagggagcccuuccggacccccggcuagccagccucccccuccccgcucucuguucuccgauaagaacgccauggccagccuucagggcugcgagacacugaacgcugcccucaccucuccgacacggauggacgcgguggcugccaaaguuccuaaugaugggcagaaccccggacccgaggaagagaagcuggacgaaagcauggagagaccugaaucccccaaagaguuucucgaucuggacaaucauaacgccgcuaccaagcgccaaucuagccuuuccgccucugaguaccuguacggcaccccuccgccccucagcuccgggaugggauucggcagcucugcuuuuccuccccacuccgugaugcugcagacaggcccucccuauacgccucagagaccggccagccacuuccagccccgggcguacuccucuccugucgccgcucugcccccucaucaccccggggccacccaaccgaauggacuuagccaggaaggcccuauuuaucgcugucaggaggaagggcugggacauuuucaggcugugaugauggagcaaaucggcacaagauccgggauucggggacccuuccaggagauguaccgccccucuggcaugcagaugcacccuguucaaagccaggccuccuuucccaaaaccccuacagccgcuaccagccaggaagaggugccgccccauaagccucccacgcucccucuggaccagucuuga

SEQ ID NO: 67283 - RNA, 777 nt, Artificial Sequence
  derived and/or modified sequence opt5 from CELA1__Homo_sapiens__NP_001962
augcuggugcucuacggccacagcacccaggaccugcccgagacaaacgccagagucguugggggaacggaagcuggccggaauagcuggccuucucaaaucagccuucaguaucgcuccgggggaucuagauaccauaccugcggcgggacacugauucggcagaacugggugaugaccgccgcgcacuguguggauuaucagaagacauuccgcgucguggcuggagaccauaaucucagccaaaacgauggcaccgagcaguacguuuccgugcagaaaaucgucgugcacccguauuggaacucugacaauguugccgccggcuacgauauugcucugcuuagacuggcccagagcgugacacucaauuccuauguccaacugggggugcugccccaggaaggagcuauccucgccaacaauagcccuugcuacauuaccggcugggggaagacgaaaaccaacggacagcuggcgcagacacuucaacaggccuaccugcccucuguggacuaugcuaucuguuccuccucuuccuacuggggcagcaccgucaagaauacaaugguuugcgccgggggagauggcgugcggucuggcugucagggggacuccggaggcccucuccauugccuggugaacgggaaauauagcguccacggagugaccuccuuuguuucuagccgcggcuguaauguguccagaaagcccacggucuucacacaagugagcgcuuacaucucuuggauuaacaauguuaucgccuccaacuga

SEQ ID NO: 67284 - RNA, 882 nt, Artificial Sequence
  derived and/or modified sequence opt5 from CELA3B__Homo_sapiens__XP_011539434
augaugcugagacuccugagcucccuucugcucguggccgucgcuucuggcuacgggcccccuagcucccggccgucuagccgcguugugaacggagaggacgccgugcccuauuccuggccuuggcaggucucucugcaauacgaaaagagcggcuccuucuaucacacaugcgggggaagccuuaucgcgcccgauugggugguuacagcuggccauuguauuucuuccagcagaacguaccaggugguccugggggaguaugaccgggccgugaaagaaggaccugagcagguuauccccauuaauucuggcgaucucuuugugcacccucuguggaaccgcuccugcgucgccuguggcaaugacaucgcucugauuaagcucagcagaucugcccagcugggggaugcugugcaacuugccucccugccgcccgcgggagacauccucccuaacgaaacccccugcuacaucacaggcugggggcggcuguauaccaauggaccucuucccgauaaacugcaggaggcccuccugccgguggucgacuacgagcauuguagccgcuggaacugguggggcuccucuguuaagaaaacaauggugugcgcugggggagauauuagaagcggcuguaauggcgacuccgggggaccucugaacugccccaccgaagauggcggguggcaagugcacggagucaccagcuucgugucugccuuuggcuguaauacccggcgcaagccuacgguuuucaccagaguguccgcuuuuaucgacuggauugaggaagggcucugccggauggagacaacccuggccugucuucccggaagccagaagcugcagggcaacaaagcgcccgagucucgcacauga

SEQ ID NO: 67285 - RNA, 1539 nt, Artificial Sequence
  derived and/or modified sequence opt5 from CELF1__Homo_sapiens__NP_001166110
auggccgcuuucaagcuggacuuucuccccgagaugaugguggaucacugcagccugaacuccucuccugucagcaaaaagaugaauggcacccuugaccauccggaucagcccgaccuggaugccaucaaaauguucguugggcaagugccuagaacaugguccgaaaaggaccuccgggagcuguuugaacaguacggagcgguguaugagauuaacguccuucgcgauagaucucagaaucccccucagagcaaaggcuguugcuucgugacguuuuacacccggaaggcugcccuggaagcccaaaacgcucuccacaauaugaagguucugcccgggaugcaucacccuauccagaugaaaccggccgacuccgagaagaacaauguggaggaucgcaaacuguucauuggaaugaucucuaagaaauguacagaaaacgacauuagagucauguuuagcuccuucggccagaucgaggaaugccggauccuccgcgggcccgauggacugagcagaggcugugcuuuugugaccuucacaacccgggccauggcgcagacagccauuaaggcuaugcaucaagcccagaccauggagggcuguucuuccccuaugguugugaaguuugcugacacgcagaaagauaaggagcagaaacgcauggcccaacagcuucagcaacagaugcagcagaucagcgcggccucugucugggggaaucuggcuggacucaacacccugggcccccaauaucuugcccuguaccuccagcugcugcagcagacagcuuccagcgggaaucucaacacccugucuucccuucacccuaugggaggccugaaugccaugcaacuccagaaccuggccgcucuugcggccgcugccagcgccgcucagaauacacccuccgggaccaacgcccugacgacaucuagcuccccgcucagcgugcugaccucuuccggaagcucuccuagcuccucuagcuccaacagcgugaaucccauugcgucucugggcgcucuccagacacuggccggcgccaccgcugggcuuaacgucggaucccuggccggcauggcugcccucaaugggggacugggcagcucugggcuuuccaacggaaccggcagcacaauggaagcgcugacgcaagccuauuccggcauccagcaguacgcugccgcugcccucccuacccuguauaaucagaaccugcucacacaacagucuauuggggcggccggaagccagaaggagggccccgaaggggcuaaucuguucaucuaccaccuuccccaagaguuuggagaccaggaccugcuccagauguucaugccuuucggcaacguuguguccgccaaaguguuuauugauaagcagaccaaucugucuaaaugcuucggguuugucagcuacgacaacccgguguccgcucaagccgccauccagagcaugaauggcuuccagaucggaaugaagagacugaagguucagcuuaaacggucuaagaacgauuccaaacccuauuga

SEQ ID NO: 67286 - RNA, 1473 nt, Artificial Sequence
  derived and/or modified sequence opt5 from CELF2__Homo_sapiens__NP_001020247
augaacggcgcccuggaccacagcgaucagcccgacccugaugcuaucaagauguucguggggcaaauuccgagauccuggucugagaaagaacucaaggagcuguuugaacccuacggagccgucuaucagaucaauguucuucgggaccgcagccagaacccuccccaguccaaaggcugcuguuucgugaccuuuuacacaagaaaggcggcucuggaggcccaaaaugcccuccauaacauuaaaacgcugccugggaugcaccaucccauccagaugaagccugcugauucugaaaagagcaaugccguggaggaccggaaacuuuucauuggaauggucuccaagaaaugcaacgagaaugauauccgcgugauguuuucuccguucggccagaucgaagagugucggauucugagagggcccgacggacucagccgcggcugcgcuuuuguuaccuucuccacaagagccauggcgcagaacgccaucaaggcuaugcaccaaagccagaccauggaaggcuguucuuccccuauuguggucaaauuugccgauacacagaaggacaaggagcagcggcgccugcaacagcagcuggcucaacagaugcagcagcucaauaccgccacaugggggaaccugaccggacuuggcgggcugacgccccaauaucucgcgcugcuucagcaggccaccucuagcuccaaucugggagcuuucagcggcauccagcaaauggccgggaugaacgcucuccagcugcagaaucuggccacacucgccgcugcggccgcugccgcccagaccucugcuacauccaccaacgccaauccucugagcacgacauccucugcgcuuggagcucugaccagccccguggccgccuccacaccgaacagcaccgcuggcgccgcuaugaacucucucaccucccugggcacacuucaagggcuggccggagcgacgguuggccucaauaacauuaaugcccuggcuguggcccagaugcugagcgggauggcugcccucaacggaggccugggggcgaccggacuuacaaauggcaccgccggcacaauggaugcucugacccaggccuacucugggauccagcaauaugcugccgccgcucucccuacgcuguacagccagucccuucugcagcaacagucugcggccggaagccagaaagagggccccgaaggggcuaaccucuuuauuuaucaucugccucaggaguucggagaccaagauauccugcagauguuuaugcccuucggcaaugucaucuccgccaagguguucauugacaaacagacaaaccucagcaagugcuuuggguucgugucuuacgacaaucccgucuccgcccaggcugccauccaagcgaugaacggcuuucagauuggaaugaaaagacugaagguucagcuuaaacggagcaagaaugauucuaagccuuacuga

SEQ ID NO: 67287 - RNA, 1458 nt, Artificial Sequence
  derived and/or modified sequence opt5 from CELF4__Homo_sapiens__NP_001020258
auguacaucaagauggccacccuggcuaacggccaggccgacaaugcgagccucuccacaaacgggcugggaucuagccccggcuccgcugggcacaugaauggacuuucucauagcccuggcaacccguccacgauucccaugaaagaucacgacgccaucaagcuguucauugggcaaaucccuagaaaucucgaugagaaagaccugaagccccuuuuugaagaguucggaaaaauuuaugaacugaccgugcucaaggaucgguuuacaggcaugcauaagggcugcgccuuccugaccuacugugagcgcgaaucugcucugaaagcccagagcgcucuccacgagcagaagacacugccugggaugaacagacccauccaggucaaaccugccgacuccgagagccggggaggaucuuccugccuucgccaaccgcccagccaggauagaaagcuguuuguugggaugcucaauaaacagcagucugaagacgaugugcggcgccuguucgaggcguuuggaaacaucgaagaguguaccauucuuagaggcccugacggaaauuccaaggggugcgccuucgugaaguauagcucucaugcugaggcccaagcugccaucaacgcgcugcacggcucccagacaaugcccggcgccagcuccucucucgucgugaaauuugcugauaccgacaaggaacggacgaugcgcagaaugcagcagauggccgggcaaaugggaauguucaauccuauggcuauucccuuuggcgccuacggggccuaugcucaggcgaugcagcaacaggccgcucugauggccagcguugcccagggaggcuaccugaacccgauggcugccuucgcggcugcccagaugcaacagauggccgcucucaauaugaacgggcuggccgcugccccuaugacccccacauccggaggcagcaccccucccggcaucacagcgcccgccgugccuucuauuccgucccccaucggggucaauggauuuaccggccuuccuccccaggcuaacgggcagccugccgcugaggccguguucgcgaacggcauucaccccuauccggcccaaagcccuacggcugccgauccccugcagcaggcuuacgccggcguucagcaauacgccgggccugcugcguaucccgccgcuuacggccagaucucucaggccuucccucagcccccgccuaugaucccccaacagcagcgggaaggacccgagggcuguaaucucuuuauuuaucaucugccucaagaguucggggacgccgaacuuaugcagauguuucugccguucggauuugugagcuucgacaaccccgcuuccgcccagacagcgauccaggcuaugaauggcuuucaaauugggaugaaacgccucaagguccagcugaaaagaccuaaggaugccaaccggcccuacuga

SEQ ID NO: 67288 - RNA, 1230 nt, Artificial Sequence
  derived and/or modified sequence opt5 from CELF5__Homo_sapiens__NP_001166144
auggccagacugaccgagagcgaagcucggcgccagcaacagcagcuccugcagcccagaccuuccccggugggcucuagcgggcccgagccucccggaggccaaccugacgggaugaaggaucuugacgccaucaaacuguucgucggacagauuccccggcaccucgaugaaaaggaccugaaaccucuuuuugagcaguucggccgcaucuacgaacugacaguucucaaggauccguauacggggaugcauaaaggaugcgcguuucugaccuacugugcuagagacuccgccauuaaggcccagacagcucugcacgagcaaaagacccuccccggcauggcccggccuauccaggugaaacccgcugauucugagagccgcggcgggagagaccggaagcuguucgugggaaugcuuaacaaacagcaguccgaagaggauguccugcgccucuuucaaccuuucggcgugauugacgaaugcacaguucugagagggcccgauggaucuagcaagggcugugccuuugugaaauucuccagccauaccgaggcgcaggccgcuauccacgcccuucaugggucucagacaaugccgggagcuuccagcucucuggucgugaaguuugccgacaccgauaaggagcggacgcuccgcagaaugcaacagaugguuggccagcugggcauccugaccccuucccucacacugcccuucagcccuuauucugcguacgcccaggcucuuaugcaacagcagaccacagugcuguccaccagcggguccuaucucucucccggagucgccuuuagccccugccacauucagcaaaucggcgcugugucccugaaugggcuuccugccacgccgauugcccccgcuagcggaguggucccuuuccccggcgggcacccugcgcuggaaacaguuuacgccaacggacucgugcccuauccggcucagucuccuaccguggccgagacacugcaucccgccuuuuccggcguccagcaguacaccgcuauguacccuaccgccgcgaucacacccauugcucacagcgugccucaacccccgccucugcuccagcagcagcaacgggaaggcguuuggcgccauggggccgacgccgacgugcccacgcugagacaguaucacuuccuucagggagucuacggcucuagcuaucaacccgaacagguguuccggcugagagagcucuga

SEQ ID NO: 67289 - RNA, 1365 nt, Artificial Sequence
  derived and/or modified sequence opt5 from CELF6__Homo_sapiens__NP_001166155
auggccgcugcccccggcgggagcgcgcagccugcuggaccgggccccagacugggguucuccaccgccgacucuggagugggcaugagcgggcucaacccuggacccgccgucccuaugaaggaucacgacgcuaucaaacuguuuguuggccaaauuccccggggccuugaugagcaggaccugaagccucucuucgaagaguuugggcgcaucuacgaacugacagugcuuaaagauagacugacgggacuccacaagggcugcgccuuccugaccuauugugcucgggacuccgcccugaaagcgcagucugcccuccacgagcagaagacacugccggggaugaaucgccccauucaagugaagccugcugccagcgaaggaagaggcgaggaucggaaacuuuuugucgggaugcugggaaagcagcagggcgaggaagacgugcgcagacucuuccagcccuuuggccauaucgaggaaugcaccguucugcgguccccugaugggacaucuaaaggaugugcuuucgugaaguuuggcagccaaggggaggcccaggcggccauucgcggacuucacggcuccagaaccauggcuggggccucuagcucccuggucgugaaacucgcugacacagaucgggagcgcgcccugagacggaugcagcagauggccggacaucugggcgcuuuccaccccgcgccgcucccucugggcgccugcggggcuuacaccacggccauccuucaacaccaggccgcucugcucgccgcggcucagggacccggccuggggccuguugccgccguggcugcccaaaugcagcaugucgcugccuuuagccuuguggcggcuccccugcuccccgccgccgcugccaacucuccuccgggauccggccccgggacccugccuggccugcccgcgccuaucggagugaauggcuucgggccccucacaccgcagaccaacggacagccuggcagcgacacacuguauaauaacgggcuuucucccuacccugcccaaucccccggagucgcugauccucugcagcaggccuaugcuggcaugcaccauuacgccgggcccgaaggcuguaaucucuuuauuuaucaucugccgcaggaguucggagacgccgaacuuauccaaaccuuccugccuuuuggcgcuguugugagcgcgaagguguucgucgaccgcgccacgaaccaguccaagugcuuuggguucgugucuuuugauaaucccacaagcgcucagaccgccauucaggccaugaacggauuccaaaucggcaugaaaagacucaagguucagcugaaacggcccaaggacgcuaauagaccuuacuga

SEQ ID NO: 67290 - RNA, 2271 nt, Artificial Sequence
  derived and/or modified sequence opt5 from CEL__Homo_sapiens__NP_001798
augcugaccaugggcagacuccagcuggugguccuugggcugacaugcuguugggccguugcuagcgccgcgaagcucggagcuguguacacggagggcggguucguggaaggagucaacaaaaagcugggccuucugggggacuccguggauaucuuuaaaggcauucccuucgccgccccuaccaaggcucucgagaauccgcaaccccacccuggauggcagggcacacugaaagccaagaacuuuaagaaacggugccugcaggcuaccaucacacaggacucuaccuauggggaugaagacugucucuaccugaauauuuggguuccccaaggacgcaaacaggugagcagagaucuuccugucaugaucuggauuuauggcggggccuuccugaugggauccggccauggggcgaacuuucucaauaacuaccuguaugacggagaggaaaucgccacacggggcaaugugaucguugugaccuucaacuaccgcgucggcccccuuggguuucugucuacgggagaugcuaaucucccuggcaacuaugggcugagagaccagcacauggccauugcuugggugaagcggaauaucgccgcguucggaggcgauccgaacaauauuacccuguuuggggagagcgccggaggcgcuuccgugucucuccagacacugagccccuacaacaagggccuuauccgcagagccauuucccaaagcggggucgcucugucuccuuggguuauccagaaaaauccccucuucugggccaagaagguggccgagaaagugggaugcccugucggcgacgcugcgcggauggcccagugucugaaggugaccgauccccgcgcucuuacacuggccuacaaaguuccgcucgccgggcuggaauauccuaugcugcauuacgugggauuuguccccgugauugacggcgauuucaucccugcugaccccaucaaccucuaugccaacgcggcugacauugauuacaucgccgggaccaauaacauggacggccacauuuuugccuccaucgauaugcccgcuauuaauaagggaaacaaaaagguuacggaggaagacuucuauaaacuggugagcgaguucacaaucaccaagggccuuagaggggccaagacaaccuuugaugucuacaccgagucuugggcucaggacccuucccaagaaaauaaaaagaaaacaguggucgauuucgagacggacgugcuguuucucguuccgaccgaaaucgcccuggcgcagcaucgggccaacgcuaagagcgccaaaacauaugcuuaccuuuucucucaccccucccgcaugccuguguaccccaagugggucggagccgaucacgcggacgauauucaguauguguuuggcaagccuuucgccacccccacaggguacagaccgcaagaccggaccguuagcaaagcuaugaucgccuauuggacgaauuuugcuaagacaggagacccuaacaugggcgauuccgccgugcccacccauugggagccuuacaccacagaaaauucuggguaucuggagauuaccaaaaagaugggcagcuccagcaugaaacgcucucucagaacaaacuuccugcgguacuggacgcugaccuaucucgcccugcccacagucaccgaccaggaggcuacaccugugcccccgaccggagauuccgaagcgacgccugugccucccaccggcgacagcgagacagcccccguuccgcccaccggggauucuggagcuccucccgucccucccacaggcgacagcggggccccucccgugccgccuaccggagauuccggcgcucccccugugcccccgacgggggacucuggcgccccucccgucccucccacaggagauagcggcgcgcccccugugccgcccaccggggacuccggagccccucccguuccucccacaggcgauagcggggcuccuccggugcccccuaccggagacucuggcgcucccccugucccgcccaccggggaugccggcccuccucccgugccucccacaggagacuccggcgccccgcccguucccccuacgggggacagcggagcgcccccugugacccccacaggcgauucugaaaccgccccggucccucccacaggggacuccggagcuccucccgugccucccaccggcgauagcgaggccgccccgguuccucccacggacgauuccaaggaagcucagaugcccgccgugaucagauuuuga

SEQ ID NO: 67291 - RNA, 9045 nt, Artificial Sequence
  derived and/or modified sequence opt5 from CELSR1__Homo_sapiens__NP_055061
auggcucccccuccgcccccugugcugcccguccuccugcuucuggccgcugccgcugcccucccugccaugggacugcgcgcugccgcuugggaaccccggguuccugggggaacccgcgccuucgcgcuuagaccgggcugcacauacgccgugggggcugccugcacgccccgggcuccucgcgaacugcucgacgugggaagagacggccggcuggccgggcgcagacgggugagcggagcgggccgcccccugccucuccaagugagacugguugcccgguccgcucccaccgcccuuucucgcagacugcgggcucgcacacaccucccgggcugcggggccagagcccggcugugcggaaccggcgcuagacuuugcggggcgcuguguuuuccugugcccggaggcugcgccgcugcccaacauagcgcccucgcugccccuacaacccugcccgcgugucgcugucccccucggccgagaccccgcuguccugggcggcccaucugccugccucccggaggcuccguuagacuccgccugcuuugugcucugcggagagccgccggcgcugugcgcguugggcucgcccuggaggcugccacagcgggaaccccgucugccagcccuucccccucuccuccccuuccucccaaccugccggaagcucgggccggcccugcuagacgcgcccggagagggacgagcggacggggcucccucaaguuccccaugcccaauuaccagguggcgcuguuugagaacgaaccugccgggacccugauucuccagcugcacgcucauuacacaaucgagggagaggaagaacgcgucagcuauuacauggaaggccuuuucgacgagagaucucggggcuauuuuagaauugauuccgccaccggggcugugagcacagacucugugcuggaucgcgagaccaaagaaacgcacguccuccggguuaaggccguggacuacuccacaccgcccagaagcgccaccacauauaucaccgugcuggucaaagauaccaaugaccauucuccuguguucgagcaguccgaauaccgcgagagaguucgggaaaaccuugaggugggauacgagguccugacaauucgcgcuagcgauagagacucccccaucaaugcgaaccuccgguaucgcgugcugggcggggccugggauguuuuucaacugaaugaaucuagcggaguggucuccacgagagcugugcucgaccgggaggaagccgccgaguaccagcugcuugucgaagcuaacgaucagggccgcaauccugggccccugagcgccaccgcgacaguguauaucgagguugaggacgaaaacgacaauuacccucaguucucugagcaaaacuaugugguccaggugcccgaagauguuggccucaauaccgcugugcugagaguccaggccacagaccgggaucagggacaaaacgccgcuauucacuacuccauccugagcggcaauguggccgggcaguuuuaucuucacucucucagcggcauucuggacgugaucaacccgcuggauuucgaggacguucagaaguacucccucucuauuaaagcgcaagauggcgggcgcccuccccugaucaacagcuccggagucgugagcgugcagguccuugacgugaaugauaacgaaccuauuuuuguuucuucccccuuccaggcuaccgugcuggagaaugucccgcucggcuacccugugguucauauccaggccguggacgccgauagcggggagaacgcuagacugcacuaucggcuggucgacacggccucuacauuucuuggcggaggcuccgcugggcccaagaauccugcccccacccccgacuucccuuuccaaauccauaacagcuccggauggauuaccgugugcgcggaacucgauagagaggaaguugagcacuacucuuuuggcguggaggccgucgaccacgggagcccgcccauguccucuagcacauccgugagcaucaccgugcuggaugucaaugacaacgauccuguuuucacacagcccacguaugaacugcgccucaaugaggacgcugccgugggaucuuccgugcugacccuucaggcucgggauagagacgccaacagcgucauuacauaccagcugaccggcgggaauacacgcaaccgguuugcccucucuucccaaagaggcggaggccugaucacccuggcccuuccucucgauuauaagcaggaacagcaguacgugcuggcgguuacggccagcgacgggacccgcucucauacagcucacgugcugauuaaugucaccgaugccaacacacaucggcccguguuccaaagcucccacuauaccguuagcgugucugaggacagaccugucggaacguccaucgccacacucagcgcuaaugaugaagacaccggcgagaacgcccgcaucacauacgugauucaggacccgguuccccaguuucggaucgauccugacuccgggaccauguacaccaugauggagcuggauuaugaaaaccagguggcguacacacuuacgauuauggcucaagacaauggaaucccccagaaaucugauaccacaacccuggagauucucauccuggacgccaacgauaaugccccucaguuccugugggacuuuuaucaaggcagcaucuucgaagaugcucccccguccacaucuauucuucaggucagcgccaccgacagagauuccgggccuaacggccggcuccuguacacguuucagggaggcgacgauggggacggagacuucuauaucgagcccacaucuggcgugauucgcacccagagacggcuggaucgcgaaaauguggcggucuacaaccucugggcucuggccguugacagagggagccccaccccucuuuccgccagcguggagauccaagugacaauucuggauaucaaugacaacgcucccauguuugagaaggaugaacucgagcuguucgucgaagagaauaacccugugggaucuguuguggccaaaauucgggcuaaugacccggaugaaggccccaacgcccagaucauguaucagaucgucgagggcgacaugagacacuuuuuccagcuggaucuucugaauggggaccuccgcgcgaugguggagcuggauuucgaaguucggagagaguacgugcucgucgugcaagccaccuccgcuccucuggucagccgcgccacagugcacauucuucugguugaccagaacgacaaucccccugugcuccccgauuuucagauccuguucaacaacuacgucacgaauaagucuaacuccuuuccgaccggagugauuggcugcaucccugcucacgaccccgauguuagcgacucucugaauuauacauucgugcaggggaacgaacuucggcugcuccugcucgauccugccaccggagagcugcaacuuuccagagaccuggauaauaaccgcccccucgaggcccugauggaagucagcguguccgacggcauucauagcgugacagcuuuuuguacccugcggguuacgaucaucaccgaugacaugcuuacaaauucuauuaccgucagacuggagaacaugagccaggaaaaauuccucuccccucugcucgcgcuguuuguggaggggguggccgcuguccuuucuacaaccaaggaugacguguucguuuuuaaugugcagaacgauacagacgucagcuccaauauccugaacgugaccuucucugcccugcuccccggaggcguucgcggccaauuuuucccgagcgaagaccugcaggagcagauuuaccuuaauagaacgcugcucacaaccaucuccacccagcgggugcugccuuuugaugacaacauuugccuccgcgagcccugugaaaauuauaugaagugcgucucugugcugagauucgauagcuccgcccccuuccuuagcucuacaaccguucuguuucggccuauccacccgaucaacgggcugcgcuguagaugucccccuggauucacgggcgacuacugugagacagaaauugaucucugcuauuccgaccccuguggggcuaacggacggugcagaagccgcgagggcggguacaccugugaaugcuuugaggauuucacaggagagcauugcgaaguggacgcccggucuggcagaugugcgaauggcgucugcaaaaacgggggaaccugugugaaucugcuuaucggcggguuucacugcguguguccucccggagaguaugaacgcccuuacugcgaggucacaacccgguccuucccgccccagagcuuuguuacguucagaggccugcggcagcgcuuucacuucaccauuucccucacauuugcuacccaggaaagaaacgggcugcuccuguacaauggacgguucaacgagaagcaugauuucaucgcccuugagauuguggacgaacaggugcaacugacauuuucugccggcgagaccacgacaaccgucgcuccuaaagugcccagcggcguuuccgaugggcgcuggcacagcgugcagguccaguauuacaauaagccuaacaucggacaucugggccucccccacgggccgucuggagagaaaauggccgugguuacaguggacgauugugacaccaccauggcggucagauucggcaaggacaucgggaauuauuccugcgccgcucagggaacacaaacgggcagcaaaaagucucuggaucuuaccggcccucugcuccucgggggagugcccaaccuccccgaggacuuuccuguccauaaucggcaguucgugggcuguaugcgcaaccugagcguugaugggaagaauguggacauggccggauuuauugcuaacaauggcacaagagaggggugcgccgcucggcgcaacuucugugauggaagacggugccagaauggcggaaccugcgugaacagauggaacauguaccuuugugaaugcccccugcgcuuugggggcaaaaauugugagcaggccaugccucacccgcaacuguucuccggcgaaucugucguuagcugguccgaccucaacaucauuaucucugugcccugguaucuggggcuuauguuucggacaagaaaggaggauagcgugcugauggaagcgaccuccggaggcccuacgagcuuccgccuccagauucugaauaacuaccugcaguuugaggucucucacgggcccuccgacguggagagcguuaugcucuccggacuucgggugacagauggcgaauggcaucaucugcugaucgagcucaaaaaugucaaggaagacucugagaugaaacaucuggugaccaugacccuugauuauggcauggaccaaaacaaggccgacauugggggaaugcugccuggccucacagucagaagcgugguugucgggggagcuuccgaagauaaggucucugugcgccggggcuucagagggugcaugcagggcguucgcaugggaggcacccccacaaauguggccacgcugaacaugaauaacgcucugaaaguccgggugaaggacgggugugauguggacgauccgugcaccagcuccccuugucccccuaauagcagaugccacgacgccugggaggauuacucuuguguuugcgacaaaggauaccucggcaucaacugugucgaugccugccaucuuaaucccugcgagaacaugggggcuugugugcgcuccccuggaagcccccagggcuaugugugcgaaugugggccgucucacuacggcccuuauugcgagaauaagcuggaccugcccuguccccggggaugguggggcaacccugucugcgggccgugucacugcgcgguuuccaaaggauuugaucccgacuguaacaagacaaauggccagugccaauguaaggaaaacuacuauaaacuccuggcccaggauaccugccuuccuugcgacuguuucccccaugggagccacucuagaacaugcgacauggcuaccggacagugugccugcaagccuggcgugaucgggcgccaguguaauagaugcgauaaccccuucgccgaggugacgacccugggcugugaagucauuuacaauggaugcccuaaggcuuuugaggccggcaucugguggccccaaacaaaguucgggcagccggcggccgugccuugucccaaaggaagcguuggcaacgcugugcggcauugcuccggggagaagggauggcucccucccgaacuguuuaauuguaccacaauuucuuucgucgaccugcgcgccaugaacgagaagcucagcagaaaugaaacccagguggauggcgcucgggcccuucagcugguuagagcgcugcgguccgccacacaacacacgggcacccucuuugggaacgacgugcgcacagcuuaucagcugcuuggacacguccugcagcaugagagcuggcaacagggcuucgaucucgccgcuacccaggacgccgauuuucacgaggacgugauccauuccgggucugcucugcuggccccggcgaccagagccgcuugggaacagauucaacggagcgagggaggcacagcccagcuccuucgcagacuggaaggguacuucuccaauguggcucggaacguccgcagaacguaccugcggccuuuuguuaucgugaccgccaauaugauccucgccguggauauuuucgacaaauuuaacuucacaggagcgcgcguccccagauuugauaccauccacgaggaguucccccgggagcuggagucuagcguguccuucccugcugacuuuuucagacccccugaagagaaggaaggcccgcuucugagacccgccggccggcgcacaaccccucagacgacaagacccgggccuggaaccgagcgggaagcucccauuucuagacgccggagacauccugacgaugccggccaguuugccguugcucucgugaucauuuaucgcacccuggggcaacugcucccggagcgguacgaccccgauagacgcagccuucggcugccucacagacccaucaucaauacaccuauggucuccacccugguguauagcgagggagcgccccugccgcgcccucuggaacggcccguucuuguggaguucgcgcugcucgaagucgaggaaagaacaaaacccgugugcgucuuuuggaaccacucucuggccgugggcgggaccggaggcugguccgcucgcggcugcgagcugcucagccggaacagaacgcaugucgccugucagugcucucacacagcuuccuucgccgugcuuauggacauuagccggagagagaauggggaaguccugccucugaagaucgugaccuacgcggccguuucucucucccuggcugcccuucugguggcuuuuguccuccugagccuggugcgcaugcuccgguccaaccuucauagcauucacaaacaccuggccguggcucuguuccucucucagcugguuuuugugaucggaauuaaucagacagagaaccccuuccuuuguaccgucguggccauccugcuccauuauauuuacaugagcacguuugcguggacccugguugaaucccugcacguguauagaaugcucacagagguccgcaauaucgauaccggcccuaugagauucuacuacguggucggguggggaaucccggccauugugacaggccuugcuguugggcuggacccccaaggauauggcaacccugauuuuugcuggcugucucuccaggacacccugaucuggagcuucgccggccccauuggggcugugaucauuaucaauacagucaccuccgugcuuucugccaagguuagcugucagcggaaacaucacuacuauggaaagaagggcaucgugucccugcuccgcacggccuuccugcugcuccuucugauuucugcgacauggcugcucgggcugcuugcugucaacagagaugcccugagcuuucauuaccucuucgccaucuuuuccggacugcagggcccuuucgugcugcucuuucacugcgugcugaaucaagagguucggaaacaccuuaaggggguccugggaggccgcaaacuccaucuggaagacagcgcuaccaccagagccacacuucugacccggucucucaacuguaauacaacguucggcgaugggcccgacaugcugcgcaccgaucugggagaguccacagcuagccucgacucuauugugagagacgaaggcauccagaagcuggggguguccagcggacuuguccggggcucccacggggagccggaugccucucugaugccucgcagcugcaaagaucccccuggacaugauuccgacagcgauucugaacucucccuggacgagcagagcucuagcuaugcguccucucacagcuccgauucugaggacgauggcgugggcgccgaagagaagugggaccccgcuagaggggccguucacagcaccccgaagggagaugcuguggccaaccaugucccugcgggcuggcccgaccaaucccuugccgaaagcgauucugaggaccccuccgggaaaccucggcugaagguggaaacaaaaguuagcguggagcuccaccgcgaggaacagggaucccauagaggcgaguaucccccugaccaggaaucugggggagcugcccggcuggcuagcucccagccgcccgagcaaagaaagggcauucugaaaaauaaggucaccuauccucccccucucacgcugaccgaacagacacuuaagggccgccugcgggagaaacucgccgauugugagcagucucccaccagcuccagaacaagcucucugggguccggaggcccugacugcgcuaucaccgugaaaagcccggggcgcgaacccggacgggaucaccuuaacggcguugccaugaaugugagaacggggucugcgcaggccgacggcuccgauagcgagaaaccuuga

SEQ ID NO: 67292 - RNA, 9939 nt, Artificial Sequence
  derived and/or modified sequence opt5 from CELSR3__Homo_sapiens__NP_001398
augauggcucggcggcccccuuggcgcggacucggagggagaagcacccccauucuccugcuucugcuccugucccuuuucccccugucucaggaggaacucggcgggggaggccaccaggggugggacccuggacuggcugccacaacgggcccccgggcccauauuggcgggggagcucuggcccucugcccugagagcuccggcgugcgcgaagaugggggacccggccugggggucagagagccuaucuuuguuggacuucggggccgcagacagucugcccggaauagccgcggcccgcccgaacagccuaaugaggagcuggggauugaacacggagugcagccccucggcuccagagagcgggaaaccgggcagggaccuggcucugugcuguacuggcgccccgaggucagcuccugugggagaacaggaccgcuucagcggggcagccugucuccuggcgcucucuccagcggggugcccggaucuggcaacuccagcccucugcccucugacuuccugauccgccaucacgggcccaagccuguuuccagccagagaaaugccggaaccggcucccggaaaagaguggggacagcucgcugcuguggcgagcucugggccaccggaucuaagggccagggggaacgggcgacaaccagcggagccgagagaacggcuccgcgccggaacugccugcccggcgccuccgggagcggaccugaacuugauucugcucccagaaccgcccgcacagccccugccuccggcagcgcuccccgggagucuagaaccgccccggaaccugcucccaaacgcaugcggagcagagggcuguuucgcugucgguuccucccucaaagacccggcccucggcccccgggacugccugcccgccccgaggccagaaaggucacauccgcuaaucgggcgagauuucgccgggccgcuaacagacauccccaguucccucaguauaauuaccagacccuugugccggagaacgaagccgccggcacggcuguucugcgcguggucgcccaagaccccgaugcgggggaggcuggaagacucguguauucucuggccgcccugaugaauagccggucccucgaacuguuuagcauugacccucagucuggccuuauccgcacagcugccgcucuggauagagaguccauggaacggcacuaccuccgcgugaccgcccaggaccacgggagccccagacugucugcgacaaccauggucgccguuaccguggcugaucggaacgaccauuccccuguguucgagcaagcccaguaucgcgagacacuuagagaaaaugucgaggaaggauaccccauccugcagcuccgggcuacggauggcgacgccccucccaacgcgaaucugcgcuauagauuuguggggccgccugccgcucgggccgcugccgccgcugcguucgagauugaucccagaagcggccugaucuccaccucuggacgcguugaccgggaacacauggagagcuacgagcucguggucgaagccuccgaccagggccaagagccugggcccagaucugcuacagugcgcguucauauuaccgugcuggaugaaaacgacaaugccccgcaguuuagcgagaaacgguacgucgcccaggugagagaggauguccgcccucacacagugguucuucgggugaccgcuacggacagagauaaggacgccaacggacugguccacuauaacaucauuuccggcaauagccgcgggcauuucgcgaucgauucucucacaggagaaauucaggugguugcuccccuggacuuugaggccgaacgggaguacgcccugagaauccgggcucaagaugccggccgcccuccccuuuccaacaauaccgggcucgcgagcauccagguggucgacauuaacgaucacauccccauuuucgugucuaccccuuuccagguguccguucuggaaaaugcuccgcugggccauagcgucauccacauucaggccguggacgccgaccauggagagaacgcuagacucgaguauucucugacaggcguggcccccgauaccccuuuugucaucaauagcgcuacaggguggguguccguuagcggaccccuugaccgggaaucuguggagcacuacuucuuuggcgucgaagcccgcgaucacggguccccuccccugagcgcguccgccucugugacgguuaccgugcucgacgucaacgauaauagaccugaguucacaaugaaggaauaucaucugcggcugaacgaggacgcugccgugggaaccagcguuguguccgucacagcuguggauagagacgccaauucugccaucagcuaccaaauuaccggcggcaacacgcgcaaucgguuugcuaucuccacccaagggggagugggccuugucacacucgcgcugccgcuggauuauaaacaggagagauacuucaagcucguucugaccgccucugaccgcgcccuucacgaucauugcuacgugcacauuaacaucacagacgccaauacccaccggcccguguuucagagcgcccauuauuccgucagcgugaacgaagauagaccuauggggucuacgauuguugugaucuccgcuagcgacgacgaugucggagagaacgcccgcaucacauaccugcucgaagacaaucugccccaauuccggauugaugcggacucuggcgcuaucacccugcaggccccucuugauuaugaggaccaggugacauacacccucgccauuaccgcuagagauaacgggaucccccaaaaagccgacacaacguauguugaagugauggucaaugaugugaacgacaaugcgccgcaguuuguugcuucccacuacaccggacuggugagcgaggaugccccucccuucacaucuguccugcagauuuccgccaccgaccgcgaugcucaugccaacggcagagugcaguauacauuucaaaauggcgaggacggggacggagauuucaccaucgaacccacgagcggcauugugcggacaguccgcagacucgaccgggaggcuguuuccguguacgaacugaccgccuacgcgguggaucgcggggucccuccccuuagaaccccugugagcauccagguuauggugcaggacgucaacgauaaugccccgguguuucccgcugaggaguucgaaguucgggugaaggagaacucuaucgucggaagcguggucgcccagauuacagcuguggacccugaugaaggccccaaugcccacaucauguaucaaauuguugaggggaacaucccugaacuguuccagauggacaucuuuuccggggagcucaccgcccugaucgaucuggacuacgaggcuagacaggaauaugugaucgucgugcaggcgacaucugcgccccuuguuagccgcgcuacggugcauguccggcucguggaucaaaaugacaacuccccggugcugaauaacuuccagauucuguuuaacaauuacguuucuaacagaagcgacaccuucccuuccggcaucauuggccgcauccccgccuaugauccugacgucucugaucaccucuuuuacagcuucgagcgggggaaugaacugcagcuucugguggugaaccaaacauccggagagcucagacugagccggaaacuggacaauaaccgcccccuugucgccucuaugcuggugaccguuacagauggccuccacuccgugaccgcucaguguguccugagagugguuauuaucacggaggaacugcuggccaauagccuuaccgugcggcuggagaacauguggcaggaacgcuuucucucuccucugcuggggagauuccuugagggagucgcggcugugcuggccacacccgccgaagacguuuuuaucuucaauauucagaacgauaccgacgugggcgggacaguccucaauguguccuuuagcgcucuggccccgcggggagcgggcgccggcgcugccgggccuugguucuccucugaggaacuccaagagcagcuguaugugcgcagagcugcccuugcugcccggagccugcucgauguccugcccuuugacgauaacguuugccugcgcgagcccugugaaaauuacaugaagugcguguccgugcuuagauucgacagcucugcgccuuuccuggccuccgcuagcacccucuuucggccgauccagcccauugccggacugagaugucgcugcccucccggcuucacaggggauuuuugcgagaccgaacucgaccuguguuacucuaacccuugccggaauggaggcgcuugugccagacgcgaagggggauauacgugcgucugucggcccagauucacaggcgaggacugcgaacuugauaccgaggccggccgcugugugccugggguuugccggaacggaggcaccuguacagacgcuccgaacgggggauuuagaugccagugucccgcgggcggggccuucgaaggaccucgcugcgagguggcugcccggagcuuucccccuuccucuuucgucauguuuagaggccugcgccaacgguuccaucugacccucagccuguccuuugccacggugcagcagucuggccuucuguucuacaaugggagacucaacgaaaagcacgauuuccuggcucucgagcugguugccggacaggugcgccuuacauauagcaccggcgaguccaauacagucgugagccccaccguccccgggggacugucugacggccaauggcauacagugcaccugagauacuauaacaaaccucggaccgaugcgcucgggggagcccagggccccuccaaggacaaaguugcugugcugagcguggaugacugcgaugucgccguugcccuucaguuuggcgccgaaaucgggaauuacuccugugcggccgcuggagugcagacgucuagcaagaaaucccuggaccucaccggcccccugcuccucgggggagugccuaaccuucccgagaauuucccugucucucauaaggauuuuauuggcugcaugcgcgaccugcacaucgaugggagacggguggacauggccgcuuucguugccaacaauggcacaauggcuggaugucaagccaaacugcacuuuugcgacagcggcccguguaagaacuccggguucugcagcgaaagauggggaucuuuuuccugugauugccccgugggcuucgggggaaaggacugucagcucaccauggcgcauccucaccauuuucggggcaaugggacacugagcuggaacuucggcucugauauggccgucuccgugcccugguaucuuggacuggcuuuucgcaccagagccacgcagggcguccucaugcaagugcaggcugggccucacagcacacugcucugccagcuggaccggggacuucugucuguuaccgugacacgcggcagcgggagagccucccaucugcugcuggaucaggucaccgugucugacggacgguggcacgaucuucgccuggagcuccaagaggagcccggcgggagacggggccaccauguucugauggugagccuggacuucucccucuuucaggauaccauggccgucggaagcgagcuucagggccugaaagugaagcagcugcacgucgggggacucccgccuggcuccgcggaagaggcuccccaagggcugguuggauguauccagggcgucuggcuuggcucuacaccuagcgggucccccgcccugcucccucccucucaucgcgugaaugcugaaccgggaugcguggucacgaacgccugcgccagcggcccuuguccgccccacgcugacugcagagaucuguggcagaccuucuccuguacaugccagccuggguacuacggaccgggcuguguugacgccugccugcucaaucccugucaaaaccaggggucuugccggcaccuuccuggagcgccccauggcuauaccugugacugcgugggcggguacuucggacaccauugugagcaccgcauggaucagcaaugcccuagaggcuggugggggagccccacaugcggaccuuguaauugcgacgugcacaaaggcuuugaucccaacuguaacaagaccaaugggcagugccauuguaaagaguuccacuaucggccgcgcggauccgacagcugccugccuugugauugcuaccccgucggcucuacguccagaagcugugccccucauucuggccagugccccugucggccgggggcucugggaagacagugcaacuccugcgacagcccuuuugccgaggugacagcuucuggcugucgcguucucuaugaugccugccccaagucccugcggagcggggugugguggccccaaaccaaguucggaguccuugcgaccgugccuugucccagaggcgcccugggggcugccguucgccucugcgacgaggcucagggauggcuggaaccugaucuguuuaauuguacauccccggccuuccgggagcucagccuucugcuggacggccucgaacugaacaaaaccgcucuugauacaauggaggccaagaaacuggcgcagagacuccgcgaggugacgggccacaccgaccauuacuuuucucaggauguccgggugacagccagacugcuggcucaccuccuugccuucgaaagccaccaacagggguuuggacugaccgcuacacaggacgcccauuucaaugagaaccugcucugggccggcuccgcgcugcuugcucccgaaaccggggaccugugggccgcccucggacagcgcgcuccuggcgggucucccggaagcgccggccuggugcggcaccuggaggaauaugcugccacgcucgcgagaaauauggagcuuaccuaccugaacccuaugggccuggucacacccaauauuaugcucuccaucgaucgcauggagcauccuucuagcccgagaggggcuagacgguaccccagauaucacuccaaccuguuucgcggacaagacgcuugggauccucacacccauguucuucugcccucucagagcccucggcccuccccgagcgaagugcucccuacaucuuccagcauugaaaauucuaccacauccagcguggugccgcccccugcgcccccugaaccggagcccggcaucuccauuaucauucugcugguguacagaacgcucgggggacuucugccugcucaguuccaggccgaacgcagaggcgcgcggcugccccaaaacccuguuaugaacucucccguggucagcguggccguuuuucacgggcgcaacuuccucagaggaauccuggaguccccgaucagccuugaguuccggcugcuccagaccgcuaaucgcucuaaggccauuugcgugcagugggacccucccggccuggcugaacaacauggcgucuggacagccagagauugugagcuggugcaccggaacgggucccaugcucgcugcagauguagccggaccggaaccuuuggcguucucauggacgccucuccucgcgaaagacuugagggggaucuggaacugcucgcgguguucacacacgucguggucgccgugagcguugcugcccuggugcuuacggccgcuauccugcucucccugcggucucugaaaagcaacguccgcggcauucacgccaauguggcggcugcccucggcguggccgagcuucuguuucugcucgggauccauagaacccacaaccagcugguuugcacagcuguggccauucuucugcauuauuucuuucucuccaccuucgcuuggcuguuuguccagggacugcaccucuaccggaugcaaguggagcccagaaauguugaccgcggcgccaugcgguucuaucaugcgcuuggcuggggagugccggccguccugcugggacucgcugugggccuggauccugaaggguacggaaaccccgacuuuuguuggaucucuguccacgagccccuuaucuggagcuucgccggcccugugguucuggugauugucaugaaugggacaauguuucuccuggcugccagaaccuccugcagcacgggccaacgcgaagcgaagaagacaucugcccugacccuccgguccagcuuccugcuucugcuccugguguccgcuucuuggcuuuuuggacugcucgccguuaaccacagcauccuggcuuuccauuaucugcacgccggccucugcgggcugcagggacuugccgugcugcuccuguucuguguccuuaaugcugaugcgagagccgcuuggaugcccgccugccugggccgcaaagccgcuccugaggaggcccggccggcgcccgggcucggaccuggcgcuuacaacaauaccgcccuguuugaagaguccgggcugauuagaaucacacucggcgccucuaccgugagcuccgugagcucugcucgcuccggacggacacaggaccaggacagccaaagaggccggucuuaccugcgcgauaacguucuugucagacauggguccgccgcugaccacaccgaucacagccugcaggcccaugcgggacccacggaccucgauguggccauguuccaccgggacgcuggcgccgauucugacuccgauagcgaccugucucuugaagaggaacgcagccuguccauuccuagcuccgagucugaggauaaugggagaacacggggaagauuucagcgcccccucugucgggcugcccagagcgaaagacugcugacccauccuaaggacguggauggcaacgaccuccuguccuauuggccggcgcuuggggagugcgaagccgcucccugugcccugcaaacauggggcucugagcgccggcucggacuggacaccagcaaagaugcugccaauaacaaucagccugaccccgcccuuacguccggcgaugaaaccucucuggggagagcucagcgccaaagaaagggaauccucaaaaaccggcugcaguacccucuggucccccagacacgcggcgcgccggagcucagcuggugcagagccgcuacccuggggcaccgggccgugccugccgcuuccuauggacgcaucuacgccggcgggggcacaggaagccuuucucagcccgcguccagauauagcucucgggagcaacuggaccuccugcuucgcagacagcugucccgggaaagacucgaggaagcucccgccccuguucugcgcccccugagccggccuggcucucaggaguguauggaugccgcuccggggagacucgaacccaaggaccgcggauccacccugccucggagacagcccccucgcgauuaccccggcgccauggcugggcgguucggaagcagagacgcccuugaucugggcgcgccgcgggaguggcucucuacacugccucccccucgcagaacccgggaccuugauccccaaccucccccgcugccccucuccccucagcgccagcugagcagagacccccugcucccuagccggccgcuggauucccuuucucgcagcuccaacucuagagagcagcuggaccaagugcccagccggcauccuuccagagaagcccucggcccccugccucagcuucugcgcgcucgggaggacucugucagcgggcccucccacggaccuagcacggaacagcucgauauucugucuuccauccuggccagcuuuaauucuuccgcucuuagcuccgugcaaucuagcuccacaccccugggcccgcacaccaccgccacaccuucugcgaccgccagcguucucgggcccuccacaccuagaagcgcuacgucucauuccauuagcgagcugucucccgacagcgaggugccgcgcuccgaaggacacucuuga

SEQ ID NO: 67293 - RNA, 4086 nt, Artificial Sequence
  derived and/or modified sequence opt5 from CEMIP__Homo_sapiens__NP_001280227
augggcgccgcugggagacaggacuuccuguuuaaggccaugcucaccaucagcuggcugacacuuacgugcuuccccggagcgaccuccacaguggcugccggcuguccugaucaaucuccggagcugcagcccuggaacccugggcacgaccaggaucaucacguccauauuggacagggcaagacccuccugcuuacaagcuccgccaccguuuacucuauccacauuagcgaagggggaaagcuggugaucaaagaccaugaugagcccauugugcuccggacacgccacauccugaucgacaauggcggcgaacugcacgcuggguccgcccucugcccuuuucaaggaaacuucaccauuauccuguauggcagagcugaugaggggauucagcccgacccuuacuauggacuuaaguacaucggcgucgggaaaggaggcgcccuggaacuccauggccagaagaagcugucuuggacguuucuuaauaaaacccugcacccgggaggaauggcggagggcggguauuucuuugagcggagcuggggacaucgcggcgugauuguucacgugaucgaucccaaguccgggacagucauucacagcgacagauucgauaccuaccggucuaaaaaggaauccgagcgccucgugcaguaucugaacgccguuccugacggaagaauccugagcguggcugucaaugaugaaggcucucggaaccucgacgacauggcccgcaaagcuaugacaaagcugggcuccaagcauuuucuucaccugggguucagacaucccuggagcuuucucaccgugaaaggaaauccuucuuccagcguggaggaucacaucgaguaccauggccaccggggguccgccgcggcccgcgucuucaagcuguuucaaacggaacacggagaguacuucaacguuucucuuagcuccgaaugggugcaggacguggaguggacagaaugguucgaucaugacaaagucagccagaccaagggcggggagaaaauuucugaucuguggaaggcucaccccggcaaaaucuguaauagaccgauugacauccaggccacaaccauggauggagugaaccucuccaccgagguuguguauaagaagggccaagacuaccgguuugcuugcuaugaucgcgggagagccugucggagcuacagaguccgcuuccugugcggaaaaccugugcggcccaagcugacaguuacgauugacaccaaugugaacucuacaauccucaaucuggaagauaacguccagagcuggaaaccuggcgacacccuugugaucgccuccacagacuauucuauguaccaggcugaggaauuucaaguccugcccuguagaagcugcgcgcccaaucaggugaagguugccgggaaaccuauguaucuccauauuggagaggaaaucgauggcguggacaugcgcgcugaggucgggcugcuuucccggaacauuaucgugaugggcgagauggaagauaaguguuacccguacagaaaccacauuugcaauuucuuugacuucgauaccuuuggaggccacaucaaguucgcccugggguuuaaagccgcucaucucgagggaacggaacugaagcacaugggccagcagcugguugggcaauaucccauccauuuccaccucgccggagacguggaugagcgcggcggguacgacccucccacauauauucgggaucugagcauccaucacaccuuuucuagaugugucaccgugcacggcuccaacggacuucugauuaaagacgugguuggcuacaauagccucgggcauugcuucuuuacagaagauggaccugaggagcgcaacaccuucgaccacugccugggccugcuugucaagucugggacacuccugcccuccgaucgggacagcaaaauguguaagaugaucacggaagacuccuauccgggauacauuccuaagcccagacaggauugcaaugcggugucuaccuucuggauggcuaacccuaauaacaaucugaucaacugugccgccgcuggcagcgaggaaacaggguuuugguucauuuuucaucacgugcccaccggcccuuccgucggaauguauucucccggcuacagcgagcauaucccgcucgggaaauucuacaauaaccgcgcccacuccaauuaucgggcuggaaugaucauugacaacggcgugaagacaaccgaggccagcgcgaaagauaagagaccuuuucugucuaucauuuccgcccgguacagcccccaccaggacgcugauccccuuaaaccucgcgaaccggccaucauuagacauuucaucgcuuauaagaaucaggaccacggggccuggcugcggggaggcgauguuuggcucgacucuugcagauuugcggauaacggcaucgggcugacgcuggccuccggaggcaccuuccccuacgacgaugggagcaagcaagagauuaaaaacucucuuuuugugggagaaagcggcaaugucgggacagagaugauggacaaccgcaucuggggaccuggcggccucgaucauuccgggcggacccugcccauuggacagaauuucccuaucagaggcauucagcuguaugacgggcccaucaacauccagaauuguacauuucgcaaguucguggcucucgaaggaagacacaccagcgcccuggcuuuucggcuuaacaaugccuggcaaucuugcccucacaacaauguuacgggcauugccuucgaggacgugcccaucacaucccgcgucuucuuuggggagccgggaccuugguucaaccagcuggauauggacggcgauaaaaccagcguguuucaugacguugauggcuccgugucugaauaccccgggagcuaucucacaaagaaugacaacuggcuggucagacacccugauuguauuaaugugcccgacuggcggggagcuaucugcuccggcuguuacgcgcagauguacauucaggccuauaaaaccucuaaccugcgcaugaagaucaucaaaaaugauuucccgagccauccucuuuaccucgagggggcucugaccagauccacacacuaucaacaguaccagcccguggucacgcugcaaaagggauauaccauucauugggaccagacagccccugccgaacucgcuaucuggcugauuaacuuuaacaagggcgauuggauccggguugggcuuugcuacccccgcggaaccacauucucuauucugagcgacgugcacaauagacuccugaaacagaccuccaagacgggcguguuuguccggacacugcagauggacaaaguggagcaaagcuaucccggccgcucucacuacuacugggaugaagacuccgggcuucucuuccugaagcugaaagcccagaacgagagagagaaguuugcguucuguagcaugaagggaugcgaacggaucaaaauuaaggcucucaucccuaaaaaugccggcguuucugauugcaccgccaccgcuuauccgaaguuuacagagagagccguggucgacgugcccaugccuaaaaagcuguucgggucccagcuuaagaccaaagaucauuuccuggaaguuaagauggagagcucuaaacagcacuuuuuccaucucuggaacgacuuugcguacaucgaaguggauggaaagaaauaucccuccagcgaggacggcauucaagucgugguuaucgaugggaaucagggacgcguggucucccacacgagcuuccggaacucuauucugcagggcaucccuuggcagcuguuuaauuacguggcuacaauucccgacaacagcaucgugcuuauggccuccaagggcagauaugucucucgcgggccuuggacccggguucuggagaagcucggagccgauagaggccugaaacucaaggaacaaauggcuuucgugggguuuaaagggagcuuccgcccgaucugggugacacuggacaccgaggaucacaaggccaaaauuuuucaggucgugcccaucccuguugugaagaaaaagaaacuuuga

SEQ ID NO: 67294 - RNA, 744 nt, Artificial Sequence
  derived and/or modified sequence opt5 from CEMP1__Homo_sapiens__NP_001041677
augggcaccagcuccacagacucucagcaagccgggcacagacggugcagcacguccaacaccucugcugagaaucugacaugucucagccugcccggauccccuggcaagaccgccccgcuucccgggccugcgcaggcuggagccggccagccccugccuaaagggugcgccgcugugaaggccgaagucggaauccccgcuccucauacaucucaggagguucgcauucacaucagacggcuccugagcugggccgcgccgggcgccuguggccuucgcuccacccccugcgcucugccucaagcccucccccaggcuagaccuugucccgggcggugguucuuuccgggaugcagccugccuacaggcggggcccagaccauucugucucucuggacguggcgccauuuccugaacugggcgcuucagcaaagagaagaaaauuccggacgggcccgcagagugcccccugugccccggaccgcucccgucagcaaaggcgaggggucucacccuccgcagaacuccaauggagagaaggugaaaacaaucacccccgauguuggccugcaucagagccucacaucugacccuaccguggccguccugcgcgcuaagagagcccccgaggcccacccuccccgguccuguagcggcucccuuacggcucgcgugugccacauggggguuugucagggacaaggcgauacagaagacgggagaaugacccugaugggauga

SEQ ID NO: 67295 - RNA, 450 nt, Artificial Sequence
  derived and/or modified sequence opt5 from CEND1__Homo_sapiens__NP_057648
auggagagcagaggcaaguccgccucuagccccaaaccugacaccaaggugccgcaggucacaacggaagcuaaaguucccccugccgcggaugggaaggcuccccugaccaaaccuuccaagaaggaggcccccgccgaaaaacaacagccuccggcugcccccacaaccgcuccugccaagaaaacaucugcgaaggccgaccccgcucuccugaacaaucacagcaaccuuaaaccugcccccaccgugccguccucuccugaugcuacacccgagccuaagggacccggcgacggggccgaagaggaugaggcggccagcggaggccccgggggacggggcccuugguccugcgaaaauuucaacccgcugcucguggcuggcggggucgccguggcugccaucgcccugauucuuggaguugcuuuucuggugcgcaagaaauga

SEQ ID NO: 67296 - RNA, 345 nt, Artificial Sequence
  derived and/or modified sequence opt5 from CENPA__Homo_sapiens__NP_001035891
augggccccagacggcgcagcagaaagccugaggccccgcggcgcagaucccccucuccuacccccacaccugggcccagccggcgcggaccuucccugggcgcuucuagccaccagcauuccagacggcgccaaggguggcucaaagaaaucagaaagcugcagaaaucuacgcaccuucugauucggaagcucccguucagccgccuggccgcggaggcuuuucuugugcaucuguucgaagacgccuaccuccugacccugcacgccggaagagucacacucuuucccaaagauguucagcuggcucggcgcaucagaggccuugaggaagggcugggauga

SEQ ID NO: 67297 - RNA, 1800 nt, Artificial Sequence
  derived and/or modified sequence opt5 from CENPB__Homo_sapiens__NP_001801
augggccccaagagacggcagcugaccuuccgcgagaaaagcagaaucauucaagaaguggaggaaaacccugaccuccggaagggggagaucgcccgcagauuuaauauuccgcccuccacacugucuacgauccuuaaaaacaagcgggcuauucuggccagcgaacgcaaauacggagucgcgucuaccugcagaaagacaaauaagcucuccccuuaugauaaacuggagggccuucugaucgcuugguuccagcagauccgggccgccgggcuccccguuaagggaauuauccugaaagagaaggcucugcgcauugccgaggagcucggcauggacgauuuuaccgcuagcaacggguggcuggacagauuccggcgcagacacggagugguguccuguucuggcgucgcccgggcgcgcgccagaaaugcugccccucggacacccgcugccccugcgagcccggccgcugugcccuccgaaggcagcgggggaucuaccacaggcuggagagcccgcgaggagcagccucccuccguugcugaaggguacgccagccaagauguguuuucugccaccgagacgucccuuugguaugacuuccugccugaucaggcugcgggacucugcggcggggacggacggcccagacaggccacccagcgccugagcguccuucugugugcuaacgccgauggcucugaaaaacucccgccucugguggccggcaaguccgcuaagccccgggccgggcaagcgggacugccuugcgacuacacagcuaauagcaaaggcgggguuaccacacaggcccucgccaaguaucugaaagcucuugauaccagaauggccgcugagucccgccgggugcugcuccuggccggaagacuugcggcccagucucuggacacgagcggccuccgccauguccagcuggccuuuuucccucccgggacagugcacccccuggaacggggagugguccaacagguuaagggccauuacagacaggcuaugcuccugaaagcuauggccgcgcuugagggccaagauccguccgggcugcagcucggacugaccgaggcccuucacuuuguggcugccgcuuggcaggccguggaacccagcgacaucgccgcuuguuuccgcgaggcgggcuuugggggaggcccuaacgccacaauuaccaccucucugaaguccgaaggggaggaagaggaggaagaggaagaggaagaggaggaagaggaaggcgagggagaggaagaggaagaggaaggcgaggaggaagaggaagaagggggagaaggcgaggagcucggggaagaggaagaggucgaagaggagggagacguggauagcgacgaagaggaagaggaggaugaagagucuagcuccgaaggccuggaggcugaagacugggcccaggggguuguggaggccggcggaucuuucggcgcuuauggggcccaagaggaagcgcagugccccacacugcauuuucucgagggaggcgaagauagcgacuccgauagcgaggaagaggacgaugaggaagaggacgaugaagacgaggacgaugacgaugacgaagaggauggggacgaggucccugugcccucuuucggagaagcuauggccuacuucgccaugguuaaacgguaccugacguccuuuccgaucgaugacagagugcagagccacauucuucaccuggagcaugaucucguccacgugacccggaagaaucaugcucgccaggccggcgucagagggcugggccaccaaucuuga

SEQ ID NO: 67298 - RNA, 2832 nt, Artificial Sequence
  derived and/or modified sequence opt5 from CENPC__Homo_sapiens__NP_001803
auggccgcuagcggccuggaccaccucaagaacggguacagacggcgcuucugcagacccucccgggcccgcgauaucaauaccgagcagggacaaaacgugcuggaaauucuucaggacuguuuugaggaaaaaucucuggcgaaugauuucagcacaaacuccacgaagucugucccuaauagcaccagaaaaaucaaggacacaugcauucaguccccgucuaaagagugucaaaagagccaucccaaguccguuccugugagcucuaaaaagaaagaagccucccuccaguuuguggucgagcccagcgaggccaccaaccggucugugcaggcccacgaaguucaucagaagauccuggcuacagauguguccagcaaaaauaccccugacucuaagaagauuuccagccgcaacaucaaugaucaccauuccgaggccgacgaagaguucuaucuuucugucggcagccccuccgugcugcucgaugcuaaaacaagcguuucucagaacgugaucccuuccagcgcccaaaagagagagaccuacacguuugaaaauucugucaacaugcugccgagcuccaccgaggugucugugaaaacaaagaaacggcugaauuucgacgauaaggucaugcucaaaaagauugaaaucgacaacaagguuagcgaugaggaagacaaaaccuccgaggggcaggagcgcaagcccagcggaucuucccagaaucggauuagagacagcgaauaugagauccagcgccaagcgaaaaagucuuuuuccacacuguuccuugaaaccgugaaaagaaagagcgaguccucuccuauugugcggcacgccgcuacggcucccccucacagcugucccccggaugacacaaagcugaucgaagaugaguuuauuaucgacgaguccgaucagucuuucgcuagccgcuccuggaucaccauuccuagaaaagccggcagccucaagcagcggacaaucucucccgcggaauccaccgcccugcuucaagggagaaaaagccgcgagaagcaucacaacauucugccuaaaacccucgcuaacgacaagcauucucacaagccccaccccgucgaaacaucccagccuagcgauaaaacggugcuggacaccucuuacgcccugaucggagagacaguuaauaacuaucggagcaccaaguacgaaauguauuccaaaaaugcugagaagccgagcagaucuaaacgcacaauuaagcagaagcagcggagaaaauuuauggccaagcccgccgaggaacaacucgaugugggccaguccaaagacgagaacauccauaccagccacaucacgcaggaugaauuucagcgcaauuccgaccggaacauggaggagcaugaagagaugggcaaugacugcgucucuaagaaacaaaugccucccguggggagcaagaaauccucuacaagaaaggauaaggaagagagcaaaaagaaacgcuuuuccucugaaagcaagaacaaacugguuccugaggaggugaccuccaccgucacaaagagccggagaauuucucgccggcccuccgacugguggguggucaagagcgaagagucuccgguguacuccaauagcucuguuagaaacgaacuuccuaugcaccauaauuccagccggaaauccaccaagaaaacaaaccagagcucuaagaauauccgcaaaaagacgauuccccugaagagacagaaaaccgcuacaaagggaaaccagcgggugcaaaaauuccucaaugcggagggcagcgggggaaucgucggccacgaugaaauuuccagaugcucucugagcgagccucuugaguccgacgaagccgaucuggcuaagaaaaagaaccucgacuguucucgcagcacccgguccucuaagaacgaggauaauaucaugacagcccagaacgugccccugaaaccucagaccagcggguacacgugcaauauccccaccgaauccaaccuggacagcggagagcacaagacaucuguucucgaagaguccggcccgagcagacugaauaacaauuaucuuaugucuggcaaaaacgauguggacgaugaggaaguccauggguccagcgacgauuccaagcagucuaaagugauuccuaagaaucgcauccaccauaaacuggugcuccccagcaacacccccaauguuagacggacaaagcgcaccagacugaagccucuugaguacuggcggggagaacgcauugacuaucaaggcagaccguccgggggauucgucaucagcggcgugcugucucccgacacgauuuccagcaaacggaaggccaaagagaacaucgggaaggugaauaaaaagucuaacaagaaacgcauuugucucgauaaugacgagagaaagacaaaccugauggucaaccugggaaucccucucggcgauccccugcagccuacccgggugaaagaccccgaaacacgcgagaucauucuuauggaucugguuagaccucaggacaccuaccaauuuuucgugaagcacggcgaacucaaagucuauaagacccuggauacacccuuuuucagcacggggaagcugauccuuggaccgcaggaggaaaaaggcaagcagcacguggggcaggacauucucguuuucuacgugaauuucggagaucugcugugcacccuccaugagacaccuuauauccuguccaccggcgacucuuuuuacguccccagcgggaacuacuauaauauuaaaaaccuucggaaugaggaauccgugcuccuguucacacaaaucaagagauga

SEQ ID NO: 67299 - RNA, 7743 nt, Artificial Sequence
  derived and/or modified sequence opt5 from CENPE__Homo_sapiens__NP_001273663
auggcugaggaaggcgcuguggcggugugcguuagagugcggccccugaacagcagagaggaaucccucggggagaccgcccagguguacuggaagacagacaauaacgucaucuaucaaguggauggaucuaagagcuucaauuuugacagaguuuuccacggcaacgaaacgaccaagaauguguacgaggagauugcugccccuaucauugauuccgccauccagggguauaacggaacaauuuuugcuuacggccagaccgccucugggaaaacauauaccaugaugggaagcgaagaccaucugggcgucaucccgcgggcuauccacgauauuuuccagaagaucaaaaaguuucccgaccgcgaguuccuucugagaguguccuacauggaaauuuauaaugagacaaucaccgaucuccuguguggcacgcaaaagaugaaaccucuuauuauccgggaggacguuaaccgcaauguguacgucgccgaucugaccgaagaggugguguacacaucugaaauggcgcucaaguggauuaccaaaggggaaaagagcagacauuauggagaaacaaaaaugaaccagcgguccagccgcucucacaccaucuuuagaaugauccuggagucccgggagaagggcgaacccagcaauugcgaggggucugucaagguuucccaucugaaccucguggaccuggccggaagcgaacgcgcugcccagacgggcgcugccggggugagacuuaaagagggauguaauauuaaccggucucuguucauccucggccaggucauuaagaaacuguccgauggccaagucgggggauuuaucaauuaccgcgacagcaaacuuacacgcauucugcagaacucccucggcgggaacgcgaaaacccggaucaucugcacaauuaccccuguuucuuucgaugaaacccugacagcccugcaguuugcuagcacggccaaguauaugaaaaauacccccuacgugaacgaggucuccacagacgaggcucuccugaagagauaucgcaaggaaaucauggaccuuaaaaagcagcuggaggaagugagccucgagacccgggcccaagccauggaaaaagaucagcuggcucagcuucuggaggagaaggaccuccugcaaaaaguucagaaugaaaagauugagaaccugacaagaaugcucgugaccucuuccagccugacgcuucagcaggaacugaaggcgaaacgcaagcggagagucacauggugucucggaaaaaucaauaagaugaaaaacucuaauuacgccgaucaauucaacauuccuaccaauaucaccacaaagacccacaagcugagcaucaaccuucugcgcgagauugacgaguccgugugcucugaaagcgaugucuuuuccaauacacucgacacgcugagcgagaucgaauggaacccggcuaccaaacugcucaaucaggagaacauugaaucugagcucaauucccuucgggccgauuaugacaaccuggugcucgauuacgagcagcugagaacagaaaaggaggaaauggagcugaaacuuaaggagaagaacgaccucgaugaguucgaggcccuggaacgcaagaccaagaaagaccaggagaaugaacugagcucuaagguugagcuccugcgggaaaaagaggaccaaaucaagaaacuucaggaguacauugauucccagaagcuggaaaacaucaaaauggaccucagcuauucccuggagucuauugaagaucccaagcagaugaagcaaacacuguucgacgcugagaccguggcccuugaugcgaaaagagagagcgcuuuucuccgcuccgaaaaucuggagcugaaggagaagaugaaggagcucgccacgaccuacaaacagauggaaaacgacauccagcuguaucagucucaacuugaggccaagaagaaaaugcaggucgaucuggagaaggaacuccagagcgcuuucaaugagaucacaaaacugaccucccugauugacggcaaggugccuaaagaucuucucuguaaccuggaacuggaggggaagaucacagaccuccaaaaggaacugaauaaagagguugaggaaaacgaggcccuucgggaagaggugauucugcucagcgaacugaagucucugcccuccgaggucgagagacuucggaaagaaauccaggauaagagcgaggaacuccacauuaucaccucugagaaagacaagcuguuuuccgagguggugcauaaggaaagccgcguucagggacugcucgaggaaaucggcaaaacgaaggaugaccuggcuacaacccagucuaauuacaaaagcacagaccaagaguuccagaacuuuaagacccuucacauggauuucgaacagaaauauaagaugguccuggaggagaaugaaagaaugaaccaggagauugugaaucucuccaaagaagcccaaaaguuugacagcucucugggcgcgcugaagaccgagcuuuccuacaaaacacaggaacugcaggagaagacgcgggaggugcaggaaagacucaacgagauggaacaacugaaagagcagcucgaaaaucgcgauagcacccugcagacagucgagcgggagaagacccuuaucacagaaaaacugcaacagacccucgaggaagugaagacgcugacacaggagaaggacgaucugaaacagcuucaagagucccugcagauugaaagagaccagcucaagucugauauccaugacaccguuaacaugaacauugauacccaggagcaacugcgcaaugcccucgaaagccugaaacagcaccaggagacaaucaacacccuuaaguccaaaaucucugaagaggugagcagaaaucugcacauggaggaaaacacaggggagacgaaggacgaguuccagcaaaagauggucggaauugauaaaaagcaggaccucgaggcuaaaaauacccagacacugaccgccgaugugaaggacaacgaaaucauugagcagcaacggaaaaucuuuucccugauucaggagaagaaugaacuucagcaaaugcuggagucuguuaucgcugaaaaggagcagcucaaaacagaccugaaggaaaacaucgagaugaccauugagaaucaggaggaacugcgccugcuuggcgaugaacugaaaaagcagcaagagaucguggcccaggagaaaaaccaugcgauuaagaaggaaggggagcugagcagaacgugcgaccggcucgccgaagucgaggaaaaacugaaggagaaaucccagcagcuucaagagaagcagcagcagcugcucaaugugcaagaagagaugagcgaaaugcagaaaaagaucaacgagauugaaaaucugaaaaacgagcucaagaauaaggagcugacccuugaacacauggagacagaacgccuggagcuggcucagaaacucaacgaaaacuaugaggagguuaagucuaucaccaaagaaagaaaggugcugaaagagcuucaaaaguccuucgaaacagagcgggaucaucugcgcggauacauuagagagaucgaagccaccggccuccagacaaaggaggaacugaaaaucgcucacauucaucucaaggagcaccaggaaaccaucgacgagcugcggcgcagcgucucugagaaaacggcccagauuaucaauacacaagaucuugaaaagucccacaccaaacugcaggaggaaauuccugugcugcaugaggaacaggagcuccugcccaacgugaaggaggucagcgaaacccaggagacaaugaaugaacuugagcugcucaccgaacaaucuacgacaaaggacuccaccacacuggccagaaucgagauggagcggcucagacugaacgaaaaauuucaggagagccaggaagagaucaagucccuuaccaaagagcgcgauaaucugaagacaauuaaagaagcucuggagguuaagcacgaccagcucaaggaacauauccgggagacccuggcgaaaauucaagaaagccagucuaagcaggagcagagccuuaacaugaaagagaaggauaaugaaacgaccaaaaucguguccgagauggaacaauucaagccgaaagacucugcccugcucagaauugagaucgaaaugcuggggcugagcaagcgccuccaggagucccacgaugagaugaagucuguggcuaaagaaaaggacgaccuucagcggcugcaagagguccugcagagcgaauccgaucagcucaaagagaacaucaaggaaauuguggccaaacaccuggagacagaggaggaacuuaagguugcccauuguugccugaaggaacaggaggagaccaucaaugaacucagagugaaccugucugagaaagaaacagagauuagcaccauccaaaagcagcuggaagcuauuaaugacaaacuccagaacaagauccaggagauuuacgagaaagaagaacaauuuaauaucaagcagaucuccgaaguccaggagaaggugaacgaacuuaaacaguucaaggagcaccgcaaagccaaggauagcgcgcugcaaucuauugaguccaaaaugcuggaacucacgaaucggcugcaggagagccaggaagagauccaaauuaugaucaaggaaaaggaggagaugaaaagaguucaggaagcccuucagauugagcgcgaccagcugaaggaaaacacaaaagagaucguggccaagaugaaagagucucaagaaaaggaguaucaguuccucaaaaugaccgccgucaaugaaacacaggagaagaugugugaaaucgagcaucugaaggagcaguuugaaacccaaaaacugaaccucgagaacauugaaaccgagaauauccggcuuacacagauucugcacgaaaaccuggaggagaugagauccgugacgaaggaacgggaugaccuccgcagcguugaggaaacccugaaaguggagagagaucagcuuaaggaaaaucugcgggagacaaucacccgcgaccucgagaaacaggaagaacugaagauuguccauaugcaccugaaggaacaccaagagacaaucgauaaacucagaggcaucguguccgagaagaccaacgaaauuucuaauaugcagaaagaccuugagcauagcaacgaugcucugaaggcccaggaccugaaaauccaagaagaacuccggauugcgcacaugcaucugaaggaacagcaggagacgaucgauaaacuuagaggaauuguguccgagaaaacagacaagcugagcaauaugcagaaagaccucgaaaacucuaaugcuaagcugcaagagaaaauccaggaacugaaggccaacgagcaccagcucauuacccuuaagaaagaugucaaugaaacccagaagaaaguuuccgagauggagcaacugaagaaacagaucaaggaccagagccugacacucucuaagcuggaaaucgagaaccuuaaucuggcccagaaacuccaugaaaaccuggaggaaaugaaaagcgugaugaaagagcgcgauaaucugcggagaguggaggaaacccucaaacuugagcgcgaccaacugaaagaaucccugcaggagacaaaggcucgggaucucgagauucagcaggaacugaaaacggccagaaugcuuucuaaggagcacaaggaaaccgucgacaaacugcgcgagaagaucagcgagaagacaauucaaaucuccgauauucagaaggaccucgauaaaucuaaggacgagcugcagaagaaacaagaucggcagaaccaccaggugaagccugagaaaagacugcucagcgacggccagcaacaucuuaccgaaucccugcgcgagaagugcagcagaaucaaagaacugcucaagcgguacucugagauggaugaccacuaugaaugccugaaccgccuuucccuggaccucgagaaggagaucgaguuccagaaagagcugagcaugagaguuaaggcuaaucugucccuccccuaccuucagacaaaacauauugaaaagcuguuuaccgccaaccagcgguguucuauggaguuccaccgcaucaugaaaaagcugaaguaugugcucagcuacgucacgaaaauuaaggaagaacaacacgaguccaucaauaaauuugaaauggauuucauugacgagguggaaaagcagaaagagcugcuuaucaagauccagcaucugcagcaagauugcgacguuccuucuagagagcuccgggaucugaaacugaaccagaauauggaccuccacauugaagagauccuuaaggauuuuagcgaauccgaguuccccagcauuaagaccgaauuucagcaagugcugucuaacagaaaagagaugacacaguuccuggaggaauggcucaauacccgcuuugacaucgagaagcugaaaaacgggauucagaaggaaaaugaucggaucugucaggucaacaauuucuuuaacaauagaauuaucgcgaucaugaacgaguccacagaguucgaggagcgcagcgccaccauuucuaaagaaugggagcaagaccuuaagucccugaaggagaagaaugagaaacucuucaaaaacuaucagacacugaagacgagccuggcuucuggagcccaggugaaccccaccacacaggauaauaaaaacccucaugucaccagccgggcuacccaacucacaacggaaaagaucagagagcuggaaaauucccuucacgaagccaaggagucugccaugcauaaagaaagcaagauuaucaaaaugcagaaggagcuggaggugaccaacgacauuaucgcuaaacuccaggcgaagguucacgaauccaauaagugccuggagaaaacaaaggaaaccauccaggugcuucaagacaaagucgcccugggcgcuaagccguacaaagaggaaauugaggaucucaagaugaaacuggugaagaucgaccuggagaagaugaaaaacgccaaggaauuugagaaagaaauuagcgccacaaaggcuaccguugaguaccagaaagaagugauccggcuccugcgcgagaaucuuagacggucccagcaggcccaagauacgucugucauuagcgagcacacagacccccagccuuccaacaagccccugaccugugggggaggcucugggaucgugcagaauaccaaggcgcucauccugaaaagcgaacauauucgccuugagaaggaaaucuccaaacugaagcaacagaacgagcagcucauuaaacagaagaaugaacugcugucuaacaaucaacaccucagcaacgaggugaagacauggaaagagagaacccugaagcgggaagcucauaaacagguuacaugcgaaaauuccccuaagagccccaaagucaccggcacggccucuaagaagaaacagaucacaccgucccaguguaaggaacgcaaccuucaagauccugugcccaaagagagcccuaagucuugcuucuuugacuccagaagcaaaucucugcccuccccucaccccgugcgguauuucgauaacagcucccucggacuguguccggagguccagaaugccggcgcugaaagcguggacucucagccugggcccuggcacgccagcuccggaaaggauguucccgagugcaagacccaguga

SEQ ID NO: 67300 - RNA, 9345 nt, Artificial Sequence
  derived and/or modified sequence opt5 from CENPF__Homo_sapiens__NP_057427
augagcugggcccuggaggaauggaaggagggccuccccaccagagcucugcagaaaauccaagaacuugaggggcagcuggacaagcucaaaaaggaaaaacagcagcggcaauuccagcuggauucccuugaggccgcccugcagaagcagaagcaaaaaguggagaaugaaaagacagagggaacgaaucucaaacgcgaaaaccagagacugauggagauuugcgagucucuggaaaagaccaaacagaagaucagccacgagcuccaggucaaggaaucccaaguuaauuuucaggagggccagcugaacucugggaaaaagcaaauugaaaaacuugagcaggagcugaagcgguguaaaagcgaacucgagcgcucccagcaggcugcccaaucugccgacgugagccugaauccuugcaacacaccgcagaagaucuucaccacaccccuuaccccuucccaguacuauagcggaucuaaauacgaagaucugaaggagaaguauaauaaagaaguggaggagagaaagcggcucgaagcugaggucaaagcccugcaggcuaagaaagccucccaaacacugccccaggcgaccaugaaccaucgcgacauugccagacaccaggcuuccucuagcguguuuagcuggcagcaagaaaagacgccuucucaucucuccagcaauucccagcggacccccauccgcagagauuucucugccagcuacuuuuccggcgagcaggaaguuacaccuagccggucuacccugcagaucgggaagcgcgacgcuaacuccagcuucuuugauaauucuagcuccccgcaccuucuggaccaacucaaagcccagaaccaggagcugagaaauaagauuaacgagcuugaacugcggcuccaaggacaugagaaagaaaugaagggccaggugaauaaauuccaggagcugcagcugcaacucgagaaggcgaaggucgaacugaucgagaaagaaaaggugcuuaacaaaugucgcgaugagcugguuagaacaaccgcccaguaugaccaggcuucuacgaaguacacagcccucgaacagaaacugaagaaacuuaccgaggaucugagcugccaacggcagaacgcugaguccgccagauguagccucgaacagaaaauuaaggagaaagaaaaggaguuucaggaggaacugucucgccaacagcgguccuuccagacacuggaccaagagugcauccagaugaaagccagacucacccaggaacugcagcaagcuaagaauaugcacaacgugcuucaggcggagcuggauaaacucaccagcgucaagcagcagcuggaaaauaaccuggaggaauuuaagcaaaaacuuugucgcgccgagcaggcuuuccaggccucucagauuaaggagaaugaacuccggagauccauggaggaaaugaaaaaggagaacaaucugcugaaaagccacuccgagcaaaaggcccgcgaagugugccaucucgaggcugaacugaagaacaucaaacagugucuuaaucagucucagaacuuugccgaggaaaugaaggcgaaaaauacaagccaagagacgaugcugcgggaccuccaggagaagauuaaccagcaagaaaauucccugacccuggagaaacuuaagcucgcuguggccgaccuggaaaagcagagagauugcucucaggaccugcucaaaaagcgcgagcaccauaucgaacagcugaacgauaaacuuagcaagacagagaaagaguccaaggcccugcucagcgcucuggaacugaagaaaaaggaguaugaggaacuuaaagaagagaagacccucuucucuuguuggaaauccgagaaugaaaagcugcugacacaaauggagagcgaaaaagagaaccuccagucuaagaucaaccaccuggagaccugccuuaagacgcagcagauuaaaucccacgaauacaaugagcgggucagaacacuggaaauggaccgcgagaaccucagcguugaaauccggaaucugcauaacgugcuggauucuaagagcguggaggucgagacccaaaaacuugccuacauggaacuccagcagaaggcugaguucuccgaccagaaacaccaaaaggaaauugagaauaugugccugaagaccagccagcugacaggccagguggaagaucucgagcauaaacugcaacuucugucuaacgagaucauggacaaggauagauguuaucaggaccuccacgccgaauacgagucccugcgggaucugcuuaaaagcaaggacgcgucccugguuaccaaugaagaccaucagcgcucucuccuggccuuugaucagcaacccgcuaugcaccacagcuucgccaacauuaucggggagcagggauccaugccuucugaaagaagcgagugccggcucgaggcugaccagucccccaaaaauucugccauccugcagaacagaguggauagccuugaauuuucccuggagagccaaaagcagaugaacucugaccuccagaagcagugugaagaacugguccaaauuaaaggcgagaucgaagagaaccugaugaaggcggaacagaugcaucaguccuucguggccgagacaagccagcgcauuucuaaacuucaagaagauacguccgcucaccagaauguuguggccgagacccugagcgcucucgagaacaaggaaaaagagcugcagcuccugaaugacaaggucgaaacagagcaagccgaaauccaggagcuuaagaaaucuaaccaucugcucgaggauucccugaaggaacugcagcuucugagcgagacccucucccuggagaagaaggagaugagcucuauuaucagccucaacaaacgggaaaucgaggagcugacacaggaaaaugggacccuuaaggagauuaacgccucccugaaucaagaaaagaugaaccugauccagaaaucugagagcuuugcuaauuauauugacgagagagaaaaguccaucucugagcucagcgaucaguacaaacaggaaaagcugauucuucugcaacgcugcgaggaaacgggaaacgcguaugaggaccucucccagaaauacaaggccgcucaggagaaaaauucuaagcuggaaugucuccugaacgagugcaccagccuuugugaaaauagaaagaacgagcuggaacagcugaaagaggccuucgccaaggagcaccaagaauuucucacaaaacuggcuuucgccgaggaacggaaucagaaccuuaugcuggagcucgaaaccgugcagcaagcgcugcgcuccgagaugacagauaaucagaacaauagcaagucugaggcuggcgggcucaaacaggaaaucaugacccugaaggaggaacagaacaagaugcaaaaagaggucaacgaccuucugcaggagaaugaacagcugaugaaggugaugaaaacgaagcacgagugccagaaccucgaauccgagccuauuagaaauagcguuaaagaacgggagucugagcgcaaccaauguaauuuuaagccccagauggaucuggaagugaaggagaucucccuugacagcuauaacgcccagcugguccagcucgaagccaugcugagaaauaaagagcucaagcugcaagaauccgagaaagagaaggaaugccuucagcaugagcugcagacaauccggggagaccuggaaaccucuaaccuccaagauaugcagagccaggagauuuccggccugaaagacugugaaaucgaugcugaggagaaguacauuagcggcccgcacgaacuuucuacaucccagaaugacaacgcccaucugcaaugcagccuccagaccaccaugaauaagcugaacgagcuggagaagaucugcgagauucuccaggcggagaaguacgaacuugugacagagcugaaugauucucgcagcgaauguaucacggcuaccagaaaaauggccgaggaaguugggaagcugcucaacgaggugaaaauccugaaugacgauuccggacuucugcacggcgagcucgucgaagacauuccugggggagaguucggcgaacagcccaacgagcaacauccugugucucuggcgccccuggaugaaagcaauuccuaugagcaccucacacuuucugacaaggaggugcagaugcacuuugcugaacugcaggagaaauuccugagccuccaguccgaacauaagauccugcacgaucaacauugccagaugagcucuaagauguccgagcuucagaccuacguugacagccugaaagccgaaaaccucguccuguccacaaaccugcggaauuuucagggggaucucgugaaggagaugcaacuuggacuggaggaaggccuggugcccucucucagcuccucuugugucccugacagcuccagccugucuucccuuggcgacagcucuuucuaucgcgcucugcucgagcagaccggggauaugucccugcugagcaaccucgaaggagccgugucugcgaaucagugcagcguugacgagguguucuguuccucucuucaagaggaaaaccugacgagaaaagagacaccgagcgcccccgcuaagggcgucgaagaacuggaaucccucugcgagguguaccggcagagccuggagaaacuugaagagaagauggaaucccaggggauuaugaagaauaaagagauccaggaacuggagcaacuccugucuagcgagagacaggaacuggauugucuccgcaagcaguaucuuuccgagaacgaacaguggcaacagaaacugaccucuguuacccuggagauggaaagcaagcucgccgcugagaaaaagcagacagagcagcugucccuugaacuggagguggcccggcuccaacugcagggacuggaccucucuagcagaucccuucugggcauugauaccgaagacgccauccaggggcgcaaugagagcugcgauaucucuaaggagcacacauccgaaacgaccgagcggacaccuaaacaugacguccaccaaauuugugauaaggacgcucagcaggaucugaaccucgacaucgagaaaauuaccgagacaggcgcggugaagcccaccggagaaugcagcggcgagcagucuccugacacgaauuacgagcccccgggggaagauaaaacccaaggauccagcgaguguaucucugaacuguccuuuagcggcccuaacgcccuuguucccauggacuuccuggggaaucaggaggauauucacaaccuccagcugagagugaaggaaacauccaaugagaaccugcgccuccuucaugucaucgaggaccgggauagaaagguggaaagccugcugaaugagaugaaagaacucgacucuaagcugcaccuucaggaggugcaacugaugaccaaaaucgaggcuugcauugaacucgagaagaucgucggagaacugaaaaaggagaacagcgaucuguccgaaaaacucgaguauuuuucuugcgaccaucaggagcuucugcagcgcguugaaacaagcgagggccugaacuccgaucucgaaaugcacgccgacaagucuagccgggaggauauuggggacaauguggccaaggugaacgauuccuggaaagaaagauuccuggacgucgagaaugagcuuucucggauccgcagcgaaaaggcuuccauugagcacgaagcccuguaccucgaggcggaccuggaagugguucagaccgagaaacugugucucgagaaggauaacgaaaauaaacaaaaggugaucgucugccuugaggaagaacugagcgugguuacaucugaaagaaaccagcugcggggcgagcucgacaccauguccaagaaaacgacagcucuggaucagcuuagcgagaagaugaaagaaaagacccaggagcuggaaucucaucaauccgagugucuccacugcauucagguggccgaggccgaagucaaagagaagaccgaacugcugcagacacucagcuccgacgugucugagcugcuuaaggauaaaacccaucugcaagaaaagcuccagagccuggagaaagacucccaggcucuuagccugacgaagugugagcucgaaaaucagaucgcccaacugaacaaagagaaggaacugcucguuaaggagucugaaucccugcaggcgcgccuuagcgagucugauuacgagaaacugaaugugagcaaggcucucgaagccgcccuggucgagaaaggagaauuugcucuuagacuguccucuacacaggaggaagugcaccagcuccggagaggcaucgagaagcugcgcgugcggauugaggccgacgagaaaaagcaacugcauaucgcugagaagcucaaagaaagagagcgcgagaacgauagccugaaggacaaagucgaaaaucuugagcgggaacugcagauguccgaggaaaaccaggagcucguuauucuggaugccgaaaauucuaaggcggaaguggagacccuuaaaacacagaucgaagagauggccagaagccugaagguguucgaacucgaccuggucacccugcgcuccgagaaagagaaccucacaaagcaaauucaggaaaagcaggggcaacugagcgagcuugauaaacugcucucuuccuuuaagagccugcuugaagagaaagaacaggcugagauccagaucaaggaggaauccaaaaccgccguggagaugcugcagaaucaacucaaggaacugaacgaggcuguugccgcccugugcggagaccaggagauuaugaaggcuacggaacagucucucgacccucccaucgaggaagaacaccagcugcggaacagcauugaaaaacuuagagcgcgccuggaggccgaugagaagaaacaacucugugugcugcagcagcuuaaggaauccgagcaccaugcugaccugcucaaaggcagagucgaaaaucuggagcgggaacuggagaucgcccgcaccaaccaggagcacgccgcucucgaagccgaaaauucuaagggggaaguggagacacugaaggcgaaaauugaaggaaugacccaaagccuuagaggccuggagcucgauguugugacaauccgguccgagaaggaaaaccugaccaaugagcuucagaaagaacaggagcgcaucagcgagcuggaaauuaucaacucuuccuucgagaauauucuccaagaaaaggagcaggaaaaaguccagaugaaggaaaagagcucuacggcuauggagaugcugcagacacaacugaaagaacucaacgagagaguggccgcccugcauaaugaccaggaggcuugcaaggccaaagagcagaaccuuuccagccaggucgaaugucuggagcucgagaaggcgcaacugcuucaggggcuggaugaagccaaaaauaacuauaucgugcuccagucuuccguuaauggccugauucaggagguggaagacggaaagcaaaaacuggagaagaaggaugaagagaucagccggcuuaaaaaccagauucaggaccaggagcaacuggucucuaagcucagccagguggaaggcgagcaccagcuguggaaagaacaaaaucucgagcugagaaaccuuaccguugagcuggaacagaagauccaggugcugcaguccaaaaacgcuagccuccaagauacacuggagguccuucaguccucuuacaagaaucuggaaaacgagcucgaacugaccaagauggacaaaaugagcuuuguggagaaggugaauaaaaugaccgccaaggagacagaacuccagcgcgagaugcacgaaauggcucagaaaacggccgagcugcaagaggaacuguccggggagaagaaccggcuugcuggagaacugcagcuccugcuugaggaaaucaagucuagcaaagaucagcugaaggagcucacccuggaaaauuccgagcucaaaaagucucuggacugcaugcauaaagaccagguugagaaggaaggcaaggucagagaggaaauugccgaguaucaacugcgccuucacgaggcggagaaaaagcaucaggcccugcuccuggauacaaacaaacaguacgagguggaaauccaaaccuaucgggagaaacuuacaagcaaagaagagugucuguccagccagaagcucgagauugaccugcugaaaucuuccaaggaggaacucaauaacagccugaaggcuaccacgcagauccuugaggaacugaaaaagacaaaaauggauaaucucaaguacgugaaccagcugaaaaaggaaaaugagagagcccaagggaagaugaaacuucugauuaagucuugcaaacagcucgaggaagagaaggaaauccugcagaaagagcugucccagcuccaagcugcccaggaaaagcagaagaccggaaccgucauggacacaaaaguggaugagcugaccacagagaucaaggaacuuaaagagacgcuggaagagaagaccaaagaggccgacgaauaucucgauaaguacugcagccugcuuauuucucacgagaagcuggaaaaagcuaaggagaugcucgaaacacagguugcgcaucuguguucccaacagagcaaacaggacucucggggcuccccucugcucgggcccguggucccgggcccuagccccauccccagcgugaccgagaagcgccuguccucuggacagaacaaagccagcggcaagagacaacgguccucugggauuugggagaauggacgcggcccuacaccggcuacccccgagagcuucuccaagaaaucuaagaaagccguuaugagcgggauccacccugccgaggauacggaaggaaccgaguuugaacccgagggccuuccugagguggucaagaaaggcuucgcugacauucccacagggaagaccuccccuuacauccugagacggacaaccauggccacacgcacgagccccagacucgcggcccagaaacuggcucuuucuccgcugucccucggaaaggaaaaccuggccgagagcucuaagccuaccgcuggcgggucccggagccagaaagugaagguugcccaacgcucccccguggauucuggaacaauccugagagaaccuaccaccaaaagcguccccgugaauaaccucccggagcgguccccuacagacucucccagagaaggccugcgcgugaagcgggggagacuugucccuagccccaaagcgggacuggaguccaacggcagcgagaauugcaagguucaguga

SEQ ID NO: 67301 - RNA, 744 nt, Artificial Sequence
  derived and/or modified sequence opt5 from CENPH__Homo_sapiens__NP_075060
auggaggaacagccccaaaugcaggacgccgaugagccugcugacagcggcggggaaggcagagccggagggccgccccagguggcgggagcucaggccgccugcuccgaggaucggaugacccugcuccugcgccuuagagcucaaacaaagcagcagcugcucgaauacaaaucuauggucgacgccagcgaggagaagacgccugaacagaucaugcaagagaaacagauugaagcuaagaucgaggaucuggagaacgaaauugaggaaguuaaaguggccuucgagaucaagaaacuugcgcuggaccggaugcgccucuccaccgcccugaaaaagaaucuggaaaagauuucuagacagagcuccgugcucauggauaacaugaagcaucugcuugagcugaauaaacucaucaugaagucucagcaagagagcugggaccuggaagagaaacuucuggauauccggaagaagcgccuccagcugaaacaggcuuccgaaagcaagcugcucgagauucaaacagagaaaaacaagcagaaaaucgaccuggauucuauggaaaauuccgagagaauuaagaucauucggcagaaccuucagauggaaaucaagauuaccacagucauccaacacguguuucagaaucugauccucggcagcaaaguuaacugggccgaggaccccgcucugaaggaaauugugcuucagcuggagaaaaaugucgauaugauguga

SEQ ID NO: 67302 - RNA, 4017 nt, Artificial Sequence
  derived and/or modified sequence opt5 from CENPJ__Homo_sapiens__NP_060921
auguuccugaugcccaccagcuccgagcucaacucuggccagaauuuucugacacaauggaugacgaacccuagcagagccggggugauccuuaaucggggauucccgauucuggaagcugacaaggagaaacgcgccgcggucgauaucuccaccucuuuucccauuaagggcacacacuucagcgacuccuuuucuuucaucaacgaagaggauagccuccuggaagaacagaaacuugaguccaauaacccuuacaagccccagagcgacaaaucugaaacccauacagcuuuuccuugcauuaagaaggggccccagguugccgccugucacuccgcuccuggacaucaagaggaaaauaaaaacgauuucaucccggaccuggccagcgaguuuaaggagggcgcuuauaaagauccccucuucaagaaacuggaacagcugaaggaggugcagcagaagaaacaagaacagcucaagagacagcagcuggagcaacuucagcggcugauggaagaacaggagaaacuccugaccauggugucugggcaaugcacacuuccuggacugucccuccugcccgacgaucagagccagaagcaccgcucuccuggcaauaccacgaccggcgaaagagccacauguugcuuucccuccuacgucuauccggacccuacccaggaggaaacauaccccagcaacauccugucccaugagcaaucuaauuucugucggaccgcgcacggggauuuugugcucacgagcaaacgcgccuccccuaaccuguucagcgaagcucaguaucaggaggcccccguugagaagaauaaccuuaaagaagagaauagaaaccaccccacaggagaaucuauucugugcugggagaaggugaccgaacagauccaagaggcuaacgacaagaaucuccagaaacaugaugacuccagcgaggucgccaacauugaggagcggccuaucaaggcggccauuggcgaacgcaaacagacauucgaggacuaccuggaggaacagauccaacuugaggaacaggagcugaagcagaaacagcucaaggaagcugaggggccgcugcccauuaaggccaaaccuaagcaacccuuucugaaaagaggagagggccucgcucgguucaccaaugccaagucuaaauuucagaaggggaaggaaagcaaacuggugaccaaccaguccacaucugaggaucaaccucuuuucaagauggaccgccagcagcugcagagaaaaacggcccucaagaauaaagaacugugugcugauaaccccauccuuaagaaggacagcaaagcgcggaccaaguccggaagcguuacacugucucaaaaaccgaagaugcucaaaugcuccaaucgcaagagccugucuccuuccggccugaaaauccagaccggcaagaagugugaugggcaguuuagagaccagauuaaauucgagaacaaggugacaagcaauaacaaagaaaaugucaccgagugccccaagccuugugauacgggaugcacaggcuggaacaaaacccaagggaaggaccggcucccccuguccaccggaccugccucuagacuugcugccaagagccccauccgcgagacaaugaaagaauccgagucuagccuggaugugucccuccagaagaaacuggaaaccugggagcgggaaaaggagaaagagaaucuggaacuugacgaguuucucuuccuggaacaggccgcugaugagauuagcuuuucuuccaacagcucuuucgugcugaagauccucgagagagaccagcaaauuugcaagggccaccgcauguccagcacaccggucaaagccguuccucagaagacgaaucccgcggaccccaucucucauuguaaccggagcgaagaucuggaccacaccgcuagagagaaagaauccgagugcgaaguggccccuaagcagcuucacagccugucuuccgccgaugagcuccgcgagcaaccguguaaaauccggaaggcugugcaaaagagcacauccgaaaaccagaccgaguggaaugccagagacgaugaagggguccccaacucugacagcuccacagauucugaggaacagcuggacgugaccauuaaaccuagcacggaggaucgcgagcggggaaucuccucuagagaagacagcccccagguuugcgaugacaagggcccuuuuaaagauacccgcacacaggaggacaagcggagagacguggaucuggaccuuuccgauaaagacuauagcucugaugaauccauuauggagagcaucaagcauaaagucucugaacccucccggucuagcucccucagccuguccaagauggacuucgaugacgagcgcaccuggacagaucuggaggaaaaucucuguaaccacgacgugguucugggcaaugagagcaccuacgggacgccucagacaugcuaccccaacaaugaaauuggaauccuugauaagaccaucaaaagaaagauugcuccggugaaacggggcgaggaccugucuaagagcagacgcucccggucuccucccacaagcgagcucaugaugaaauuuuucccuucccugaagcccaagccgaaaucugauagccaucuggggaacgaacuuaagcucaauaucucccaggaccaaccucccggagacaacgccagaucucagguccugcgcgagaaaauuaucgaacuggagaccgaaauugagaaguucaaagcggagaaugccagccucgcuaagcugagaaucgaacgggaguccgcccuugaaaagcugcgcaaagagauugcugauuuugaacagcagaaggccaaagagcucgcgagaaucgaggaguucaagaaagaggaaaugcggaagcugcaaaaggagcgcaaaguguuugaaaaguauaccacagccgcuagaacguucccugacaaaaaggagcgggaggaaauccagacccugaaacagcagauugccgaucuucgcgaggaccucaagagaaaggaaacaaaauggagcucuacccacucccggcugcgcagccaaauccagaugcuggucagagagaacacagaucuccgggaggaaauuaaggugauggagagauuucgccuggacgcuuggaaacgggccgaagccaucgagucuucccuugaaguugagaagaaagauaagcuggcuaauaccagcgugagauuccagaacucccaaauuucuagcggcacgcaggucgagaaauacaagaagaauuaucuccccaugcaggggaaucccccucgccgguccaaaagcgcgccgcccagagaccugggcaaccuggauaagggacaggccgcuucuccucgcgaaccccuugagccucugaacuuucccgacccugaauacaaagaggaagaggaggaucaagacauccagggcgaaaucucccauccggacgggaagguggagaaaguuuauaagaacggaugucgggugauucucuuccccaauggcacaagaaaggaagucagcgccgaugggaaaaccaucaccgugacauuuuucaacggagacgugaagcagguuaugccugaucagcgcgucauuuacuauuacgccgcugcccaaaccacacacacgaccuaccccgagggccuggaagugcuccacuuuucuagcgggcagaucgagaaacauuauccugacggccggaaggagauuacauuccccgaucagaccgugaaaaaucuguuuccggacggacaggaagaguccaucuucccugauggcacaaucgucagagugcaacgggacgggaacaaacuuauugaguucaauaacggacagcgcgaacugcacaccgcgcaguuuaagagacgggaguaccccgauggcacgguuaagaccguguaugcuaaugggcaucaagaaacaaaguaccgcucuggaagaauccgggucaaagacaaggagggcaacgugcucauggauaccgaacuguga

SEQ ID NO: 67303 - RNA, 810 nt, Artificial Sequence
  derived and/or modified sequence opt5 from CENPK__Homo_sapiens__NP_001253967
augaaccaggaggaccuggaucccgacagcaccacagaugugggcgacgucacgaauaccgaagaggaacucaucagagagugcgaagagauguggaaggauauggaggaaugucaaaacaaacugucccuuauugggacagagacccugacagacucuaaugcccagcucagccugcuuaucaugcagguuaagugccugaccgcugaacucucccaguggcagaaaaagacaccugagaccauuccgcugacggaggaugugcugaucacccucggaaaagaagaguuccaaaagcugcggcaggaccuugaaauggugcugucuacaaaggagagcaaaaacgaaaagcucaaagaggaucuggagcgcgaacagagauggcuugacgagcaacagcagauuauggaaucccugaauguccuccacucugagcugaagaacaaaguggaaaccuuuagcgagucccggaucuucaaugagcugaagacaaagaugcucaacaucaaagaauacaaggagaaacugcuuagcacccugggcgaauuucucgaggaucauuucccccugccugaccgcucuguuaagaaaaagaaaaagaauauucaggaauccagcgugaaccuuaucacgcugcacgagaugcucgagauucugaucaauagacuguuugaugucccccaugacccuuaugugaagauuucugacuccuucuggcccccuuacguugaacuccugcuucggaacgggaucgcccugcgccacccggaggaucccacacggauuagacucgaagcguuucaucaauga

SEQ ID NO: 67304 - RNA, 1062 nt, Artificial Sequence
  derived and/or modified sequence opt5 from CENPN__Homo_sapiens__NP_001094095
auggacgagaccguggccgaguucaucaagagaacaauucugaaaauccccaugaacgaacucacgaccauucugaaggcuugggauuuucuuagcgaaaaucagcugcaaacagucaacuuccggcagcgcaaagaguccguugugcagcaccucauccaucugugcgaagagaagagagccucuauuagcgacgcggcccuucuggauaucaucuacaugcaguuucaccaacaucagaaagugugggaggucuuccagauguccaagggcccuggggaagacguggaucucuuugacaugaagcaguucaaaaauucuuuuaagaaaauucugcaacgggcucugaagaacguuaccgugagcuuccgcgagacagaagagaaugccgucuggaucagaauugcuuggggaacccaguauacaaaaccgaaccaguacaagcccaccuaugugguuuacuauucccagacgccuuacgccuuuaccucuagcuccaugcuccggcgcaauacaccccugcuuggccaagcucugaccaucgccagcaagcaccaucagauugugaaaauggaucucagaucucgguaucuggacucccuuaaggcgaucgucuucaaacaguacaaccaaacauuugagacccacaauagcacgacaccucugcaggaacgcucucucgggcuggauauuaacauggacuccagaaucauccacgagaauauuguggaaaaggagcgggugcagcgcaucacccaggaaacauucggagauuacccccaaccucagcuggaguuugcccaguauaaacucgagaccaaguucaaaagcggccugaacgggucuauucuugcugaaagagaggaaccgcugcggugucucaucaaguucuccagcccccaucugcuugaggcccugaagucccucgcuccugccgcgcuggucugccgcauucagaaacugcucuguuacucuggaagccacucccaaggcacccaggaccccagcucuuggcagaaggaucuguaucuucuguuuguuccucucuaccccagaugcuga

SEQ ID NO: 67305 - RNA, 885 nt, Artificial Sequence
  derived and/or modified sequence opt5 from CENPO__Homo_sapiens__NP_001186732
auggccggcauccuggcuagcgggcucggagugcuggcccaccuugagagacuggaaacccaggucucccggucucgcaagcaaagcgaggaacuccaguccguucaggcgcaggagggcgcucuggggacaaaaauucauaaacuuagacggcugcgcgacgaacucagagccguggugcggcaccgcagagccucugucaaggcuugcaucgccaacguggagcccaaucaaacgguugagauuaacgaacaggaggcucuggaagagaagcuggagaaugugaaagccauccuccaggcguaccauuucaccggacugagcggcaaacuuacaucccgcggggucugugugugcauuucuaccgccuuugaaggaaaccugcucgauagcuauuucguugaccuggugauccagaagccucuucggauccaccaucacuccgucccgguguuuauuccccuggaggaaaucgcugccaaguaccuccaaacaaauauucagcacuuccuguuuagccugugugaguaucucaacgcuuacucuggcagaaaguaucaggccgaucggcugcaguccgacuucgcggcccuucugaccggcccucuccaacgcaauccccugugcaaccuucugagcuuuacauacaaacucgauccugggggacagucuuuccccuuuugugcuagacugcuguauaaggaccucaccgccacgcugccuaccgaugugacaguuaccugccagggcgucgaagugcuuuccacaagcugggaggagcaacgggcuucucaugaaacccuguucuguacgaaaccgcuccaccagguguuugccuccuucacacgcaagggggagaagcuggacaugagccuugucuccuga

SEQ ID NO: 67306 - RNA, 807 nt, Artificial Sequence
  derived and/or modified sequence opt5 from CENPQ__Homo_sapiens__NP_060602
augagcggcaaggccaacgcuuccaaaaagaaugcccagcaacugaaaagaaaccccaagcggaaaaaggacaaugaggaagugguccucucugagaacaagguucgcaauaccgugaaaaagaacaaaaaucaccugaaggaucuuagcuccgaagggcagacaaaacauacgaaccugaagcacggaaagaccgcggcuucuaaaagaaagacauggcagccucucagcaaauccacccgggaccaucugcagacaaugauggagucugugaucaugaccauucuuagcaauuccaucaaggaaaaagaggagauucaauaccaccugaacuuccucaagaaacgccugcugcagcagugcgaaacacucaaggucccgcccaagaaaauggaggaucugaccaaugugagcucucuucugaacauggaaagagcccgggacaaggccaaugaggagggccucgcucugcuucaggaagagaucgauaaaaugguugaaacgaccgagcugaugacagggaacauucaaucccucaagaauaaaauccagauccuggccagcgaaguggaggaggaagaggaacgcgucaagcagaugcaucagauuaacucuuccggagugcugagccucccugagcugucucaaaagacccuuaaagcucccacacugcagaaggaaauccucgcccugauuccuaaccagaaugcgcuucugaaagaccucgauauccugcacaacuccagccaaaugaaguccaugucuaccuuuauugaggaggccuauaaaaagcuggacgcuagcuga

SEQ ID NO: 67307 - RNA, 1257 nt, Artificial Sequence
  derived and/or modified sequence opt5 from CENPU__Homo_sapiens__NP_078905
auggcccccagaggccggcgcagaccucggccgcaccgcagcgagggggcuagacgguccaagaacacccuggaacgcacacauucuaugaaagacaaggccggacagaaaugcaagcccaucgauguguucgacuuuccugauaauagcgacgucuccucuauuggcagacucggggagaacgaaaaagaugaggaaacguacgagaccuucgaucccccucugcacagcacagcgaucuaugcugacgaggaagaguuuuccaagcauuguggacuuucucugagcuccacacccccuggcaaggaagccaaacggagcucugacaccuccgggaaugaggccagcgagauugaaucuguuaagaucuccgcuaaaaagccgggacgcaaacucagacccauuagcgaugacucugaguccaucgaagagagcgauacccggcgcaaggugaaguccgccgagaaaaucucuacacaaagacacgaagugauucggaccacggcuagcuccgagcugagcgaaaagccugccgagucugucaccuccaaaaagacaggcccccuuagcgcgcagccuucuguggaaaaagagaaccuggccaucgaaagccaguccaagacccagaaaaagggcaagauuucucaugacaaacgcaagaaaagcagauccaaggcuaucgggagcgauacaucugacauuguucacaucuggugccccgagggaaugaaaaccuccgacauuaaggagcucaauaucgugcugccggaguucgaaaagacgcaccuggaacaucaacagcggaucgagagcaaagucuguaaggccgcuauugccacauuuuacgugaacguuaaagaacaguucaucaagaugcucaaagagucucagaugcugaccaaucuuaagagaaagaacgcgaaaaugauuuccgauaucgagaagaaacgccaacggaugauugaagugcaggacgagcugcucagacuggaaccucagcuuaagcagcugcaaacaaaauaugaugagcucaaggagcgcaagagcucccugcggaaugccgcuuacuuucugucuaaccucaaacagcuguaucaggacuacagcgauguccaagcccaggaacccaaugugaaggagaccuaugacuccucuagccuuccugcucugcuguucaaagccagaacccugcuuggcgccgaaucccaccuccgcaacaucaaucaucagcucgagaagcugcuggaucagggguga

SEQ ID NO: 67308 - RNA, 819 nt, Artificial Sequence
  derived and/or modified sequence opt5 from CENPV__Homo_sapiens__NP_859067
augagacggagccgcuccucugccgcugccaagcugagaggccagaaacggagcggggcguccgcugcccccgccgcuucugccgcugccgcgcucgccccuagcgcuacccgcacaagacgguccgccucucaagcuggaagcaagucccaggccguggagaaaccgcccagcgaaaagccucgccugagacggucuagcccccgcgcgcaggaggaaggcccuggggagcccccuccgcccgaacuugcccugcucccucccccucccccgccucccccuacgcccgcuacccccacauccucugccuccaaccuggaccuuggagagcagagagagcggugggaaaccuuccaaaaacgccagaagcugacaagcgagggcgcugccaagcuccugcuggauaccuuugaauaccaggggcucgucaaacacacaggaggcugccauuguggcgccguuagauucgaggugugggcuucugcggaccugcacaucuuugauugcaauuguuccauuugcaagaaaaagcagaaccggcauuucaucgugccugccagccgcuuuaaacuucugaagggggcugagcacauuaccacguauaccuucaauacacauaaggcccaacacaccuuuuguaaaagaugcggaguccaguccuucuacacaccgcggucuaaccccggcggguuuggaaucgccccucacugucucgacgaaggcaccgugagaagcaugguuacggaggaguucaauggguccgauugggaaaaggcuaugaaagaacauaagacaauuaaaaacaugagcaaggaguga

SEQ ID NO: 67309 - RNA, 267 nt, Artificial Sequence
  derived and/or modified sequence opt5 from CENPW__Homo_sapiens__NP_001012525
auggcccugagcaccaucgugucccagagaaagcaaauuaaacggaaggcuccccgcggcuuccucaaaagagucuuuaagcggaaaaagccucagcugcgccuugagaagucuggggaccugcucguucaccugaacugccuucuguucgugcauagacucgccgaagagagccggacaaaugcgugugcuuccaaaugccgcgugaucaacaaggaacacguccuggccgccgcuaaagugauucugaagaaaucuagaggauga

SEQ ID NO: 67310 - RNA, 636 nt, Artificial Sequence
  derived and/or modified sequence opt5 from CEP112__Homo_sapiens__NP_001032402
augugggccagccugucccucgaccaccccucugcuaaggagaaccaggcccugagacuuaucgaaaugcgggaggaaaauggcaacgugccuaaaaccgagcaagcggggagccugaagccgcuccgcgauacaggaaaauccaaucugaaggaaaagaaggcuaacucuaaacuuaaacagauugagaaggaguacacgcagaaacuggccaagagcucccagaucauugccgaacuccaaaccacaaucucuagccugaaagaggaaaauucccagcagcagcuggcugccgagagacggcuccaagacguccgccagaaguucgaggaugaaaagaaacagcugauuagagacaacgaucaggcuaucaagguucuucaagacgagcuggaaaaucggagcaaccaggugcgcugcgccgagaaaaagcuccagcauaaagaacuggagucucaagagcagaucaccuauauuagacaggaauacgagacaaaacuuaagggccugaugcccgcgucccuccggcaggaacuggaggauaccaucagcucucugaagucccaagugaauuuucuccagaagcgcgccagcauucugcaggaggaacuuacaaccuaucaggggagacgguga

SEQ ID NO: 67311 - RNA, 2883 nt, Artificial Sequence
  derived and/or modified sequence opt5 from CEP120__Homo_sapiens__NP_001159698
augcugguggucgaggccaaguucgacggcgaacagcucgcuaccgaucccguugaccacacagaucaaccugaguuugccacggaacuggcgugggagaucgacagaaaagcccuucaucagcaccggcugcagcgcaccccgauuaagcuccagugcuucgcucuggaucccgugacaagcgccaaagaaaccaucggguacauugugcuugaccugagaacagcucaagagaccaagcaggccccuaaaugguaucagcuccuguccaacaaguacacaaaguuuaaaucugagauccagauuagcaucgcucuggaaaccgauacgaagcccccugucgacuccuucaaagccaagggagcgcccccucgggauggcaaagugccggccauccucgcugggcuggacccccgcgauauuguugccgugcuuaaugaggaaggaggcuaucaucaaaucgggccugcugaguacuguaccgacucuuuuauuaugagcgucacaaucgccuucgcgacccagcuggagcagcucauucccugcacaaugaagcugccugaaagacagcccgaguuuuucuuuuauuacucccuucugggaaacgaugugaccaaugaaccguucaacgaccucaucaauccuaacuuugagcccgaacgggccucuguucgcauuagaagcuccguggagauccugcgggucuaucuggcucuccaaagcaagcugcagauccaccuuuguugcggcgaccagucucugggcuccacggagauuccucucacagggcugcuuaaaaagggaagcaccgaaaucaaucaacaucccgugacaguggagggcgccuucacccuggaucccccuaaccgcgcuaaacagaagcucgccccgauucccgucgaacuggccccuaccguuggggugucuguggcucugcagagagagggaaucgacucccagagccucauugaacugaaaacacaaaaugagcacgagcccgaacacucuaagaaaaagguccuuacgccuaucaaggagaaaacccugacaggccccaaguccccgaccgugagcccuguucccucccauaaccagucuccucccacaaaagaugacgcgaccgaaagcgagguggaaucccuccaguacgauaaggacacgaaaccuaaucccaaggccucuagcuccgucccggcuagccuggcccagcuugugacaaccucuaacgccagcgagguugcuuccgggcaaaagaucgccgugccugcgaccucucaccauuuuuguuucagcauugaucugcgguccauccacgcucucgagauuggauuccccaucaauugcauucugcgcuacagcuaucccuuuuucggcucugccgccccuaucaugacaaacccgcccgucgaagugcggaaaaauauggaggucuuucugccucaguccuacugugcuuucgacuuugccaccaugccccaccagcuccaggauacauuccugagaaucccucuucugguggaacucuggcauaaggacaaaaugagcaaggaucugcugcuuggcauugcucgcauccaacucucuaacauucuguccagcgagaaaacgagauuucugggguccaacggagagcagugcuggcggcagaccuauucugaaagcguucccgugaucgccgcgcagggcuccaauaacagaauugccgaccucucuuacacagucacccuggaggacuaugggcuugugaagaugcgcgaaaucuucauuagcgauuccagccaaggaguuucugcugugcagcagaagccuuccagccugcccccggccccuugucccucugagauccaaacagaaccucgggagacccucgaguacaaagcugcccuggaacuggagauguggaaggaaaugcaggaggacaucuuugaaaaucagcuuaaacagaaggagcucgcgcacaugcaagcccuggcugaggaauggaaaaagagagaucgcgagcgggaaucccuggucaagaaaaagguggccgaguauacgauucucgaaggcaaacugcagaagacccuuaucgaccuggagaaaagagagcagcagcucgcuagcguggaaucugagcugcaacgcgaaaagaaagagcugcagagcgagcggcagagaaaccuucaggaacuccaagauuccauucgccgggccaaggaggacugcauccaucagguugaacuggagagacugaagauuaaacagcucgaagaggauaagcaccgccugcaacagcagcuuaaugacgccgagaacaaauacaagauccuggaaaaagaguuccagcaauuuaaggaucagcagaauaacaagcccgaaauccggcuccagagcgagauuaaucugcugacacuugaaaaagucgagcucgagagaaagcuggaaucugcuaccaaauccaagcugcauuacaaacaacagugggggcgggcgcucaaggagcuggcccgccuuaagcagagagaacaggagagccaaauggcucggcugaaaaagcagcaggaagaacucgagcagaugagacugcgcuaucuggccgccgaagagaaagacacagugaagaccgaacggcaagagcuucuggauaucagaaacgagcucaaucgccugagacagcaggaacaaaaacaguaccaggacuccacggagauugcuucuggaaagaaggauggcccgcacggcagcgugcucgaagaggggcuggacgacuaucuuacacggcugaucgaggagcgcgauacccucaugagaacaggagucuacaaccacgaggaccggauuaucuccgaacuggaucgccagaucagagagauucuggccaaaucuaaugcgagcaacuga

SEQ ID NO: 67312 - RNA, 3285 nt, Artificial Sequence
  derived and/or modified sequence opt5 from CEP128__Homo_sapiens__XP_006720119
auggccgagagcuccucugaaagcgaccacuucagaugccgggaucgccugucccccugggcugccagaucuacccaucggggcacacgcagccucccuacgguggaggucaccgaaaagguuaacacaaucaccuccacacugcaggacaccucuagaaaucuucggcaaguggaucagaugcuggggcgcuacagagaguauagcaacggacaggcgggcgcuauugaacaccucaaagagucccuggagcagagcaucgaccaacuucggucucagcgccugcucagaaauuccgggggacggagcauuucugugacaucccugagcgccucugaucuggacggcgggaccggauccgaacuccaucacuuuccgcccacgagcccucugaaggauuacggcgacccccagggcaucaaacgcaugagaucccggaccgggguccgcuucgugcaggagacagaugacaugacccaacuucauggauuucaccagucucugagagaucucagcuccgaacagauucggcugggcgacgauuucaacagagagcuuagccgccggucuagauccgacgccgagacaaagcgcgcucuggaagaacucaccgaaaaacugaaugaggcccagaagcaagaaguugugagcgaccgggucgagagacgccugcaggagcucgaacgggagaugagaacggaacgcgagcugguggaacggagacaggaucaacuugggcugaugucucuccagcugcaggaggcucuuaagaaacaggaggccaaggcggacgaacacgagggagccaucaaaaacaagcugcgccaaacagaaaccgagaaaaaucagcucgaacaggagcuggagcugagccggagacuccugaaccaguccgaaggcucucgggagacacuucugcaucaaguugaagaacuccgcacccagcugaccaaggcugagggggauagaaagggacuucagcaccaggugagccaaaucuccaaacagcagagcaauuaucaggacgaacaaggcgaggauuggcgguuuagacgcggcgucgaacgggagaagcaggaccuggaaaaacagaugucugaucucagagugcaacugaacuucuccgccauggcuagcgagcuggaggaagugaagcgcuguauggagagaaaagacaaggaaaaagcccaucucgcgucucaggucgagaaucugacacgggaacuugagaacggggagaagcagcagcugcaaaugcucgaucgccugaaggaaauucagaaucacuuugacacgugcgaggccgaaagaaaacacgcugaucugcagaucuccgagcuuacccggcaugccgaagacgcuacaaagcaggccgagcgcuaccucagcgagcugcaacaguccgaagcccugaaagaggaagcugagaagagacgggaggaccucaaacugaaggcgcaggaaucuauucgccaguggaaacuuaaacacaagaaacuggagagagcccucgaaaagcaaagcgagaccguugaugaacugacaggaaagaacaaucagauccugaaggagaaggacgagcuuaaaacccagcucuaugcugcccugcaacagauugaaaaccugcggaaggagcucaacgaugugcugacgaaacgcgcccuucaggaagaggaacugcauuccaaggaggagaaacucagagacaucaagucucaccaggcugaucuggaacuggaggugaagaauagccuugacacaauucaucggcucgaauccgagcugaaaaagcaaagcaaaauccagucucagaugaaggucgaaaaagcccaccuggaggaggaaaucgcggagcucaagaaaucccaggcucaagauaaggccaagcugcuugaaaugcaggagagcauuaaagaccugucugccaucagagcugaucucgccaacaagcuggcugaggaggagcgcgccaaaaaggcggugcugaaagaccuuuccgaucucaccgcccaggcuaagagccgggacgaagagaccgccacaauuaucacccagcugaagcuggaaagagauguucaccaacgcgagcucaaagaccugacaucuagccuucaguccgugaagacgaaacaugagcagaauauucaggaacugaugaagcacuucaaaaaggaaaagagcgaagcugagaaccauauccggacccucaaagccgaaucucuggaggagaagaauauggcgaaaauccacagaggccaacuggaaaaacuuaaaucccagugugaccgccugacagaggaacucacccagaacgagaaugaaaacaagaagcugaaacucaaguaccaaugccugaaagaucagcuugaggagcgggaaaagcacauuagcaucgaggaggagcaucugagacgcauggaggaagcccggcuccagcugaaagaccagcugcuuugucuggagacagaacaagaguccauucucggggucaucggaaaggaaauugaugcugccugcaaaaccuuuucuaaggacagcguggagaagcugaaaguuuucuccucuggcccugauauccacuaugacccccauagauggcucgcugagagcaagacgaaacugcaguggcuuugugaggagcugaaggaacgggagaaucgcgaaaagaaccucagacaccagcugaugcugugccggcagcaacuucgcaaucugaccgagaacaaggaguccgaacuccagugucuguuucagcagaucgagagacaagaacagcuccuggaugagauucaucgggaaaagagagaccuucuggaggagacacagcgcaaagaugaagagauggggucucugcaagaccgggugaucgcccucgaaaccagcacacaggucgcccuggaucaccuugaguccgugccugagaagcugagccuccuggaagacuucaaagauuuuagagacucuugcuccagcucugagcgcaccgacggacgguacuccaaguacagaguccgccggaauagccuccagcaccaucaggaugacacgaaauauagaacaaagucuuucaagggcgaucgcaccuuccuggaaggcucccacacaagagggcuugaccauagcuccagcuggcaagaucacucucgguuucugagcuccccgcgcuucucuuacgugaacagcuuuaccaaaagaaccguugcucccgacuccgcgucuaauaaggaggaugccacaaugaacggaacgagcucccagccuaaaaaggaagaguauggcucuuga
